United States Patent 10,407,724 (METHODS AND COMPOSITIONS FOR SCREENING AND TREATING DEVELOPMENTAL DISORDERS) - sequence listing, part 46

SEQ ID NO: 859 - DNA, 37654 bp, Homo sapiens
actagctgttcttaaattttattttccaaaaaatggcattttccaggtgccccagtcctcattcctaaggtcccacctcagttggcacctgtgcgtgtatatggatacactttccccccagggccctgcctggtatgggccagggcagcccatgaactctgggcctcaccacgaggttctgggtgaggccctcgtcccgcctcagtgctggcccgagctgccgagccagggccgcagcccccgtcttgcctctgtctgccggctgctcccggggcctgatcctctggcccccactgggcctgggctgcacatggcagctacctgctcactgtcctcctcactccctggcacacagcttcagggtggaccaatcacccaacgtcagattctgaaagaaaaagccccggtgagaagggagggggacaggtgggtgcatacccacacctgcagccgcccagacaggccctgctgctcccaccacgcgggatccaggctggcagacactcaccggcccgcaggctaggtctcccgccacttcttcccgttcagcacctgcagcttctccaggctctgggtcactaagcacagtgcttgccctgaggaatgatgaccttgagcctctcccggccaggctcaggagggctgggtggtgctgccccggggtctcagctgcaggatgtgacctgcccctcacccgttatggccccagccccgaggtcagccttggggtagagagacacaaacccgctttccctggaaaggggtccctttgcctccctcggaaacaaaaggagcgctcagtcgtctggtccccggagactcacccatctcacggacacggtcctccagggctcccgagagctcggggaggctcatggcctgcagggacgcttgccagcccttggagtctgtggtgcaggtgcagggaccgagttagctgggggtctgcgtccccacaggccctgctttattctgagcccatgcaaccaggagaacctgcttggatcagaacctccctacccgcctgacagtgtctaagcaacctcccaaggccgaggcagggaagccctgttgtgcccttcctcccacaggctgagcaaacactacgaggcccgggtcagcccgagagaaggcaaagctctgccggtggggacccgggtctgggccctggctggaggctacagaagtcactggcggtctcagcacagcacagccagccaaggcacagggcctttctcgagtacctcctacccctgggggataggcagttttcctgtcacaggtgaggaagtgggcttgggtccccagggccccctcttttccttggactctgggatcatgtgcacacagggacctgggagagtggctgccggccggagaaccaggccaagcccactgggtcaaacctggcttcagggctcccccaccttcccctctgcccagtgcggagtcaggccactgctcttaccagctggggggacggctaggcccagagtggctgcaccagggggctggtcctgcctcactcgagatgacagctcagcttgacaggctctgccagacacagaaacaaatattggtgagagcagaggcctggccgctgcagagcccccacctcagaccttctaggggagggaggggctcagccctgtccttgcagctggccctcatgggctgggccagtgccccatgaggctgcactaaagagcaggagggcgaccggtgcagattcccggacccaactcctgcctgggtctgcctgcaggaaggaagggcctgatgaaatgggggtggggtggctccagaccctgaaatccacccctcagttacaaaatcaggaggaaaggatgtgtgggggcccaggggccaggtggctgaccactggagacccagcccagggcagctcagagccactcaccgcagctggtccaggacgagggcagcatcccgggccagggcccacgtctcccgcagccgggcctggaggtcctcgcgggcgcggtcctgctccagcaggcagctctccaccacggcgcgcagctcctgctcctgacacacctggccccgcgtggcctctacctcctcgcagcgctgcaggggggtggggggcgcggggaggctgggaggtggccggtcaagccagacccttggccacggccctgtcctgtgtgtggggccctctccccactgcatccacctgacccctccacacagcacccaccttttctgtcagagatggagccaactcacgggtgtcaccctgcccccccatcccccacccagccactcaccttgtgcagctggatggcgagctcctgcatctcagcctccagccggtcggcgtaggccagctccagggcatccccgggtgggcgggcactgctgtgccagcgggcaatggcggacgtcatcttcctcttgggcccaaacagcctgcggggggaatgtgaccaggatatgcctcagcgtcccaagagcgcttacatgagtgggagtttgccccaaccccgggctgagggccagagcggcccttctggacgcacgtgatgccaatttccttcaggtcgctctcagtgagggtcagaaagatgcggaggtccacgtcctgctcctcaaacacctgcaggtacttcagacacccgatctgctccagcagtgcggcaaggtcctggcaggcacaggggacaggttgggggaggtagtggctgacgacgaagcagagacgttttcctccactcggagccccaccacttccccaggctcagaaccaagacagtgccttgtgtgtggcgcccaggctgtcccctcctactctggtggctcaggcagggcaggatgttgcaggcaggtgagtcctcacactatggtcggccacgtggggacaatgtatgttcatcaccagaaactggcctcctcctcccacacatgctcagttctgtgaagggaccatggagctgctgatctcgacaatgctttgtaggcggagagcgctgccctctaattctagagtctcagtgtcggatgttctgatttccacttgtctaagcgcagctcttctccgagttcacctgtctggagttcaccgagctccctggatgtaagatccgtgtttctgatccactgagatggtcaggctgtttctcacccatcgtttctgctctccttctggaatgccactgtatggggtggtgtcggtgtgcttgaggggatcacagatttctgttaattttttttactcattctttctgttcctcaagcgagatgatctcaggtgacctgtgttcacaagttgtctgactcttctgcctgctcaattctgctgtgagctcgtctagtgatattttcatttcatttacttttcaactccagaaatcctacttttgagagtttattgcttttaatggacaaacaaatgttactctgacattttcttcaagctattttctgaaagaaacatacttaggacactaccctgaccagactccactcaacgtatgttgaagggaccgagacgtgtgcctgctcactgagccaggggctgcagggagaagccggcaaatccaaggctctactgaacagcaaagccagtgctttaacaaataaccagccaggccgggcatggcaccaggccaggtgtggtggctcacgcctgtaatcccagcactttgggaggtcgaggcgggcggatcacgatgtcaggaatttgagaccagcctggccaacatagtgaaatcccgtctctactaaaaatacaaaaaattagatgggcatggtggcgggtgcctgtaatcccagctacttgggaggctgaggcaggagaatcgcttgaacccaggaggaggaggttgcagtgagccgagatcgcgccactgcactccagcccagatgacagtgcgagactccgtctcgaacaaacaaaccaaataaccaaccagagcttccctctgcctctcctctccgtgcctcttctgcccacacagggtaggagaactcagcagacacaggtgagacagctgagctgtgagtcacacctctgatccctaaggtaatgtgtggtcagagggaccacagaaaggaggaggatggtggcagctgtaaccatcaccaagcacacactgtgtgtagttcctgtctctgcttcaaccacatcttgtcagactcctgcaggcagctctgaggtcaagtgtgcttttcttctccccaggctcagggaggccaactccagtatggaaagcagggagacaggtcctttccgtggagaggaacagagtagaagcgctgcagcggggctgccagccatggagccggctgtgagcctgtggagcctaacaggccatggggatgccaccgccattctgttctcctagcagcgcctggcacgtcatatacacaacacatgcctcctaagtcacaaaaagtgccgtctctgagtgtaacctccagtttcacaagcggtcttacctggggtcctgagtagggggccctctgagtctgggggctggactcagcgagaaagccttccctgtcagttgcagcgcggggaggccactggctgtcaggattcttggtcttcatgtaacttttagcttgtttgcgagctgagcttttacaggcatgatccgagtcctgcagtgagaggcgtgcatctgaaagagtgcgcgggctaacttgagagccttggtgaaacccccacccgccacacaggggcttgagaggcttcgtgaaaccccccacccgccacacaggggcttccggtgcgttcgctgtcgtctgagaagccagaccctggacacagcacgtcccagtgcagcacacacgtgcagcagctgcttcttacatacatgctcatcttaaagtaactgggggatgtcaggcatcccagccagggaccggctatgggagaccaagaaagaaagaatccgtacctcgttgctctccacagaagcttcgctgctgagcccctgggctctggccaggccctcgctgctgctgctgctctggacgggccccaggttggcacagaaagcatgttcctctgagggcgggaagacagggcgtccgcctgcagccctcaccgaggtgctgcgcatgggcgtgccccgggctgagccgcctccaccagggcactccttggggcctgcagcggttgcttccttatatttcaaacttcctgcctgtcctaaaccctcccctctatacagacgggcagggcttctgtcttttttgttcactgataaatcccaagcacccggagcagtgcttggcacacggtgggcactatggaaacagctgctgcacggaggtgcagttataacagacattcctactggggcctgccctgaaagcctcaggggctcccaagcaaggagctaaacctgttgctgtggaacggctcccttaagccgcacggggatgctggaccagaagcttctcccattcctcacaagaaccagggccgtccacacctacccctttcctgtcctctgctggatggctgtgtccagcgccaggcccaggggataagtggggatgggcacacaggagctccaggacctgcctgagccacgggccggatgggtgggggtgcacgtaccccgactgctgctgctgctgctgctctccacatcccgctcattgatgggggaggtgacatcccggcagcagaggccctcttcttccagggggttctcgccactgctgttgaaggtgacatagccacggggaggagcctgctctgtgtacagaatggggcccataagcccagggaactccaaagtgaaacctcctcagaggccgaggcccaggatggaggcaggtgacttcccagtcatgacctcacctacttgcccctgcgacctggcatggctctatctgtggtgtgtgggtggaaaagatgctctgagggtcagtcagtggcccaagcaagtgcctggtggggcgagggctggcagccaggtcaagcctgggccctctccatttcttttccaaggggaaaacgtagcaaatggtcagctgtatttacagatgcctgaccagagaaaactataccatgagtgttccttttagcaggaggtagctaatgacctcacacagacacccatcgaccacgtgtctttatgtccctgtgacctttaaccacaggcgcttagcgggcctcctctggtcagtcaaccccggcgaaaaagagacctggctgagcaggaaggaaaaaggccttgaggtaaaaattaacaacaataatatgaaattacctaactctacctgcctctaaaaccaagcagaaaaaggggcatgtataccaggcaatttcactccagttttgcccctttacataaaaagactgacttgaccagtcacggtggcacatgtctgtaatctcagctacttgggaggctgagacaggaggatcgcttgagctcaggaactggagccttcagtgagctatgatcgtgccactgcactccagcctgggctacagtgaaaccctgtctcaaaaaagaacccaaaggactggttgatgggaccatggggaacttactttcctctttacgtattttcctagttatggagaagtttttctaatcagcacatgctatttatcattgccccctaaactgtttttgagacagggtcttgctgtgttatccagactggaatgcaatggcaccatcatgggtcactacagccttgacctcctgggctcaagcaatccttccacctcagcctctcatgtaactggggctacaggcatgggccaccatatctggctaattttcaaaattttttgtagagatagggtcttgctacattgcccaggctggtctcacaactcctgagcccaagcaatcttcctacctcagccttccaaagtgctgggattacaggtataagccactgcacctggcccccccaattttttttttttttttttgagacggagtcttgctctgtcaccagactggagtgcagtggcacaatctcggctcactgcaacctccgcctcccgggttcaaccgattctcctgcctcagcctcccgagtagctgggattataggcacgtactaccatgcccagctaatttttgcatttttagtaaagatgggatttcaccatgttggccaggatggtctggatctcttgatccacctgcctcggcctcccaaagtgctgggattacaggcgtgagccactgcgcccggccccaaatttcttaattactggcaaataaaatatatgcacttatagaaaatttaaatttcacaaggtatgagaaaacaaaaatcccctgaaataccacacctgagaccaccaccatgattacttctctgtggatacatacaaagaaccgcacacaagcggcttcagacatgtatgattttgttaaagcatttgttgtacagctatatagattaattaccaactcagccccaggatgacagcttccttcctgtccccaccacacctcaggctgtagcaggtggcagggaccttttggaaggaagagactctgccactcagaacgaccagcccggtgtcccagagccagtgctcacagctcagcggacgggacacgggcgggccctcatgctgtggtggggctggccagcagctcgagagaggccttcccagtggcccagtcagctcacccttcccaggatgatgggagaaggtgggtctccagttcccaacccagcacccaggcttgggaagacagaagtctgcacatctgcttgttcctggggtctagaagggaattcaattactggtggacccctggctgaaacactgtctactctcactcttccaagtcctggcctcaaagaggccttgctcccgagaaggaccagccaccaggcctgtgagaccagcagccttggcctggctatgagtgggtgacagccatcaaaggaagacataactcacacctccagctgagctctgggacagaccacagcaatagagagtaggcaccaaacccaactcccctaaaaagaaaccccagcactccccaagagcaaaacgctcaacaccctggggctgggaatctgagaatgaacgagactggaaaacccaaaggctaggattcttcaccagcaagtcaacaagcgggccctctctcaggagggtctgagtacaacttcatcgccctgagaaaacagcagggcctgttttcttggcctcctgcccccagcagcgcacccgacccagctggtatgggcagggcagggaagtgaacttcacgctttgcctcctccctgtatgagccaacccacctatgtgatgaatgaaatctgaccttagctacatttctgctgcaggagagaaagttctattcctaaatttaaccaacgaaaaggaaactccaggagataaagcaaaaaacaagagctagtccgtgaccaatgcatttccatcacaggactcaatcctgagtctccctgagcatgaaagctgggccacctgtcccgctgccacctgaggtccagcgacccacatttcaggagcctaagagctattccattcttgccaacacaaaatcctggtatgcaatgagaaagagccctcgggaaacgcgggccactcaccatagcgaggccgtggggctctgccgcccaggccaatgcctgtgatcctggccagggctcgcggtccctcgtggatgctgacacccttcttccggcaaggcctctgtctctgaggagcagggcaggactcgtcagaagagctcagatcttcgtacttttctgtgatcaaacaccaagattaagatagtgtgttcagtaatggactcatttactaatccttacggcaaactgaaagaaagtgactgtcgccggttttgttaaattaaggagaagggtatctgccagggcatcacttctgagaaatgccctaacaggccggggcgctgctccaatgggccacagggagctgcaaagttagtgaggatgggaagtttcatttttcttgagacagagtctcactctgtcccccgagctgaagtgtaatggcatgatcttggctcactcactgcaacctccgcctcctgggttctagcgattctcacgcctcacccttccaagtagctgcggttacagatgcgtgccaccatgcccagtgttttttttcttttctttttcagtagacacaggcttttgccatgttggccaggctggtctcaaactcctgatctgcctgccttggcctcccaaagtgctgggattacaggcatgagccaccatgcccagccaggagtttattatctctgttggggtttgccaaattgttcataagtctgtattgttcataatcagaaattctgttctaatttgaataagtaaaacccatctcttcattaaaatatatggtaatataagtcacaactactttttcctaatcccttcctttggaaacaacttttttttttttcttttgagaaggagttttgctcttgctgcccaggctggaacttccgcctcctgggttcaagcaattctcctatctcagcctcccgagtagttgggaattataggcagatgccaccatacccagctaatttttatattttagtagagatggggtttcatcatattaggctggtcttgaactcctgacctcaggtgatccacccacctcagcctcgcaaagtgctgggattataggcacgttaccactgtgcccggctggaaacaacttattaagcaattctgtattttcttttttttttctttatttttttgagacggagtcttgctctgtcacccaggcaggagtgcaatggtgcgatcacggctcactgcaagctccacctcctgggttcacgccactctcctgcctcaggctcccaagtagctgggactacaggcacccggccaccatgcccagctaatcttgtttttgtatttttagtagagacggggtttcaccatgttggccaggctggtctcgatctcctgaccttgtgatccgcccaccttggcctcccacaaagtgctggcatcacaggagtgagccacagcgcccagccacaattttgtattttctaaagcatggcatgtgtttgctatgattataaactgtttcaaatcacttcccagtctgagctttcagagctcaaaccagagcttttattattttgtagcttttcagtttttcatatttgatttgtataaggctctgatctgattctacttttaagagatacgtgagttgtatacaggaggaaatgatgagatctccttgtggagtgggtaagctggggcagaaatgaagggaaaggtcctttgcattaccacctgagctgtgtttattatgaaacaatcccaatgccagggaagaggctgggctgagcctgacactgagaaaggagctgctcgctcaggtgcaaactgacaggacaactcagggcaggccagcaaagagggagagctcaggccctgaacgtgggccactctgtccttccccatgacgaggctcaagctctggcgactgagctagccatatggacacacacctcctcacactcaaagatctatagcactccagggagactgtgcttccatccaagctgaaggggagggagctgtaagacaaatgcaaagaggcagcaataagcaagggaacggcagctgcgtgaatctcagcacccaacacaccctcagagcagcttaaaaagaacaggcagatggaaaccacaaaagagccagggctgcaatcctgctatcaacgtggaattcagggcaaaacacattaaatatgacacggaaggacacttttttttttttttttttgaaacagagtttcactccgtcacctaggctggagtgcagtggcacaatctcggctcattgtaacctccgcctcccgggttcaagtgattctcctgcctcagcctcccgagtagctgggattgtaagtatgtgccaccatgcctggctaatttgtgtattttgagtagagacaaggtttcaccatgtaggctggactggtctcgaactcctgacctcaggggatctgcccgccttggcctcccaaagtgctcggattacaggtatgggccatgcccagccagaaggacacttctaatactaaaagccataattcacagtgaatctataacaagttatgaaaatctgtcaccaaaaaatgcaccaacttccttcataaatcagaaacacgctaataggtaattttgtagaaaatgaactaagagtacataatcctaaataagatagactcacagatatgctaaactgtatacagataatagagaatacaacttctcaagcaaaacacggaacactaaaaaatattgatcagggccgggcgcggtggctcacgcctgtaatcccagcactttgggaggccgaggtgggcggatcacttgaggtcaggacttcaagaccaacctggccaacatggtgaaaccctgtccctactaaaaatacaaaaaaaaatgagccaggcgtggtggcagatgcctggaatcccaactactcgggaggctgaggcaggagagtcgcttgaacctgggaggcagaggttgcagtgagtcaagatcgcacttgggcactccagcctgggtgacagagtgagactacatctgaaaaaaatatatatatatatagatagatcagtagatgataaataagatgacaaggaagttatgtaaatgtaagaattataaacactctctgatcagacacattaaagttaatcagaataacatgagaaattaattgcaagatcaaaaaggcccttccatctagaaattaacaaacaaaaacaatcataatacttctattagacaactcctgggtgaaggagaaaatataaataaaaattacagaatttctaaaaataacaaggaaagtattaaatacagaacccccagaatacacttaaagcagcaatcagcaaaaattcacagcctctaacatttagcaacaaaagggcaacaatgaaaatgaaagaagtttccaactcaaaaaactagaacaacaaagtaagccaaataaaaataaaagcagaaattaaacagacaatcagtaggtctcattaataaatcaaaatccgatgggtttttcttgtttttccactaaacagacaaagtactagtatttaacttaagaaaaaaaggaagaggctgcgcacggtggctcacacctgtaattctagcagtttgggaggccgaggtgggcagatcacgaggtgaggagatcgagaccatcctggctaacacagtgaaaccctgtctctactaaaaatacaaaaaaaaaattagccaggtgtggtggtgggcaccctgtagtcccagctactcaaaaggctgaggcaggagaatcgcttgaacctgggaggcgggggttgcagtgagccgagatcgcgccactgcactccagcctgggcaacagagcgagactctgtctcaaaaaaaaaaaaagaacaaacacaaatattcaaaataagaagtgaggccgggcgcagtggctcatgcctataatctcagcactgtgggagactgaggtgggaggatcgcttgggcccaggagtttgagaccagcctgggcaacatactgagacactgtctctattttttttaatagaagaaatttttgccgggtgcagcggttcatgcctgtaatcccagcactttgggaggccgagtcgggtggaccaccttatgtcgggagttcgagaccaccctgaccaacatggagaaaccctgtctctcccaaaaatgcaaaattagccagacgtggtggcacatgcctgtaatcccagctactagggaggctgaggcaggagaatcgcttgaacccgggaggtggaggttgcagtgagccaagatcgtgccattgcactccagcctaggaaacaagagcgaaactccatctcaaaaaaaaaaaaaaattaaaaaatataagaaatgagatccagcaattccactactgggtatttatccaaaagaaaggaaatcagtataccaaagagatgtctacaccctcatgtttactgccgcagtattcacagtagcctagatagagaatcaacctgtgtccatcagtggatgaacgaagacagaaaatgagtttatatacacaattgaatattattcagacataaagaatgaaatctgatcatttgtggcaacatgaataagcctggaagagactatgttcagtaaaataagccagacatagaaaagaaagacaaatgccagctgttgtggtgactcacacttgtaatcccaacactctgggaggccaaggcgagaggatcacttgagcccaggagttcaaaaccaacctggtcagtatagcaagaccccgtctctacaaaaaaataaaacattagccaggtgtggtggtaggtgcctgtagtgccagctactcgggaggctgagataggaggatcacttgagcccaggaattggaggctgcagtgagccaagattatgccaccacactccagcctgggtgacaaagcgagaacctgtctcaaaaaccaaacaaacaacaaaaaagactacatgactacatgatgtcacccatttacaggatttttaaaagctcatgtcaaacatgtagagtagaatagtgattatcagaggttgggggtggggaggtagtgggagagattggtcaataggtgtaaaattacagatcgaagaaagaagttctggtgttcacagtagagtgactatacggaacaacagcttatacctcaaaatagctactagaagacatgattttaaatgttctcacctcgaaatgataaatgtttgaggtgatggataagctaatcaccttaatttgatcattacacagtgtatacatgtatcaaaacatcacacactgtaccccataaatatgtagttattttgtgtcaattaaaaatgagataaatattttccaggtcaggtgcagtagctcatgcctgtagtcccagcactttgggaggctgaggcgggtggattgcttgagctcaggactcttgagaccagcctggtcaacatggcaaaaccacctctctacaaaaaatacaaacgtaagctgggcgtggtagggtgcacctacagtcctagctactcgtagagctgaggtagaaggatcgttttgagcctgggaggcggaggttgcattgagtcgagattgggtcactggactccagcctgggtgacaaagcaagaccctgtcacaaaaaataaatcaatattttccatgccaaaaaaagataataacaggagaaaataaccactgaaacagagtattttattttgttttattttatctatttacttttctttgagatggagtctcgctctgtcgccaagctggagtgcagtggcgtgattttggcttactgcaatctccccctcccgggttcaagtgattctcctgcctcagcctccagagtagctggcgcacaccaccacattggcttatttttgtatttttagtggagacggggtttcaccatgttggccaggctggtcttgaactcctgacctcaagtgatccacacgcctcagcctcccaaagtgctgagattacaggcatgagccactgcacccagcctgaaacagaattttttttttttttttttttttgagacagagtttcgctcttgttgcctaggctggactgcaatggcacgatctcggctcacctcaacctctgcctcccgggttcaagggattctcccacctcagcctcccgagtagctgggattacaggcatgcaccactacgcccagctaattttatatttttagtagagatggggtttctccatactgatcaggctggtctcgaactcccgacctcaggtgatccgcccaactcggccttccaaagtgctgagattataggcataagccaccgcgcctggccctgaaacagaatattttaaaaggagaaaaaaattggccgggtgcggtggctcacacctataatcccagtactttgggaggcccaggtgggcagaccacctgaggtcgggagtttgagaccagcccggccaacatggagaaaccctgtctctactaaaaacataaaattatccaggcatggtagcgcatgcctgtaatcccatctacttgggacgctgaggcaggagaatcacttgaacccgggaggcagaggttgcggtgagtcaagatcgagccactgcactccagcctggggaacaagagtgaaactctgtctcaaaaaaaaaaaaaaaaaaagggagaaaatattatcttgtagacctctgcagataagtctgaaatcctagatgaagtgatctctcaggaaaatataatttaccaaaactgaccccataagaaaagaaagtatgaggaggccaatctctatagaagaaatagaaaaactgttatcgaggaaccacctcacagaaagagaccagatggtttcatgggaggattctatcaaaacttctaagaccaggtagcactaatgctacgtgtattgtcctagaacacaaaaaaggaaggaaaacttccaaattatttttatgaagtaaacactgatacccatacctgatagacagaacaaaaatagaaaagtatagaccacgccgggagcggtggctcacgcctgtaatcccagcactttgggaggctgaggcaggcggatcactggagatcaggagttcgagaccagcctggccaacatggtgaaaccccgtctctactaaaaatacaaaaattagctgggtgtagtggtgcacgcctgtgatcccagctactcgggaggctgaggcagaagaattgcttgaactcaggaggcggaggttgcggaggttgcagtgagctgagatctcgccactccagtccagcctgggcaacagagcaagactccatttcaaaaacaaaaaaaaagaagaaagaaaactatagaccagtatcacttatgactgaatatccatagaaaaatactaaatattaataaacagaattcaaaaacacattaaaatagtacaacatgtgggatttatgccaagaatgtaaggttgattcattattaggaggttcatgaagacaatctaccatatgaaaattcaccatcgtctccaaagatatgggaacacaattcaatagttactcctgtaaaacaccactcaggaatagaagaactgaggaatactttgttaataagctaaaataacatatgccttcccttttacagtcagcctctcatgtaacgtggcatttccactaagatcaggaccaaggtaaggaggctcactatctccactatgttgaacaatgagctagaggtgttagcaactaaacaaaagaacggtgcaattcaacaaagtcagagtcatgagaatcagcaggaagcagtgtatccatcgatacttaaagattatatgttagtacacctgtaaagccctaaagaatcaataacaaaactaacctgaacaatgtaagaattctgtaaggtagcagaatataaaattagtttgcagggctgagtgcagtggctcacacctgtaatcccagcactttgggaggctgagatgggtggatcacctgaggttgcgagttctagaccagcctgaccaacatggagaaaccccatctctactgaaaatacaaaaaattagccgggcatggtggtgcacgcctgtaatcccagctacctgggaggctgaggcaaaattgcttgaacctgggaggaagaggttgcggtgaggcaagatcgcttcattgcactccagcctgagcaacaagagcgaaactcccgtatcaaaaaaaaaacaaaagtttgcagaaatccactgccttcaaatgcactgacaatatgcagtgaaacgatataatgacaccactaaaggacttattcacgtatccaaccaccacctgttctccaaaaacctactgaaataaaaaataaatagcactgaataattaataccctgagagttggggggaaaaaaaggatataatgatagggaaaaccccatttacaatagcgacaaagatgatcaaacacttaggaataaacttaagtcacatgcaaaatgtagatgaagaaaaatttaaaaccctcctgcaagacccaaaagtacattggaacaagaagtcatcccttgttcttggataagacaacaacacaaagatatagttaatttatacattgtcacaatctcagtaaaaatatcaatactgtttttaaggagctagacaagttgatattcaagttcatatagaagaatgaacaagccatagctcaggaaacagtgaaaacagaaaactaagaggggcctgcccctactcggtagtcaagcatactacagaaagcctctacattcacaacagcctggttttgtaccactctccatcgtaaccatccttatctcctgttagagcaggggcctcaaccttgacatgtaagcagctgggggaggcagagccaaatctcagagaaggtgggagccggggaagcgggggacatctttctctgccaggtcacctaaagctcaaggcaaccagagaccccagcagggcgcggctggcaggtgtgggtacctgggctccgatagaggctcttgggcagagagggcgagtaagtgtccatcaaggccacgatcttcatgtgtccgtactgcttggccagcatccgggctgtggctccactgtggtctctcgcgtccaccttgactccctgtgaatgtccgtgaaagggggttaggggcctctccttcaaagcacctgcccttcctgggctgctggctgggaagacagaagggcatatgctggtttctgactgcctccctgtgtgggaaacatcacatctgcatgagaaagaggcaggcttgtctgcaccgcagccacaagttttgctctcactctcttcttagggacaaggatgaggagggctgggggctggggagtcatctcccacgctcatgacctcccttgcagggggctggcagccaccatgcggagatcccagccttcaccttctgcgcctgggctgtgtcccactcacttcgcttgtcttcaaagaaagcagccttttaaaccagtcagaatgaaagcaccatcctctgaagcagaattcgtaactttgatccaaagctctataatgtatttacaggtcttgcagcgcaacaattccacttccatgaccctaaggaaataaccctaaatacagaaaaggctttagtgcacaaagatgtttggcacaggccgggtgcggtggctcatgcctgtaatcccagcactttgggaggccgaggtgggcagatcacgaggtcaggagattgagaccatcctggccaacatggtgaaaccccgtctctactaaaaatacaaaaattagccgggcgtggtggtgaacgcctatagtctcagctactcgggaggctgaggcaggagaattgcttgaacccgggaagcggaggctgcagtgagctgagatcatgccactgcactccagcctgaagacagagtgagactctgtctcaaaaaaaaaaaaaaaaaaaaaaaaaggatgtttggcacagcatattcacaataatgaaaacctacctagagaaaacttgaatgctcagggggataagcagtcagttctgttattgccatagatggtgatatttacaaacagctgtatgatcaagttgaaaaaggatcatggccaagtgaggtggctcatgcctgtaatcccagcatttgacaggccaaggcaggtggatcgctcggctcaggagttggacaacaacctgggcaacacagcatgaacccacctctacaagaaaaaaaaataaactataatcaatacagcatgtttttggtgtcactgtacactgtaactgtccttctctcctgtcagaccaggcagctgggggaggcagggaagccagagccaaagctcagaggaggaggcgggaccccggaaagggggagcatctttaataaaaaattagcagggtgtggcggcacatgcctgtagtcccagctactcaggaggctgaggcaggaggatcacttaagtcccagagcttgacgctgcagcgagctgagatcgcaccactgtactccagcctgggcaatagagcgagaccttgtctcaaaaaaataaaaaaggatcatgatacaaaactacatatacattacaactccggcaaaatgagaccaaaaaaattacacagaaaacaatattggaaggtaacatacccaaaatgttgctatttttaagttatttactatttttgatggggatttttccaattttccaatcttctatgtttttaaaatgtactaccataagcatgtttgcttttttttttttaataggatcttgctctgttacccaggctgaagtgcagcggcgcctaaggaaataatgcaggacatacactacaatttagaattttcactgtggcattcagcatagtgagaatcagaaggaacttaaaataagagattaatgagctacgtgagagcatatccagaaaacagagcgcctcccgcccatttacgtggtgggtgggagtacctgcggtgacacggactagggtgcacaaaacatcattaagagaaaaaaggcacagccaggcgccgtggctcatgcctgtaatcccagcactttgggaggccgaggtggacggagcacaaggtcaggagttccataccagcctggccaacagggtgaatcctcatctctactacaaatacaaaaagaaattagccgggcgtggtggtgggcacctgcagtcccagctactccggggggctgaggcaggagaatcgcttgaacccaggaggtggaggttgcagtgagccaagatcgcaccactggactccagcctgggcgacacacggagactccaactcaaaaaaaaaaaaaaaaaaaaaaatcacaacccttaaggagttttgctaccacccatacggcaactgtctctcccgttagaccagggggcctcaaccttgacccccatatgtagttggtgggggaggcagaggtggtctctgggcagggatacaggacaaaaaactgtgttttcacaaagtataaggagttttactttctagagtgccccccatcctacttttgactctgattaaaaattacctatgagactttgtgccttaaaaaataatttataggccgggcacagtggctcacgcctgtaatcccagcactttgggggaccaaggtgggtggatcataggtcatgagttcgagaccagcctgggcaatgtggtgaaaccccgtctctactaaaaaatacaaaaattagccaggtgtggtggtgcgtgcctgtatcccagctactcaggaggctgagggaggagaaatccttgaatccaggaggcggaggttgcagtgagctgagatcgcgccactgcactacagcctcgacgacagactgagattccatctcaaaaaaataataataaataataacaataatttataagctgggcacggtggctcaagcctgtaatcccagcactttggtaggccgagacgggtggatcacctgaggtcaggagttcaagaccagcctggccaatgtgggaaaacgtggtaaaaccccatctctactaaaaatacaaaaattagccgggcgtggtggcacacgtctgtactcccagctactcaggaagctgaggaaggagaattgcctgagtccaggaggtggaagttgcaatgagccaagatcacgccactgcacaccagcctgggcaacagacgaagcaagactctatctcaaaaataaaaaataatttcttggctgggcacagaggctcacacctgtaatcccagcacttttggaggctgaggtgggcggatcacttgaggtcaggagtttgagaccagcctggccaacaaccagcctggtcaggagtttgagaccagcctgtatctactaaaaacacaaaagttagctgggagtggtggcacacacctgtaatcccagctactcgggaggctgaggcaggagaatcgcttcaacacgggaggcagagattgcagtaagctgctgcactccagcctgggcgacagagggcgactccatctcaagaaaaaaaaaaaattctagtttaagtttgatagaaggaaccctaaggtttaaccagaataaaacagtagcctctttactgtaggattttaactcgttatatatttttggttttgtttttgaggcagaatctcactctgtggcccacgctggattacactggctcattgcaaccctgacctccccagctcaagtgatcctcccttctcagcctccctgggattacaaacacacaccacaactggctttttttttttgagacggagtctcactctgtcacccaggctggagtgcaatggcgcaatctcggctcactgcaacctctgccttccgggttcaagtgattctcccgcctcagcctcccaagtagctgggactacaggggcacgccaccacgccccgctaatggggtttcaccatgttggccaggctggtcttgaactcctgacctcaggtgatccacctgccttggcatcccaaagtgctgggattacaggcatgagccaccatgcctggccaattttttttttttttttttttttaatttagagacaaggtctcactgtattgcccagactggtctccaactccagcctcaagcgatcttcccactttggcctctaaaagtgctgggattactggcatgagccactatgcctgatgtgaaaataaatttttaactacttaggctttaagagacttttttttcctattttataatgtccatattactaaagagacacatgatcaaaactcattttaacatgaaggtgggatcagaaagtttagaaaccctggaacaagactatccggaaggcacgaatcaactttctcttaaagagagaggcccagacagatccatatcctcttctcctgactgagctgctggggcttggccccactggcagaagggaaatgggggacaaggaaagcagccacagccctttcctcccctagcaaagagcacaagatgcccagacttgccccattctctacctccagaaatggagcccagctctggagggacaggctgggaaaccgggtgggccccctcctctggctccaggtggtctaactactgggcggcaggaaaaacgtgggagagaggagcttccaggcagggcttgcccaccagcatcgctggcaggcaaaccacccaggccatcgggccacctgctgccagtcctgccccatcccccaaagcagtcactaaccaacactttgattcttgtcaagtgctggaggaagaactcagtgttgagttcctgagtctgataattttgtgtgactgggaaagagaacatttttgcttttaggaaatacataatgaaattcttactctcaggaaatacatatttaggggaaaaggggcattatgtcacaatttacatttaaatgattcagaaaacatatgcatgttatacataaagagactgataagaaaatgaggtgaaatgttaacatttggggaatgtggtaaaggcatgcaaattgttggccaagcaccgtggttcctgcctgtaatcccagcgctttgggaggccaaggtgggaggaccacttgcagccaggagtttgagaccagcctaagcaacttagtgagaccccaactctacaaaaaaatcaaatcagctagtgtgatagcatgcgcttgtggtctcagctactcaggaggctgagttgcaaggatcccttgaacctgggaggttgaggctgcaacaaactatgatcgcgccactgtgctccagcatgggcaaacagagtgagactctgtctcaaaaagaaacaaacatacaatcaaaaattataagagtacatatctcttatgatctccagttctaccttacttaaaatgactctaaacttacaagtagaggctctttatggttctgggctattgattctatgatgtgtcttaaggaagtctagttcatgtcagcaggattatctgtcaaagaattatctggccgggcatggtggctcaggtctgtaactccagcactttgggaggccaaggtgggaagattgcttgaggccaggagttcaagaccagcctgggcaacatagtgagatttttgtctctacaaaaaaaaaacagccaggcgtggtagtgcgtgcctgtagtcccagctactgaggaggctgaggcagaaggattacttcagcccaggaggttgagactacaatgacccatgatcaggccactgcactctagtgtggtgacaaagcaagaccctatataaaaaaaataaataaaaaatacaaaaataattatttgcagaaaaagaaacccaaatggccagggagccaaaaagtctaacatcctggccaggcacagtggctcacgcctgtaatcccagcactttgggaggctgaggcagacagatcatgaggtcaggagttcgagaccagcctggccaacatggtgaaaccctgtctccactaaaaatacaaaaattagctggatatggtggcacacacctggaatcccagctactcgggaggctgagccaggcgaattgcttgagcctgggagtcagaagttgcactgagctgagatcacaccactgtactccagccttggggacagagcaagaccccaccccaaaaaaaaaaaaaaaaaaaaggccaggcacggtggctcacgcctgtaatcccagcactttggaagaccaaggcgggcgggtcacaaggtcaagagattgagaccatcctggccaacatggtgaaaccctgtctctactaaaaatacaaaaattagctgggcatggtggcgagtgcctacagtcccagctactcgggaggctgaggcaggaaaatcgcttgaacctgggaggcagaggttgcagtgagccgagatcgcgccactgcactccagcctgggtgacagagagagactccatctcaaaaaaaaaaaagaagtctaacaccctaaggggaggggtgtgaaccaggaccactatggaacaaagcaagtttacactacccactaccgactgaacccacctcacacaacaaagactctactttgaagaacacatcctaagctcctgaagaaattcccatatgtgcttaaaaagacgtgtaagaaatgtcaacggtaggccaggcgcagtggctcatgcctgtaatctcagcactttgggaggccaaagtggtagatcacttgaggtcaggagttcaagaccatcctgaccaacatgccgaaaccctgtctactaaaaatacaaaattagctgggcgtggtggcacacgcctgtaatcccagctactcaggaggctgaggcaggagaatcgcttgaacctgggaggcagaggttgcaatgagccgagattgcgccactgcactccagccagggctacagagcgagactccatctcaaaacaaacaaacaaacaaacaaaaaaactctgattcatccctacagggaataccatgccaccataaaaaaaaaaaaaaaaaagagaggccaggcacggtggctcacgcctgtaatcccagcactttgggaggccaaggtgggcggatcacgaggtcaggagatcgagaccatcctggctaacgcggtgaaaccccgtctctactaaaaatatgaaaaattagctgggcatggtggcgggcgcctgtggtcccagctactcgggaggctgaggcaggagaatggtgtgaacccggaagtctgaggttgcagtgagccgagatcgtgccactgcactctagcctgggcaacagagcaagacgccatctcaaaaaaaaaaaaaaaagagaggggctgggtgcgttggctcgtgcctgtaatcccagcactttgggagaccgaggcaggcgaactgcctgagctcaggagttcaagaccagcctgggcaacgtggcaaaaccccatctctacaaaaaaaatacaaaaattggctgggcgtggtggcacgcacctgtaatcccagctacttgggaggctgaggcaggaggatcacttgagaccaggaggtcaaggctgcagtgagctgagactgcaccactccactccagcctgagggacagagcaagaccccatctctttattgatttattgatttatttatttatttatttatttatttatttagagatagtctcactctgtcacccaggctggagtgcagtggcaacatcttggctcatcgcaacctctgcctcccaggttcaagtgattctcctgtctcagcctcccaagtagctgggattacagcgtcagccacctgtattttgtatttttgtatttttggtagaggcgggtttcaccaccttggccaagctggtctcaaactcctgacctcaagtgatctgtctgccttggcctctcaaagtgctgggattacaggagcgagacaatgcacctggccccgtctctttatacaccaatatagaaaaatcttcatgattaagttttttaaaaaatgcaagatgggagcagctgcacatggggcaggaccatgagcatgtgtgggtgtattcccagagtcgcccgtggggagggtgccaaggagacgcaggcagggtgggggacaggcctgcggtgcacccaccttctggtctgcatgtgtaccatgtgcatgttgtgtcccaaaattctttgttaaaaagagataccatgtgaatttttcactatttaagaaattcccaccaataagtgagaaaaaaacaaactatccaatagaaaattgggcaataaacatagacagctcgtaagagaaatacaaatggccagccgggcacagtggctcacacctgtaatcccagcactttgggaggccagggcgggcagatcatgaggtcaggagatcgagaccatcctggctaacacggtgaaaccttgtctctactaaaaatacaaaaaattagccgggattttttgtatttttagtcccagctactcgggaggctgaggcaggacaatctcttaaacctgggaggtggaggttgcagtgagctgagatcatgccactgtactccagcctgggcgactgagtgagactcagtctcaaaaaaaaaaaaaaaaaagaaatacaaatggctaagaaatcaatttaaaaatgttcaactggctgggcgcagtggcttatgcctgtaatcctagcactttgggaggctaaggtgggtggattgcctgagttcaggagttcaagagcagcctgggcaacatggtgaaacctcatctctactaaaatacaaaaaattagccaggtgtgcgggcgggtgcctgcagtcccagctactcgggaggctgaggcagaagaactgcttgaacttgggaggtagaggttgcagtgagccgagatcacgccactgcactccagccttccagcctgggcgacacagcacaagacttctgtctccaaaaaaaaaaaaaaagaaaaaaatttcaactactctaacaaggacaaactaaaatgagacgctacaattcacccgccagattgacaaaaggttgactgacatcaggactggtgaggacaagagaaaatggacacctttgtctatgactggtgggcaggacaacagacaaccttggtagtgggaattcatcaggaccgcctgcacttccccccattgggtttaacagccttataaagatataatccacataccaacaagtcacccacttacaatgtacaattcaacggcttctcgtatattcacagttgttcaaccatcaccacaaacaattttagcacatttttatcaccccaatcttcccattccccaagacccaggaaaccactcatctattttctgtctatgtatttgcttattctggacatttcctatgagtgaaatcacctagtgtgtggcctgttgtgtctggcttctttcactgagccgaatgttttccttttctttttctttttgaggcaggatccactctgtgacccagaatggagtgtggcggcgcaatcatagctcactgcaacctccaactccagggctgaagcgaccctctggcctcagcctcccaaagtgttgggattaccggcgtgcgccaccgcacccagcccagcctaacgcatcagggttcacccctgccgcagcatgcagcagtactgcattactttgtagggccgaataatatcctgctatacagatatatattttgtttatcaattcctcagtagatggacttgtgggtttttctactttttggcaattatgaataatactgctatgaatatttatgtacaaggttctgtgtggacaggcttgcacctgtgatcccagcactttgggaggctgaggtgatcgcttgagctcaggaattcaagactagcctgcacaacatactgagacccccaactctaccaaaaaaaaaaaattaaataattagccggggcatggtagcatgcacctgtagtcccagctacttgggggctgaggcaggaggatcgcttgagcccaggaggctgaagctgcagtgagccacgatctcgccactgaactccagcctgggatacagggcaacaccatgtctcaaaaaaataaattaataaaataaaacagaaatacaacatacagaaataactgcaaatgtattaaagctatgtgtaaaaggatattcccggaacactgtttataattgcaaaatgttaaaaactaagtttctactaataagaaactcattaaattaactgaggcagattgtacacggaatactgtacaaagataagatgtctataagatgtctctaagttacagactatacgtagaatcccactttgttcaaaacacaaagcaatgtgcacacacttgcctacagacacatctttccacagcagaggaaaagtcctagggcagctctttctcaaaccaagtgggcatcagggaggttgaaaaagagaggaggatctctgccttcttattctatataatttttctaagtgacaggattatgagtgctatttacttttaaaatatttttccataattttcagatagtattttcaaaattattacaggaataggtgtctatttctactcaccactgtatccttaatgcctaagcaccactcaacaccgggcgtcaatagataatgaaaatgtgttgaataaatgaatgaaagttatttctgtgcaaaggaaaattctgtaatagcttatacttcagtaatatgattcctcatttgccgtgactacattacatgctaataatcagggtcacttacgtgattcagaaaatactgcacgattatctcatggccagcagcagctgcttccatcaagggagtaaatccacatatcggctccctgcaagatgtgggccacagtcagatgattggaagagacaagttccgccaggcaaaaactccctgctgaagataaaccctgagcagtgcacgagtcaccgatccctaagcgtagaacactgtccctttccagaattaacaggtgacatgagaacagtgaatataacacatcagctccatttactcttctggtgtctgtccccagggctggtctttgtcctaaagacagatgtctgcctgtcgtcccacctgttggctattcccactggctacctctgaaatctccacctcaatcatattcaaaaagctgttctaattcctcacagaaagccagcatctcccatccattcatccaaatcctggcttcaagttcaacgtcctccatgaacccactctgaaaagttcaagtactaatgatctaagctatctttgccacgcttagctcctgaagcttgcttttcatgcttggttatgctaactcggcactgtcttcagagggcttccaaatccctccttgtctcatgctggtttggaagtcaggaaccatgcatgggaaatgctggttttcatccatcttaagacacacagtgttcatattttaacatctctcaagtcagaaaacatctttaaatcaacaggcgagttgaatgttaattagtagcatattttttctttcttagtggcatacaaaattatcaggtgtcttagaatgaatgacagccagggtgggtgctgcattggtacccgctgcgtttgttcaaaggtgattattatcatgacaagctttagacaacaatcccacttccaacttataaaactcatgactggttttttgtttgtttttgagacagagttttgctcttgttgctcaggctggagtgcagtggcacgatctctcagttcactgcaacctctgccttctggtttcaagtgattctcccgcctcagactcccgagtagctgggattacaggcacctgccaccacgcccagctaatttttgtatttttagtagagacggggtttcaccatgttggccagactggtctcgaactcctgacctcatgatctgcccgccttggcctcccagagtgctaggattacaggtgtgagccactgagcccggccaaaactcatgactgttgtttttgtttttttttttttgagatggagtcttgctctgtcacccaggctggagtgcagtggtgcaatctcggctcactgcaagctccacctcccgggttcacaccattctcttgcctcagcctcccgagtagctgggactacaggcgcccgtcaccatgcccagctaattttttcgtatttttagtagagatggggtttcaccatgttagccaggatggtctcgatctcctgacctcgtgatctgcctacctcggcctcccaaagagctgggatcacaggcgtgagccaccacgcccggcctcatgactgtttcaaagcatcacctcacctcatccatacaaaaagcaagaaaatggaaggaatttgcatgtaatgtatgacatttaaatgccattcagtatgttaggcccctggcatacaataaaacatgtaattcttacaactgtatgacccaggtgggtttcagataaagaaaaggaagctgagagggcttgaagagatgcatctcacagatgtacgaaaaggcctgtgcctggaaggactctggtcctacccctcatcttgagcctctcgtgccgaagcagggtggccctaaactctggttagctgcctccagagccaccctccttagagtcagatgacacctaggccactcctgtggccactaaagatgtggcaatcacctcacgttggcattggctccactgtccaagaggaacctgaccatgtgctggtgcccggcgctggtacagtggaagagggctgtccagccctggatgtctttcatttctagctctgcaccttgcttcaagagaacacagaacgtgcgttacggcctcatctcctctgcgtggggcgggcgccctccaggcggccatgctgcaagaatcagaagtgattacacgagcacacacgaacaccgtggcctgcagtggttcgcatctctgtcagggtggccacggagcccctcaggtttctgggcctgagttccctcgtagctcacctggagaagaaagtaggcgatgctctcgttgccacagctggaggccagcatcagtggagtctgcccttctggggtcggcacattcacactcacccccgcctcaagcagcaggtgcacgattgtgtcgtggccaatgtaggaggcatacatcagcggggtccagccaccaccattcttcttattcaaatctaactctctcctaaacaaacgcaagatatgctagacatggccagccgcctcgcatgtggggttcaccaaagctggtggcgaggctaggccaggcgggatgagttgacaggaagcagaagttatctgccaccctggacgttgtggggattggaggcaggcaggcagaaaaatgctgacagttgctcgtacactgccttgtgaggccctgagccttcgtctccttgctctgatttcgcatcctcctagcccaaggccagctatgctctttcacaccaccagataggcagatggcactcaaccagggaatatgtggcaatgtgtgaaggcatttttggttctcacaactgggcagggaagggctgctggaggccaaggctgccgctaaacatcccacagtgtccaggacagcccccacagcaaagaatgatccagcctggattgtcaacacagccacagttgaaaaaccctgaccaccacaggcctggcatctactagcccactgctgggtggagaggagcagtgaggaaagaagggactccaccgtggacaagtcccaccgccactgattcatcctttgtcacctcaccttaaagaaacattcttgaaaaatctgtgaccaaagaatcccatctttctcactgattgctgttaaaattctggcaatgcattttcccatgggaaaaaactgtgggcttcctagctgcgactctggggttgggacaagggagtcacatttaaaataatacccacttgcatggttacctgggatcctacatggttaacgcccacaggccttctttcccttccccagttcttgcctgcagaggggataacaactggtgactgaaccccaggatctgtcccttttacgggattcacttttttgttgtttttttgagacagagtctcgctctgtcgcccaggctggagtgcagtggcgcgatctcggctcactgcaagctccgcctcccaagttcacgccattctcctgcctcagcctcccaagtagctgggactacaggcgcccgccactacgcccagctagttttttgtatttttagtagagatggggtttcaccgtgttagccaggatggtctcgatctcctgacctcgtgatccacccgccttagcctcccaaagtgctggattacaggcgtgagccaccgcgcccagccgggattcacatattagaccacagcaggcaactaccttccattgcctggcagccctcagtgactctgggatgcacacctgggcagccattccagaaggtcctgataccagggttcagtggcagcccctggccaggggggctgcatggagatgcctctgcagcagggctcgaatgcacccagctcgtcctaacactatcttcctttacacaacagcagagcatctccctggggctctcttaccactcctcgttcagccccaccccttccttctgatgcccccagctcccctcaggccccatcctgtgcttactatcagcaagcctccacctcagctagtgtcaaaatcccatcacaacacaaacgcctccccctgctcctctatggagcggttatggactctgcatcttaacaggacacccaaagacttaagagcctgagaattccaaacgtgaccctttgaggggccgtactgactgcatacccagctgcctatgcctagagcctcctgtggagggagcgcaacagaccaccctgtaccaaggtgcaccagcactccatgggctgggtatgtctaagtgagggccacaacttgggaaccggagacctggggcttcagcaatgctttgctttggctcactgggaactggaagaggcacgcagagagaggaagagaggtcgctgcaccacaatatcaaatgagaaccaggagacagagttaggctgtgtgtggaacataagggggtggaagtgaggagacgacccttttccaaaaacaagatgatcacatcctactatgggcaagacgcagccatggaccctgccaggggctttatattgtctctaactattgtacacagattagcaaagggcaggtgggcagtgacgtcgggaggtcattccccagaggcactgaaagcccagcctctctcctcctccatggcagaagctagaggggaacagggatcacagggatcgaatgaaccctccgggaaaagaaggccagggatcactttcttttttcttttttttgtttttgagacagagtctcactctgttgcccaggctagagtgcagtggcgcaatctcagctcactgtaacctccacctcccgggttcaagcgattctcctgcctcagcctcctgagtagctgggattacaggtacatgccaccacacccagctaacttttatatttttagtagagatggggtttcatcatgttatccagaatggtctcaaactcctgacctcaagtgacccgcccatctcagcctcccaaagtgctggaattacaagtgtgagccaccgcaccaggccatcactttctgtctttatttttattttgcttgtttgtttgggcatttctgcaattagtgaataaaattagtctggttaaagaatgactgtttataagcttctgatcaaagtttactccctctttttcttcctaggaataaaaacggcctctttgtcagggctcagcatcaatacttactgacagctgcctgagataagcaggttaacctattctacacgcattaaacatccacaactgtgtgcaaagccccatcacgtgggatcgaagccatcactgcgctgctcaaaatgtgagaggaagttccccgagatctcttaccgctgcacacactccttcaccacttcatactggccaatggaagcagctgtgtgaagatccagggggacatccagctcctccccgctgacctgtgtcccgagcccgtgccacatggacaagctgcggttcaggagttccggctcgctggcttcatcgctgagctcggacatcactgaggaggaaggcccaagggttagatctttcctggctggttgttccagggcatgaaacaggctggtcctgcccctgctacaccactgcactagcagactgataacccagtgcagtcaaccccgggagtaactcagacaaatttatttgctgaaataatgtatgctttgggcagtcccaaccatgctaaatctggtgagcctgctatcacaccagtaaagaggagcacatatggtgaggcattaactgtggagtacctgctcctccttccaaccgcaggcaccaggtaaaagagaattctccaccaactctaggaacctgacaacctcttggatgggcagtgaagaaatgctaattgggttgtttaacccaatcagttccttgatgtggtggggaagaaccctggatttggggtttgatcaaaattcagcttggacccggtgcggtggctcacacctgtaatcccagcactttgggaggccaaggtgggcagatcacttgaggtcaagagttcaagaccagcctggccaacatggtgaaatcctgtctctactaaaaatacaaaaattagctgggcatgaaggccagctactcgggaggctgaggtaggagcatcacttgaactgaggaggcggaggttgcggtgagccaagatcacgccattgcactccagcctgggaaacagagcaagactttgtctccaaaaacaaaacaaaaaaaaaaaacaacaaaaaagcagctctgctacttagcaactccaatccctagtgcctcactgtctaacggggacatatctaaaaaggctgctattatgatacataaaagaatggataaacaaacggtggcacatccatataatggatgctactcagcattaaacacaaggatccaacagttgacatgcaacacgtgaatgaatttcaaatgatttacgctaaatggaagaagcctgcctacagtataatttcacttacatgacattctggaaaaggcaaaattaaagggttggaggttggggcagagagggaatttgggggacgatagacctgtatgactgtgacggtggatctgtgactccatgcctttatgaaaccacagaactgaacaccaaaatgaattttactgtatgtaaattttatttatttttttgagacagtctcgctctgttgcccaggctggagtgcagtggcatgatttcagctcactggaacctctgcctcctgggtttaagggcttcttgagcctcagccacctgaatagctgagattacaggtgtgcgccatcatgttaggctaatttttgtatttttagtagagacgggggtttcaccatgttggccaggctggtctcgaactcctcacctcaggtgatccgcccgcctcagcctctcaaagtcctggaaatataggcgtgagccactgcacctggcctgtaaattttaaatataaattaatttttctggaatggttatgaaattgaaaatttcaaaaaagtaaaaataaatttttctgaaaaaaatagaaagcaattccccaacagacaaaccaggatgtgactggtggcacgcagcaaccgtcaactgaataggaatccacttaggcatcctttgaagagagagctatggggggaaatataacaggccggtgaactggtgaggtaacactttccccgagatgggcctacatgggtaacggcacaccaggaatccccaaatcaaggcaaggtcatcagcttcctagtagaatccttaggtacaagagtgccaggaaacaagggtaggaaagggagcaaaggcgaaaacaaaggccttgtcaggttgtgatgacctacaggtgctatggtagttaatagatgcgatgaggacctcagtttctattaaagaatgcttccaagccccaggtgacagccaagatggctaaagaaacaagccaccaatgtgggagacgaacacttcacagacccttggtgaagagtgtgtgtaggtgcggtggggcaagcaaagccctccttcctggagccaccacctcttcagctagcagagcccaagatcgtgcagtgcccttccctcactttgcaggtgagaatcccaccctaacagccctggccaacgaagcctggataagaaaccaaacgagctgagggtcagttcagagtcccttccatacctccctcaagccttcactgggcatgtctcttccacgccaaaggcctcctgcagggtgaggccgtgttctctatttactggagacttgcatatctgacatccccagaggtctgaaggacaatgagaaccagaccaagcgtgacggaccacttgaggccaggagttcgagaccaccctggccaaaatggtgaactcccatctttactaaaattacaaaaattagctgggtgtggtggtgggcgcctgtagtctcagtactcaggaggctgaggcaagagaatcgcttgagcctgggaggcgattgcagtgagccgagctcaagccactgcactccagcctgggcaacagagcgaaattctgtctcaaaaaaaaaaacaaaaaaaaaacactaaagtgaaaactaaaatgtcccatcccgagtggtgtggtgtaaagtagcattagagataagacgttttagttttcattcaactttttggttctgtccattctgaaaatgctaagtatctgttacctttacagtgaatcctaaagaaaatgtggtacttagacacaatggagtactattcagccataaaaaaagaatgagatcctatcatttgcaaaaacatggatggaagcggagatcgttatgtttagtgaaataagccaggcacagaaagataaatattgcatgttctcaattatttgtggttatctaaaaatcaaaacaactgaactcatggacatagaaagtagaaggatggttacttctagtgtaaccaaggctgggaagggtagtggagggtggggatgcttaatggatacaaaaaaaacagaatgaataagatctagtatttgatcaagccactgcactccagcctgggcgacaaagcgagactccgtctcaaaaaaaaaaaaaaaaaaaaaaagatctagtatttgaccgcacaacagggtgactatagtcaatataatctaattgcacattttatttatttattattattttttttgagacataatctcactctgttacccaggctagagtgcagcggcgtgatctcggctcaatgcaacctccgcctcctgggttcaagcgattctcctgcctcagcttcccgagtagctgagattacaggtatgagccaccatgccagcctagttttcgtatgtttagtagagacgaagtgtccccatgttggccaggctggtctcaaatccttgacttcaggtgatccgcccgcctttgcctcccaaagtgctaggattacaggcgtgagtgagccaccgcgcccggctgcacatttaaaaataattcaaagagtataatcatattgtttgtaacacaaaggataaatgcttgaagggatggagacccccattttacatgtgattattacgaactgcatgcctgtatcaaaatctctcatatacgccataaatatatacacctactacgtacccacaaaaattaaaaaatttttaaaaatcttaacaaatgtgatgctggtggtaactgtcacgcccacagaggaggtctgtgaaagcacccaggcaccccctctcgccccgtggaaccgcatcgcaaaggtagctcactggccccggggcgggtccctggccgacaaacccgtaactcacagcagtgacgcttcccgacgccccccggccacatccccacaggaacgctacggcgcacagggcattactgtgcccccaccacaaccacataaagaaaatgtgggggctcggtcctccagtcacgcggcgagcaagtgcagcgcgggacgcccgagcgccgggtctaggcgggctgcaggtgccggcaagtgctggggccgggccgccgcggaacccacctgtgct

SEQ ID NO: 860 - DNA, 13203 bp, Homo sapiens
ctgggagaacaatggctttattcagatgttggtgcctctgcccctctggtgcccccgatccccacaaggggccgcgaggcgggcaggtcacagcaggttgaagtcccctttgtgctgttccagccactggtccagcgtcagggccttggggttgagtctcagggtcagctcgatgtcacggtcgggtctcagggcatagaaacggaacatgttggccaggtcccgggcaccgggaaagccaagcttttcgtagtcctcaggagtcatctggaagcagaggagcctgtcgtggccggcgtcctccagtgccccgggaggtggcggggcagggaggccggatgggctggggtctcccgacctgctacacccagagccactattgtctcggtccctgacccaggtcctccgtacaaggtcatttgaaaacttctaagagccgaaagttcagaaactgctgctctcctgagctgcctgacattgtagatcagtttaaagattgttcttggccagatgctgtggctcatgcccgtaatccctgcactttgggaggctgaggcaggcaaatctcttgaggccaggagttcgagaccagcgtggccaacacgataaaaccccgtctctttcaaaaatacaaaaattagccagcctggtggtaggtgcgtgtaatcccagctacttaggaggctgagacaggagaatcgcttgaaaccaggaggtggaggttgcagtgagctgagatcaccccactgtactccagcctgggcaacaagagtgagaccctgtctcaaaaatgaataaataaaaagactattattttcagatcatgagacgaaaatatctcagtcccttccaaatcagagacctgcctgcatcactttctttctcaaaaaccaaagcttgaccagacacagtggctcacacctgtcatcccagcactttgggaggtggaggtgggaggatcgcttgagcccaggagttaggcccaccacgccgggctaattttttgtatttttagtagagacggggtttcaccgtgttagtcaggatggtctcgatttcctgaccttgtaattgcccgcctcagcctcccaaagtgctaggattacaggtgtgagctaccgcgcctgacccaactttcgtcttttaaggactccagtgtttcccagattcttttttttttttggagttggagtctcgctctgtcgcccagtctggagtgcagtggcatctcggctcgctgcaaactctgcctcctgagttcaagcgattctcttgcctcagcctcccaagtagctgggattacaggcgcctgccaccacacccggctaatttgtttatttttagtagagatggggtttcaccctgttggccaggctggtctcaaactcctgacctcaggtgatccacctgcctcggcctcccaaagtgctgggattacaggcgtgagctactgcacccagcctcccagattctttaatgagtatgtcttactttcctaatggtaatgacaaacattagaaaccaggtacccaagagtctgtccagtaggcctcctgcccacccagccaggccaatgggggcaggggtcggccctatctttctagcctctttccctttaaatcccctcccacaggggaggggtcgggtctatctttccagactcttttctcttcaaattccctcccacagaggagcccggcagggcctgcattttcacccctccttgccttggctcctatggccctctcctcctggaagcttttctctctatttggtcaaaacatctaagccagaaatttcactctgtggccagttagctcctggaacagcagaaaataaacgttgacgatgaacgaatgaatttagatgtactgcccagaggtgtgggcagccctggacacaccctccctacgggagctagaaagccctgacaaggatgcctgagtcacctggggcgggaggcccaccttggcatcgtgcacgaccttgcgggtgtgcttggtgagcagggcagcgtactcctcggccgtgtgcctgcaagtgctcagcccgatgttctggccgacgtatttttctggcatcttcaaaaggctgagcaccacaggacccaggtcagacacggacatgccatccatgggaacgtcacctgtgggcaagcctgtggggcagagacgtgagctggtatatgtcccgagggcagacaggggcagggacagagcccctctccaaagggtccaagctggttcttcccagcagtcagctgcacactccagcactcgggcatagctaagacaagtcttgctatttgtggtagcacagaggcagcagtggaattgagtcaggaaacgggatggaatccgggtactgccacctagggcaggctgttgaggctctctgagcctgggttgctgcattcctagaatggggctaagaacctgggcctgcccagctctctcagcgctaggatgacagagaagggacaaaggaaaaggactctgaaagctgctacagagagtgtggctggagcccagggtctccgctaatctggaggcaccagcctgaagtactctgtcatatcctagattcctggaagctggaacgtccacctctgagtagatactccaaataccaactcacttaccaggaatcctgattaaccagacaccaacggctggcctagagcagcacgtccatgataaatgcttcataaatcctgaatgaatgaatgactcgcaaacttccaggctgaggttttgtagatggggaggctggcaactgtctgggtgtggcctgtggaatgcttgggtcctatcctccttacctagagacaggggccagtgcagcttcctgttcagatcacctgggagctcgagggcacagagcgcacagaccggagcaggagatatccctgactgcaggtttttttttttttttttttttgagatggagtctcgctctgtcgcccaggctggagtgcagtggcgcaatcttggctcaccacaagctccacctcccgggttcacaccattctcctgcctcagcctcccgagtagctgggactacaggcgcctgccgccacacccggctaagtttttgtatttttagtagagacaggggtttcaccaagttagccatgatggtctcgatctcctgaacctcgtgatccgccctcctcggcctcccaaagtgctgggattacaggcgtaagccaccgtgcccggccttttttttttgagacggggtcttgctctgtcacccaggctggagtgcagtgccacgatctcggctcactgcaacctctgcctcctgggttcaagcgattcttctgcctcagcctcccgagtagctgggattacaggcgtgcaccaccacgccaggctggctaatttttgtatttttagtagagatggggtttcacaccatgctggccaggctggtctcaaactcctgaactggtggtctgcccacctcggcttcccaaagtgctgggattacaggcgtaagccactgcgcctggccagctttgcaaactataataaatggtggtaccaaagggctactgttaccaccagacttggcccgccaggtgagcaggactcccatgggctgggcccttatgcgagggtgacctggcattcaaccagagggtaaggagtggccagccagaggcaccaacccctcctgccctgatcactgagtgaccagcaggacacaggttgggtgagccttgttcccagccagggccagtgcacctaacctgtttatagccccaatgggcactgagaagaaagagctttcctagtttgtgaaatctgcaactgaacttcattttccaaatcctctcctcgtctttggtttttttgttttgttttgttttgttttgtttgttttgagacggagtgttgctcttgtcgcctaggctagagtgcagtggcacaatctcagctcactgcaacctccacctcctgggttcaagcgattcccctgcctcagcctccctagtagctgccagtacaggtgggtggcaccacgcccagctaatttttgtatttttagtagagatggggtttcaccatgttggccaggctggtctccccgcctcagcctcccaaagtgctgggactacaggcataagccacagcgcccggccctcctcatctttgaaggagaactgacaatcactaggtcctctctgtaaagccttccaatggaccaagcgaatatcgtgtcaccaccatctcagcagatcttgccacccctgcaaacattggtatagagcccatctcacagaacaggaagctgaggccccgcaagctgacaggatgtgctcagtcctgggcctaacgtgagggagccacggcttgaacctggcaccacgtgacagcggcccgcggtctgttacaccaacggctttacagggtgagagctctgcctcaccgtgtgcgagaaagggcacttactcagcaagtagctctttccgtctggggctttctggggcaagaagtgggagaggaggttctcaaaatagcagggcagccgcacactggtcatgggaacgccaatgtcccggaaatattcctccacctcccctttgccgtcaaagtgcgcggcggccaatctccctgccgtcagcttcttgatgttctccaggccgctgtagaccacatagtggaggcccaggcgcctggccagatcagcgagcagcttcccctggagggcagggaaggagagatcacaaggctcagaagaaggatgtctgtccctggtcacagccccagcattctaatcccggagcggccaccatctgcgaggttaacatctagaccccacttacccttgaggaggccccctctcctggaatgatgttcacacatgacaccacgcccgtaaacacagccccggaagccttctaccagccactgactctggcccaccatgtgcaacataggacgggggggcaggtcggctgcagggggacggcctgcatggaggtctaaaggagaatgcacacgtcccatctctgctggtgtgagaacaccctgcccatggagctcagccatcttccttggagagccctgggaggctatacagaggcaccacagctgcctaggttcaaatcaggctctgccatgtacgagcagtgtgaccccagagaagtgatggcaccatcctgacctcgctggtaaaatgcagatgacaacactacctactgcatgaggtgacgcagagattcggacggtggcctccaaaaagatatgccgcatcctcattcctgaaaactgtgaatgtgaccttattcggaaaaagggtcttggcagatgtaattacgtgaaggatcttgagatgggaacatcctgcactaactagataggcgctaaatccagtaaccagggtacttataagagacgggagaagagacaacacctggagaaggccatgcgaagagggaagcggagattggagctttgtggccacaagcccaggaacacctggagccatgagaagccagaaacagtgaagaaggatttccctcaaaccccttgttttgttttgttttttaagatggactctcactctgtcacccaggcaggagtgcagtggcgtgatctctgctcactgcagcctccgcttcctggattcaagcaattctcctgcctcaccctcctgagtcgctgggactacaggtgcccgccaccatgcctggctaatttttgtattttttgtagagacagggttttgctgtgttggccaggctggtcttgaactcctgaccttaagtgatctgcccacctcagcctcccaaagtgctgggattacaagcataaactaccacgcctggcctccaagactctggagagagggtgacattgctgacaccttgattttgaacttctagcttctagaatatcagagaatcgatttctgtggtttttgtttttgtttttgagacagagtctagctctgtcgctcaggccggagtgcagtggcacaatcttggctcactgcaacctccgcctcttgggttcaagcaattctcctgcctcagcctcctgagtagctgggattacaggcgcccaccaccatgcccagctaatttttgtatttttagtagagacagggtttcactgtgttggccaggatggtctcaaactcctgacttcaagtgatctgcccgcctcggcctcccaaagtgtggggattacaagcatgagccactgtgcccagctgatttctatggttttaagccacgtggattgtggtcctttttcgtgacagtaccaggaagcccacagggaatcatcaggattagaaataagatctgctgggctgggcgcagtggctcatgcccgcagtcccagcactttgggaggccgaggcaggcggatcgcctgaggccgggagttagagaccagcttgaccaacatggagaaaccccgtctgtactaaaaatacaaaaaaattaccagggcatggtgacgcatgcatgtaatctcagctattcgggaggctggggcaggagaataacttgaacccaggaggcggaggttgcggtgagccaagattgcgccattgcatgccagcctgggcaacaaaagcgaaactcggcctcaaaaaataaagaaagaaataagatcagctcagggccgggcatgtggcttacgcctgtaatcccagcactttgggaggccgaggtgggcggatcacctgaggtcaggagttcaagaccagcctggccaacatggtgaaaccccgcctctactaaaaatacaaaaattagttgggtgtgctggtacacacctataatcccagctactcgggaggctgaggcagaagaattgcttgaatctgggaggcagaggttgcagtgagccgagatcaccccactgcactccggcctgggcgacagagcaagactcagtctcaaaaaaaaaaaaaaaaaaaagatctgcgttaatcagagaagttgtctttgtctgctctatataatgggcttctaggtaagaccataattgaagaaagggtcaaggctaataacaagtttggatgggtacacgtggacatgaaggcaacaacagacactgggaaccacgggagggagggaggcaagggttgaaaacctacctactgggtactgtgcccactacctgggtgacaggtccagtcacaccccagacctcagcatcactcaatataccaatgtaacaaacctgtgcatgtacccctgaatctaaaataaaagtggaaattactttttaaaaaaaacttctaacatttttgattaaaaaaaaaaaaaacaaacgaacaggccaggcgtggttgctcacggagactgagacggcctcaaacaaacaaaaaaaaagtaattggatgagaaagcaacagcgtccacctgcttcacagcctagagcaggcagaggcatgaagaagagggaaaggcctgcagtgctccaacctccctgcagagtcggagctcctcccaggcgctctgctcctagcctggccgggcctccctgcagctcctgcctgccctcacctgcttgacctcctgctcctggctgcagctctcccagtaattggtcacgatgaaggtggcgtaagccccattcagggccagctccatgatgacctggtcatcttggtctccctgcactacttctgcaccttgcagcctcagctcctttgctgccttcttcctagggtttcgggtcaccactcgaaccttgaatgtcccatcttccaggagtgtgcgggccacggagccaccctgggcacctacaaagaatcaaaaagacctctcaggtcagacctacctgaaagtcccactgaagggcgaaaccccgaagggagtgctccaccacagcaaggagcatccaggaaaccttctcaacgacgattctcattcaggtatttttattttctttattttatttttttgagatggagtctcactctatcacccaggctgaagtgcagtggcacgatcttggcttggtgaaaccccgcctctatcaaaaaatacaaaaattagctgggtgtgaaggcacatgcctgtactcccagctactcaggaggctgaggcacgagaattgctggaacccaggaggcggaggttgcagtgagctgagattgcgccactgcaccacagcctgggtgacacagcgagaatctgtattaaaaaaaaaaaaaaaaggccaggcatggtggctcacgcctgtaatcacagcactttgggaggccaggccgagtggatcaccaggtaaggagaccgagaccatcctggctaacacagtgaaaccctgtctctgctaaaaatacaaacttagccgggcgtggtggcacccgcctgtagtcacagctactcaggaggctaaggcaggagaatcgcttgaacacaggaggcggaggttgcagtgagcccagatcacgccactgcactccagcctgggtgacaaagtgagattccctctcaaaaaaaaaaaaaaaaaaaaaaaaagggcctggtgcagtggctcacacctgtaatcctagcactttgagaggccgaggggggtagatcacctgaagttgggagtttgagaacagcccgaccaacatggagaaaccactgtctctactaaaaatacaaaattagctaggcgtggtggcacatgcctgtaatcccagctactcgagaggctgaggcaggagaatcgcttgaacccaggaggcagaggttgcggtgagccgagatcgcgccattgcactccagcctgggcaacaagagcgaaacttggtctcaaaaaaataaaggtaaaaatatttgtgatgtaataaagtaaaaaaagtagaatacaaaaccatattcaggctgggtgcagtggctgtaatcctagcactttgggaggctgagacaggtggatcacgaggtcaggagctcaagaccagcctagccaagatggtgaaaccccgtctctactaaaaataaaaaaatgaggccgggtgcagtagctcacaactgtaatcccagcactttgggaggccgaggcgggcggatcatgaggtcaggagatcgagaccatcctggctaacacggtgaaaccctgtctctactaaaaatacaaaaacttagccgggcgtggtggcgggcgcctgtagtcccagctactcgggagactgaggcaggagaatggcatgaacccaggaggtggagcttgcagtgagccgagatcgcgccactgcactccagcctggacgacagagcaagactccgtctcaaaaaaaaaaaaaaattagctgggcatggtggagcctgtaatcccagctacttgggaggctgaggcaggagaatcgcttgaaccagggtggcagaggttgcagtgagccgagattgggccactgcactccagcctgggtgacacagtgagactctgtctcaaaacaaaagaaaaaaccatattcagatcttgatgggatttgaattcttcctgaagtagaatataaagccatattcagatacacaaccatattcagatctgctcaaaaacgagacaaagaaaaatagttaacagaaaggaatacaaaaacttattcagatctcgatggagcttgagtcacacaggcatgcgcatcggtcagatgtacccttaagattttgcgcgttgcagctgggcccaggggctcatgcctgtaatccagacactttgggaggctgaggcacgcagatctcttgagctcaggagtttgagaccagcctgggcaacatggtgaaaccatatctctacaaaaaaaaaccaaaaattagctgggcgtggtggcatgtgcctgtagtcccagctaccagggaggctgaggctggaggaaagcctgaacccaggaggttgaggctgcagtgagccgtgatcacaccactgcacgccagcctgggtaacagagtaaggccctgtctccaaaaaaaaaaaaaaaaaaaaattctttattatatgtatattttacctcataattaaaaataatctataaacaaatactgaattctagctaatgttatgcatgctttagtatggaagggcggtgtacacatatctgcaatttacacagaaatgcatcaaaaataaggactgaggccgggcacagtagctcatagctgtaatctaagcactttgggagggtaagggggatgggttttgcttgaggccaggagtttgagaccagcctaggcagcagggtgagacccagtctctacaaaaaattaaaaaatcagctgggcctgttagcgctcatctgaagtcccagctactcaggcgaatgagtcaggaggattgcttgaggcttggaagtcaaagctgtagtgagtgatgattgagccactgcactccagcctgggcaacagagcaagaccctgactcagaaaaaagtgtacaccaatgttccatggcagcattattcataatagccaaaaagtggaaataaatcaagtatccatccactgacgaatggacaaacagaatatagtctatccatacggtggaatattactcagccataaaaataagtaaagctgtcaggagttcgagaccagcctgaccaacatggtgaaaccccgtctctactaaaaaatacaaaattagctgggtgtggtggtgcacacctgtaatcccagctacttgggaggctgaggcaggagaattgcttgaacccgggaggcagaggttgcagcgagcagagatcacaccattgcactccagcctgggcaacaagagagaaactctgtcttaaaaataaaaaagtaaagttggccgggcgcggtggctcaagcctctaatcccagcactttaggaagctgaagtgggcagatcacctgaggtcaggagtttgagaccagcctggccacatggcaaaaccccatctctattaaaaatacaaaaattagccaggcatggtggctcacgcctgtagtccctgctactcaggagggtgagacaggagaatcgcttgaacccgagtggcagaagttgcagtgagcagagatcacgccactgcactgctgcctgggcaacagagcgggactctgtctcaaaaaaaaaaaaaaaaagagtaaagcccggacacacactacaacatgaacaaaccttgaaaacatgctaactgaagaagccagagagaaaaggctacatattatgattttattcatatgaaatgtcccgaatagacaaatccatagaaaccaaaagtagattggagctttctaggggttggctgggaggagtaagaatggggagtaactgttcacgggttcatggagttcttttttttttttttttttttgagatcaggtctcactctgttgcccaggctggagtgcagtggcacaatcaggtcactgcagccttgacctgctggactcaggtgatcctcccacctcaacctcctaggtagctataggtgcatgacaccacgccccactaatttttgtatttttttgtagagacgagattttgccctgttgttcaggctggtctcaaacacctcagctcaagcgatctgcccatttggtccaactaaagtgctgggattacagggttgagccactgcacctgggccagagtttctttttggagtgatggaaattttctaaaattgattgtggtgatggttgtacaattctatgaatacactagaaaccagtgagttgcacactttaaacaggtagattgtatagtacgtgaattatatctcaataaagctgttagagatattaaatatgtataaataagaaaaaataggaatgaaataatatgctatcatttgaaaaaatgataacatgttatctactctggcaggatattcaagaaacttggtaacagcaatagatgaggtggaagaggaggctaggaagaagatttaattttggtatcatgttcaagtactcctattcaaataagttaagtaactcatttttttttaatttggaaagcaggtctggcgtggtggttcatgcctgtaatacctgcactttgggaggccgaggcgggtcatcacctgaggtcaggagtttgagaccagcctgaccaatatgatgaaaccccgtctctactaaaaatacaaaaattagccgggcgtggtggcatgcccttgtaatcccagctactcgggaggctgagacaggagaatcgcttcaacccgggaggcaaaggttgcaatgagccgagatcgtgccatcgcactgcagcctgggtgacagagcaaaactccgtccaaaaaaaaaaaaattggaaagcaatttgggcctcgttcctgcgaccacagccccaacctgggtcgggggtcccagtgaccttacccctccctgcagaccccaggacgggcggtcttcagggctaggcgccctggctctgcaagggccccagtctggggtttggctcacctgtgcctccgaaaaccaccaccagtttcttgtccaccatgaggacgagaatgggacgaatccggtccagagatctgggggtaatgggaggcgtggagttgggggtggggccggggttcccgccaggagcgacaaaggacacccccattgtctatgcatcgagtatgtgtcgaagggggcggctgggcccggagcggcaagacgcctgtcccgagatatcggggtcccgcgacccacctcgtgtcccttgggcccgatcccctcctccttcccgcctcccccggttccagtcacccgccccccggcccgggtcccaccggctggagtgacctcctcgccgcggcctgggcgggacaagttccaggagcccgggaccccgattctgcggccgagtccactgcagaggcggggatggagctgcgcgctaggcgccaactccctccccgcagctccggccccacctggcagagcgccgctcacggaagcccagcgtcggaggacccctggctgcagccgccaatcccgacgtgtcggccgaaacccctcctccggcgcagttggctcctcctggatcccgcgggactcggcgtcgtttccgggtttgcccgccccaggcacgtgcacagtgagtttgtgtaaatccagttagaccaaaatgagcgaggtggagagcctcttaaccggatgctacgggtgatgactgggaggaggagaaaaattacctctttatcttgcatgaacatcttaattttcaggtattgggcgtcaggcaaagataattaaagctatgtccatgagtctta

SEQ ID NO: 861 - DNA, 30288 bp, Homo sapiens
aacaaggctgcaatgaatatctttatttattggtatggtagaaagttcacactagaatatgaactcttttaaaaagcaggacacaaaattgtatacgaagtaagcagaaaacatgtatggcatgtattagcatattcatattctgtgaacatttggaattctgtattcaaaatctattttgaccattcccaagtgattttgaaggtctttggcatgtcataatttgttattttgtcaaggccagtgtttgggtgtgagagtggtgcacagggcaggagtgtgtaactttgttaggaagtgagcctagccacaccctcctgagtcactggttctttactatcctggggtaggcaatatcttttgttcagctgataaaagctttgtcattgtgaagattggctcccaatgataggaaactgctggtgatgaaaataaaggggtcttaaagattattctcagccagaaaaaataagtgttagacaaattaaatggaaaataattaatattttagtagtctttacaatttggaggtctaaggctctgtcagcatgggttctttaaggtcaaggatctaggatacacatgcacaggaaaaaagactggaagtatgctaagcagtgactatctctgaatgattgtgaaaaaattttaggatgaataagcagaaaaaaacaataaatgacaaaatataacaatggagttttcttgacaatgaaattctcttaaacttaaatctctttaattaggcaggtaaactattttatcatcttcgtttgacctggcccttcttttcaatgttaacagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataaggtacacccctttgttcccagaggcgctgcaggtttaacgcacaggggtcagtgcatgcatgtggggcttccgtagcggggaagcaagacttaactgaggttttggctgccccaagatcctgtcactcactcaaggcaagcacaagatttgcttctcttacctctgtgcgcaaagggagaggccaatttgaattatgactaattaacataaattttaaaaacaatacatttttctctgccaaggttataaacgttatgtgtaaatgaaaccagtccctgacagttccagtgttagaatttcatgctggacattttcctcttccaacagaatcttgctgtctacctagtataggggcagacaaaaaaacacgtagactgcctttttttttttctttctttttttttttttcgagaccgagtctcgccctgtcgtccaggctggaatgcaatggggcgatctcggctcactgtaacctccgcctcccgagttcaagtgattctcctgcctcaacctcccgagtacctgggactgactacaggtgcacgccaccacacccagctaatttctgtgtttttagtagagatggcgtttcactgtgttggccaggctggtctcaaactcctggcctcaagtgatctgcctgccttggcttcccaaagtgctgggattacaaacatgagccactgcacctagccacaacttgatggattttcatgaactcagtacccccatgtaacctgcacgtaggtcacaaaatatatttatcaggaccccagaaaccctccttctgccctgccagaagactacctcaatacttatgggcaaccactgccctgatttctaacagcttagatctgcttagatttgtggggtttttttgtttttgaggcagagtcttactctgtcgcccaggctggagtgcagtggcaccatcttgtctcagtgcaacctctgcctcccgggttcacgccattctcctgcctcagcctcccgagtagctgggagtgcaggcgtccgccaccacgcccggcaaattttttgtatttttagtagagacagcgtttcaatgtgttagtcagggtggtctcgatctcctgaccttgtgatccacccaccttggcctctcaaagtgctgggattacaggcatgagccacagcacctggcctctcttttttgttgttgttgttgttttttgagaccaagtctcactctgtcacccaggctggagtgcggtgatgcaatcttggctcactgcaacttccgcctcccaggttcaaatgtttctcctgcctcagcctcccgagtagctaggattacgggtgccagccaccacgcctggctaattttttttttttttttttgtatttttagtagagatggggttttaccattttaaccatgtaggccatgctggtctccaactcctgacctcaagtgatccacccacctccgcctcccaaagtgttaggattataggcgtgagtcaccgcacctggccgtgtttttgtattttatgtagatggaattgtatggtatttgagtaccgcctaggtgaaaagctgtttttttttttgagacagagtctcgctctgtcgcccaggctggcatgcagtggtgcaatcttggctcactgcaagctccgcctcctcggttcatgccgttttcctgtctcagcctctcgagtagctgggactacaggcgcccgccaccacgtctggttaattttttgtatttttagtagagacagggttccaccgtgttagccaggatggtctcgatctcctgacctcgtgatccgcccgtctctgcctcccaaagtgctgggattacaggcgtgagccaccgtgcctggcccgtgaaaagcatttttaagcacctgtgtctgcctttgcactgtgctaggctctgaggaaaaggtaagtgggccccacactcgcagcattgtggtctctagcatgtctcttagtgaaatggggatgaggctggtaattggttcacagttgtctgagtgtggaacgagaatgaaatcatgttgtgaattttctagcagtatgcctcagtgccaagtgatcagtcggtcttattcacaggtgtgctgttcggagggtatttttggttagaaggattaatctttttttcctgagattaaaaaaatgtgttttcttggcctggcatagtggctcacacctgtaatcccagcactttgggagtctgagacatgaggatcacttgaccacaggagttcaagactagcctgggcaacatagtgaaactccatctgtgcaaaataatacagaaattagctgggcatgatggtgcatgcctgaagttccagctactcagaaagctgaggtgggaggattgcttgagcctgggaggtcaaggttgcagtgagccgtgatcacaccaccgcactgggtgaaagcaagaccctgtgtcaaaaaaaaaaaaaaaaaaaaaaggctggaaggcctggcgcagtgactcatgcctgtaatccccacactttgggtggccgaggcaggcggatcacttgatgtcaggagtttgataccagcctgatcaacatggcaaaaacccatctctactaaaaatacaaaaattagccgggtgtggtagtgcatgcatgtaatcccagctactcggtaggctgaggcaggataattgcttgaacccaggaggcagagattgcagtgagctgagatcatgccactgtactccagcctgggtgatggcgactccatctccccctaccaaaaaacaccaaaccaaaaaagaaaaagtgtttccttgattgagatctgattgcctgattgccagaatggaggcctgtgagtctgtaccaagggtcagcctgttgcatgagcaccactgggcagaatgacagaaagtaatttcaaatccctttataattcctgtttcaggaaaatggtatcttcttcctttagaggaagagacaggagcaggagttggttaatgtgtttattcatgggttcaaaccaaatcagcaggtcaactgaaattagaactccagtgctctgatgtcacctttttggggactacagatgcccttcaccattgcagaaaaatgcatggaggatacacagagaattttgatccaattcagaggattcagtcctggacttcgggttcagaactcctaaatcgtcgtgggtctactctgcagtgttaaaaatacaataaaatcaggcacatttgtgcagcagttcttttagtgtatagtccttaatagtatgaaggcattgtgctagactcagaggactatagaaagttagagaaaacactgtaccagcctcaaaacaaacatcctatagatgttttgagagaatggtaccaccgcaggtaacagaaattacaatatggtcattgtttaagtctggtacgacacaggccctggaggtcttagaaagaagagagcttatttcctgattagtgttgggacagagctggaccttccgtcatacagtcaggaaatggtagttattggaagactgctgttggcaaggcgttcagtagtatacatagaatccagtgctgctcaaggttggtgggatttcttacagttacataaccactcaagttatatgcgatcattgtagaaaaattagaagatccagataagcatgtttgaaagactccccatttgaggtatgatcgttagatgtatgctctataatatcccattgtatgtgtacaccacaaatcatttaactgatcctttgcaggtggtatttcagtaggcagagatgggagggtgagataagaaagtttgtttgaaacaggcatacagtctttagtgttttctgtctaccttgaagtcttaaacatacttcgtacaggagtcttattaaaattaggattcctggctcctggctgggtgtggtggctctcgcctgtaatcccagcactttgggaggctgagatgggcagatcatttgagcccaggagcttgagaccagcctgggcaacatgatgaaaccctatctatacaaaaaacttaaaaaaaaaaaatttagctaggcatagtgttgtatgcctatagtcccagctattcaggaggctgaggcaggaggatcacccgagcctggggaggttgaggctacagtgagtcatgattgtgccactgcactgcagcctgagtgacagagtgagactcttatctcaaaaaaaaaaaaaaaaaatttttttttttggattccttgctcacaaagcttaaggcttatctgtggaaaatttgcttgatgagaaaagaataagcttataaaatggaaataagccttggaagcctgagtttaactttggtagcaccgagagaagtgcaaattcagacctttctaaacagtatggcagaacggctctcaagaacttgcaccacattcagtgggattttcacgtttttgagcccttgactattttggaagtcaatggactctttcttagaatgtttttaaatgcctgaagaaaattttaagagttacaaaggaagtccactttattgaacgtggttgtgtagcgactgggcatctccttctaaaggccctttgctgtctttgagtcctgcagcccctcatgctgtggtggatgattgtaggcattcaatcaagttttattaacctacattaagggaaattttactttcttaattaagataaacattgatgagatggtagcatgttttctaccttgcccttttctggaaaacattgtttttatagaggtattgagtaatcagtgaagtttctatgaataagaacatgggaatattttctgacttattttttgtggaacgatctctttacagaagaaagatctgtcagatcctttcaatgacgaagaaaaggaaaggcataaagtagaggcccttgcccgaaaatttgaagaaaaatacgtaagatttctctcttgaataacaaaacaacctcattgggtgggagacgtttccacactgtattcctttagtggatcatcatgtaataaacactgatctggaagtaagccttaagcatggagagaagagaagcagttattaaacctaacgcattaaggtacagaaaaggggcatggcagagctagtgtgaagagctaactggacaaataaccgagaagggcctgtggtcgccttagaagaaatattttggtacaaagcataagaagccatttagttcatttttctgtcctaggacattttatacaggtacaaatatgttctatgttaaaaggttttcaggaaaggaggttttggggtttgtgtgtatgtgagagagtgactgttttagttagtgcattacctctttgagtcatagctgatgaagttcaaggccacagttaattctgtgtgtttattcaaaaagcatgtaatctattgctttcacattttagggtggaaagaaacgtagaaaagaccgaatacaggacttgatcgatatggggtatggttatgatgaatccgactccttcatcgataactctgaggcggtaagtagttactgaaaatgccgtgtcagacccactgtacctgtagctcctcctgatactgaccaggaagctgggggtggggtcagagcagtcgtgccctcttcccagcatgaggcagtagcagcactgatgagagacgaaatgacattctttatccgggtcttagttccctcttcagaaagtgatgaccagatctgtccaaaacaccttgtagctcagacattcatgtttgaccagaggatgttttagcatgctcttggaagtggcagaggagcacagtcacatctctctcgagacccactttgcaccttcggactgcagaagcagaacttggagctgacagtttgtttcccatcttcagtatgatgagcttgttcctgcttctttgactacgaagtatggaggattttacattaactcgggaaccctgcagtttagacaagcatcagagtctgaagatgacttcattaaagaaaagaagaaaaaatctccaaaggttagaatgtgcttgcttttggatttcagaaatgctttttgacgtgaccctatcagatcagtaggtgacttgccagaatacgtggcgcttggccggctcaggaggatggtggaaaggcagagccgtgccaggttgatggctcgcctcttacacgtgtgccctaatgaggacacgtgcccgtgggggctctgttcagcacttggtcattatgtccatgtcacatgacatcccagcaggctcagcaggggtcgtttctggaggtggcctcagggtgggaaggctgtggaatgagggaatgtgtaccactcttgctgaccctcttctgtggacatgtagaggacttcagtttcagggctgccatcccactgaaaaccagtcagccttaggatcagtgtgtttaaaaacctgtctaccactgcctatgtgtttaagatgagaggtagggcccacttgtaactttcaaactacaaaggtttcaggctccagaatggtcactgttgtctcagccctgggtgtttccaggagacaccgtcggtgggaatgctgtgggtttgtggtccagggactgatctgagagcttttgttcatgaaggaaatgagacaggtctcaggatgtgccccgggcggagcaaggccagtgccgtgtagtgcacttgctccctgagttagggagccgtgtaactgtgccttgtctttaattctcagaagcggaagttgaaggaaggtggtgagaagataaagaagaagaaaaaagatgacacttatgacaaggagaagaaatcgaaaaagtccaagttttccaaagccgggtgagaggcagcagcttctttgctaggataaagcctgaactgttagggcaggacgactgggagctgactcacctcctccccacagcttcggaagaggcagcagggcctggccttcctgtcctcccgcacgcctcccgcagtgccattctgggcatagacgctcacctctcagtgtgtcagatagttccactgtcagtgttggcagctattgttgtcactgtgtgactgctgatgtttctcgtcctctggggtgctcctctctgccccagttctccttctgtctccgctgttttcccttgttgtctatggtcatgcttccttctcctcacttggtctcaccccagcttctcttcaagttgctgctgttctctgctgctcctgctttctccctctaaatacttttcttgctctccctgcccctttttgcaaccttttatttcagcctggcagtggtttctaaaaacccgtcggaaatttagcatatgtgacactgtgttgctaacctgtattaactctcaagctttggtctcagcaagaacgagctccatatgccaagaggagggaggaggaatgacagggtggactgtgacaggttctcctggagaccatgaccctgggagcaggggtgaaggcctctggagttccctttggaggtgtcctatagtctgagtgaccagtttccctcttgcttgcagcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagctcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggtatggtggcacagtgcggctgggctttcctggaagcagtttgggcagattgctgttggttctgcactgcgtgaagcttgcccagagaaactcttagtgagttggcagttaaggtgtcagctttttccaaaccctattctcatcctgagggagaaaacagtgtaagccttgcccgtcaggcatcattttaggcctttcttggtttcttcatttctggaaaatttgctttcttctggggagattgttctctttctgttttctgtcagtttgttttccacacggcatcttttccttcatgtgatagacggatgatgttggcagcaggcagctgaggcagagattaatcttagaattcttacgaaggttttgcaaattcacaaaagtttgtaaacatacaagttacacgtagagtagatgcttcgttgccactaggtttcagtcgctcccttgcgttgtgtatccagtgttaggtagtgattacaggaatgcctcaaatgtgatgaatgaaaagcagcttaattttaaatgctgtccatgtcccattaaaacccaccatcggcagggtgcagtggctcacgcctgtaatcccagcactttgggaggccgaggtgggcggatcacctgaggtcaggagttcgagaccagcctggccaacatggtgaaaccctgtttctactaaaaatacaaaaaattagctgggcctggtggcgctcgccgtaatcccggctacttgggaggctgaggcagcagaatcgcttgaacccaggaggcggaggttgtggtgagtggagattgcgccagtgcactctagcctgggccacagagcaagattccattaaaaaacaaaccaaccaccattaccacctttaggatctagcagctcttgctgttttactccagtgattgggaattaagcactgagaattgtctgttcaagtaacacatttctaactgtaaactaggcatggatcattggttgtaatatcatttacctttaagttaaaataacattttaccttaagcatcaggacttgtgatgcagctctagtggcagtcataatctacagctgtaggttttaaatcagtgattcttacagtatttcagaagcattgttacctataatatcctttgtgttttagggcagggtaaattgtcagctactgctaaaatgattttctcacttccaaaaaatatttgaacaccatatacaaagcaaataaagtatctattcaaagctctacctcatctttgtcagcttgtgtccagcattggaaattcaagtattgtatttgaatgtaatgatttaagtgaattgtaccatgttggggtttggagtatctcttagtatgacattgaggtggaagtagctgaatctgaacttggtgtttttgagcctgctgtcctatatttgctctcagaattcatgttaaccaaacattactccttgttctttttaatcctctggttcgtaatcaaattgtttcttagcttctgaaagtcttgttaaatcatttaaggtctatgtgacgatagatggtcgttagagaaaagtcaaaaccagattcttggctgtgtccccactcgtgccataggttgtgttctagtgtgaaaacttactgtttcactttcttgggaaagatggggacagatttagtggcaacagaatgacataaccggaaacaatgttgggctgtggtgcaagaaagcggagctgagtaaacaccttgttaggcaagctgcccctcctcagtgattgccaagtgtcagttagctcttgggcataacaaacacagggttcaggatcccatagtcaaggtgggcctgggtcccagtggggagctggtgaccaggagaggctgatgttctggttggaaaatacagtattcaagtgtgaagttgatattcgagtcttcacattgcccttctcctataacagcattaagaaactttgaaaaatggggtggaaggtgtatggaaattatccatccggccaatataaaaacaatttctagttggatattcttttctagcctctgtgtatatgtttttatgcagctgtaattatagttgtgaataactgttttctgcctttttacgtaatattataaagccctcatgactttttatggttgcattaaaaaggtggcttattttaaaaagatgcttaatgctactccgaagggtcctcaggtgcgctcttctgaccagggccctgcacttggggcacttggagtccctgcatgtgtgtgcaaatgctcaggacccctgatcccactgagaatctgctgggaaagatagtcttcccagggaaggaatgcactggtatactcaaattgcttatgattccaaaagccacatgtggatatttgatatttggatccttaataaggggtccatcctagatcttgaaatggacatcgcatttttaaaatttaaagtaaacctgatgtatgtaactgggacattagcagtgttacgtgtttctcactttattttttatacccctaattttcccccccttttccctctattataagattgggtagactttacatcttggccctaggtgacacacaaatcagtttctatcactgtctgcaaaacaccccccaaaatttgccttgtcatagcagttcgtttctcctgactctgggccaacgctcatggctgcattcagctggcaagttggccaggtgctggcagggcttttctttcctggcctttcatcctgccttcttcagggcttggtggtctcagggcaacatctcaagaggggaaaggtggaagctgcagggcccttgagagctagccttagaggctatgtgtatcacatgacttccagcacacttttggtcagagcaaatcacaagagccgcccagatccaaggattagggagctagggtgcacctctttgggaggagaatttctttgtgggaggaatctgtgatcctggtttgttgttgttgttgcctttttttttttttttttttttttgagacagagtctgactccatcacccaggctggagtgcagtggtgcaatctcagctcactgcaacatccacctccgccttctgggttcaagtgattcttgtgcctcagcctcccgagtagctgggattacaggcgtgagccactgcgcctggcctgtgttcctgttttgtattctgccacagtacatagcagattcttatcccatgtgtattgatcccttaggggaaaaaactctgggaagcaaaattagatatatcttctaactaaatatggtacttaaaactttaaaaaatgtctttgaaaacttgtgtatgttaaagaggtcctctgagagggaaccttggtgatgcctctgccacgttcactacattctcacatcagcctgttttttgttactgatttgtattgtacatttgtataggccccagggaatccagtgatttgatggccttaccctgccctctgttaatatgcattgatggtgtcttttgtcttggttgttggcaggtacaggtgctgacaaagctcaggtttgatgctcctttgggttattgtcttgaggtagtttgacagctactcagccttgggctggacaaataacccagatctattttggttctctttagtcaagcataacatagagacaatactaagagcaggaatcaaagagaccccatgtcacccattctgctctgccctctatagaattagaacccctcatcacaagaagtgcagggagagatggatccaaagagaataacgtagggggaaaaaaaacgaaaacaacttgtttgatctttttaaaaaaaatcatgcccgattttctcctactcagcaaaaacagatacagtatataagattttgagctgggtgctaaaaggctacaggtgacttttcttagaataaataaaacagctcattaaaaggctgttggaactcttataaatcagcatgattgggatgtttaacctcatttactagttaacttaggattgattaattcacacaacttctggggtaagagtgtctctttttaggggtgagggaccccatttatttttggaagactatcagatatatatccaattgctcttttaattagatttactttaaaatgccgcagtcgactcttcagtataaagccagaccctcagagatattgtctatgcaattcaaaaggtttacagaaaagtactttctaaaattacataatattatttaaaatatttttaaagattgcgtaaagattacatagaaagcttctgaaatattgtacaagtggctatctaaacagaaaatttggcagggcgcggtggctcatgcctgtaatcgcagtactttgggaggccgaggtgggaggatcacctgagcccaggagttccagaccagcctgggtaacagagtgagaaaaaaaaatctaaaaattagtcaggcgtggttgcgtgcagctgtagtcccagctgcttgggaagctgaggcgggaggattatttgagcctgggaggtcaaggctgtatgagctgcgatcacgtcactgcactccagaatgggtgacagagtgagaccatctcaataaaataagatgctgggcatggtggctcagcctgtaatcccagcattttgggtggctgaggcgggcggatcacttggggtcagatgtttgagaccagcctggccaacatggtgaaaccccatctctactaaaaatacaaaaaattagccgaacatgggggtgggtgcctgtaatcccagctactcaggaggctgaggcaggagaatcacttgaacccgggaggtggaggttgcagtgagctgagatcacgccattgcactccagcctgggcaacagaacaagactccgtctcaaaaactaaactaaaataaaaaaataaaaaataataagataaaatttgattggaagtttaagctgtagatgggtctgaaagtgtggcatgtgaaatacatgttaattagtttgaattaatgtaagggtgcttctcgatcttaaaactagcagtgtaagcttaagcaaaaaaagttcagttttattttttcccagactaatataattctagtaccttccaagtgctaaggtagaattctgaatgtttccaagagtgtaagaaattggcacatggctgggtgaaaagtcatgccctttttttccattattcgtctgtggatttcacccctctgggctttcacctagccaagggatctgtagaagcttgagttttgcgcattttcttctgacttagttttggttgtttggtgttaagcttttcttcctgtggcgtgccgttttacagtagtatcttcatttgttgattcattcactcagtcaacatttagtaaatattatgtgacaggcagccatgggaaatatactgatgaataagactcagttctatattttattttattattattttttaagacagggtcttgctctgtcacccaggctggagtgcagtggcacgatcttgccttactgcaacctccacgcccagggctcaagtgatcctgccacctcagcctccagagtagttgggaccacaggcatgcaccaccatgcccagcttttttttgtatttttagtagagacagggtctcatcatgtgcccaagctggtctgaaactcctgagctcgcgtgttccgcccaccttggcctcccaatgtgttaggattacaggtgtgagccaccgcgccgggccaaggttccattcttgtctttcatgagctcgttacataaatggacccgatagatacgcagacaatggactgtagtacagagcagaatgaagtaagctttgtgatgtgtggacggccagatagccggacttaaggggttaaagagaggctcttggggggcatataggaagcagactggaggcaacaggcttcgccggcctcctggggaagatgccctaagagaaggcagggagcagagctgaagatgggcgagttggtggatggctgggccagatcgtggaggaccccaaatgccatgtgaaggagtttgggtttgataccaggcttggaaagagctgctgaagggttctgaagaagggagtggcggtcttaaggttggagtgcaattattagaagtggggaacacaggggaagagcagaagccagtgggtctggtgtaagttgagtttgcaaaccagagggtcatccatccacagaagtgcagttgacccttgaacaacacagggtttaactgcgtggatccacttacacgcagatgttttctaaccaaatgtgggttgatttgagggatgctaaatctgtgtatagagggctaactttttgtataggcaggttcctcagggctgactgtgcagttggattttggtatatacgggggtcctgtaaccaatcccctgcctataccaggcgttgactgtaattgggaaatttctcagagataactggaaattctggtccagagcttagatgagaggatttagggcttagtttagatttgagtgtacaattgtctgtgttattttgaagccctgagggggaaagaagttattgggagaagtgggttctagtgagaatcctggggtccgcctatggaaaggagctggtggaggaggcagatggagcagttagagtggttggaaggggccccagaggatgcagtgagaggaaggtgagtgggggagatgatggtgaggggttagcagtgtctgcaatttcagaggggttgatcccttcattctagatagtcaccttatcacccttgtttgctgtcgttactgtatatcatgtctgatttcagaaattttatttcacccaaagccttcagaccagcagctcttgggttgagaggaatggttcccagccctttttgcacatcagtgttcccagggttgctttgaaagagtacttgggccacttttgagagtgtgcattcctgaatctcctttccagagactgtgatttgaatggcctgagttgctccaagctgcccagggaattccaatatgcaaccaagtgtgagaaccctgatgcagacttccacagggtctgcttttttgtgttcccgctgtgtcgtggctgcctgccgtggttgcttcaggggtctctgagcttgccatccagggtgtgtgttaactgtgttcttttcgaaagcaaactaagactgtactgaaactcctataatctggtgttaataggtaatatggtgggttaattattcacatggtctggctaatagagagctcgtggtataccataagtagattaggaattgtcaaagagttttaatgtccttaagtgttagagctacacattattattatttttgtagataaaaaggcctttaaatcctatagactggttgaagttcttgaatatttttgtactgtagatacatggaaatcccaactaatggtgtagttgatggtgtatgggtgcaggggttagttggccttattggcctctggctaagtgcattgtgatggctttgactctgattttcttttctgtgactgttttaagtcccaggaagaactggcagcccacagatgctgcagcagcatttgaaaagagaatattgatcgcaggcgaacttaacctgggactagggtggagttggaaaggtggcggtgtgactgtattgacaggtgctctttatggagcgatgactcctgtgcctgtgggtgagcgtaagggacatgtggggaaagtgcactaacggctgttactgtctgctgtgcaccaggctgccagagctgctgagggggagagcagacagaagttcttcacccaggatattaatggaatcctattagagtgagtatcgtctgtctgtctgtctgtctgtctgtttctgctattactgagcttggggcaagccagctaggggacagtgggagtacaattgaactgcataaaggtgaccaccaaggagataaaagaagaattggattaacatggtttcattgttatttttcttttaaaaatcaaaacacaacagggacaccaagtacttgtctccagaagcgatagacctccttgatcttaggcagcaggcattaataacatgtgataatcatggcctgttagaagaggatttcttggcaggtatgagatgaggagagagagaaggtgttgcctgactgtctctgagaatcctgaagaatgagagacagcctggtggcctcgggcctgctctgccttgggtgttgcttggcgtccctggctgttccgctcgctggcactcctgttcctagtgccacgtgcatcatccctaatgctgttcccacatgcctgagcctctgagacaccacgctgtgtgaatcgggttaaaaaacagatgagcaaacatttgtaaatccagactgggaaaagtgaatccttgtggcctggcctgcagtgttgccgcttttctcctggttgcagtttgtggcaggggaagcttgttgctcaacagctgaggagtttgtgtgtgtaagaacagttgtcaaaatgtgggtgttctaccacatggcctcgcctggccgggacctggattggccccttgggtcaggaagtgtgagctgcagagagcacctgagcattggtgcggacgataggattgtgtcaacaaggaacctgcttgagcgtgccaaatgtggacagctcaaggcattgaagagaaatatttttttgcttatctagatggagaaactggaggggtgaggctttccctgacctcataatggttgataaacgtggggactgggggaaaaaaaagaaatgctgccgggaagtgtctcctttgaaccccaagtaactcatgactttccactttgaaagctttcatgttttctctatgaaatttagtgcttcagagcttgttctcctgggctctgttttcctggtattgtgacctaagagccttggcccacattacctagccatgttcatcaggcttgggagttgttgttgtttgttgattgctgaggatgtgtttccttgggcattcagttacattgtgtgaccaacaagacagggtttgactgccgttggctcctagctttcctctccacgtacggtgagctgatgaagacaggagttgcagtgagctgcagccggtggtgactgtgttttgttcttcagcatagaggcgcagactcgggagctgagcagtcaggtccgctctggggtgtatgcctatcttgcgtcattcctgccctgcagcaaggatgccctgctcaagcgtgctcggaaacttcacctctatgaacaggtgggtgactctagagtgaagccctttggctttggggtcctggcggaggggtgactgagtcttaagcaatgatgcgtctgctgccccactgcctccttgtgatcaccccatcatgcgtcctgagcgtaagagcgatgtgtaaacctgccttgaattgtgtcccgctcttcgcaggggggccgtctgaaggagcctctccagaagctcaaggaagccattggcagggcgatgccagagcagatggccaagtaccaggacgaatgccaggcacacacgcaggcaaaggttgccaagtaagtttgtcctggcgcttgcaggtgcaaccctcccgtcttgcctcttcccctcccgtttctcggtgtgtactgccgtttcccaaggagcctcttggctcttctttggccttttctccttctctgtgaagtcccagtagtgcagagtgaggggagaggcggtgggcaggagcaccttggggccccatgtaattctattcaccccgtaggatgctggaagaggagaaagacaaggagcagagggaccggatttgttcggatgaggaagaagatgaagaaaaagggggcaggaggataatgggacctcggaagaagttccaatggaatgatgagatcaggtgtgcccacactgggacttggcctctttggagggttggtggggcagtgtctgagcacgtcccctattgctgacaaaggttaggctcatttactttcatcagggctgctgaaagcacatgattggaaccttggagcagcatctgaagtagtttggagtttctgatttctgcctccttctcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccaggtgagggccgtgtgctgagatgggcatctgtgcagtcaagacacgtttgaacgctgcttttgtgccaggccaacaggatccttgctcacagggagtcactgtctagctgcctcaactctgatctcacctgagtaactgggggacatgcaggtagctgggaaagggtcttctggatcttccctggaggaagggaagttgcctccagggttttgtttttgtcattttttgtcccacttcagttgatgtttggcctcccatctcaatatgcactttccttttttttttttttttttttttttttttgagatggagtctcgctctgttgcctgggctggagtgcagtggtatgatctcagctcactgcaagctccacctcccaggttcacgccgttctcctgcctcaacctcccgagtagctgggactacaggtgcctgccaccatgcccggctaattttttgtatttttagtagaaatggggtttcaccgtgttagccaggatggtctcaatctcctgaccttgtgatctgcccaccttggcctccctaagtgctgggattacaggcgtgagccaccacacccggccacacttcctgttttaacatacaggctgctatgagcatttgagagatgggttcatcttgggtctttcctgatgttcctgaagaagtgtcatttgcaggtagcagggctgactccttattggaactaagtgccaggcttccatctcagaggctaccttgtacgaagtcacttcctgcgaatgaagtatttgtgtcatacatgggacagagaaagttagctggagtgattttcttgattggactcgaatcatctgttgtgcggatagatcttggaacctttgaaattgctgtcctctctacgtaggctggactcatacgaagaacgtttttgttgagtttctctggacaaagacatgctgggtcactccacattttattcctggaatggagggactaggcaataaggaaagtgctgtgccctttagggaagcatcaccatgagaggtttgaggcagagccatacattttcttggtaaaggccagactcagcctttgggcagccagtgtgtcccattgagatcctctcaccaggaatttggctccccaatccattgacctttttttttgtgtgtgtggggggtgggtgggcatggtgggggggcggggacaaagtctcactctgttgcccagactggagtgcaatggcacgatctcggctcactgcaacctccgcctccccggtttgagcgaatctcctgcctcagcctcccgagtagctgggattacaggcgtgcgccaccacgcctggctaattttagtatttttagtagagacggggtttcaccatgttggccaggctggtctcgaactcctgacctcaggtgatccacctgccttggcctccaaaagtgctgggattacaggcgtgagccactgcgcctggccagttgacatttaatgagggatagctactgaggaccagggacactagcaaagttctggaagcagagtcccagctttctggggcatgtacagatgcctggtgttctgtgtctttcagaactctgtttaaggagagcagacgaggccatgggcacctgacttcaatcctgtgagtgtcttggtattttcacatctcgggacaagtgttgtttttggtctcctctggatattctctaaacttttctgtgctcattcctttgaacagggccaagaagaaagttatggccccttctaaaatcaaggtgaaggtgagtcagtttgctcgggtcacatgtcagctatgcccatctccctacaactatgctctggaaacagtcaagtgactgtggaagctcattgatctttgctcgtctggggacagctgctcaggatgacattcttgaagtcataacaggacagagacccaagccacttaacccccctctagccttggttctacaaacagtacccagctggcccagttcctggggttcatgtgggattaagtgggatcttcttggcagccctctgaggagtcagtagtccctgaaggtgtgaacgtgttacactgtgatctttgtatggaagaaatacactctagccaagtgcagtttagcttggagccacagcagaaagaaaaggcgactttactgagctaccaggcagaaatggagggcaatatagtggctggagaatagacactgtgaaaattaccttagatgttgcagaaacctctcaatgtagtaaaaattgctgtttatcaacatttttcccagttcttagtgtggtgcccttagccatccctaagcagaccgtgagaatgagatgtgcaaatcatttactcctaagtatctgttgagctcccacaatgtcccagacacactgtattaagcaccagggatgcaggagtgaaggattagaccccattcctgttcccatgaaaagctcactcttctttgaacccagtctgaggagatgggtgctgggaaaaatcaagaagggaaaaatagctgctttaaggcaattctcatgccatgccttggtctgattgcagctaggagtgcgctgagacagtgggaatgccagtaggcagagtatctcttcacgagagtcttaacgcttttcaaaacagaagaaagtttctcctggcggcttgtttgtacttagcaacgaagcatgccggggtaaacccagccctggccaaccagatactcaccaggggtgatgaagtcatggcatctaaagtcaaggcgggcacagctcctgctctgtcccaccacttgtcttgtaattatacaggaaggcccagtttttttgactcgagttcacatgtttgtatcctcacaacaggccaatgttggcatctttggacctttctaaacatcaacatttctgttttcctttaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcagtgagtatctgtcatagcagcctgccctgccccactcacaggggccttggggatgaggttgcttgccttgccccgggtggagagtgagatctaaaaccacaggtcaggtaggaacagtgggctcagacgtaggaagggagactgggctccctgttctcaggtattcacttttctggtgacaggaagcccaggatggcctaaagcttcttctgaggagggcagagggacctaaaggatggccagcaccaagcaccatgcctcttcggaggctgtctgtgtggcacagaatgagcaacagcccttgccttccgtgaccccttgcctctccatctctctaaagggggctggaaatgctgtcttctatcagttgagtcatgtggaggtgttcatggaccaggaatagcaggaccttctaagagtgattctgttggtttttgaaggacagagtccaataattaatgcatctcgcttgtgtgtaatcacagcaggttcgggaagagggagtgagcattttcttttctttttttcttttttttttttttgagacgaagtcttgctctttcaccaaggctggagtgcagtggcgctatctcggctcagcgcaagctccacctcccgggttcacgccattctcctgcctcagcttcttgagtagctgggactacaggcgtccgccaccacgcccagctaattttttgtgtttttagtagagatggagtttcaccatgttagccaggatagtctcgatctcctgacctcgtgatctgcccgcctcggcctcccaaagtgctgggattgcaggtgtgagccactgcacccggcctctttttctaatatataaatgaagtggttgcaaagacaaaaccatagaaaggtctgttggaggtctcacctcctttcctgcacccaccacctctgtaaggtaactaagctctttagtttctggtttattttcctctttttaaacaaaagattaataaatataaataaaggtatatatgtatgtgtgtgtatgtatgtatataaatatatatacacatataaatatccatgaacatttatggatatctatattacatttttcccttcacaaaggaggctttttttttttgagacagagtctggctctgtcacctaggctggactgcagtagcgcgatcacagctcactgcaacctctgtaggagacatatttaatatcctgcttttaaaaaaattatgttccctggaatccattccatgttggttcataaagactgtcctggatcctgtctttggggctgcagggtcggagggtgcctcccagggccatctgacatggatgtgtatgtcctcctttgtggacacacaaggaggatcctttgtgttgccaggtttggtgtgagtgagccacgaacaggactggagttcttaccgcttgctgtgtttcttccctagaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtaagtgcttctttgctgcctctggtcactcaggaacctctagattgtggccaggggtcctgctgttgtgtactctggttcctgtgtttgagtctggtgtgtgactgtggggaacatctccgggaactgtgccaagcccccactgcccctttgggtgtggtgcccagactggcctggcaggttatcgggggcttttggctgctggagctgctttcctgttcctgtcttcaatgtgtgtgttttgttcttttctcccctcctgttttctctcaggtcttctggctggcttgcactccagcccgccccatgcagcgcctctcccacacgctgcggtgcccacccatatcccgcagagtctgccaggtaatcacccgacggtcagtgtgccacgcgcaccgtgtgcctttgccctctccacccctaggtgctttgccgctgccaagggtcttggtgtctttgccttgacgctgttgttgttttggtttgtcctttgaggctgtgctttgtcagtactcagggtgacacgcacttctactcttggggtttcctctggtccccacttggagctgccgccaggtcagcctcagcctgtgtgatcacagggaaagttgcggggggcagggtggtgcgcttttgtgtgcggtggaggagttcctaaccctcggcttgtttttttctcttcagtttaaaaaaaaaaaaaaagggaaggtaatggtgcatcttctccaagggctaattgggtacaacaaggtcttggaatgcaagctgctccactgtcagatgtgattgcttaacagaaggctctctaaactttgtttccattaaagggaaaatccaggtagcagccagaggccacagtgcaagactttgagaggagcagctttaaatctgtccaagtgtgaaaactccatcagaacagatttgtgggagcacagcaggcatgtggtcggtgctccccttagcatcttctgaaatagggaacttctaaaagcctcaggcttgaggctgctctggtagcacctgagaactgggctcaggtgccccgggttggtacctttgcattgagtgcgtctgcctcaccctatcccgagtctgcgattcttgggtacgcctcctggaattctggcatgggaagtctcatggtgtctcagctttgacctagcattgttcctactgtagacccgcttcagacatgaccagggtgctacttggataaggggagagccgctcgtatggaagccagccgaggtaaccctggcgaactggtgccaggtggaagtaaggaccctctgtgctgcacgtctcccaagttacatctgcctcatgatgtgctgtggctccctggcaccatggcgcattatagtaaacaccagaggccatatggggcaagactaaatctgtaaatctccacaatggaaactgtgcttctttgaggggctaagcctatagcactagtgactcctcctttccttgggaggagaagtaaagtgcagtgacttctctacagactagaggctgcagagccaccttggtgagagcaggggtctttccaaagtcaggctgccctgcctttgcttactctcaggaatgttactctcagaaaagcaaagtaattgaggccggacgcggtggctatcacctgtaatcccagcactttgggaggccaaggcaggaggattgcctgagtccaggagttcaagaccagcctgggcaacatggcaagaccctatctctacatttaaagaaaaaaattagtcaggtgtggtggcatgtgcctgtagtcccagctctttaggaagctgaggcagaaggatcacttgagccgaggaggtcgaggctgcagcgagccgtggtcatgctactgcactccagcctgggcaagagtgagaccctgtctcaaaagattgctttctgctatattttcatttttcctctgggtatgaaaaggctatcagaataggaagaataagtgctagtgttctataccactgtagggtgactgtagttaacagtagtatgtagtttcagttaggaggaggatattgaacgtcgccagcaaaaggagatgaaaaacgtttgagatgatggatatgctaataactctaacgtgacactacacattttagatgttgaaacatcactatgtaccccataaaatatgtgtcattattatgagtcagtttttaaaactgtttaaggctctcagaggctggatgtggtggcattgagaggcaggaggattgcttgaacccaggaatcagagggtatagtgtgctgtgatcatgcttgtgaatagctgctgtactccagcctgggcaacatagtgagacctcatctctaaaaaaattttttttaatcagtttaaaagttcgaggaaaaagaaaatcaatcagaaaagcaactataccaaaacagggttatccaagtgagcttctctcacttccttagatggacttcagcttataggatgacacgagatgcgagtaagaagctatttgcgcatttcagctgcgtgacttgtgtctgcgttgctttcctttctttcttctgtggactgagaatgctagtgcctttgaatttgtctttacaggacctgagggtcttttgatggtaagagaatgaatgatcattgctgccttgagttctgtgtgatcgtcaggcctcgcctcaggatggcaattgtagcctgagatgacgtagcccaagttgcacagcagagttgctgttctggaaacactgtgctgagtgaccaccgaccttcacagtgctagtgtgcttgcaggctgtggccaggagtagtgtacacgaataactgctggctggtgtctcatggcttgtttgagctctagaacactcagcatttggggacttttgctatttaggtgtctcccttgaagtttggttactactgccttaaggaaatcagagagcatgaaaaacttgcgttctaatttttcttactcttttccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgtctcctttttttacataagaaccaatccgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccacgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaaca

SEQ ID NO: 862 - DNA, 34453 bp, Homo sapiens
ggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaaggtgcgtgtcgttgtcgggtccgggctctctcgttagccttgccctagttttgcacttttgaaaaagttgtgacaacaggaagacagatgccgggcgtagtttggacactttaaaactgaaccatgaactgggaagtgttaactgcagttgagcgcagcgtcggcccaaacttcagcagaccaggtagaatcacaattttgcaaaagatcccagtcccgatcacagactccacagtgttaaggattgacttagacttggtgtcgggctcttgttgagtcactgccagctggcaaaggtggcgagtcgacacgcatttccccaaggcattgtggtggttagagatttcggttgcaagtcggtgtttagcgtactgggtcgtcccgcagcctgatttttcttgggagatcagtttccctgaagtaccaagaattagctgcacggactgtcatttactgcgtgtgtatttttaagacaaagtgatctttaaagcgtatttaagattccagggaataatttgataaaaatttaacataagttcctgtttaaaaattctgaatttgtgaggaattgaatgagattttaataacttaaataaaaacatgaatcttggccgggcagggtggtataagcctgtaatcccagcattttgggatgccgaggcgggtggaccacctgagatcaggagttcgagaccagcctggccaacacggtcaaacccagtactctactaaaaatacaaaattagccgggcgtggtggcgcatgcctgtagtcccagctacttgggaggctgaggcaggagaatcgcttaacccgggaagcggaggttgccgtgagccgagattatgtcactgcactccagctaggcgacagagcgagcgagactcgtccccccgccaaaaagaaaaaagaaaaaaaaatctcaaatgaacattgcaccaaaacctagaggcattccccttaacatcagaaacatggtacatttctaccactattagataataagaatatattgcctaaaacctgaaagttctagccagtgcagtaagacaggaaacaaaaataagaaatgcaatttttggaaaagggaagacagaattctcatttccgtggatgataggtctgcctattttgaaaacaaaaacaaaaaccaaaaaacccattaaaataagaattcaggaagggtactcattataagttggaatgcacaatttagtttttctgtttcatcaataaccagtttgaaaatacaatgtttagaaggagatatatatatatatagtaagaaaaaattaaaaattgctgaggataaccaagggacaaggaaggctagtattttctcagtaacaccaactgaggtttttaaagggggatctttgtttttttcttttttttgtttgagacggagtttcactcttgtcgcccaggctggagtgcagtggcaggatcacggctcactgcagcctggaccttcccagtctaaagccatcctcccacctcagcctccttagtagccaagactacaggggtgtgccaccatacctggctaatttaaaaaaaatttttttgtgcagatgaagtctcatcatgttgtccaggctggtcttaaactcctaggctccagcgatcatcctgccttagcctcccaaagtgctgggtccgggaagttgaggctgcagtgagctctcatggtgccactgcactccagcctgggcaacaggagtgaggcaactgtctcacaaaaaaaaaaaaaaaaaccacaaaaaaagctaaaatctttccaaggacttaggcaactctcgtaagtctaatagataaatgtaagttttttttaagcattcaaacatgtttgaacttaattatattttcttaagcattttgaattatgattgtaagtctaacgtaccattgttaaatatattggattctcttaaatgtttcaaatggcttagtaacagcagaacattataatgattataaaacaaccccaaatctaagtggtaatagagtacagatttgactcactttatcctgtagtcctattttttaccttcttgggcctggagagtcacttaagcaactgaaaggagcagttttgccatctaggattgaagctgcagtctctcagacttggactgagataaggttatgtgtttactgcctggacagggggagtaggacctggttgccaattcaaggatgaccttcctgcatcccattggttaacttgctgattcccttcttatagtgagactgttccggttctatcagtgggggaatctgtaagccttcagctgggatttatttccacaacccagcgcatcacaaatatcctgagggccttggagatttcttttagggaaatctcctttaacatcttagtacgtgttgggagatggtcttttgcagcgccagcctgttacactgctaatcgttttgccgcctgattagaattattttaactcttcatttgtagatattttgttcccttatgtgatgttataagttgattttgtgatcataattcgacaaatgaatattggatatatacaaatacgtctacatgtatgtggatatatacgatatatgctaattttcctgaattaactcacatttgtgattgatttacaaccaaaatacagtgagtttttttgaaacctgccaaaataatacataggctggaatggcaaagtattatttataaagaaggataataaacatgagctttaactttgcaacattaaagtatgaaactttacaaaacagtgcaatactgattaaagaatctctaaataccgtattaatatgacacatggacttcagaaacaggccttagatatctgtgatgttgctttgcaatatatgccaaatcagcagaggaaggaaggattgtttagtgattgatgctggaagaaaccaagttacagcctctcctcatactttatagcatagcaaattcatctggggttaatgaagtaaatgtgaaaaaatatctataaatgaccatataggctgggctcagtggctcacacctgtaatcccagcaggagttcaaaaccagtctgggcaacatggcaaaacaacgtccctacaaaaaatacaaaaattagcacgcctgtagttccaactactagggaggctgaggtaggaggatcgctttagcttgggaggttgaggcctcagtgagctgagattgagtcactttattccagcctgggcaacagagtgagaccttgtctcaaaaaacaaaaaacctatatacacaagttcttctataagatctggttggagacgaacattctaggcataaaagaaatgggaggagtctcaaaggaaaagagcctagttttaactgcatacaaagttataatttccttggaaggagggtcgcttgaggttgtgagcttaagaccagcctgggcaacatagtgggtcagcatctctacaaaaaatagaaaaaattagccaggcatggtgggatatacctgtagtctcagctcctcgagaggttgaagtggtgagaggtttgcttgagcctgggaggttgaggctgaagtggctgtgattgggccactgctctctagcctggatataacagcgagaccctagctcaaaaaaaaaagaaaaaagttaacatttctttcatcatacctcactctaagcaacactaaacagcaaataacaaaacaagaagaagtacttataagagatatgacagattttgtatatctataatgtataataatttatgtataatatcaagagcgcttacaagtcaataagaaagtcacaatttattcaaccattccctgattgattgtcatttgattgtcattttggttgcttccatcatttttcttgtataaacaaggctgcaatgaatatctttatttattggtatggtagaaagttcacactagaatatgaactcttttaaaaagcaggacacaaaattgtatacgaagtaagcagaaaacatgtatggcatgtattagcatattcatattctgtgaacatttggaattctgtattcaaaatctattttgaccattcccaagtgattttgaaggtctttggcatgtcataatttgttattttgtcaaggccagtgtttgggtgtgagagtggtgcacagggcaggagtgtgtaactttgttaggaagtgagcctagccacaccctcctgagtcactggttctttactatcctggggtaggcaatatcttttgttcagctgataaaagctttgtcattgtgaagattggctcccaatgataggaaactgctggtgatgaaaataaaggggtcttaaagattattctcagccagaaaaaataagtgttagacaaattaaatggaaaataattaatattttagtagtctttacaatttggaggtctaaggctctgtcagcatgggttctttaaggtcaaggatctaggatacacatgcacaggaaaaaagactggaagtatgctaagcagtgactatctctgaatgattgtgaaaaaattttaggatgaataagcagaaaaaaacaataaatgacaaaatataacaatggagttttcttgacaatgaaattctcttaaacttaaatctctttaattaggcaggtaaactattttatcatcttcgtttgacctggcccttcttttcaatgttaacagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataaggtacacccctttgttcccagaggcgctgcaggtttaacgcacaggggtcagtgcatgcatgtggggcttccgtagcggggaagcaagacttaactgaggttttggctgccccaagatcctgtcactcactcaaggcaagcacaagatttgcttctcttacctctgtgcgcaaagggagaggccaatttgaattatgactaattaacataaattttaaaaacaatacatttttctctgccaaggttataaacgttatgtgtaaatgaaaccagtccctgacagttccagtgttagaatttcatgctggacattttcctcttccaacagaatcttgctgtctacctagtataggggcagacaaaaaaacacgtagactgcctttttttttttctttctttttttttttttcgagaccgagtctcgccctgtcgtccaggctggaatgcaatggggcgatctcggctcactgtaacctccgcctcccgagttcaagtgattctcctgcctcaacctcccgagtacctgggactgactacaggtgcacgccaccacacccagctaatttctgtgtttttagtagagatggcgtttcactgtgttggccaggctggtctcaaactcctggcctcaagtgatctgcctgccttggcttcccaaagtgctgggattacaaacatgagccactgcacctagccacaacttgatggattttcatgaactcagtacccccatgtaacctgcacgtaggtcacaaaatatatttatcaggaccccagaaaccctccttctgccctgccagaagactacctcaatacttatgggcaaccactgccctgatttctaacagcttagatctgcttagatttgtggggtttttttgtttttgaggcagagtcttactctgtcgcccaggctggagtgcagtggcaccatcttgtctcagtgcaacctctgcctcccgggttcacgccattctcctgcctcagcctcccgagtagctgggagtgcaggcgtccgccaccacgcccggcaaattttttgtatttttagtagagacagcgtttcaatgtgttagtcagggtggtctcgatctcctgaccttgtgatccacccaccttggcctctcaaagtgctgggattacaggcatgagccacagcacctggcctctcttttttgttgttgttgttgttttttgagaccaagtctcactctgtcacccaggctggagtgcggtgatgcaatcttggctcactgcaacttccgcctcccaggttcaaatgtttctcctgcctcagcctcccgagtagctaggattacgggtgccagccaccacgcctggctaattttttttttttttttttgtatttttagtagagatggggttttaccattttaaccatgtaggccatgctggtctccaactcctgacctcaagtgatccacccacctccgcctcccaaagtgttaggattataggcgtgagtcaccgcacctggccgtgtttttgtattttatgtagatggaattgtatggtatttgagtaccgcctaggtgaaaagctgtttttttttttgagacagagtctcgctctgtcgcccaggctggcatgcagtggtgcaatcttggctcactgcaagctccgcctcctcggttcatgccgttttcctgtctcagcctctcgagtagctgggactacaggcgcccgccaccacgtctggttaattttttgtatttttagtagagacagggttccaccgtgttagccaggatggtctcgatctcctgacctcgtgatccgcccgtctctgcctcccaaagtgctgggattacaggcgtgagccaccgtgcctggcccgtgaaaagcatttttaagcacctgtgtctgcctttgcactgtgctaggctctgaggaaaaggtaagtgggccccacactcgcagcattgtggtctctagcatgtctcttagtgaaatggggatgaggctggtaattggttcacagttgtctgagtgtggaacgagaatgaaatcatgttgtgaattttctagcagtatgcctcagtgccaagtgatcagtcggtcttattcacaggtgtgctgttcggagggtatttttggttagaaggattaatctttttttcctgagattaaaaaaatgtgttttcttggcctggcatagtggctcacacctgtaatcccagcactttgggagtctgagacatgaggatcacttgaccacaggagttcaagactagcctgggcaacatagtgaaactccatctgtgcaaaataatacagaaattagctgggcatgatggtgcatgcctgaagttccagctactcagaaagctgaggtgggaggattgcttgagcctgggaggtcaaggttgcagtgagccgtgatcacaccaccgcactgggtgaaagcaagaccctgtgtcaaaaaaaaaaaaaaaaaaaaaaggctggaaggcctggcgcagtgactcatgcctgtaatccccacactttgggtggccgaggcaggcggatcacttgatgtcaggagtttgataccagcctgatcaacatggcaaaaacccatctctactaaaaatacaaaaattagccgggtgtggtagtgcatgcatgtaatcccagctactcggtaggctgaggcaggataattgcttgaacccaggaggcagagattgcagtgagctgagatcatgccactgtactccagcctgggtgatggcgactccatctccccctaccaaaaaacaccaaaccaaaaaagaaaaagtgtttccttgattgagatctgattgcctgattgccagaatggaggcctgtgagtctgtaccaagggtcagcctgttgcatgagcaccactgggcagaatgacagaaagtaatttcaaatccctttataattcctgtttcaggaaaatggtatcttcttcctttagaggaagagacaggagcaggagttggttaatgtgtttattcatgggttcaaaccaaatcagcaggtcaactgaaattagaactccagtgctctgatgtcacctttttggggactacagatgcccttcaccattgcagaaaaatgcatggaggatacacagagaattttgatccaattcagaggattcagtcctggacttcgggttcagaactcctaaatcgtcgtgggtctactctgcagtgttaaaaatacaataaaatcaggcacatttgtgcagcagttcttttagtgtatagtccttaatagtatgaaggcattgtgctagactcagaggactatagaaagttagagaaaacactgtaccagcctcaaaacaaacatcctatagatgttttgagagaatggtaccaccgcaggtaacagaaattacaatatggtcattgtttaagtctggtacgacacaggccctggaggtcttagaaagaagagagcttatttcctgattagtgttgggacagagctggaccttccgtcatacagtcaggaaatggtagttattggaagactgctgttggcaaggcgttcagtagtatacatagaatccagtgctgctcaaggttggtgggatttcttacagttacataaccactcaagttatatgcgatcattgtagaaaaattagaagatccagataagcatgtttgaaagactccccatttgaggtatgatcgttagatgtatgctctataatatcccattgtatgtgtacaccacaaatcatttaactgatcctttgcaggtggtatttcagtaggcagagatgggagggtgagataagaaagtttgtttgaaacaggcatacagtctttagtgttttctgtctaccttgaagtcttaaacatacttcgtacaggagtcttattaaaattaggattcctggctcctggctgggtgtggtggctctcgcctgtaatcccagcactttgggaggctgagatgggcagatcatttgagcccaggagcttgagaccagcctgggcaacatgatgaaaccctatctatacaaaaaacttaaaaaaaaaaaatttagctaggcatagtgttgtatgcctatagtcccagctattcaggaggctgaggcaggaggatcacccgagcctggggaggttgaggctacagtgagtcatgattgtgccactgcactgcagcctgagtgacagagtgagactcttatctcaaaaaaaaaaaaaaaaaatttttttttttggattccttgctcacaaagcttaaggcttatctgtggaaaatttgcttgatgagaaaagaataagcttataaaatggaaataagccttggaagcctgagtttaactttggtagcaccgagagaagtgcaaattcagacctttctaaacagtatggcagaacggctctcaagaacttgcaccacattcagtgggattttcacgtttttgagcccttgactattttggaagtcaatggactctttcttagaatgtttttaaatgcctgaagaaaattttaagagttacaaaggaagtccactttattgaacgtggttgtgtagcgactgggcatctccttctaaaggccctttgctgtctttgagtcctgcagcccctcatgctgtggtggatgattgtaggcattcaatcaagttttattaacctacattaagggaaattttactttcttaattaagataaacattgatgagatggtagcatgttttctaccttgcccttttctggaaaacattgtttttatagaggtattgagtaatcagtgaagtttctatgaataagaacatgggaatattttctgacttattttttgtggaacgatctctttacagaagaaagatctgtcagatcctttcaatgacgaagaaaaggaaaggcataaagtagaggcccttgcccgaaaatttgaagaaaaatacgtaagatttctctcttgaataacaaaacaacctcattgggtgggagacgtttccacactgtattcctttagtggatcatcatgtaataaacactgatctggaagtaagccttaagcatggagagaagagaagcagttattaaacctaacgcattaaggtacagaaaaggggcatggcagagctagtgtgaagagctaactggacaaataaccgagaagggcctgtggtcgccttagaagaaatattttggtacaaagcataagaagccatttagttcatttttctgtcctaggacattttatacaggtacaaatatgttctatgttaaaaggttttcaggaaaggaggttttggggtttgtgtgtatgtgagagagtgactgttttagttagtgcattacctctttgagtcatagctgatgaagttcaaggccacagttaattctgtgtgtttattcaaaaagcatgtaatctattgctttcacattttagggtggaaagaaacgtagaaaagaccgaatacaggacttgatcgatatggggtatggttatgatgaatccgactccttcatcgataactctgaggcggtaagtagttactgaaaatgccgtgtcagacccactgtacctgtagctcctcctgatactgaccaggaagctgggggtggggtcagagcagtcgtgccctcttcccagcatgaggcagtagcagcactgatgagagacgaaatgacattctttatccgggtcttagttccctcttcagaaagtgatgaccagatctgtccaaaacaccttgtagctcagacattcatgtttgaccagaggatgttttagcatgctcttggaagtggcagaggagcacagtcacatctctctcgagacccactttgcaccttcggactgcagaagcagaacttggagctgacagtttgtttcccatcttcagtatgatgagcttgttcctgcttctttgactacgaagtatggaggattttacattaactcgggaaccctgcagtttagacaagcatcagagtctgaagatgacttcattaaagaaaagaagaaaaaatctccaaaggttagaatgtgcttgcttttggatttcagaaatgctttttgacgtgaccctatcagatcagtaggtgacttgccagaatacgtggcgcttggccggctcaggaggatggtggaaaggcagagccgtgccaggttgatggctcgcctcttacacgtgtgccctaatgaggacacgtgcccgtgggggctctgttcagcacttggtcattatgtccatgtcacatgacatcccagcaggctcagcaggggtcgtttctggaggtggcctcagggtgggaaggctgtggaatgagggaatgtgtaccactcttgctgaccctcttctgtggacatgtagaggacttcagtttcagggctgccatcccactgaaaaccagtcagccttaggatcagtgtgtttaaaaacctgtctaccactgcctatgtgtttaagatgagaggtagggcccacttgtaactttcaaactacaaaggtttcaggctccagaatggtcactgttgtctcagccctgggtgtttccaggagacaccgtcggtgggaatgctgtgggtttgtggtccagggactgatctgagagcttttgttcatgaaggaaatgagacaggtctcaggatgtgccccgggcggagcaaggccagtgccgtgtagtgcacttgctccctgagttagggagccgtgtaactgtgccttgtctttaattctcagaagcggaagttgaaggaaggtggtgagaagataaagaagaagaaaaaagatgacacttatgacaaggagaagaaatcgaaaaagtccaagttttccaaagccgggtgagaggcagcagcttctttgctaggataaagcctgaactgttagggcaggacgactgggagctgactcacctcctccccacagcttcggaagaggcagcagggcctggccttcctgtcctcccgcacgcctcccgcagtgccattctgggcatagacgctcacctctcagtgtgtcagatagttccactgtcagtgttggcagctattgttgtcactgtgtgactgctgatgtttctcgtcctctggggtgctcctctctgccccagttctccttctgtctccgctgttttcccttgttgtctatggtcatgcttccttctcctcacttggtctcaccccagcttctcttcaagttgctgctgttctctgctgctcctgctttctccctctaaatacttttcttgctctccctgcccctttttgcaaccttttatttcagcctggcagtggtttctaaaaacccgtcggaaatttagcatatgtgacactgtgttgctaacctgtattaactctcaagctttggtctcagcaagaacgagctccatatgccaagaggagggaggaggaatgacagggtggactgtgacaggttctcctggagaccatgaccctgggagcaggggtgaaggcctctggagttccctttggaggtgtcctatagtctgagtgaccagtttccctcttgcttgcagcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagctcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggtatggtggcacagtgcggctgggctttcctggaagcagtttgggcagattgctgttggttctgcactgcgtgaagcttgcccagagaaactcttagtgagttggcagttaaggtgtcagctttttccaaaccctattctcatcctgagggagaaaacagtgtaagccttgcccgtcaggcatcattttaggcctttcttggtttcttcatttctggaaaatttgctttcttctggggagattgttctctttctgttttctgtcagtttgttttccacacggcatcttttccttcatgtgatagacggatgatgttggcagcaggcagctgaggcagagattaatcttagaattcttacgaaggttttgcaaattcacaaaagtttgtaaacatacaagttacacgtagagtagatgcttcgttgccactaggtttcagtcgctcccttgcgttgtgtatccagtgttaggtagtgattacaggaatgcctcaaatgtgatgaatgaaaagcagcttaattttaaatgctgtccatgtcccattaaaacccaccatcggcagggtgcagtggctcacgcctgtaatcccagcactttgggaggccgaggtgggcggatcacctgaggtcaggagttcgagaccagcctggccaacatggtgaaaccctgtttctactaaaaatacaaaaaattagctgggcctggtggcgctcgccgtaatcccggctacttgggaggctgaggcagcagaatcgcttgaacccaggaggcggaggttgtggtgagtggagattgcgccagtgcactctagcctgggccacagagcaagattccattaaaaaacaaaccaaccaccattaccacctttaggatctagcagctcttgctgttttactccagtgattgggaattaagcactgagaattgtctgttcaagtaacacatttctaactgtaaactaggcatggatcattggttgtaatatcatttacctttaagttaaaataacattttaccttaagcatcaggacttgtgatgcagctctagtggcagtcataatctacagctgtaggttttaaatcagtgattcttacagtatttcagaagcattgttacctataatatcctttgtgttttagggcagggtaaattgtcagctactgctaaaatgattttctcacttccaaaaaatatttgaacaccatatacaaagcaaataaagtatctattcaaagctctacctcatctttgtcagcttgtgtccagcattggaaattcaagtattgtatttgaatgtaatgatttaagtgaattgtaccatgttggggtttggagtatctcttagtatgacattgaggtggaagtagctgaatctgaacttggtgtttttgagcctgctgtcctatatttgctctcagaattcatgttaaccaaacattactccttgttctttttaatcctctggttcgtaatcaaattgtttcttagcttctgaaagtcttgttaaatcatttaaggtctatgtgacgatagatggtcgttagagaaaagtcaaaaccagattcttggctgtgtccccactcgtgccataggttgtgttctagtgtgaaaacttactgtttcactttcttgggaaagatggggacagatttagtggcaacagaatgacataaccggaaacaatgttgggctgtggtgcaagaaagcggagctgagtaaacaccttgttaggcaagctgcccctcctcagtgattgccaagtgtcagttagctcttgggcataacaaacacagggttcaggatcccatagtcaaggtgggcctgggtcccagtggggagctggtgaccaggagaggctgatgttctggttggaaaatacagtattcaagtgtgaagttgatattcgagtcttcacattgcccttctcctataacagcattaagaaactttgaaaaatggggtggaaggtgtatggaaattatccatccggccaatataaaaacaatttctagttggatattcttttctagcctctgtgtatatgtttttatgcagctgtaattatagttgtgaataactgttttctgcctttttacgtaatattataaagccctcatgactttttatggttgcattaaaaaggtggcttattttaaaaagatgcttaatgctactccgaagggtcctcaggtgcgctcttctgaccagggccctgcacttggggcacttggagtccctgcatgtgtgtgcaaatgctcaggacccctgatcccactgagaatctgctgggaaagatagtcttcccagggaaggaatgcactggtatactcaaattgcttatgattccaaaagccacatgtggatatttgatatttggatccttaataaggggtccatcctagatcttgaaatggacatcgcatttttaaaatttaaagtaaacctgatgtatgtaactgggacattagcagtgttacgtgtttctcactttattttttatacccctaattttcccccccttttccctctattataagattgggtagactttacatcttggccctaggtgacacacaaatcagtttctatcactgtctgcaaaacaccccccaaaatttgccttgtcatagcagttcgtttctcctgactctgggccaacgctcatggctgcattcagctggcaagttggccaggtgctggcagggcttttctttcctggcctttcatcctgccttcttcagggcttggtggtctcagggcaacatctcaagaggggaaaggtggaagctgcagggcccttgagagctagccttagaggctatgtgtatcacatgacttccagcacacttttggtcagagcaaatcacaagagccgcccagatccaaggattagggagctagggtgcacctctttgggaggagaatttctttgtgggaggaatctgtgatcctggtttgttgttgttgttgcctttttttttttttttttttttttgagacagagtctgactccatcacccaggctggagtgcagtggtgcaatctcagctcactgcaacatccacctccgccttctgggttcaagtgattcttgtgcctcagcctcccgagtagctgggattacaggcgtgagccactgcgcctggcctgtgttcctgttttgtattctgccacagtacatagcagattcttatcccatgtgtattgatcccttaggggaaaaaactctgggaagcaaaattagatatatcttctaactaaatatggtacttaaaactttaaaaaatgtctttgaaaacttgtgtatgttaaagaggtcctctgagagggaaccttggtgatgcctctgccacgttcactacattctcacatcagcctgttttttgttactgatttgtattgtacatttgtataggccccagggaatccagtgatttgatggccttaccctgccctctgttaatatgcattgatggtgtcttttgtcttggttgttggcaggtacaggtgctgacaaagctcaggtttgatgctcctttgggttattgtcttgaggtagtttgacagctactcagccttgggctggacaaataacccagatctattttggttctctttagtcaagcataacatagagacaatactaagagcaggaatcaaagagaccccatgtcacccattctgctctgccctctatagaattagaacccctcatcacaagaagtgcagggagagatggatccaaagagaataacgtagggggaaaaaaaacgaaaacaacttgtttgatctttttaaaaaaaatcatgcccgattttctcctactcagcaaaaacagatacagtatataagattttgagctgggtgctaaaaggctacaggtgacttttcttagaataaataaaacagctcattaaaaggctgttggaactcttataaatcagcatgattgggatgtttaacctcatttactagttaacttaggattgattaattcacacaacttctggggtaagagtgtctctttttaggggtgagggaccccatttatttttggaagactatcagatatatatccaattgctcttttaattagatttactttaaaatgccgcagtcgactcttcagtataaagccagaccctcagagatattgtctatgcaattcaaaaggtttacagaaaagtactttctaaaattacataatattatttaaaatatttttaaagattgcgtaaagattacatagaaagcttctgaaatattgtacaagtggctatctaaacagaaaatttggcagggcgcggtggctcatgcctgtaatcgcagtactttgggaggccgaggtgggaggatcacctgagcccaggagttccagaccagcctgggtaacagagtgagaaaaaaaaatctaaaaattagtcaggcgtggttgcgtgcagctgtagtcccagctgcttgggaagctgaggcgggaggattatttgagcctgggaggtcaaggctgtatgagctgcgatcacgtcactgcactccagaatgggtgacagagtgagaccatctcaataaaataagatgctgggcatggtggctcagcctgtaatcccagcattttgggtggctgaggcgggcggatcacttggggtcagatgtttgagaccagcctggccaacatggtgaaaccccatctctactaaaaatacaaaaaattagccgaacatgggggtgggtgcctgtaatcccagctactcaggaggctgaggcaggagaatcacttgaacccgggaggtggaggttgcagtgagctgagatcacgccattgcactccagcctgggcaacagaacaagactccgtctcaaaaactaaactaaaataaaaaaataaaaaataataagataaaatttgattggaagtttaagctgtagatgggtctgaaagtgtggcatgtgaaatacatgttaattagtttgaattaatgtaagggtgcttctcgatcttaaaactagcagtgtaagcttaagcaaaaaaagttcagttttattttttcccagactaatataattctagtaccttccaagtgctaaggtagaattctgaatgtttccaagagtgtaagaaattggcacatggctgggtgaaaagtcatgccctttttttccattattcgtctgtggatttcacccctctgggctttcacctagccaagggatctgtagaagcttgagttttgcgcattttcttctgacttagttttggttgtttggtgttaagcttttcttcctgtggcgtgccgttttacagtagtatcttcatttgttgattcattcactcagtcaacatttagtaaatattatgtgacaggcagccatgggaaatatactgatgaataagactcagttctatattttattttattattattttttaagacagggtcttgctctgtcacccaggctggagtgcagtggcacgatcttgccttactgcaacctccacgcccagggctcaagtgatcctgccacctcagcctccagagtagttgggaccacaggcatgcaccaccatgcccagcttttttttgtatttttagtagagacagggtctcatcatgtgcccaagctggtctgaaactcctgagctcgcgtgttccgcccaccttggcctcccaatgtgttaggattacaggtgtgagccaccgcgccgggccaaggttccattcttgtctttcatgagctcgttacataaatggacccgatagatacgcagacaatggactgtagtacagagcagaatgaagtaagctttgtgatgtgtggacggccagatagccggacttaaggggttaaagagaggctcttggggggcatataggaagcagactggaggcaacaggcttcgccggcctcctggggaagatgccctaagagaaggcagggagcagagctgaagatgggcgagttggtggatggctgggccagatcgtggaggaccccaaatgccatgtgaaggagtttgggtttgataccaggcttggaaagagctgctgaagggttctgaagaagggagtggcggtcttaaggttggagtgcaattattagaagtggggaacacaggggaagagcagaagccagtgggtctggtgtaagttgagtttgcaaaccagagggtcatccatccacagaagtgcagttgacccttgaacaacacagggtttaactgcgtggatccacttacacgcagatgttttctaaccaaatgtgggttgatttgagggatgctaaatctgtgtatagagggctaactttttgtataggcaggttcctcagggctgactgtgcagttggattttggtatatacgggggtcctgtaaccaatcccctgcctataccaggcgttgactgtaattgggaaatttctcagagataactggaaattctggtccagagcttagatgagaggatttagggcttagtttagatttgagtgtacaattgtctgtgttattttgaagccctgagggggaaagaagttattgggagaagtgggttctagtgagaatcctggggtccgcctatggaaaggagctggtggaggaggcagatggagcagttagagtggttggaaggggccccagaggatgcagtgagaggaaggtgagtgggggagatgatggtgaggggttagcagtgtctgcaatttcagaggggttgatcccttcattctagatagtcaccttatcacccttgtttgctgtcgttactgtatatcatgtctgatttcagaaattttatttcacccaaagccttcagaccagcagctcttgggttgagaggaatggttcccagccctttttgcacatcagtgttcccagggttgctttgaaagagtacttgggccacttttgagagtgtgcattcctgaatctcctttccagagactgtgatttgaatggcctgagttgctccaagctgcccagggaattccaatatgcaaccaagtgtgagaaccctgatgcagacttccacagggtctgcttttttgtgttcccgctgtgtcgtggctgcctgccgtggttgcttcaggggtctctgagcttgccatccagggtgtgtgttaactgtgttcttttcgaaagcaaactaagactgtactgaaactcctataatctggtgttaataggtaatatggtgggttaattattcacatggtctggctaatagagagctcgtggtataccataagtagattaggaattgtcaaagagttttaatgtccttaagtgttagagctacacattattattatttttgtagataaaaaggcctttaaatcctatagactggttgaagttcttgaatatttttgtactgtagatacatggaaatcccaactaatggtgtagttgatggtgtatgggtgcaggggttagttggccttattggcctctggctaagtgcattgtgatggctttgactctgattttcttttctgtgactgttttaagtcccaggaagaactggcagcccacagatgctgcagcagcatttgaaaagagaatattgatcgcaggcgaacttaacctgggactagggtggagttggaaaggtggcggtgtgactgtattgacaggtgctctttatggagcgatgactcctgtgcctgtgggtgagcgtaagggacatgtggggaaagtgcactaacggctgttactgtctgctgtgcaccaggctgccagagctgctgagggggagagcagacagaagttcttcacccaggatattaatggaatcctattagagtgagtatcgtctgtctgtctgtctgtctgtctgtttctgctattactgagcttggggcaagccagctaggggacagtgggagtacaattgaactgcataaaggtgaccaccaaggagataaaagaagaattggattaacatggtttcattgttatttttcttttaaaaatcaaaacacaacagggacaccaagtacttgtctccagaagcgatagacctccttgatcttaggcagcaggcattaataacatgtgataatcatggcctgttagaagaggatttcttggcaggtatgagatgaggagagagagaaggtgttgcctgactgtctctgagaatcctgaagaatgagagacagcctggtggcctcgggcctgctctgccttgggtgttgcttggcgtccctggctgttccgctcgctggcactcctgttcctagtgccacgtgcatcatccctaatgctgttcccacatgcctgagcctctgagacaccacgctgtgtgaatcgggttaaaaaacagatgagcaaacatttgtaaatccagactgggaaaagtgaatccttgtggcctggcctgcagtgttgccgcttttctcctggttgcagtttgtggcaggggaagcttgttgctcaacagctgaggagtttgtgtgtgtaagaacagttgtcaaaatgtgggtgttctaccacatggcctcgcctggccgggacctggattggccccttgggtcaggaagtgtgagctgcagagagcacctgagcattggtgcggacgataggattgtgtcaacaaggaacctgcttgagcgtgccaaatgtggacagctcaaggcattgaagagaaatatttttttgcttatctagatggagaaactggaggggtgaggctttccctgacctcataatggttgataaacgtggggactgggggaaaaaaaagaaatgctgccgggaagtgtctcctttgaaccccaagtaactcatgactttccactttgaaagctttcatgttttctctatgaaatttagtgcttcagagcttgttctcctgggctctgttttcctggtattgtgacctaagagccttggcccacattacctagccatgttcatcaggcttgggagttgttgttgtttgttgattgctgaggatgtgtttccttgggcattcagttacattgtgtgaccaacaagacagggtttgactgccgttggctcctagctttcctctccacgtacggtgagctgatgaagacaggagttgcagtgagctgcagccggtggtgactgtgttttgttcttcagcatagaggcgcagactcgggagctgagcagtcaggtccgctctggggtgtatgcctatcttgcgtcattcctgccctgcagcaaggatgccctgctcaagcgtgctcggaaacttcacctctatgaacaggtgggtgactctagagtgaagccctttggctttggggtcctggcggaggggtgactgagtcttaagcaatgatgcgtctgctgccccactgcctccttgtgatcaccccatcatgcgtcctgagcgtaagagcgatgtgtaaacctgccttgaattgtgtcccgctcttcgcaggggggccgtctgaaggagcctctccagaagctcaaggaagccattggcagggcgatgccagagcagatggccaagtaccaggacgaatgccaggcacacacgcaggcaaaggttgccaagtaagtttgtcctggcgcttgcaggtgcaaccctcccgtcttgcctcttcccctcccgtttctcggtgtgtactgccgtttcccaaggagcctcttggctcttctttggccttttctccttctctgtgaagtcccagtagtgcagagtgaggggagaggcggtgggcaggagcaccttggggccccatgtaattctattcaccccgtaggatgctggaagaggagaaagacaaggagcagagggaccggatttgttcggatgaggaagaagatgaagaaaaagggggcaggaggataatgggacctcggaagaagttccaatggaatgatgagatcaggtgtgcccacactgggacttggcctctttggagggttggtggggcagtgtctgagcacgtcccctattgctgacaaaggttaggctcatttactttcatcagggctgctgaaagcacatgattggaaccttggagcagcatctgaagtagtttggagtttctgatttctgcctccttctcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccaggtgagggccgtgtgctgagatgggcatctgtgcagtcaagacacgtttgaacgctgcttttgtgccaggccaacaggatccttgctcacagggagtcactgtctagctgcctcaactctgatctcacctgagtaactgggggacatgcaggtagctgggaaagggtcttctggatcttccctggaggaagggaagttgcctccagggttttgtttttgtcattttttgtcccacttcagttgatgtttggcctcccatctcaatatgcactttccttttttttttttttttttttttttttttgagatggagtctcgctctgttgcctgggctggagtgcagtggtatgatctcagctcactgcaagctccacctcccaggttcacgccgttctcctgcctcaacctcccgagtagctgggactacaggtgcctgccaccatgcccggctaattttttgtatttttagtagaaatggggtttcaccgtgttagccaggatggtctcaatctcctgaccttgtgatctgcccaccttggcctccctaagtgctgggattacaggcgtgagccaccacacccggccacacttcctgttttaacatacaggctgctatgagcatttgagagatgggttcatcttgggtctttcctgatgttcctgaagaagtgtcatttgcaggtagcagggctgactccttattggaactaagtgccaggcttccatctcagaggctaccttgtacgaagtcacttcctgcgaatgaagtatttgtgtcatacatgggacagagaaagttagctggagtgattttcttgattggactcgaatcatctgttgtgcggatagatcttggaacctttgaaattgctgtcctctctacgtaggctggactcatacgaagaacgtttttgttgagtttctctggacaaagacatgctgggtcactccacattttattcctggaatggagggactaggcaataaggaaagtgctgtgccctttagggaagcatcaccatgagaggtttgaggcagagccatacattttcttggtaaaggccagactcagcctttgggcagccagtgtgtcccattgagatcctctcaccaggaatttggctccccaatccattgacctttttttttgtgtgtgtggggggtgggtgggcatggtgggggggcggggacaaagtctcactctgttgcccagactggagtgcaatggcacgatctcggctcactgcaacctccgcctccccggtttgagcgaatctcctgcctcagcctcccgagtagctgggattacaggcgtgcgccaccacgcctggctaattttagtatttttagtagagacggggtttcaccatgttggccaggctggtctcgaactcctgacctcaggtgatccacctgccttggcctccaaaagtgctgggattacaggcgtgagccactgcgcctggccagttgacatttaatgagggatagctactgaggaccagggacactagcaaagttctggaagcagagtcccagctttctggggcatgtacagatgcctggtgttctgtgtctttcagaactctgtttaaggagagcagacgaggccatgggcacctgacttcaatcctgtgagtgtcttggtattttcacatctcgggacaagtgttgtttttggtctcctctggatattctctaaacttttctgtgctcattcctttgaacagggccaagaagaaagttatggccccttctaaaatcaaggtgaaggtgagtcagtttgctcgggtcacatgtcagctatgcccatctccctacaactatgctctggaaacagtcaagtgactgtggaagctcattgatctttgctcgtctggggacagctgctcaggatgacattcttgaagtcataacaggacagagacccaagccacttaacccccctctagccttggttctacaaacagtacccagctggcccagttcctggggttcatgtgggattaagtgggatcttcttggcagccctctgaggagtcagtagtccctgaaggtgtgaacgtgttacactgtgatctttgtatggaagaaatacactctagccaagtgcagtttagcttggagccacagcagaaagaaaaggcgactttactgagctaccaggcagaaatggagggcaatatagtggctggagaatagacactgtgaaaattaccttagatgttgcagaaacctctcaatgtagtaaaaattgctgtttatcaacatttttcccagttcttagtgtggtgcccttagccatccctaagcagaccgtgagaatgagatgtgcaaatcatttactcctaagtatctgttgagctcccacaatgtcccagacacactgtattaagcaccagggatgcaggagtgaaggattagaccccattcctgttcccatgaaaagctcactcttctttgaacccagtctgaggagatgggtgctgggaaaaatcaagaagggaaaaatagctgctttaaggcaattctcatgccatgccttggtctgattgcagctaggagtgcgctgagacagtgggaatgccagtaggcagagtatctcttcacgagagtcttaacgcttttcaaaacagaagaaagtttctcctggcggcttgtttgtacttagcaacgaagcatgccggggtaaacccagccctggccaaccagatactcaccaggggtgatgaagtcatggcatctaaagtcaaggcgggcacagctcctgctctgtcccaccacttgtcttgtaattatacaggaaggcccagtttttttgactcgagttcacatgtttgtatcctcacaacaggccaatgttggcatctttggacctttctaaacatcaacatttctgttttcctttaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcagtgagtatctgtcatagcagcctgccctgccccactcacaggggccttggggatgaggttgcttgccttgccccgggtggagagtgagatctaaaaccacaggtcaggtaggaacagtgggctcagacgtaggaagggagactgggctccctgttctcaggtattcacttttctggtgacaggaagcccaggatggcctaaagcttcttctgaggagggcagagggacctaaaggatggccagcaccaagcaccatgcctcttcggaggctgtctgtgtggcacagaatgagcaacagcccttgccttccgtgaccccttgcctctccatctctctaaagggggctggaaatgctgtcttctatcagttgagtcatgtggaggtgttcatggaccaggaatagcaggaccttctaagagtgattctgttggtttttgaaggacagagtccaataattaatgcatctcgcttgtgtgtaatcacagcaggttcgggaagagggagtgagcattttcttttctttttttcttttttttttttttgagacgaagtcttgctctttcaccaaggctggagtgcagtggcgctatctcggctcagcgcaagctccacctcccgggttcacgccattctcctgcctcagcttcttgagtagctgggactacaggcgtccgccaccacgcccagctaattttttgtgtttttagtagagatggagtttcaccatgttagccaggatagtctcgatctcctgacctcgtgatctgcccgcctcggcctcccaaagtgctgggattgcaggtgtgagccactgcacccggcctctttttctaatatataaatgaagtggttgcaaagacaaaaccatagaaaggtctgttggaggtctcacctcctttcctgcacccaccacctctgtaaggtaactaagctctttagtttctggtttattttcctctttttaaacaaaagattaataaatataaataaaggtatatatgtatgtgtgtgtatgtatgtatataaatatatatacacatataaatatccatgaacatttatggatatctatattacatttttcccttcacaaaggaggctttttttttttgagacagagtctggctctgtcacctaggctggactgcagtagcgcgatcacagctcactgcaacctctgtaggagacatatttaatatcctgcttttaaaaaaattatgttccctggaatccattccatgttggttcataaagactgtcctggatcctgtctttggggctgcagggtcggagggtgcctcccagggccatctgacatggatgtgtatgtcctcctttgtggacacacaaggaggatcctttgtgttgccaggtttggtgtgagtgagccacgaacaggactggagttcttaccgcttgctgtgtttcttccctagaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtaagtgcttctttgctgcctctggtcactcaggaacctctagattgtggccaggggtcctgctgttgtgtactctggttcctgtgtttgagtctggtgtgtgactgtggggaacatctccgggaactgtgccaagcccccactgcccctttgggtgtggtgcccagactggcctggcaggttatcgggggcttttggctgctggagctgctttcctgttcctgtcttcaatgtgtgtgttttgttcttttctcccctcctgttttctctcaggtcttctggctggcttgcactccagcccgccccatgcagcgcctctcccacacgctgcggtgcccacccatatcccgcagagtctgccaggtaatcacccgacggtcagtgtgccacgcgcaccgtgtgcctttgccctctccacccctaggtgctttgccgctgccaagggtcttggtgtctttgccttgacgctgttgttgttttggtttgtcctttgaggctgtgctttgtcagtactcagggtgacacgcacttctactcttggggtttcctctggtccccacttggagctgccgccaggtcagcctcagcctgtgtgatcacagggaaagttgcggggggcagggtggtgcgcttttgtgtgcggtggaggagttcctaaccctcggcttgtttttttctcttcagtttaaaaaaaaaaaaaaagggaaggtaatggtgcatcttctccaagggctaattgggtacaacaaggtcttggaatgcaagctgctccactgtcagatgtgattgcttaacagaaggctctctaaactttgtttccattaaagggaaaatccaggtagcagccagaggccacagtgcaagactttgagaggagcagctttaaatctgtccaagtgtgaaaactccatcagaacagatttgtgggagcacagcaggcatgtggtcggtgctccccttagcatcttctgaaatagggaacttctaaaagcctcaggcttgaggctgctctggtagcacctgagaactgggctcaggtgccccgggttggtacctttgcattgagtgcgtctgcctcaccctatcccgagtctgcgattcttgggtacgcctcctggaattctggcatgggaagtctcatggtgtctcagctttgacctagcattgttcctactgtagacccgcttcagacatgaccagggtgctacttggataaggggagagccgctcgtatggaagccagccgaggtaaccctggcgaactggtgccaggtggaagtaaggaccctctgtgctgcacgtctcccaagttacatctgcctcatgatgtgctgtggctccctggcaccatggcgcattatagtaaacaccagaggccatatggggcaagactaaatctgtaaatctccacaatggaaactgtgcttctttgaggggctaagcctatagcactagtgactcctcctttccttgggaggagaagtaaagtgcagtgacttctctacagactagaggctgcagagccaccttggtgagagcaggggtctttccaaagtcaggctgccctgcctttgcttactctcaggaatgttactctcagaaaagcaaagtaattgaggccggacgcggtggctatcacctgtaatcccagcactttgggaggccaaggcaggaggattgcctgagtccaggagttcaagaccagcctgggcaacatggcaagaccctatctctacatttaaagaaaaaaattagtcaggtgtggtggcatgtgcctgtagtcccagctctttaggaagctgaggcagaaggatcacttgagccgaggaggtcgaggctgcagcgagccgtggtcatgctactgcactccagcctgggcaagagtgagaccctgtctcaaaagattgctttctgctatattttcatttttcctctgggtatgaaaaggctatcagaataggaagaataagtgctagtgttctataccactgtagggtgactgtagttaacagtagtatgtagtttcagttaggaggaggatattgaacgtcgccagcaaaaggagatgaaaaacgtttgagatgatggatatgctaataactctaacgtgacactacacattttagatgttgaaacatcactatgtaccccataaaatatgtgtcattattatgagtcagtttttaaaactgtttaaggctctcagaggctggatgtggtggcattgagaggcaggaggattgcttgaacccaggaatcagagggtatagtgtgctgtgatcatgcttgtgaatagctgctgtactccagcctgggcaacatagtgagacctcatctctaaaaaaattttttttaatcagtttaaaagttcgaggaaaaagaaaatcaatcagaaaagcaactataccaaaacagggttatccaagtgagcttctctcacttccttagatggacttcagcttataggatgacacgagatgcgagtaagaagctatttgcgcatttcagctgcgtgacttgtgtctgcgttgctttcctttctttcttctgtggactgagaatgctagtgcctttgaatttgtctttacaggacctgagggtcttttgatggtaagagaatgaatgatcattgctgccttgagttctgtgtgatcgtcaggcctcgcctcaggatggcaattgtagcctgagatgacgtagcccaagttgcacagcagagttgctgttctggaaacactgtgctgagtgaccaccgaccttcacagtgctagtgtgcttgcaggctgtggccaggagtagtgtacacgaataactgctggctggtgtctcatggcttgtttgagctctagaacactcagcatttggggacttttgctatttaggtgtctcccttgaagtttggttactactgccttaaggaaatcagagagcatgaaaaacttgcgttctaatttttcttactcttttccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgtctcctttttttacataagaaccaatccgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccacgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaaca

SEQ ID NO: 863 - DNA, 7375 bp, Homo sapiens
gtgaagaccagctgggagcccactgcctgctgccacctccaactccggccccctcaccatgcactccctggacgagccgctcgacctgaagctgagtatcaccaagctccgggcggcaagagagaagcgggagaggacgctgggtgtggtccggccccgtgctctgcacagggagctgggcctggtggatgacagccccacacctggctctccaggctccccgccctcaggtactggccctgggcagggcagggggacttagccctgatccagtcatggtgacagggagaatggccaagtgtgtccaccagcatgtagctgcagcccctctcggcttccggttcatgggaagcccgcacgcttgtccttccatccgcccagcatcgtatgtctgcagggaggtgggagctgcagtgcccagctcacgtggctggcacacgatgcaaactgaggcctctaggcagatctggaacagagctggtcgggcaaccaggcattcagaaggagcggcagtagtcccaggacctgcaccctaggctgtggggtggtgccgctggccaacctgggcagtagaggctgggtctgagcccaggaggtgcctctcagggattcccggtgcttgggcccagggtggtgggcaccacttctgccctgcctccaagagcagagtcacccgaaaaccagattcaccgcttgtctgaaggggaaggctatgggagcagcccagcccgaacctgccactttacagaagggaacactgaggcaggaaggggcctgggaaaagctagaaaggttcctacctgcccgtctgacagggacccaggggccctgggttcgagtcctgttctgttattaaccctgcgtgccagaccattcccgtctgcaaagcgggcacttcccccctccccggctcacgggggccaagctctggcggctggtaaagctcagaggtggtgggtggtgtcacacacctgtcagctccacaggctgctcctcacattcgtgtggtctgggggcatggctggtgtctgctcccaaggtcacagtgggggttcggaggcaggagtacctggcccactgggactctacactccagcacaccctgaactgtgcctctccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacggggacctgcctccagtgcccagtgcctcggtaaggaggggtgagagttccggagagaggggtggactggtttcctggggttgccatgacaaagtaccccaacactgagtggtttaaaaaacagatgtgttacccctcataattctggaggctggagtctacctggaaggctctaggggagaaccttccctgcctctctcctgccttctggcagcttctggaaatgcctggcactctagcctggtagctgcttcactccaggctctgccctgtcttcacacggtctttgtccctctgtgtccgaatctctctctggtttctcttataaagacaccagtcatggccgggcacggtggctcacacctgtaaccccagcactttaggaggctaaagtgggaagatcgcttgagcccaggagttcaaaactagcctgggcaacatagcaagaccccatctctatttatttttttgagacagagtcttgcttcattgcccaggctggaggccagtggcccggatctcagctcactgcaacctccgcctcccgggttcaagcgattctcctgcctcagcctcccaagctgggactacaggtacacaccatcacacctggctacttttgtatttttagtagagacagggtttctccatgttggtcaggctggtcttgaactcctgacctcaactgatccgcccatctcggcctcccaaagtgctgggattacaggcgtgagccactgtgcccggccttttttttttttttttttaaacagggtctagctctgtcacccaggctggagtgcagtggcatgatctcggctcactgcaacctctgcctcccaggttcaagcaattctcctgcctcagcctcccaaatagctgagattacaggcatgtgccatcacgcctggctaatttttgtatttttagcagacatggggtttcaccatattggccaggctgatcttgaactcctgacgtcaagtgatccgcccacctcagcctcccaaagtgctgagattacaggcgtgagccaccgcacctggctatatattttttttaattaagaaaataaaaatttaaaacacaccagtcactgggtgttgggcccaccctaatctagtgtgacctcatgttaacttgattacatctgcaaagatcctagttccaaataaggccacatgcacaggtaggggctggggagaagaggacctgaatgtctctgtttggggacaccattcagtccactaccgatgggacggggggctctgggccagcaggaccttgactagccctcccctcgcaccccaggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaaggtgagtgggggccagcaagagtagtgtggagtctggggcaggtcaccccgcatgggctcagaacacttcccatcctccgcagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtgaggtgggggagagaggggtagagggaggactggggtctccagtgagctgagccgtgccccccgccctccctggagcaggtacaagatgctcatccacatccgcacacacaccaacgagaagccacaccgctgtccgacctgcagcaagagcttctcccgcctggagaacctgaagatccacaaccggtcgcacacaggtaagaggccggggccgggcggcttggcccatgaagggggcgctcagctgagaccggctgggcaggtccccagggggaggggactgttaagtaaatcccgggcctcagagataagggttgatgtcatcgcccaggggtcccttttccaatgcagtttgctaggggaagcatcccctgggggtcagacccccacccagcacctgctcttggagcaccaatgccatttcctggttcccgtgggtatcttctgactaatgccacctctgtgatcgcagaggccaggtcggcttcactcctcactacagcccaggcccataccaggacagctctggttgtcagagccacagacataattttacatttcctaatcgctgcataaaacacagcaaaaataaatgggtgaaattaattgtaatatggttcgttgaccccggtacatccaacgtgttatcaattcattattaaagacaaatcagtgagatattgaagttcttcatttcatgacaaagcctcaaggagctgatgtgtatgttttttcctggtgtttatttcaccctggcagcacatctccaggtggagagccatgtatcaggaggtcagtcactacatgtggccccctgctctggccagggcagcagaagatgcctggtgaaccttcagccatttgttgagtgagggcagtagcgcccaggcagcactccctgtggccaggcccacgctgggcgcctcgtgccaggatgtgatctccaaggccatggtgtcttttttttcttgagacagactcactctgtcacccaggctggagtgcagtggcatgatcttggcccactgcaacctctgcctcccaggttcaagtgattctcctgcctcagcctctgaggtagctgggattacaggcacctgccaccacacccagctagttttcgtagttttagtagagacggggtctcaccatgttggccctgctggtctggaactcctggcctcaagtgatctgcctgccttggcctcccaaagtgctgaaattacaggcgtgagccaccgggcccggcctccaaggccatgttctgctgctgaaaggcacatcctctgtagcagagggtgcagggcgaggctaggcagagctggagtcaaccaggctgagttttcagcctctgtgccctgcctgggggcagatctcatgccatgtgctggggatgccccctgcccccagaattggggcatctatgttcccagggagtgcttggcccggggaaatgttgagtgcatggggtgagacccaggaaggggagagacccctcatggcggcactgcactgcaccaccctgcaggtgagaagccctacgtctgcccctacgagggctgcaacaagcgctattccaactccagtgaccgctttaagcacacgcgcacccactatgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctcccccttcctgagaggagcccccagggaccagaggcctgcccttccctcctaggcttacccagcccctgccctgggggctccttggacccctttccctctgaccctgcctccagagggaaagcaagacagatgcaggcccctgcaaagccccaggtagaagcatgccccccaggacaaggcgcctcccactagttaggaggaggcccgctctgcagccgccgtcctcaccccaggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaagatg

SEQ ID NO: 864 - DNA, 37869 bp, Homo sapiens; identical to SEQ ID NO: 857

SEQ ID NO: 865 - DNA, 1232 bp, Homo sapiens
tgctttgtgaaatgggccctgcttctcttgtccttttgtactaggagaaatgttaaatagttagaaaccgacctggattactccgatctgaactgagatcacatgggactttaatagttgaaaaaacgaacccttaatagcggctacactattaggatgtcctgatccagcattgaagctgtaaaccctgttgttgatatggaccctagaataggattgtgccgttatccctaggataacttattccgttgatcaaattattgggtcagtgtgtgttaacttgcttagactagtgcggtcttagtttaggtagtttggaggttgaattatgctctgaaataaaagaaaatttttattttttttgttttttatttatttattttttaagacagagtctggctctgttgccaggctggagtgcagtggcacgatcttggctcactgctatctccacctcccgggttaaagccattctcctgcctcagtctcctgagtagctgggattacaggcacataccaccacacccagctaatttttgtatttttagtagagacgggatttcaccatattggccgggatggtctcgatctcctgacctcgtgatctgcctgtctcagcctcccaaagtgctgggattataggcgtgagccaccacgccgggcaccccaaccaaaatttttaatgcaaagatagtaggctagggcctgtaggctttttttgagtttctatttgcattaatgaattaaagctctatagagtcttctcatcttatttgtttatactgcctcttcatggataggtcaatttcactgactgaaagtaagagacagctgaacccttgtgtggccattcatacaagtccctatttagggaacaagtgattatgctacctttacaatgtcaggataccgcagctgttgaacatatgtcactgggcaggcggtgcctctaatactggtgaagccagaggtgatgtttttggtaaacaggtggggtaagatttcccgagttccttatactttttgtaatctttccttagagcatacctgtgttggattaatggtataaataatagggtatttattctttattaatattaggctgttaactatcagtggattctggtttgatataagcttatgcaatggagaatgtcttcgtgttactaatattaacattattgcttctattaagtaatagattagtctaatgtaatgttaggagttcaata

SEQ ID NO: 866 - DNA, 18942 bp, Homo sapiens
gtggagggagaaacaactttattttcatcagaaattagtaatgtttataaatttgtttatagtagtttgtaaattattatcagaaatagtaatgtctataaaccacttactttaagagacaatcaggaactatgatgagggcaataataaaaggagaaatcttacaaaaaattaacctggatgttgtgcttgctctaaggttaagtcacttagggaaacagattcagtattatccaatggcttaaccatccttccttctttctgtttgctttttggtggtggctgggttacaaagagcagtgtcttctgccctgaaggtagcagtattacggtgggtgcctagaggtcaattattggtttagaagagattcaggcccttaacttttacatgtgctttccaggaaaggagacactttctttctcagccctgtgtgaggactatgttagcccagaaagtgttcttggaccactgggtgcccattctcagtgctaggaacaggaagaccctggtttcctggtagaatttatggatcctacagctttctctccatcaaactttaagtcacagtaagataggactctggagtcacaggcacagccaggagaggtcagcgtccttatgctgactcctggtcctagacatgggtcttaagatccagtagtcagtaggtctgttgcaaagtcagggactggctagatctctccacagcagaagaaagctcatacatgctgacctgaggaacttaatctgacagtttaccgacacactcataacgcatctcttccttcctgtgatgagagtactgctttcatgtgtactgtctgatgacgggtgagggcagagttcttagtgaagcctctctcacagtgagaacacctgtaaggcttttcaccagtgtgggtttttcggtgggcactgaagtgggagctattgttgaagattttcccacacactgcacacttgtatgggctctccccagtgtggatgcgccggtgagcactgaactgggaactgttgttgaatctctttccacagacaatgcactggtaaggcttttccccggtatgggtcctctggtggacaatgaggctggaactctggttgaagcttttcccacattgcccacactgatagggcctctcccctgtgtgagttcgtaggtgggcagtgaggttggagcgctcactaaagcccttcccgcactcactgcacttgtgaggcttctcgcctgtgtggattctttgatgccgaacaagataagaacttcggctaaaggttttcccacattcaggacattgagatactttttccagtttgagcgctggcttgtggggagagtgcacactctgagagcagtttttcccacagaggatatgtgtacaggctttgtccctggcacaaaaactctggtgactcatcttctcctgggatggggttttctcctcactctcccctggagaatttctacattgccttcttgatgttggctcactctccaagcctttttgtagctcagagtgccaataaactcctctggactttctctgtaaagccttgtttatttctacttcctctgaatcatcccattttagattttcttttttaatctcgttcttgaactcaaaacctgaaaaaaaaaaaccccacagaaatacaatggactatagagaaggaaaacaatggaatgcaaagttataactatactacgtagaagaaatatctaattgaaattcttcatgtgattaagtctcctgctaattaatagctttttattttctcattgtaatatttttgagctccaaattattacaggaaaattatgccctaaactccaacttttctcctatcttttttcggatgttctgacacaatgacaaactgaggcaagacattaagcactatatcatctgccagtctgtttataggtgtaccctcaattcttgaatgttctaacttctagcagcagaataacaaaaggcaaccctgggcttggccagctcaaacaggaagaaagcaaggtgctaagtacccagccagcataggctcaggctgtgaaaggcaaggccatgctagagaaaaagggagaagatggacctggtctggaggcctaaccagcagtctgacaatgcatagtgaaactccatgggaaaagatgacatgaacttagttgaaagaggttggcaaatgcaaaatcagggctgtaaaatgcaaggggaataacctttaactccatgaaaaccaaaacttggatagggtcacacatcaagatgatgatgatgccaggatcagtgacagctcctactcaactgctaggctaatggcctctaaagtggactttgccatcctttgaccatcagagccaagggagtcttaccaagtctgtttgggaacagcactggcaggtctagtttcctgacttcctggccaggattcctgaagtccttttcatccctgtctgcaccatccacagtgccatcttctacctccgtgggttccccattctggtgattcagctctccagcctcaatatcacttccttcttggccaggaacagcatcgcttgccataggaggtgcagaggcccaggagcctgaaagagcattcatttcctcataaaagatacaaggctcaggcacacggcctctcctcactttgcggtaactcaactgtaggcttttgaacttggtgcgacactgttctggggtccgcagaaaaccctgctcccagagtccttccgccatggccctgtagatctggctgttctgctgacaggtctggagttttccataaaattgagaactactaagaatagccaggagcgtcttggtctcttcatagccccagggcacacctgttgctgggggacaaagaataggtcaattagatctgtcagttagatcatggaggactgtacatactgcagtgtgcagttttggcagcttaaaaagttacatcctaggctggatgcggtggctcacacctgtaatcccagcactttgggaggccaaggcgggcagatcatgaggtcaagagatcgagaccatcctggccaacatggtgaaaccccgtctctactaaaaatacaacaaaaaatagctgggtgtggtgccgtgtgcctgtagtcccagctactcaggaggctgaggaagaagaatcacttgaacccaggaggcagaggttgcagtgagctgagattgtgccactgcactccagcctgatgacagagagagaatgccatgctcatgggtaggaaaaatcaatatcgtgaaaatggccatactgctcaaggtaatttatagattcaatgccatccccatcaagctaccaatgactttcttcacagaattggaaaaaactactttaaagtttatatggaaccaaaaaagagcccgcattgccaagtcaatcctaagccaaaagaacaaagctggaggcatcacgctacctgacttcaaactatactacaaggctacagtaaccaaaacagcatggtactggtacaaaaacagagaaatagaccaatggaacagcacagagccctcagaaataatgccgcatatctacaaccatctgatctttgacaaacctgacaaaaacaagcaatggggaaaggattccctatttaataaatggtgctgggaaacctggctagccatatgtagaaagctgaaactggatcccttccttacaccttatacaaaaattaattcaagaaggattaaagacttaaacgttagacctaaaaccataaaaaccctagaagaaaacctaggcattaccattcaggacataggcatgggcaaggacttcatgtctaaaacaccaaaagcaatggcaaccaaagccaaaattgacaaatgggatctaattaaaccaaagagcttctgcacagcaaaagaaactaccatcagagtgaacaggcaacctacagaatgggagaaaatttttgcaatctactcatctgacaaagggctaatatccagaatctacaatgaactctaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaactacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtcgcgattcctcagggatctagaaccagaaataccatttgacccagcaatcccattactaggtgtatacccaaaggattataaatcatgctgctataaagacacatgcacacgtatgtttattgcggcactattcacaacagcaaagacttggaaccaagccaaatgtccaacaatgatagactggattaagaaaatgtggcatgtatacaccatggaatactatgcaaccataaaaaatgatgagttcatgtcctttgtagggacatggatgaagctggaaaccatcattctcagcaaactattgcgaggacaaaaaaccaaataccacatgttgtcactcataggttgtaactgaacagtgagaacacatggacacaggtaggggaacatcacacacggaggcctgttgtggggtggggagagaggggagggatagcatttggagatatacctaatgttaaatgacgagttcatgggtgcagcacaccaacatggcacatgtatacatatgtaactaacctgcactttgtgcacatgtaccttaaagcttaaagtataaaaaaaaaaaaaaaaaaagttacatcctggtttctcaaaccgtgccacaactggctattgttatttctaggaagaaatctcactgtggctttttgtctaaaacatgaaaacttttagtataatacaaaagacattccctccactgataatgacttatagggttatttactaaagctgcctatttaatttctcgttaattatcctcaatcctactcattcctcctggagaggtggctggcaataagggtagtggcttgcctgccttgacagttgtgggacttcctgagggtggccacataagaggacacagtgaacaggtgatactcaaggaaagcaaagattcaggggacagaggagctggttgtaacgatatatctgcctgttccctccctgatacaggaatacctcctcagccagcccatctctatctgtttatatctcctgtcatccttgtagatacaggaaactaaatgacagcagttaacacaccaaggtaagaataagtagtaaacatctgagaagagcagttcaggatggctggctactaaataaccctcaccacacacacctgctgcccatctgggccagttcatgaggaccgatttgactagagctgtcccagcaagtgcattccaacatctggtcatgatgctctgaagcgcaccagcctcttcttgtcaccccctcttctccacactgagccaccatcacctcatgcctggatcactgccatagcctatctggtcttcttgcttccactctggaccttctacggtctactttcaacccaacagccagagggagtcccctcctttgttattcaatttaactaacactgagtgcctacaatgccagtttctgagaaatataaatattacatgaaccctgccttcaaggaggtcacagtcctatagaagtctctccagcaaaaagagacacaaataaatgtttacgtagagttaagtgccaaataaagtgacatactcaaagtggtccttttaaaactattactcctctgcccagaaccgcacaaggctcccccatttcactcagaagaaaaaagtccttcatgtagggcctcatgatcccatattagtacttctcaaattatctatgaaggacaggagtcttgtgcttatttcttttgtaaaatacaataaaaatgcaaccgaatagtgcagcagtgtcaaattgttataaaagtttctaattgctccctctcagtctcagctagcagcactcatttgatctggctttctgagctcgttttctcattactcatgggtgtactctgtgccagtgaactggcatgcccacctcgctccagcccaagtcattgcgtctgtcttacactcttcctccatgtaggatatggctgcatagctcatccctcctccttcagcaagtcttttcaaatgtcattttctcagtgagggcgaccctgaggacccaaactgaaaactgcaaaccaacctctgccctagcactcccatcacgctgctctgctgctgcttctctcccattgcgcttatcgccctctaacatcttctgccgcttactgattatgctatggtctgtctcttcccacagggcaggaatctttatctgtttgttcactgttgtatccctaacgacctagaactaggtctgagatactgtaggcactaaattaatatttgtggaaagaatgacttgtcctctcacattctgtctcaactcttacctctaattttaaaggatcctcaatggttgacaagaaaccaaaagtgtgtggggaatacaagccctcattcaataagcctaatgttgtagcagttaaaattacaggtaccattacatgaaatattcagaatagctcaatccacagagacagaatgaagactggtgtctgcaaagggcttgcaggggaaggacggggagaaactgctggatggttgtgggaccttactttggagagatggaaaggttctggaactggacgtggtggtaattatacaacactctgaaagtgctagaggccaaagaattgttcactttacagtggttaattttatgtcatgtgaatttcacctaataagttaaaaatcacaagtacaaaaatatttatatctcaccttattgtattatccatatatacttagtaatacaaatctcaatacagagctcaaaaagacactatactctcctgcaactggacagagatgaggtgcagaagcctgaagcagcagcaagaaatggcacatgatgaagccaggaaactgggagttcctggcaaaggaggggagggatggcaggggcagagcagggaaaaaccacacaccactggggagggcaacattgtagagtgaggcggggcactgtcacagggcctgtgttcacagccttgtgtagtccctcccaccctgggcttagccaggagtaccctgcatgtgaagcagcagaggagaaatctaggcccagtgagctgcagtgtctgtctctgaatctgcatggtcagggaggctgctctgaggaggaggcatttggcccagatgggacagaactgatttgagaaaggcaagagagcggtctgcttggcagaaccttccccaagtgtcctgagatgctgggaaagggcctggttcctcccggaaggcctgggcatagtagactgtcctggttgggtggttttatttgttaatctcctctgccactggggaaactcgggagcgactactgctacctgtgtgcatgagcgcacattcagcatgaacacatctgtgctcctggtggccacctgtctggctccggctctggactacttgttctgactctgtctcactaacattttgcttctccaccgcctcacccttcacctcccatgttcttgactgccggtcacacatgctgcccctttcttttgatctctgcctgtgtctctctggcctgctctggttccccatttacttcctcctttccctccacccaacagtctccccactccctctgtctccctccctctcaagtcctttcagcctctctgaacaactgaacacatccaccttgacctggagggaagatggatccttacccagcgagacgtgactgtccttcctctgggtggcacccctgtagagggccctttgtgcagggcctgggcacatccattcttgctgacagagggatacagctctgttgtcacgcatggctggtccctgtaacaacactggagctgctgctaccgataaaatagcaccactctagcctggggtgggggcagagacaggatcacagttgtcagatcaggggcaaggcaaaggcaggggaggtcagctcccagtgggacaggttctgagccatgtgatgatgtcagagtggacagaatcaaaataacccgagaagccccatggaccacacagaatctttctcatgtctctggaaaggaggagggttttggggtgagagtgggtactcaagagacagaaggcatcaaccacagctcacctgggacccagctgtccagaccacagcacctgtctcctggtcgtggagacctgtgttttgaggcaggttcctgggagcctgaggagcaagccaggctgggggaaaaaacagccgctattagagggcggcttccacacaacagcacagagcagaagctctcaaagtgggctcctgggccagccgcatcagcagcccctggcaacccatcagaaatacaaattctggggccccacctcagatcttctgaatcggaaattctggaggtggggcctaggactctgttttatcactctcccacctccgaatgagtctgaggcaaactcaagtttgagaaccactgccagcgctcacggcctctgtgagttgagaagttcctttcatgagattcctcttggcataagagctttaatttttttttcattttaaagaaaaatatacatgtcagggaaaaaaagagaatcgtagtgggcaaacaaaaatctctccatagccctgccacccaaagataaccagagtactctttaaaataccacagtaacagaaacccttcatatttttcacaccaagataatacattttttctcaagtctccaacttcaagaattgtacaaatatgactgtgacatcgcttaaaaatacaggaaaattaaaaaaattgtacaaataaaatgaatcatgtctatgacttattaatggaacttcagtggcaactcagaggtatgtgacccttcgggaggtgacaacactccagatctgtgagtggcccatgggcctgggaagagcgggagcctagcctggaaggcagcaagtcctgcttctctttacttacagccccctgctgtcccaaagccttggaaatcacacacagagaacacaggtgttcccaaggattaaaaggaaataaatgctaagtggcaaagtttataaagatgttgacaagagtattaactttgcttaaaaaaaaactaaaatcagccgggcgcggtggctcacgcctgtaatcccagcactttgggaggccgaggcaggcagatcacctgaggtcaggagttcgagaccagcctgcccaacatggcgaaaccctgtctctactaaaaatacaaaaaattagccgggcgtggtggcaggcgcctgtaatcccagctactcaggacgctgaggcaagagaatcacttgaacccaggaggcagaggttgcagtgagccaacatcatgccgctacactccagcctgggcgacaagagtgaaactccatctcaaaaaaaaaaaaaaaaaacaaaatactaaaatctcttagacaattttccagtttatcaacacaggtttgccaacttaaacatcatcaagacacactgtttttcaggctggatgtggtggcacatgcctgtattcccagcactttgggaggctgaggcaggaggactgcttgaacctagcagtttgaggcagcagtgaactatgatgccaccactgcactccagcctgggcaacagagcaagaccctgtctcttaaaaaaacttacctagcaacctgtaatggcagcttccaattaaacagaaaaggcagcaagtatctagccaaattactttatggaaaaagacttataaaaatatagacccttggaatatccatgcaatggaatattcagccatcaaaaggaacaaagtactgatacatgctcaaaacatgaaaagtgaaagaaggcagacacaaaacgtcacataatacatgtgattcaacttatatgaaatgtccacaacaggtaaatccatggaaacagaatggggagcaactgtttaatgggtacagggtttccttttcgggaggataaaaatgttttgaaactagacagaggtgatggctgcataacactgtgaatgtactaagcataactgaattgttcattgaaatggttaattttatgttatgtgaccttcacctcaattaaaacaattttttttttttttttttggtagagacaggatcttgttatgttgcccaggttggtctcgactcctaggctcaagctatcctcccgcttcagcctcccaaagtgctgaggttacaggcataagccattgtacccagccaagataatttttttagtttaaaaagttttctaaggccaggcgtggtggctcatgcctgtaatcccagcactttgggaggccgaggcaggtggatcacgaggtcaggagatcgagaccatcctggctaacacgatgaaacgccgtctctactaaaaattcaaaaaattagccgggcatggtggcgggtgctttagtcccagctacttgggaggctgaggcaggagaatggcgtgaacctgggaggcagagcttgcagtaagccaagatcgcattactgcactccagcctgggcgacagagcaagactccgtctcaaaaaacaaagaaacaaaaaaagttttctaaaaaaattaagacaagtaaaaacaaaaaatagagctctggaagaaaagcaaaaataataaaaatgtattctggaaaagattaagttggatggggaaggggatttaatgtcttcaagtatatgaaaaactgctgtgcagaaggtgaaggtaaccatgttcacctttaatgacacctgattctttagtaacagaattgtaataaaaaagaattatgctaacacataaagaatctctgttcctactttaagtgctattaccctcaactgaaatttgtaatcttgcttttggatatggagagagatatatatatatttctatatatatatttctatatttatatatatatttatatttatatatatatatatatataaatttatatattttatatatatatatattttttgttttctttgagacagcccaggctggaatacagtggtgcgatcttggctgactgcaaccttcacctcctgggttcaagcagttctcctgactcagcctcctgagtagctgggattaccatgcccagctaattttttgtatttttagtagaaacggggtttcacgatgttagcaagactggtctcgaactcctgacctcaggtgatccgcctgtctggtcttccaaggtgctgggattacaggcgtgagccaacacgccctgccggtttttggatgtatttcaaaggcatttagtctggaacccttgggtggactcagttcagacctttgtttccagtaaatgattgttcctcacctgcctcaggtgaggacagaggcttctgcttaccttctgactgttcccctggtctttggtgtgagctctgtgatcccttaaaagtcggttcctctggctgaacctcctgtttccattgggatctcagtgattctctggttgctcccaaaggggccatctccttcatgagtactttcaagtccttctcagaatctagaacctgagaacagaccccattatctatcactacaaattcctgcctaagctggactttacaactcctaagagtggcattaaaaaatgtgtaacataaggaagcagaagagaaaaatctaggagccactgtattgctgctgtaataaaataaaaattaatagaattaggtatttgaggggcagtagcttacgcctgtaatcccagcactttgggaggccgaggcaggtggatcacgtgaggtcaggagttcaaggccagcctggcaacaaggtgaaagaaaccccgtctctactaaaaatacaaacattagctgggtgtagtggtgtgaatctgtaaccccagctatttgggaggctgaggcaggagaatcacttgaacccaggaggcggaggttgcagtgatccaagatcacgccactgcactccagcgtggacaacacagcaagactctgtctcaaaaacaaaaaaaaactctttgaagtggttaagattatttatatgacagcacctagcatagagcctgacacaccagaactgttaaaaactgaaatatatttgtcagaagagagaatgtcagctttcactttagcaaacccccatgacttcagcactaggccatttcctctgccccccaaatccagtatcagttctgtcttcaaaagagacctcgcattggtcctctctcttcacctcatggctccatcagggtccaggacactatctgctgtctgcatcctctctactgctggaccctccaatccattctctctacatggaacccagtgtgatctttttaaaatctagagtcctgtccctccgtagtaacagcactcttcagtggcttcccactgcacacagaataaaatccagactcctctttgcagcctaaaaggcccagcatcattctgcccggcctcctccctttctctcacagcactcttccccagtctctgagctccagccacaagccctcccttcttcctctcaaacccgcccagtcttttcccaccttaggctcttggtatgtgctgtgccctctgtctggagtactctcctcccagctcttgggacaactggttccttctcctccttcagtgtcacctcagagaagtcctgcctcacagcctatctcccaacactccagttatcacatcactctgctcatttccttccaagcactcatctgaaacgatctttatggtttacttttgatttatgattgtctgtttcccccatggaccgcgggctccagcaggccaggggccgtgcctgtcctgttcactgtaaaatcctcaatatcaacggtcactgaaaatcaacttttgtctttcagagccatcttcattctttaagtcccatgcttataacaaacacccttaaagggaatgaagagaggtactgagaggcaagtggggtcctgagaaattatatcaacctctattactactacccacctccacttcttgctctctccttcactttcatgataggtaataaggtttggctgtgtccccacccaaatctcatcttcagttgtagttcccataatccccacgtgtcatgggaaggacccggtggacgtaattgaatcatgggggcagtttcctccatgctactctagtgatagtaagttctcatggcttcccccttcactcagttctcattcttctctttcctgctgccatgtgaaggaggacatgtttgcttccccttccgccatgactgtaagtttcctgaggcctccacagccatgcagaactgtgagtcaattaaacctcttctctttataaattatccagtctcgggtatgtccttatagcagtgtgagaacggactaataaattaggtttcaaataggtgtttaacctatacactcctgcactgttttcttttatattaagagtgtgggccgggcacaatggttcacacctgtattcccaacactttgggaggctgaggtgggtggactgcctgagctcagaaggtcaagaccagcctaagcaacatggcaaaacctcacctgtaataaaaaacaaaaattagttgggcatggtggtgtgcacctgtagtcccagctacttggggggctgaggcaagaggatcgcttgaacccaggaggctgagactgcagtgagccgcattcatgccactgcactccaacctaagtgacagaccaagaccctttcaaaaaataaataaataaaataaacataagtgtgattccgacatggttaaggataagaagaggagagaccatcaaacagagtgatggaaggggaactgggctaggatgactcttggcatactgggattcccactctatttataatagttcagttctccaagttctaccttcatacaagtgctactgcacctctccattcaatcttacttatgaataagagtcccaatcccacagatttcagactaatttcctgaacttcttccctgatgcatcaccatcaagctgctcttcccctctctaaattaagtcaaaagtactaactcttcaatcctaccaaatttcatctatatcccccttcacccattcctcttcccacagcccgtgcacatccctacctcctcactgggaaacacaagtatatctgctgcctagggccttcccattccagccatgcagactctggcacccagcaagctgcttcctgctctgatcacagacccactcaggctgaccaacgttcctctgacctgtgccctccattactctaggcctctcccagacttacccaatttcagttgccttcctcctaccaactcttccacaaccgaagctggtatgttacttttcctcttcctgtgcctttcccacctccctgctccaagaaaatataagctggttacaccaatcagatctcagacctagtcctgaccgtaagaggatattttatgaatccatcagtgtcccaaactgaacacttaatcccggcatcaagaactagagcaaggcctggctctaatataattttgttgagtgtacaacacatgtcactctgccctcaaagaagctcctagcatgaaactagattttcattcactagcatctctagttttcctccatcccctgagtgaaggagagttgtcctttccctggccttgttttcgagaatttttctgagtgtttttaccaccttaattagggacttcaaatattattaaatatatgaatgtctagcagctgtatccacagatgagaaattcttcccgtattataagggcataggaccaatccaagacagccaagaccttctgtgggcagcagagggctactgtgtgtttctcaaccaagcacctctccagtaactggattccccgacaacttcataaccaaaaccacaaagttccgacttccttttctcacctgttgtccaggagctctctgtacatcctcaaccagagccacagcttcctcgccgttttctggatgctgctccctcacccaggtctggatctcctctggcaagatagtcagaaactgctccaaaaccagcagctccaggatttcctcttttgagtgggtcttcggcctcagccactgacaacagagttcccagagtttgctaaaagcttcatgtgggccagttacctcctggtagcaaaactgcctgaagcgctgacgggaggcctcggagtcagggctgttaccctggagggctgatttctggccctgtgtgggatccttgtttgaggatgggtgtgcctcggtactcttcactgcagccatcatttgcttcaacgaactggcttactctggttgccacttctaccctggagatcagagtccatctttcccacatcactgggaagccatgttctcctgcaaggaatgtctttctgtaatccgtgggacatgagagtgtcagacatgtgtagagactcacagcggaaaaaaagggctcaactttgaaggatgtctgaagaggatggaaaaagacaatataaacctatcaaacattccttcactctggttcttgtgatttacttcctatccctttcctttactccctccacaaatctacaccaaggatccaaaacactagaaatagatctagaccatcctggctaactgcctttgcaaaaaccattaacagtgagaagattatgacactaaaagagataggatctaaccaactccatcttgcttttaacctccaaactgccgttggtcattcctgggtgtgggccaagctagctttgggagaaatttagtttatagtttgaatgataataacccttcccaaaactaaactgcctttgtaaaactaattaaagacaactaggttaggaggatgagaggggcctgaattctgctaagatgcaggcataatgaaatgattatccagaggtcacaagatttgcaacttccccaattaaataacatcacgattgtagaacctaagattggccttttgagatgccttttcaggcctctgctttctgacaaccagatggctccacctagaccagggactcctctgtggctcccacccaaaatcgcactcagcacacaaaaaccgttttccacagccctatgaatgcatccccaaccagtcagcattccctgttccctacccaactgcgtgccaaagccctagcctctgaatttccggggaggctgacttgagtaataaaactttagtctcccatttagccggttctgtgcgtattaaactctttctctattgcagttcccctgtcttgacaaactggctttatctaggcagtgggcaagatgaacccactgggcagttacagtaccaaaaaatatagtcttctcccagccaagattctgtgtctgctgacgaattactcaaactgttcctgacgatatagttcacctgttccttcccttcttccctcacacacctaggtctttttcctgtccttccctatcctcaagaagcctgaattcatgttcccaattgctaccctctcctcgggggagaactggtgtgtgtgtgcttcttgattaacttcttcattactattactccacacacacacaacgtggataagtgactgttcgggtttgctgtatgtttttattttccagcattcctttcccacttctagtagcagcatcttcttcctttgtgaaaaagtccccctcgaccaggcgtggtggctcacgcttgcaatcccagcactttgagaggccaaggcgggcggatcacgtggtcaggagatctagaccatcctggctaacaagatgaaactccgtctctactaaaaatacaaaaaaattagctgggcatggtggcacgcacctgtagtcgcagctactcgggaggctgaggcaggagaatcgcttgaacccgggaggcggaggttgcagtgagctgtgatcacgccattgcactccagcctgggcaacaagagcgagactgtctcaaaaaaagaaaaagtccctctcattggttctggtggggatattaattacaatacccacttccccagaagtgggcatatgacacacagctaggcctatcaaaattcttttctcagattttacatgagaggtagggaaagctcttcattttctaggaattggtaaattgggcaaatgtaagatcagagttgtctccaactatgtcccactctctactccactcttccatcacaggagtgagcctgtttacaagaggacaatatactcaagtcttgacaacatgtttggatctccaaggccagtttatgtaaggcaatatttttttaagagttaattttaaaaatagttttatataatttaaaattaataaataacttttaaaaataattttatttgtttttttatctttagagatggagtctcactctgttgcccaggctggtctcaaactcctgaactcaagcaatcctcccacctcaacctcccaaagtgttaggattacaagtataagccaccatgcccgaccttaaaaataattttaaatagaagctaacttttgtattttttgtagaggtggagtttcactatgttgcccaggctggtctcaaactcctgtgctcaagtgatcctcccaccttggcctcccaaagtgctgggattacaggtgtgagccactgcacccgcgaaggcagtcttttttaatgagtttgtgttggtttttatctacttaaaacacagattaaagcagatcgtaatttacattttctccaggggctgatacaccctcaccatgtggtattaaaatggatccagcatgcacaacaagatgaatatactcaggactactgagctgtacacttaaaaatggttatgatggtaaatgttttttaaaaattaaagaaatttttttatattttaaaaatggatttgggttcccttttctcaaggaacttgaactgccttcacttaaattctctttacatttcagtgcttctagagatagagaaatcaagggcattattattgttagcactgctttctagccaaaaagaaactgagagcgatgaagtatcttgcctaaagcatcacacagcacagctcctaggcagcaaggccaggactagaaccagcaccccttgccttcattatgttcatcctgtgccttacctggctgaagaagaatttaataaaagctcttctaacttcatgcagaaggcggaacctgcacccttcttgaccccttttgaccccttacctcccactcatcgttaaattttaaaatgctgttctctgaaaattttacttcactctagcgatggcccaaacactcggaaaaaaatgtagcatgaggatggggagccaggttgataggtttttcacttagttaactatttattgagtactcagaacgcactcggtgccagggctaggcactgtggatgagtagggagtgggcgagacagggacgagatgagcagggtcaaggccagggggtcccggggcgccggcgctcaggctcggggtgatccgcacggtgggagcggggcacggtgatcgcggcgcgtctggggacgcccggcctgagggaggctgcctgtcccaaggagacgcccatcggggccggacccgaacgcctcggagaagactcccagcggggaggggctcctcggccgtcgcagggcccagcggctaatcccgccggccgcaaggaagcggagaactcaccggacaccagcactcgcgactccacaaactccctcagcctccgggccggaagtcagcggcgcgattcgctccgcccattac

SEQ ID NO: 867 - DNA, 8176 bp, Homo sapiens
cagcgagtggcatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtaaggagggtcctctcccatcatcctggggatttctttttcttttctttttttttttttttctttttttgagacggaatcttgctctttcgcccaggcccgagtgcagtggcgctatctcggctcactgcaagctccgcctcccgggttcacgccattctcctgcctcagcctcccgagtagctgggactacaggcgcccgccaccgcgcccggctaattttttgtatttttagtagagacagggtttcaccgtgttagccaggatggtctcgatctcctgacctcgtgatccgcccgcctcggcctcccaaagtgctgggactacaggtgtgagccaccgtgcccggccgatttctttttcatctgggtaatgtttggtatctggatctctccctatttaagtctcagaagtggactggatggcttcagaagttgcttccagcctctatctgggaacctatcctgagttattaacaggtttttagaaaatccaactactgatacccagtgaggcaacagaggaccaaggttcttaccattcctttatgcaccttgtgtcaccagaagtaattgtaaggttcttaaatcccttctgtcagctcttcccccacccaacttagttttcctactagcagaattcttagcagatagggtcaccctgttgggtagcagttggactttggggaacttcatttcattggaagttctagcttattgtctttccagtgtttagcttatagtctttttttttttttttttttttttttttttttttttttgagatggagtcttgctgtgtttcccaagctggagtgcagtggtgccatttcagcccactgcaacctctgcaccccaggttcaagcgattctcaggtctcagcctcctgagtagctgggtttacaggtgcctgccaccacgcccagctaatttttgtactttttagtagagagggggtttcactatgttggccaggctagtctcgaactcctgacctcaagtgatcctcccgccttggcctctcaaagtgctgggattacaggcgtgagccaccacacctggcctagctttttgtctttgatttttttttttttttttgagactgggtctcactgtgttgctgaggctggagggcagtggcacgatctcagctcgctgcaacctccatgtccagctcaagtgttcctcacacctcagcctctcaagtagctgggactgcaggtacatgccaccatgcgtggctaatttttgtacttttgtagagacagggtttctccacattgcccaggctggtcttgaactcttcttgggcccaggcgatccgcccgtcttgacctcccaaagtgctgggattacaggagtgagccacacaatgcctgactagcttattgtctttggatcaggaagttacagttcaactggccagcgttgccattgcttgccactccccgccccgaagtcagaccccagtcaggacctaggcaagaagcaaacggcaggtacttcggaaaatagaacttgttagggaatgaaggtggggtggtcctcttagacccctactactactgggatctccttaccaggaaagcctttggcagaacaatgtattaggtaagaaggacttttaacagcccctcaccatactgcttcctgttcctacagggcctatttccagcagaagtaggtggggggtggtgtgtagagtaggcatctgatggcccagtgttgtgactgaccctgatatttgtgccagcaactaccctgatgactttgactctggcccttgagaaaggcccaagctttaggggaagccactcggctgatttgtagcatcctcattcctgtcattcttcacgttctcccctttacttcctttgagggtttcagtggtttctatgaaagttgacctctagatggttatcagcaattcccaaggtaaacgggtcattatacaacagtgagagatcaagcttccctcagtcctgatggatggaattaatggatggggcttgttcctaggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacaggtaaacactctgccttttctctccctctcatcagccctttatctccatcaatgtatctcatggttctgcaaaggcatagaccacatgtgtgtgtttttttaaatgttatatataatagtagatgattattcactaaacaaatttcactaattaggatggtggtgatactacaagtaagtatgtttttatcgttttctgttaatgaaaatttaagaatccagtgcatgacagggttgtacctacttttctgtccgtttcagaacttcttatagaaaagacagatccaaatatggccacagatgaacttccatgcaagctatggctgagtttcattgcttaaaatgctcctctgtttagaggggcctggtagaaataaaaacccaccctatatcttatatctttgtcctcctctgtgatgttgcttgtactttagatcctcaaatctatttccctttctctggtgtgatacttgtgtaactgctggccttgttctacacagtcctgtgatctctaagcctgaatgacagtgacattttggccaagcctggtgatgtgaatacaagatacagtgagcacgttagggaggagggttacaagacgacaaaaatcctcagtttcttaatatttgctacatccaatgaggtacttcgtgttttagtctgttcaggctgctaatataaaatgctagagactaggtagtttataaacaacaggagtttatttctcacagttctagaggctaggaagtctgagttcaaggtgccagcatggttgggttccagtgaggcccctcttccaggtcacagactgcctacttctcagtcctcatgtggcagaaggggaagacaggctcccgtggggctctttcatgaaggcactaatcccattccagtgagggcagcaccctcatgacctaatcacctcccaaaggccccatgtcctaacactattaccttgggagttagaatttcatatgaatttggaggaacataaacatttagcccctggcaaccacagtctactttttgtctctagaattgcttattctgaacattttatacaaatggaatcacacaggccgggcacagtggctcacgcctgtaatcccagcactttgggaggccaaggcaggcggatcacttaggctcaggagttcgagaccagcctgggcaacatggcgaaatcctgtctctacaaaaaatgcaaaaattagcggggcatggtgctgcacacctgtaatcccagctgcttgggggagctgaggcaggaggatcacttcaacctgggaggtcgaggctgcagtgaactgagatcgtgccactgcactctagcctatgtgacaaagtaagaccctgtctcaaaaataaataaataaataaattgaatcacacaatatgtggtcttttgtgtgtggcttctttcactgagcatgttttcaagttttatccatgctgtagcatcaatcagtgcttcattccttttctgtggctgaataataggcattgtacggatatattacatgttggttttctgttcatgttggttcatctgttcatagatttttgggttgtttctactttttggttattatgaagaatgctgctataaatgtgtgtttttgtgtagacatgttttcatttctcttgagtatatacctaggagtggaattaccatatgctaggtcatgtggtaattccatgtttaacttatgaggaactaccagactgttttccaaagcagctacaccattttacatccccaccaatactgtgtgaggattccgatttctccacattcttgctagcacttgttattgtcttatacccatcctattcggtgagaaattttgatttgaggttttgatttacatttccctagtgactaatggtgttgaacatcttttcatgtgcttattatccagttacatatcttgtgtggaaaaatatctgttcagatcctttggtcatttttaaattaggttatttgtctttattttttataagagtcctttatgtattctagatactagacccttatgtgtaatttgcaaatcttttctctcattttgtgggttgtctcactttcttgacagtgtcctttgacgcacacgtttttcattttgctgcagtctaatttatctatttttttctttctttatgctttggtgtcatatgtaaaatagcactgcctaatccaagggcacaaatatgtacagctatggtttcttcaaggagacatagatttagctcttactttcagctatttggtccattttaagtttattttttccccatacataaacaagtcaatttttatataggttttgaggtaggggtctgtcaatctgatcaggggtctgtcttaatctgatcaggctcttacaacaaattgccttagactaggtaatttataaacaacagaaatttgttgctcatagttcctggatactgggaagttcaagatcaaggtgccagcagatttggtgtctggcgagggcccattcctcataaatggtgcctgctatgagtccccacatggtagtctcttgggtttcttttataaggacactaatcccatttatgaggaccccaccctcataacctaatcacctcccagatgccccacctcccaagaccactgcactggggactgtcaatatatgtgtgtcaggggacaggggggataaacattcagaccatagcagggtccaacttcattctcttgtatgtggaaatccagtagtcctagaatcctttatgaaaaagactattcttttcccattgaattgtcttgtcaaaaagcaattgaccctgattgtataggctgattatttacatttgaatttaaatgaattaaaattaaaaaaaaatttaaaattaagttccttagtcacagtagtcacatttcaagtacccagtagccacatagtcacatgtggctagtggctgccatattgaacaacgtgcatgtgcctgtgcatgcacgtgtgcacacacacattttccacatcacaagggatccttctccagatcctgtgatttcccataggccgttccagctcatctccatccagactgtcaatccttctgtaattaggatacatggctaagccctgattccagtttctgaactcatatactgtcaaatttgtaatgaaagaaaacatcacagtctctgaacttaccatcttttgaagagaaggtggttgtcaattagtgtttactaagtgaggggtatttgttgaaatagctcaggcattggactacagcagtaaaatttgcaatgttgagatttcacctctcttccttcttcattagatacccaattctgatgggtttgcttttccctgttcttcatttcctaaacctttccctaaagggagaaaggaagaaggaggatggagaacttggttcctaaatttaatataaatcacagtcaccccaggagcctgctaactgtgcagattatcaggcccaaccccccgagattctgacccagcagctctgggggaagggtgaagagcctgcttgtttaacaagtgctccagatgagtctaatgcaagttgccagcggagggccaccctttgagaaacctctcagagtatttcataactcttgctgaagttatttcttccaagtgcagaaaatgaagcattttctttctaattatagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttacttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgaagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccagaa

SEQ ID NO: 868 - DNA, 3855 bp, Homo sapiens
cagcgagtggcatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtaaggagggtcctctcccatcatcctggggatttctttttcttttctttttttttttttttctttttttgagacggaatcttgctctttcgcccaggcccgagtgcagtggcgctatctcggctcactgcaagctccgcctcccgggttcacgccattctcctgcctcagcctcccgagtagctgggactacaggcgcccgccaccgcgcccggctaattttttgtatttttagtagagacagggtttcaccgtgttagccaggatggtctcgatctcctgacctcgtgatccgcccgcctcggcctcccaaagtgctgggactacaggtgtgagccaccgtgcccggccgatttctttttcatctgggtaatgtttggtatctggatctctccctatttaagtctcagaagtggactggatggcttcagaagttgcttccagcctctatctgggaacctatcctgagttattaacaggtttttagaaaatccaactactgatacccagtgaggcaacagaggaccaaggttcttaccattcctttatgcaccttgtgtcaccagaagtaattgtaaggttcttaaatcccttctgtcagctcttcccccacccaacttagttttcctactagcagaattcttagcagatagggtcaccctgttgggtagcagttggactttggggaacttcatttcattggaagttctagcttattgtctttccagtgtttagcttatagtctttttttttttttttttttttttttttttttttttttgagatggagtcttgctgtgtttcccaagctggagtgcagtggtgccatttcagcccactgcaacctctgcaccccaggttcaagcgattctcaggtctcagcctcctgagtagctgggtttacaggtgcctgccaccacgcccagctaatttttgtactttttagtagagagggggtttcactatgttggccaggctagtctcgaactcctgacctcaagtgatcctcccgccttggcctctcaaagtgctgggattacaggcgtgagccaccacacctggcctagctttttgtctttgatttttttttttttttttgagactgggtctcactgtgttgctgaggctggagggcagtggcacgatctcagctcgctgcaacctccatgtccagctcaagtgttcctcacacctcagcctctcaagtagctgggactgcaggtacatgccaccatgcgtggctaatttttgtacttttgtagagacagggtttctccacattgcccaggctggtcttgaactcttcttgggcccaggcgatccgcccgtcttgacctcccaaagtgctgggattacaggagtgagccacacaatgcctgactagcttattgtctttggatcaggaagttacagttcaactggccagcgttgccattgcttgccactccccgccccgaagtcagaccccagtcaggacctaggcaagaagcaaacggcaggtacttcggaaaatagaacttgttagggaatgaaggtggggtggtcctcttagacccctactactactgggatctccttaccaggaaagcctttggcagaacaatgtattaggtaagaaggacttttaacagcccctcaccatactgcttcctgttcctacagggcctatttccagcagaagtaggtggggggtggtgtgtagagtaggcatctgatggcccagtgttgtgactgaccctgatatttgtgccagcaactaccctgatgactttgactctggcccttgagaaaggcccaagctttaggggaagccactcggctgatttgtagcatcctcattcctgtcattcttcacgttctcccctttacttcctttgagggtttcagtggtttctatgaaagttgacctctagatggttatcagcaattcccaaggtaaacgggtcattatacaacagtgagagatcaagcttccctcagtcctgatggatggaattaatggatggggcttgttcctaggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacaggtaaacactctgccttttctctccctctcatcagccctttatctccatcaatgtatctcatggttctgcaaaggcatagaccacatgtgtgtgtttttttaaatgttatatataatagtagatgattattcactaaacaaatttcactaattaggatggtggtgatactacaagtaagtatgtttttatcgttttctgttaatgaaaatttaagaatccagtgcatgacagggttgtacctacttttctgtccgtttcagaacttcttatagaaaagacagatccaaatatggccacagatgaacttccatgcaagctatggctgagtttcattgcttaaaatgctcctctgtttagaggggcctggtagaaataaaaacccaccctatatctta

SEQ ID NO: 869 - DNA, 38107 bp, Homo sapiens
tgtttgtccctgaccgtgcgccgtccaagggtccattggttgccatagagatcgtcgagcgctgggcctgtgatcgctgaggggcgagcagttgcgaccctgggctcctggggacctgagcgttatgtctttccgcgacctccgcagtaaggcagccccgcgcccctgtgacctgcgggtcttccagagattcagggctcccgcccgccgggtcccctgtgtaggcgatccctgaggcttgcgctgccggaggctcctttcgggcctctgcgcctcagggaccgcctgacccgcggctgcaacccggccgagcgtcccaggcccttcttcggccatttctagcgaggatggaaagttctctatctgccactggccgcgtgtggctcagaacgcttgaaatgtggctagtgcagatgaataactgaatttttaagtgtaatttatttctgtttgtgtagctgcatgccgctcttcgctaccgtattggaaaatgcatggagagtttagagactattttttgagttgggttagcttagcgcttagaaaaccgaacagcaggccgggcgcggtggctcacgcccgtaagcccaacactttgggaggccgaggcgggcgaatcacctgaggtcgggagttcgagaccagcctgaccaacatggagaaaccccgtctctactaaaattacaaaattagccgggggtggtggcgggcgcctgtaatcccagctactcgggagtctgaagcaggagaatcgctttggaggttgcggtgagccgagatcgggccattgcactccagcctaggcaacaagagcgaaacaacatctcaaaaaacaaaaaacaaaccaaaaaaaaaacaaccagcaacgaaaccgaggagaggaggctgggtgataatcattgcggctaacattttttgagttttaacgatctgccagggcccgctctgtgttatgcgcatttcattttaatcatctgaacaactctgtgccccctgtatttggtagtgaggaaacgggcacagagaggtcaggtaacttgggcaggtgatacaggcggtaggaggtggcactggggcttgaattcaggttgcctgaactccagacatcctgaactccatctgcatcctttctgcagggctggtaaggagaagggagctcgaattcctttgctaagagggtggggaagtggaagaacgaggctaagagtgttggttacggctgggcgcagtgggtcacgcctgtaatcccagccctttggaagaccgaggcaggcggatcacttaatttcaggagttctagactagcctagctaacatggcgaaaccctgccgctgctaaaaattcaaaaaattagccgggcatggtggcgcgcgtctgtagtcccaggtacttgggaagctgaggcaggagaattgcttgattccgggaggcagaggttgcagtgagccaagatggcaccactgcgctccaccctggccgacagagtgagactgtctttaaaaaaaaaaaaaaaaaaggaaaggtagatgatgattgccaatttggtgtgatccgaggggtctcttaaagccagttttctcgtccaattgttggtgcctgaaattttagcattagagattactccttttggttatgaattgctcttttctacaatgtaaaaatatctaggaagacgcattaccttttatccatgcagccactgagcaccagagtgtgaatcctgccctctggggtttgaaggtttttggtggccacacatcatgcaggatgactgtctcctcccacatagtttttagagaggccagcaccctgccgggggacgtagaatggggttttgttggggagcgcacacacggagatttcggaatattttgatcttaaattaatgctctgcagttgtgcagtgtatggtaaggatcttactcaaattagtgtctattttgacaataacaccgcagcattaacagaacttgactagtacctagtggtcaggagtatttaggcagtgccttactgtgtgaaggaaaggctgctgctttcttttctgttctttttttgagacagtcttgctctgtctcccaggctggagtgcagtggtgtgatcttagctcactgcaacctctgcctcccagcaattctcctgccccagcctccccagtaactggaattataggcgcccgccaccacactcacctaacttttgtatttttatttttattttattcttttctttttttgagatggagtctcgctctgtcacccaggctggagtgcagtgacgcgatctcggctcactgcaagctccgcctcctgggttcacgccattctcctgcctcagcctcctagtagctgggactacaggtgcccgccaccacacctggctaatttttttgtatttttagtagagacggggtttcaccgtgttagccaggatggtctcaatctcctgaccttgtgatccactcgcctcggcctcccagagtgctgggattacaggcgtgagccactgtgcccggcaacttttgtatttttagtagaggtggggtttcaccattttggtcaggctggtcttgaactcctgacctcaggtgatctaccctcctcggctcccaaagtgctgagattacaggcgtgaaccacccgcgcctggccttttttgtttttgtttttgagacagggtctcactctgtcacccaggctggagtgcagtcacatgatctgagcttactgcaacctcctgggcccaggtgatcgtcccacctcagcctgctgaatagctgagaccacaggcatgcaccaccacacccagttaattttttttttaatctctgtattcacatttcccagaaaacagttacagagtccctttgtgactttgctgtttcctgtgctcacactttctgtttcattgtcttgcgaagtctgacctgacttgcagtacctaggtaggttatttgtgaacattgatggaccattttgaacatggatcttcaagaagagtgcagacagaccttaaataaccaggaagcacactgaatgtagatcttggtacatatgggaactcaacaaatgtttgtggtgttcatttccaagtcctgctctcttgaaagcactaaggcttttcctgaggtgaccccaacctatggatcaacaagtattagtattactgtttcttaatctgttttatagtaaatctaaatatggttgtatagttcaaccactctatttaagatttctctaaatacaaggcgactgatctttaaaacttgtgttatttgggtcctatgtggtcactaaaattaaaaaaaaagacaactcagaaacatgaatgtcatcctacggattcccctcagaaataaccactgttaacattttaaaacactttttaatcagctgaatttgagtcaaaccactgttgacatttaaaaatactttttcttcatgacattttataaggacgggtgtttcttccttttagcagtaaaaagaaatgagatactaaagagagaaatgaaattcacagctaatccctcaattccattttcatgtatagccatctacttctcccattgaacttaaatatatgctttttaggtagcatttttggtattttaaattttatctcctttttgctttcccttgtagaaagttgacaaatagtccctaaagctgtcaataggttggaaataagaaggaaaagtaaagacaatatctaagttaataagtagttgctgtgtgatggggaactgaatgaattgtatttttccttggacagatttcacagagatgatgagagccctgggataccctcgacatatttctatggaaaatttccgtacacccaattttggacttgtatctgaagtgcttctctggcttgtgaaaaggttcgaacggcactttattgacatctaagagtgaatactgggttttatttattagtcatctagaaaacaggacacagctgtgatgctgcaaaagggaaagtttttggaatttgacagacccagctgtattctgttacaaaggagttgtggctgggcacagtggctcactgctctcatcccagcacttcataatctcagtcattcaagactagcctcatcaacatagcaagaccctgtctccatacacaaaagaacaattagctgagcctgggtggtacacactcatagttccagcgactcaggaggctgaggcaggaggatcacttgatcccaggagtttgaggctgcagtgccactgatcatgctattgcacaccagcccgggcagattgagactgtgtctcaaaaaacaaaatcaggccgggcgcagtggctcacgcctgtaatcccagcactttgggaggccgaggcgggtggatcacgaggtcaggagatcaagaccatcctggctaacacggtgaaaccccatctctattaaaaacacaaaaaattagccaggcgtggtggcgggcgcctgtggtcccagctactcaggaggctgaggcaggagaatggagtgaacccgggaggcggagcatgcagtgagccgaagtgtgcagtgagccgagatagcgccactgcagttcagcctgggtgaaagagcgagactccgtctcaaaaaaaaaaaaaaaaaaaaaaaatcagtggagtttaaagaatgctgtgggagtgggaaatataccaggaagtcgtgaaaggagacgactattcctcagtaggatgctgggccaggctgctcttcagcccctcatggcagagtgacaggggcctttttgcacattctgatcagtacactggattagaaataatggagatttctttttctgtgaaaaaattgaatatgttatatgattcagggttggcagctttttctgttaaggaccagataatattttaccttttgctaaatataaaattcataagatctctattgcgtctcttctttttgttaaaatgtaaaaacagttcttagcttgcaggctgtacaggtcggaggctgcagtctgctgacccctggtttcaataccttgaagaaaataacttcaccaactctgctgctgcttagagctgactaatcggccctagcactgatctctgagtcaagggctgtcagccagggtagcagttctgattagcttcatgacatggtgagatctgagagagatttaattttataagctgagatccacatttagtttttgaaatctgtttttcttaggtggggatttgctcccttggtatttggttttgcttttgaagtttgccttgatctcactctcccacttggggacttggagagcgttgtgttccagacccgctgtcctctcagttgcccacattctctttagtagactttctccttggttaacccgtgctctctcctcttacctctcttgatagatatgagccccagactgacatcccgcctgacgtggatactgaacaggaccgagttttcttcattaaggcaattgcccagttcatggttagtggacacttattttgtggagttgtaaaattaaataaactagaaaggatgactccttgttagggcgactttcaaactgtgtaattgagtttttctttctttttttttgagatggagtctcattctctcgcccaggccggagtgcagtggcacaatcttggctcactgcaacctccgtctcctcgggggttctcctgtctcagcctcccgagtagctaggattagaggcacacgccaccacacctggctaatttttgcatttttagtagagactgggtttcaccatgttggctaggctggtctcaaactcccgacctcaagtaatccaccctccttggcctcccaaagtgctggaattacagatgtgagccaccacgcgcctggcctgagtttgctttctaaaaccattccattgctgggtttctgtggcaccatttcaccagcgaagttctttttgtttgtcttttaattcattatttgttaagaattttgtttatgccaggtgtggtggctcacgcctgtaatcccagcactttggaaggccgaggtgggcggatcacgaggtcaggagattgagactatcctggctagcagggtgaaaccccgtctccagtaaaaatacaaaaaattagttggatgtggtggcgggcacctgtagtcccagctactcgggaggctgaggcaggagaatggtgtgaacctgggaggcagagcttgcagtgagccgagatcacgccactgcactccagcctgggcaacagagcaagactctgtcttaaaaaaaaaaaaaaagaattttatttatttatttttgaatagataacatatttcatggctcacaaattgaaagtaggctgggcgtggttgttcatgcctgtaatcctagcactttggcaggccaaggtgggaggatagcttgagtccaggagtttgagaacagcctgggtgatgtagtgagatcctgtctctacaaaaaataaatttaaaaaaaattagatgggcctggtgacacgtgcctgtagtctcaggtgcttgggaggctgaggtgggaggattgcttgagcccgggaggttgaggctgcagtgagccgggatcatgtcattgcactccagcccaggtgacagagtgagaccctatctcaaaaaaaaaaaaaaaattaaaaacattatgaaacaaaatggagtaaaatgactttttaccctatctgccctgggccaagttccattccaaataaccactattttaaatctcttccagagtttgtgtgtgtgtgtgtgtgtgtgtgtgtgtgtgtgtgtgcaaataaaaatatatatttttcctttgttttacacaaatggtactgtattctacttgatgtacttactgtacactacaagatgtttagcatcttgctttacttaatggtatattttagagaactttccaaatacatatagaatttcctcattctgtttacgcctgagtggtattgcttgcatggatttgccataatttatgtaatttatataggtaggcttttaggttgtctgaagctttgctctttggaacagtgctgtaacaaataacctgtacatctcattttgtttgtgtttgagtgtgtccctagaataagttcttagatttgggattgctgggtcaaaagatatgtgcatttgtaattttgatgtcttttaccaaattgctctccatcaagattgtcccagtttatacaaccactcacaatgtttgagtcacttgaatgctttgcttttattaggttatatcccagttgtcagcagaggcattttcaactcacctacatgggatttagtttagacattacatggaaagggccttcaactttttttttttttggtctaaaaataggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaaggtaaggacaacaaaagccttgtagtgggcgatggagcgttgatttcttgagctctgaagtggaaggagtctgctacagctccgctgcttttcttcctcctcagctgagggcagtttgtcagttttgtgctcatcagcatttggataaagtcaaagtcacaatccactaattcaactatttattaaaagcttagtatttgtcaggtagcattcaagcgctgaggatacagttgtgaacaaaaaggacaaaaatcgtgtgtttattctcttcagttaggggagtcagactgtgaacaataagaggtgtggaaggccagatgcagtgcaggctgtggagaataataagctgggatggggatggatgctgcccagagtgatcttaaatcgggtgatcaggaaggcctcatggattggatggtgtttccagcagagatccaagggagggaaagagtgagttgtgcgggtggcgggtggcgtcagggtgtctcaggatgataatttgttttgggctgggtgcagtgactcactcctgtaagccaaacactttgggaggccgaggtgggaggatcctttgatgccaagagttccagaccaacctgggcaacatagtgagacgccatttttaccaaaaaaaagaaaaaaattagctaggcgtggtggtacacacctgtggtcccagctgcccaggaggctgaggtgggaagatctcttgagcccaggcagtcaagccatgttcatggcactgcgctcccgcctaggcaacagaacgagaccttgtctggggggaagaaaaaaaatgtgttttgtgtgtttgaggaaaagcaaggaggccgtgtgatgagggttgggattgacagaccctctggcgcctgggaagcccctggaaagcctttgtctttgcctctaaggtgggaatcgttgggatccaagcggaaccttctgtgcttatttcccgtccaaagggttgctctggctgctgagccgccatcagaccgaagcaggcggcagggctggaagcagcgagcctgtttggagagtgaggggtgaccgtggctttgagcagagtgctggtgggacaggtgccgtcaggtgtcagggagcgaccacagcagcaagccagaaataaaggttaagccgttactctgaggcccaaggcctcagagcaggagacctaggaatgaaggccccggggctgggagtgcacctaagagtgtggccacgcagggtacgtgaaaccacagtgcactggctgagctccaagtctgctgcagggaagaaagcttcccctgtgaggcctgctaggtgaggccttgtcatggtctatagttgggcttgaaaagccacacacagcttttttgttttgtttttgttttgttttgagacggagtttcagtctgtggcccaggctggagtgcaatggcacgatcttggctcgctgcgcctctgcctcccaggttcaagagattcttctgcctcagcctcctaagtagctgggattacaggtacacaccaccatgcccagctaattttttttttttttttttgagatggagtttcactcttgttgcccaggctggagtgcaatggcacaatctcagctcactgcaacctctgcctcccaggttcaagtgattcttctgcctcagcctcctgagtagctgagattacaggcatgcgccaccacacccagctaattttttacttgtagtagagtcagggtttctccatgttggtcaggctagtctcgaactcctgacctcaggtgatctgcccgcctcagcctcccaaagtgctaggattacaggcgtgagccaccgcacccggctttgtatttttttttttttttttagcagagatggggtttcaccatgttggccagctagtctcaaactcctgacctcaggtgatctgcctgcctcggcctcccgtagtgctgggattataggcgtgagccaccgcgcctgtcctcacatgtgggtttttaaccaggagcgacactcgtcagcaagagaagtgtctagagattggggcatattttgatggtagatctcacgggatgaggcatgggttgagagtaagtcaggtgctacaggccgggtcttggggcagccgtgcggcagagcttgcagagctcatgggtgtgttccgcctctgtgctgtactctacgggaaccactggccacatgtggcaagcacaactgaggaactgagttgagttctgcattttctttaattcttaagtaatttaagtgaaaatggccacatgtggctattggttactatattagacatcactgctctgaagttttttgtgtgagcccctggaaggatgaagttgccatgtactgaagcagagaaggttctgcacatgctccatttgccacgccgattggctgtccaggtggagatggtgcacaggtagctggtatgtgaaactagagcccagggaaagcccaggctggagctgggagctggggagcaatcagcacacagatggtattaaagccttgagggtaggagcagagccagcagaaaagacggggggtccaggaatgaaactctgactcgctccacttttgagaagcagagaaggtgacagactcctgcaaagaagtttggggatgtgctgctcggaagggaagaaaagcagctagagccagagcaggctggatcctggaggactaaggaagagggaagcaagctatcaaagccatcagctgcaaatgaagagggagagttgttgctagtgggttgaaaatgagagccagaaggtgaggattggttgtccaggagagagggagagtgagcagagcagggagacgtttatgtttgggctccttagaagagttagcatattctaggaagaaggggtgacacacacatcctaagaaagaagcctgtgcacagggctcagtgctaaatcctcattgtggttgtcatcaccttcctggcaacagctgcccatctgtggagcccagaaccattgtaagtccttagtgggtgccacccgatttgcgcctctccaagcctgtggaggaaagtctgaggcagagaaggagggcaggggaggacgaaacacaggacgtcaggctgctgcaagaggatgtgtgtccctcaggctgtccctttgtgtggccgctctgctgccgtcaggcaccctactgtgacaaagtccaagtaggaagcacgtcagctttctcccagctatgccctcctggttgtggcttcagtttgaggtgacattaggttttttggagagacccaggcgtcctggaattggtctctttagtacttagatgatcatttcctgagcgtgtgtcccgcagcctgtgagcatgtaactggggaagcacatgtttgtggtcacgtgtcccaaccaaaggtaggagctgacatgaacaggctagtggttgaatgcatgttaaaaatctgtggctggccgggcacggtggctcacgcctgtgatcccagcactttgggaggccgaggtgggtggatcacctgaggtcaggaattcaagagcagcctgaccaacatgtagaaatcctgtctctactaaaaatacaaaattagccgggcgtggtggcacatgcctgtaatcccagccacttgggaggctgaggcaggaaaattacttgaacctgggaggtggagattgcggtgagccgagatcgcgctatcacactccagcctaggcaacaagaacgaaactccgtctcaaaaaaaaaaaaaaaaaaatctgtggctggctgaacatggtggttctgcctataatcccaacactttgggaggctgaggtcggagggtcacttgaggccaggagttagagagcagcctgggtaacatagccaagaccctgtctctattaaaaaacatctgttgctgaggtttctgtttttgttattttccttccagattgcagatttgaaggcagccaggcagcttgcgtctgaaatcacctccaaaggagcatctctgtatgacttgctcggcatggaagtagagttgagggtaagcattccagtacttccttaaccatgcagattttctcttcaaggttttctttttcaattctgtttctcccttttcagttctgatttaatgaaatacacctggttgaatgagctaatgtgtggaaaggtgatagaggatattagctgtccttcctgcttctggtgggcactggtctagctttatttatttatttatttatttttatttatttatttttgagacggagtctcgctgtgttgcccaggctggagtgcagtggcgcaatctcgtctcactgcaagctccgcctcccaggttcacgccattctcctgcctcagcctcccaagtagctgggactacaggtgcctgccaccacacccggctaattttttgtatttttagtagagacagggtttcaccgtgttagccaggatggtctcaatctcctgacctcgtgatctgcctgccttggcctcccaaagtgctgggattaccggtgtgagccaccgcgcccggcactggtctacctttaacttcttgtttaggagtggcagctccatggcatgtgactgagctgtccttgttgtgcccactggcagactttattgatcatgatgtttttttctggtgtactctgcttcagcattttctcaaaaatgatcttctgagcttgcagttccccgaccttgctgcccagtgcaaacacctggggacctctaaagacttctgaagcctggctttcactctggggtccttgttatggaatgtgacctgggcattgggagttttcagattctcccgggtgattctaacagcagtttgggaccagcaatcttggcatcacttccagtcagctgaagttgatgttgcagtggagactgatttgatttgcaatccttattccagccaatgccagccaagaagtatgtgccatcacctacatttaagtagctgtttaagactggagtggtgtttattttttatttttttaattttgttattttttttgagacagtctcactctgttgcccaggctggagtgcggtggctcaatctcggctcactaaaacctccgcctcccaggttcaggtgattctccttcctcagcctcctgagtagctgcaattacagatatgtgtcaccacacccggctaatttttgtatttttagtagagatggggtttcatcatgttggccaggttggtctcaaactcctgatctcaagtgattcgccttcctcggcctcccaaagtgctgggattacaggcatgagccactgcgtctggcctagagtggagtagtgtttaatccttacctgtaaagatttatggcatttgaagcatatgtgctcaatctaatgctttaaaactaaatgaatttctttcattcacttcctagcaagagtgccagccatggcttctctctctcactgccttgcctgtgttctggcataccctgggagcaaactggaagtggaagtctggggaagagggacttaggtgctagattgctatgtctgctcatcatatattgacccggcagttgccacctgatgaagtgtggttggcagaatgaaactgccactgacatctgctagctaattcagatgatgagtaaggtacctccaggctttcccctgttctgtttgtagtgcagtggtgtacatatgtctgtacatgtccctaagagactcagagacaggagctggccacttgctgattgccactagagctgtggcatcattgtgagacttcatttccatcccacggggtctctttcaacaccatcctgtaaagaatgatgaagtaaccagtggctgaaactgttcccaaggaaaccatgagaccctgaatgtagtacttgtcaaattctgtgtgtagtcatgatccgaggaagagcgcctatccagtgtttgtttttctttcattcagtaaacatttactgaggtgcagcctcagccacaggcaaggcactgagctctgcctccttgactaagtcctcaccctgccctcagccattcccaccaggtgcaccgtggatgaaaggaagcacaagacgagttttgacacagtgcttcaggaaccttgtcttactttgttcaggctgccgtcccaaaacacaataagctgagtgacttataaataacagatttgtttctcacagttctggagattgggaagttctagatgaaagcactagcagcttcagtgtctggcgagggcttgttccccacagatggtgccttgttgctgagtcctcacatggcagcaggggtgagggatctccccagggtttctcttaggagctaatcacctcctaacatcatcacattgtggtttcgagtttcaacataggaattttggggtcacacaaacattgtctatagtaaacctcataactatatccacattacaatcccatgtctcagaagttttcagcactgatatgatagtcacagatgtctcccttgataggttaatggttcatgctaggggcagggccatggtcactgttcttatcggttgcgtttgttagtgataggcaactgagagggacttcatgctaagaaagatgcttagtttgggagtcacctggacagaatgcaggtaaagaagcaaattggggctgggcatagtgactcatgcctgtgatcctagcactgtgggagaccaaggaacgtggatcacttgagcctaggagtttgagcaacatagtgagaccctatctctatttaaaaaaaaaaaaaagaagcagcagcaaatttgggagaaaagataatggatgctaagttcagttttgctcatagagttggggtcacctaggcctctggctgaaaaggaggaccttgagctctggagagagctgggtaggcactcagataatggaagacattataggaggtgatggtggcagtgtttttgcatcagagatccacatggcaataaacttcggagaatcagtctataaggcacatctagatctaggaatactggttttgagaactccttttctgaaaatatacgtaaatgattttactgtttcctaggaaatgagaacagaagccattgccagacctctggaaataaacgagactgaaaaagtgatgagaattgcaataaaagagattttggtaagatgactttgcttttatataatgttttttatgcctgggattcaaaaatactgatttcttgcccatacaagacagaacaagctaggcttagtaacaagggatgtgttagtggggaaatgaaaaactcaagaggacattcgagcttacctaggtcacttactatcatttttttcccctcgttataaataaaaacagcttctcatgttattaaaaattgatcagtttcagtaatttgataattatcagttattcaataattttaataaataatgctctattttattttgtttaaccaattcctcactgcttagtatttaaatgatttcagggttttctaaattccagacagcactgtaataagtagaaggatcactattgtttactgctcgctcacatcagttatcctctcatctaaagcagtcagttggaaggcagatcatgagggtgactctagactcagattgcttgggtttgaattccactgtgtgatattaggcaagttacttaccctctctgtgcctcattttcctcatctgtaaaatggcaagaactgcattcccaactgtgtggggtccttataaacatgaatcacgacagggcatatcaagcctcgtctctgatgcacaattgataatcagtcatcactggtgatttattttactcagtagacacggatgagggcccctgtgtacattcagagtaggcataaaacaagaatttgctatgagttgtacaaaattctaaaaatcataggtttttaaaaatatgtaattcttttgtcattaaacagtaatacctgctgggcagcccagcctagggagtcagagcctcacagcgggagaagggcaccacagccctggtgggagattggtgacagataggcagatgggtcagataagtaaaaatatggcaaggataatggagccacgttcctcactgttggagaaaaaagtcacaaaaatgtcacaaaaatggaaagagagaaaattagggtgaacttgaaattggaggtgttggttaaacgcatagttttcaatatatagataggtataggaataaattttgatatacatgtatgcacatttaaggaattacgtatatatgtatataaatgttttatttatatacatacacgtagagacacccacactcatacatttcttagctctgagcacacgtagcacctggcttaatgccattctccactaaaaggaaccaggactcttaggggaaaatggctaattccagagttgggcaggagaagtacgagaaagtaaggaagagttcaaaggaggaaagggaactattggaagcatgcagaagccaacttaagtgggcttctcctggccaaagtaaggacaacttaagcatcaaaataaataagttagaataattaattttatggtataatagaatgaaataggaaaccatgagttttcactggcataaaaaaataaatgaatattggaggctgaggaggagcaggtcattcacacagattcgaagtaactttccacaaagtactttttttttcttttttttttttttgagacggagtcttgctctgttgcccaggctggagtacagtggcacaacctcggctcattgcaacctctgcctcccaggttcaagtgattctcctgagtagctgggattactggcgcacaccactacacccagctaattattgtatttttgttttattttatttatttatttgtttatttttttagacgaagtcttgctatgtcacccaggctgaagtgcagtagcgccatctcagctcactgcaatctctgcctcctgggttcgagcaattctcgtgcctcaacctcccaaatagctggaagtacaggcatgcgccaccacgcccagctaatttttgtttttttttttagtagagatggagttttgccatgtttggccaggcttgtctcaaactcctgacttcaggtgatccgcccgccttgacctctcaaagtgctgggattacaggcatgaggcattgtgcctggcccgcagagtacttattaattacagaggggaaaagagtcacttctcagggagaagcctgccagtcacccccttaatcaagagatcaaagtgaacatcatcgttacagaacaaatcaaaatcatgcacgcctggtaggatgcagtcacttctgagtattcctgccaacgatgcatatctgactctaatgagacaaagccggattgaggggcattctacagattaaccagcctgtatgctcccagagtgaaaaggttctgaaagtcaaggaaagctgagggggcatttcagactgagggaggctgtggagatgtgataactggacacataggcagctcctatctgctgttggggacttcactgggacaagtggggacagtggagtggggctggagttagacggtggtagtgtgttagtgctggcttcctgttttgatgattgtattgtggggatgtaggagaaagtccttatttgtaggaaatacacgctaaagtattcagggtattggaacgtctggtcagcaacttactgtcacctaggttgggaaaaacgctttgtgttgtacaacaggttttccgtaaatttttgattgtttctaaatttaaaaattaaaaaaaaattattatacctcttatccttgccagtgttctaactgaatcaggtgaacacggcatgaatgtgcccttagcactaatatgttaaaagtagaacacccaagagaggacagggttcatttcttggtagacatctcttaagactcctttcattgttagaaaatatctgtgatgtttgatcattctaaaaacaaccaaaacaacatgggtacttaaaagggtttggggagtacaggccatttatttcagaaaccagggaaaattgcttgtgtttacacagctgttttgcattgtggatctttcttgtttgaggaacagatatgtttaaggtgggataaatttactaggttttaatctgactttggttcgaggaaacagttgccattaactgaagttgtttagaaaggagacccacctttcttcctgtgagggtgaactcgcatttctcctgggggctctaaggcacttgcagcaaatcgatgataagggtctgattattttcatgaaagtatcttagaagtggctagtgtacttagaccaaaaaaattagaccataaacgcattgtcagtaacagtggctggttccaaaacacaccatgcctgagagttgtggagagtgtctgggcttcgtaggccatttctctgtggagcccatagcttttcagagacttgcaggaaaacagagtaaccccttcgtgggatgctacacataggcaaagagctggaggggaagccccaccttggccaccaggaacttaatgcagggctggaaagccagaaccctggggggcagttccacgctcagctgggtggcagtccagattcctcataaagagattggagcctgaaccccaggcatgtgatccagccagccaccggacaagacgcatgtgaagacggcgcactaccagtgactctacctgcttcaaatgaaccttctcttaggatagggagacttgtgtcaccgtcagtgggcccgtgtcccccttcccttctttactcagcctctgttgcccaagggcctctgtccaactgttgccctggaccccttccagagctggtgcacaccagtgtggccattgccactgtgggaactgctttcgtactgtcttcagagtggtttctcctcgtttttagtctgtagtcaagcttctgttgccagggagagggaagaggaccttctctcaatcccagcaggcagtgggttagggctgggaccagctgtttctttctctcccctcctagtagagcagtacttggtgtgtgtgggtattctgtaagtcgggtgtttgtaactaggggcatggcccgaatgataaaaaggcagactgaccgtccagagtgatgtgcaccttgttctaaccgagtgagccagagaaaagactgcaggcctctccaccttgaccaggacactcttctttgcatcttcacttctttccctgggtagaaatgcctgcttttcatggggaaaaaaaaagagatacctttttctggacctgtgtgacattctccctggaactagtgggttaagtgagtcattgcttggggaagtgtctatttgtttgcttttgtgtttgttgagcataatgttgctatgcctgaagagttgcaaaattcttctaagaattaggatggctgtttttattgccaccttgtctcattatttcccattaaatatagacacaggttcagaagactaaagacctgctcaataatgtggcctctgatgaagctaatttagaagccaaaatcgaaaagagaaaattagaactggaaagaaatcggaagcgactagagactctgcagagtgtcaggtagatatgaacacttggagaatgagtagaaagatgtcctggaaagttcaaacaaactgggcgtggtggctcatgtctgaaatctcagctactcatgaagctggggcggggggttctcttgagcccaggagtttgagaccagcctgggcagcataatgaaaccccatctctaaaaatttttaaaaattacctcagtatggtgatacacacctgtagtcccagctacttgggaggctgaggcgggaggattgcttgagcccaggaggttgaggctgcagtgagctatggttgcatcactgcactccagcctgagccacagaacaaggccgagtaacagaacaaggccctgactctaaaagaaaaaaaaagttagaacaaagacttaagagaatagaatgtgatcttaactcttctcaagcaatgaaaaaaagccttacataagggtatcttcacctcaaatgtacatgtgttgcctgtcataacaagcagatggctaaactcattctctttactgcttgcggtatgtctggaaaactgcttaaagcttgaactgccctttaagcttttatagcttcttggaactcaaggcagagtaagtgaatccagacggggaaatccagacgtggtctcctaagatcttgccataaattaggtagaaacagaaacatactcctgcctgtttgttggcatagattttagactttatttaaaccttgatcattcctcaccagtcagtaattcatctttcttcctacgttacctcattggaaatatatttcccaggaataccgatggagaatagtggtgccggctctctctctcttctcttcctcgttctgtgcctctttccctcccccatgcttctgctctttctcccttttcattcaccctttatttttctttcttcttggctccctcctcttcccagctgcctactctgctcggatgttttgcctttttggatgttggtggctggctacaccctgcccactgtcccgaggtctgtggggaggcagcacctggaggcagcgacagcaaccacagggagcgccctggctcctccctgcccagcgcaaggccaaggcccttcccctcctgaaactggctctttacctctggagcctcagagagggaaaaaaaaaaaaacagaagtcattgccgccatatagattgatctccttgacacattccacttttaaagcatcaattcatttttgttaagctccaaatcattttaacagaaaagtctctttgttttgctctagttcaaaagattataattatttctgagtttatctgcttatatttttaaaagagtagaattttccctttaaggtcaataataagaaaaaagaaaaagttcagcaaaccagtatagatttttatggttttttttgtttttgttttttttttttgagttggagtttcgctcttgttgccgaggctggagtgcaatggcgcgatcccggctcactgcaaactctgcctcccggattcaagcgattctcctgcctcagcctctcaagtagctgggattacaggcggccgccaccacgcccagctaatttttgtatttttagtagagacggagtttcaccatgttggccaggctggtcttgaactcctgaccttgtgatccacctgccttggcctcccaaagtgctgggattacaggcatgagtcatcatcacgcctggcctttttaaaaaattttttatcgtttaaaaacctctttagactgggcacagtgattcacgtctataatcccagcactttgagaggccaaggcgggcagatcgcttgaactcaggggttcaagaccagcctgggcaatatggcgaaaccccatctctacaaaaaaaaaatataaaaaatagctgggcatagtggcacatgtctgtagtcccagctacttgggggcctgagacaggaggatcacctgagcccaggcgttcgatgctgcagtaagccatgatcacaccactgcactgtagcctgggtgacaaagtgagaccctgtctcaacaaacaaaaaaaaaccaccagccttaattcgtaacaacctgtggtcccctttttagaggattgctttaaatttataatatcctgacagtagaacattattattattattattatttcttttgagatggagtctctctgtgttgcctaggctggagtgcagtggcgcaatctcggctcactgcaacctccacctcccaggttcaagcagttctcctgcctcagccacccgagtagctgggattacaggcatgtgccaccacgcctggctaatgtttgtatttttagtagagacgaggtttcaccatgttggccaggctggtctgaaactcctgacctcagttgatccacccgcctcagtctcccaaagtgctgggattacaggcgtgcgccaccgcacccggccaacagtagaacattatacccaaataagataataatatatatatttattgatttggagagatgtgtctggtatgtgatttttttgcctttagagatggggtctcaatgtgtcacccaggctggagggctggagtgccacggcaaggtcagaggatcctcactcactgcagccttgaactccagggctcaatcctcctcctacttcagcctcccaaagtgctagggttacaggtgtgagccgatgcacccagcctgatcatttttaactctattgagattacggtatattgaaatgaaataaagattataaaatttcttggtatatttaattttttttttaaatgcattcctatctatatttatgcatagaaaagtctggaaggatgtatgtcaactatcaagcgcttatacctggtgatgggattatcagtaatttttacgtcattcttcatactttcaggattatttcaagtttttacaaagagcacatcttatttatgatgaaaaagaagtatgttcattttggggggagaaagcagaaaagggaaaatatttttaagcattacaagaatgaaggaccttctctaattaagggtttccagagaaagccaccatggaatctgaaactgtgaatacccatttcaaactactgcatataattcacctttcctttttatttcatttgcttcttttaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggtgagctgagcctgtcctctgttcagccattccttctggtgtgttattttgtactgggtgacaggtcattttgttaatatcattgtgaaaaaaatatcagtacatgttttttctccctggtcagtctgaggattgctcatgtaatgtgtttgttttgctggcagtgtacactggactccagggttgtcaaatctttgatgtcatatttcatcaggtttggtcagttaagagaacagacagggccgacatgaggcctgtgtggctgcgtaagaccctgtgccgacatggggcctgtgcttgctttcaggccctgttgtcactgtcttgaaattcataataatttttaagtgcattttattttccactgatcccaaaaattatgtagctggtctcgagtgcagatttaaaagcttgcttggctttgggaggccaagacgagcggatcacttgaggtcaggagtttgagaccagcctggccaacatggtgaaacccctcctctcataaaaatacaaaaaattagccgggtgtggtcgtacacacctgtagtcccagctactcggcaggctgagacaggagaatcgtttgaacatgggaggaagaggttgcagtgagccaagatcgtgccactgtactccagcctggacaacagagcaagatcccatctccaaaaataagaaaataaagcttgcttagtcagttcacataaagattttcaaggcaaggtgcgatggcttatacttgtaatcccagcactttgggaggcttaggcaggaggatcactggagcccaggagtctgagaccagtttgggcagcataatgagaccctgtctctacaaagaagtaaaaataaattagctggacatggtgttacacacctgttgtctcagctacttgggaggctgagatggaaggattgcttgagcctgggagtttgaagttggagtgagccatgatcatgccactgcactccagctcggttgacagagcaagaccctgtctcaaaaagaaaaaaaaaaagggccgggcgcggtggctcacgcctgtaatcccagcactttgggaggccacagctggtggaccacgaggtcaggagtttgaaatcagcttgtccaacatggtgaaaccccgtctactaaaaatacaaaatttatctggtatggtggcgggcacctgtaatcccagctacttgggaggctaaggcaggagaattgcttgaacccaggaggcagaggttgcagtgagccgagattgcgccactgcactctagcctgggcgacagagcaagacaccatctcaaaaaaaaaaaaaaaaaaaaaaaaagaaagagattttcaagtcctggttaattgaatcaccagaatagctcattggagattgttttgtaaagaggaatggcagtttatttattgattgtgggaaataaatgtgtggccttgagcctgaccaaccatcttacaggttcctctcatccctgtgggtaaggccatttaggaaaagagtgttttagacccgagcatgagttgataaatgtggaatttagagcaaaggaaattgaaccaagttgtgatcagtttttgaattgccctatccttaacctgagaatggtcatttagactccattttcatgatgaaattggtctgcagtctccctttctcatgcccttgacagcttttggtattaaggttatgctaggcttcttacaatactgagcatttgagtttggcagagctattttgttgtccaggagggctaactgggagtacctaacgcatccgtgtggacacatgtcatcttgacgaggaattcattgctagcattactctgtggcagaggcaggccatggagaaatggtacgggacaggcacatttcgagggcactagaaagagcttggagtttagaacattttaaacattgggtacctgggaaagaacagtcaagggcagtgaaaagaaacgttggccatttttttgtattatctggggccacctctgggttcagagaacaaaccaaacagtatgcctcagagtggcaggtaggtggcccaggaaacttcccagggagcccctctaccctacccttccttcaacaagtacatctctttttctcttactcactctcgctctctgtcgttagaatacctgttccctcgaaataccccatgccggaaacacagtgctttatttttaatgtttagaacaacaatatataaagccaacttcctccctctgtctgtccctcccccccactctctctctttgtctctttctctttctcaacggggtctcactctgttgcctgccactctgtctggagggcagggtgtgattataactcactgtagcttcagacctcttgggctcaagcgatcctcccacctcagcttcttgagtagctgggactataggcacttgccaccatacctggctaaattttttaaatttgttgtagagatgaggtttccctatgttgcccaggctggtctcaaactcctgggctcaagtgatcctcctgccttggcctcccaaagcgtgggggttacaggtgtgagccaccacgcccagcccccattctctttcttgataataatcaaggccacattttatgatctgagatatttcctcctgtccccacccctgttcccatccttacctgtcccaccatttagcatcttttgagctggaatctgaaggcagggcaggaaagataaatgataaaatctatactttcttcctttgaaagcaggaggcctgtctctgccctaaaattagatgtgtctgttctgtgtccccaggtcatacaggcatgcgtgatgggcatttagttctcctcagaggcagggaaatgcaatcggagaagcatggggtggggcagctgcttcactctgggcgcccctgtccaccaggccacgaggcaaccgcagagagaaagggcagtaagtttcaggaccctggagttgctcaggcagtgttaattctcttccccttccttgagtttagctctttttttgttctgtagcacaaacttagcagtccttacacagtggtgaagaagaatagaacagtccagaaaagggccatctctcctgagtctgtatttcctcttccacaggaagctaaaaacactctctgcctgatacagaacaagctcaaggaggaagagaagcgcctgctcaagagtggaagtaaggctgggcttcgtagacgagcagtttactctggactagtattttcagccttgaaatatatatagagagatatatatatattttttaatatgtattttcttctttttttcagcagttttttttttactgtagtaagaacacttcactttacatcttcaattttgaaaagtataataaattattgttgactataggtacaaaaatattttcaaaaggcggttttctcacaacttctatattgggtaccattgtattcactcaagagtctggtttaaatatagcatttaaaacacatttcgttcttgtgccagttaagatagtgttttcccctgtttaaatgatagtttgaattatatatgatgcgtaactataagaaaacatggccctagatgtgtgtagggttctgtattttcaggctgaatgatggaaagcaagcactgggatgcagtgcagggagaggggccgctcgctttgtgatggtccccatgctgctgagatgccccccataatccagaatggctcagcaagacactcagctggagagacacagggttacgtccatgcaaagcctagattccgggaaggagctctctgtgaccaggcagcttcccttatccttgtgtgggcggcaagccgcccaggtgccgaggcaagagaccgagagcacgagctgttccagtataataaaatatataaaataagaatagttatactagatatagatcatagatatgattatatatgaatatcattaatcattagtttatagcaattactctttattccaatatcataataatcctcgctctacaatcataacctaggaaaaaacaggccatacagatataggagctgaggggacatggtgagaagtgaccagaagacaagagtgcaaaccttctgttatgcccagacagggccaccagagggctccttggtctagtgggaacaccagcgtctgggaagccgcccgttgccaagtggaccgtggtctagtggtagcgtcagtgtcaaggaaaaacacctgctacttagcagaccaggaaagggagtctccctttccccgggggagtttagagaagactttactcctccacctcttgtggagggcctgacatcagtcaggcccgcccgcagttatccggaggcctaaccatctcccggtgatactgtgcttcagtggtcatgctcctagtctgccttcatgttctgtcctgtacacctggctctgccttttagatagtagtagcaaattagtggaagtactaaaagtctctgataagcagaaataatggcgtaagctgtctctctctcctctctgtctctctgcctcagctgccaggcagggaagggccccctgtccagtggatacgtgacccatgtgaccttacctatcactgaagatggctcactctccttaccctgcccctttgtcttgtatccaataaatatcagcacagcctggcattcagggccactatcagtctccacgtcttcgtggtagtggtcccccaagcccggctgtcttttcttttatctctttgtcttgtgtctttatttctacagtctctcatctctgcacatggggagaaaacccaccgaccctgtggggctgtaccctacatccctgaacttcagtgtcaagtcactgtcagggaccggtagcagcccaggatcttcctgctgaattgatggccttgttgcacggagttcctcctcctcttgctggttgccctttcttttcttcagggtgaaatattctattcactctcatgttgagggcagcatacttgaggcatcaggcccacacacatgctcccacacacactctctctctctctctttctctttctttgccatttcccttgtatctctctcattttgcacctgttctgtgactctctcgtctgaatctcaggaaactttggaggaaggatagggactgctgggaaatcctccaggaacaaggttaggaaatttgaagggcctgtctagccaaagcagccctcccctttttagttccatgtcagccaggagcatgtgaagcagccctcagtgatcagcctgcatggggtttgtcccttgcgagaggcccagctcagctaggagccctggtttgttgcttgcatcccatgctgtccccgggccaggatgctaagacctgccattctgatcttgctttattcaccaagatttacctttgtgttttcttctaggagttctatagttttagctcttacatttaggtctctgatccactttgagttaatttttgtatatggtgtgagacagggggtccaacttcattcttttgcatgtggctattcggttgtcctattatcatttgtggaaaagactattatttccccattgagttatactcgcatgttgtcagccattaattttaattgtcactgtcagctcagtggtttcagtgtcagcatgcattaatgtcttagtctgttttgtgctgctgtaacagaatacctgagactgggtaattatatattttacataaaatatatacagcattgtatatatggatacatgcagtcatccctcaatatctgcgaagaactggtgccagaacccacctgtggataccaaaatccacagatgttcaagtccttttcatgtaacctatgcacatcctcccatatactttaagtcatctctagattacataaaatacctaacataatgcctatacatcacttcattcacatggattcaacatagtacttggtatgtggcaaattcaagttttgctttttggaactttgtagatcttttttgaactttgtagattttttttccaaataattcagatccatggttggctgaacccatggatgtgaaatccatggatacagagggccagttttgtatgtgtgtgtgtgtgtgtgtagtttatatatatatgtcatatatattattatatataatatatattatattatatattattatatataatatatattatattatatattatataattatattatattatatatattatataattatatattattatatgttatatattattatatattatatattattatatattatatattatataatattatatattattatatattatatattatataatattatatattatatattattatatattatatattattatatattatatattattatatattatatattattatatattatatattatatattatataatattatatattatatatattattatatattatatattatataatatatattatattattatatattatataatatatattatattattatatatatattataatataatatattatataatatattatataatatatattttataatataatttataatttataaatttatatttataattatatatgttatatagttatatattattatatataataatatatgacaattatataacatatataatatattagtattaggttatattattatcattataatcagaaacttacttgtctgaaatttaatgagccacagttctaggagcaagcccaagatcaaggagctgcatcttgccgcaccatcccatggcagaagggcaaagagagggcgagagagagcaagagatcaaactcacagcctcaagcccttttataaccagcattaatccattcttcaaggcggagccctcatgacctaaacacctcccagtatgccccacctcccaacactgttgcattgggatttaagtttccaacacaggcttttcggagacacattgaaatcatataatagcaattgactttagtttacctgctcacttctcaggtctgtattggtttgagttgtaagaagaaatcttattgagcctgaggtacatgtattaattttattttaaaattgattatataatttgatttgcattgcatgggataaggatttaatgtcttaatttcctggatagaataagaaatgaacaaatgacttttgcacacagaccttactgggcagagctgtttcgttgtgatcatgaagccactcctttgttttgcctgcttgtgttcctgctaggtaacgatgactcggacatagacatccaggaggacgatgaatccgacagtgagttggaagaaaggcggctgcccaagccacagacagccatggagatgctcatgcaaggtaccccggcgtctttcgctggacttcctccctgcgccctgtttcacagaacacctggccaggactggggcaggctgcttagtattgaggcccacaagcgtgctgcgaatggcccctagaagcagctcttgctcaggtttatcctgtcctgttgtttatggctcttgaactgctcagtggtcatgtttgctccttgtctgtgatcccaagactggatggttcatatttatggcttggtatttctcacagccacaagaacacattgcctctgccactctcagtgcagtgatatacttaatagcctgagaattaatgcagaaagggacttaaatgagcatctctgccttaaaaaaagttcttctaattcctttactcatcacaaaagattcaagcaacaaagctcagcgcagtggtgcacaccttattcccagctactcaggaggctgaggcagaaggatcatttgagcctaggagctcggagctgtagtatgtgatgattgtgtccgtgaatatccactgcattccggcccgggcaacatagaggggctcttaaaactaagttaagccaggcgcggtggctcacgcctgtaatcccagcactttgggaggccaaggcgggtggatcacgaggtcaagagatcgagaccatcctggctaacacggtgaaaccccgtctctactaaaaataaaaaaaaaattagttgggcgcaatggcgggcgcccatagtcccagctactcgggaggctgagacaggagaatggtgtgaacccaggaggcggagcttgcagtgagccgagatcacgccactgcactccagcctgggcgacagagtgagactccgtctcaaaaaaaaaaaaagagttaaaacaaaaaaagactcaggcaacaaaatttgtagagcaaatgtgaattctctcctggggtcttcctcatgtcccactcccacctgggagggctcatggctagtggccagggtgggtgtgtctttacagattacctttctgtacatatacatacgcacacacatacacatacaaagatcacctgaaaaaaatttaacctgagtgcaaccagacggtatgtatggttctgcaacttgcttttgtttttaaaaattaagtacaattggaactcttcctctgtcagcaatagatctgccccctaattttttttttttttctttttgagacaaagtctcgctcttggtccccaggttggagtgcaatggcatgatcttggctcactgcaacctctgcttcccggagggagcaattctcctgcaatcccaagtagctggggttacaggcccgtgccaccacacccagctaatttttgtatttttagtagagacggggtttcaccatgttggccaggctggtctcgaactcccaacctcaggtgatccacccgcctcggcctcccaaagtgctgggattacaggcctgagccaccactcctggcctgccccctactttttaatggctatgtcatattcctagcaggactgtacccatgatttactgggcgttctcgcattgatatttcccctcttttccttgtatatacatctttctgcatgtctgcatatctttaggttgcatcattaaaagtcaaattcttaggtcaaaggttccataaatttttattttaatactataaaattctcctatatttgcctttaaaaacatttcttatctaccacctgttaatgtttggagcacagttgcttttttttttttttttttttttttttttggagacagaatctcattctgtcgttcacgctagagtgcagtggcacgatctcagctcactgcaacctctgcttcctggtttcaagcgagtctcctgcctcagcctcccgagtagctgagactacaggtgtgaaccaccatacctggctaatgtttaaaaaaatttctgtagaaatgaggtttcattatgttgcccaggctggcctcaaactcctggcctcctgtctcagcctcccaaattcctgggattatacgcaaaagccaacatgcctggccagaaaacaaatcttgaatgctatttcctgctttattttccaagatttttatgacttcttcatgcttttgttgttctcaggaagacctggcaaacgcattgtgggcacgatgcaaggtggagactccgatgacaatgtaagtcccccgctcccctcagtggttctgtgcactctgggtttggctgtccccatagatgggagtggctgagttgctgtcagcagccagggagccgtctatggtcagcccggccgtgcctcgatgcgtggcagggtttggcctcatgaggctctggactcttcgttgctcgtggatggctcatctcttttcaagtgaatgtgcttgctctgctttttttgccttctcactgttctttccattctcgctttccaaagatggaagcagcaccagctctcttaggtaaatgcaagacttccagctccaagaagcaggttggttttctgttctgcctcatgtgtttgtgggtgtctgtcagccctcccggggccagccaggggcctctccctaggagtgatgcttcctctctcctgggcaaaaaggccactcaaaagagatcctgtggtgacagcgggatcactgaaggcccctgtgctaaagtggaggcgcaggcacggagcctggaggcggggaaagctcaggccgggccatcctcaggccctgggccgccacctagaaatgaaggaggacgccgagggccgggctcaggaccaacccccctccctgttctgtgctggggacggaatggtgaagcagcactgtccccagaccaggccctcgaggtgccaggcatgaggctgagacataagctgccttgagctttactgagtggataactccctggagcacttaagcaaaaggggattctaggggtcctcagtgaggtccagtcatcagggctctgccgcccattgctcaagcctacgttctttgttgcgtccctggcagtgctgctcggcccacacagcaaagggcgactcaacagagactgaccccaggctgcctccatgtgccctgaatttacagggcacagtctgtagagaagcagagagagcaactggaaaataattttcctaacaagctcgggtgtggatggtatacagcgtctctccgtcttgcccacccaagacagaagcagagggagtgtggcgtgggtgctggcaatgctgaggcagcaccgcctgcctcttctccagggtttgccttctctctcctcagagcgaatgcattagtcgcagctgagctttatgcctggtggtcacttgtttatttcaaggaggctgtgtccatgccgccctccaggcacagggttccatgctttacgtgttcaggcatccaacacgtgtctgttgagtgcctgccacatgccagtgctgtcgtggattatggggaacgcagcaggggcagaggcaagcccctgcttcatggctcacaccccagcaataatgatggattgtcggatcagggctcatggtgttaacaggaggaataacagcttcaggggacagggagtgacagggaacaaggagggggtggcgtcttctgcgaggtcagtgaaggcccctgacgtggtggtgtttgagcagggcctgagtggagggagcgagcgcatgggttggcggcacctgggcatgtggaatgcactcctcgcatcgaggagcagaggcagctggtgtgattgtgggtgagtgcgagaggcagcaggggccatgcagagctttgcagggtgagatgaagactctgttttctctgagtgtgaggggaaggccctgaagaatcatgagcccagaagggtcaagagctgatgatccctgtttgagagaagccagttaggaggcgcctgcacccgtggaggtcagaggtgacggtgcttggccgaaggtgtggcagcagaggtgttgagaaatggtcaggtcctgggtctctctaagaaccatcaggttttgtgaattgattggacataggctgttagagaaagagaaaaatgagggtgcctgggcttggtctaatcagcagaaagcagagtttcattttctgagatggggccgacttgacaaaggggcttggaaggcagatcgaaagtttgattttggacattctgaatgtgacagccacatgctagggttgagtagccaggtggaatttaagtctggagttcaagggccacgtctgggctagagattgaattttgggagccacccttatttggttggtatctaagccacaaggatagatgtgactgcctagggagagcaagtagaatgagaagagaggcgacccaaggtcctgagctgcatctgccctgcagaggtccgggaggaaggggcaggcagaggaggctgaggggcgtcagcagtgaggaagggggacctggactagagaaggggccctgggggatggagaagatgggttttaaggatgaaggggtgattccacagctcaagcaggatgaggcctgagaatcgatcccagtccgttgaatgtttccttcttgacaggagcagtgctggggtcagtaggtgagagcccgggggaactgaagcagtcgtgaggggcacaggtgtggacagtgagttcaacgactcgctcaggagctttgtgtgaggggagagagacagggcagagcagctggagaggaaggtgggattacctttggggttttttttcaagaaggaaattacagcatgagtgtgcaccgacaggaatgatctagatagaacgaccagccatcctggtttacatgggacgcaggaactgccgttttaaagctgggctgagttggtcaccctggagccctggatccgatgaggagagagagggtgtgtctttcactttgctccctttttttcttttttttcttttttttttgagatggagtcttgctttggagtgcagtggtgcaatctcggctcactgcacctctgcctcccaggttcaagcgattcttctgcctcagtctccggagtagctgggattcactttgctccttataccaatgtctatgttgctttccatccacaatctacaaaaagccaaaacaggcctcccttccctctctccaagcccctgtccttcttgccatctgtagggggagtctctaggtccagtggccctcagcgcagatgcagagtgcttcttagacgctgcgggaaagccagcccctgcagcaccacacccagatgcacctgcagtttggaggattctggttggatgataaattccagctggcagtacatagcctcagtcccatctgtatgccctcccacagcctgcttgccactctgccagcctcttccttcacacagggatgctgctatagaaagggaggcagagagtcttaggacaagatgtcaggaatgaggcaggatcccccgttgcatctgccatttttttcctataggaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtctttaaaaaaaagaaaaagaaaagcacgctgcttgtaaaaagcgtacagtaggtcaggcgtggtggctcatgcctgtaatcctagcactttgagaggctgaggtgggtagatcacctgaggtcaggggtttgagaccagcctggccaacatggcgaaaccccacctctactaaaaatacaaaaattagccgggcgtggtagcgcatgcctgtaaccccagctactggggaggctgaggcaggagaatcgcttgaacctaggaggcggaggttgcagtgagccgagatggcgccactgcactccagcctgggcagcagagtgagactccatctcaaaaaaaaaaaaaaaaaaaaaagcatacagtaaataaaaaagcacaaaacagttttcacttattttacaattaaaaagtcagaagacttctgaagttacttatcttttaatacatgtatttaacaccatacttcatattattaaataggttttacttaaaaatataattattgtatttgtacctgtcagatataaatacttattcaggagttcacaggtacgaaaagatacacataaattttaggaacttttgagttatttctgtcatttttgcttttttctctttcttttcctaaattttatgtataagattacccctaaaaaaaaaaaaacagccagtattcagtgaattcaccagtaatttgaaatgcaccatattgtaaatgatccactgacagggaagccagcgtgttggagccatgccagccacctcagacaccgtggctctaagatgcggaagagtcactgcatcttcttgaatgttacagatttggtttgcctgaatgtgacttgacttctgttttgaaaaaacatacgaatagagttctattttccttatgtgatgctttcttctaacacactttaacacagaagcctaacctagctacaaagagcctatccacagacataggcaacagctccaaagggtatttcattgtgtcacctgcttctagatcatctgttagttaactgactttgtgcaaggtctcaccatgtatagcactgccttgcttgagcacggaagtttctgtcaacagcaagctttatgtgctctatcatttttattaaagtatttcagtcaatagtgacccattgtagaatggatgcaggattcacatgtgcaagtgctttgtgacctggcaccatttggttttggccaagcagcagagcagacctcaggacctaacgaggatggttgtgattaggtcaaatagaaaactagcaggccattgctgacaatttttactatataattagaggacttcctaaaatgctttaaaaaaaaatgtgtatggatggaaaatacaaaggaatttttcaaatactcaatt

SEQ ID NO: 870 - DNA, 28973 bp, Homo sapiens
cttccgggctgcgctgccggcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgaggtggcggggggcggccgccggggctcggacctgcggcggggcgccgagggggcggggtaggcggggaggccgcgccggggtcaggggggccagcgcccaccgggtacgagcgcgctggtgaggcaggcccggccgcgcccgcgcccccggcgcacggtcctcccgggagccggtttcggggacggcggcggggagtgggcgctggccagggacgagggttgaggaggtcgcggctctcatgctgggtgggagtcgggccttctgcctgggggttgcgtcagtgtccgaccccgcgatgagtggtcgggacaatttgcaactagagggtggtcctcatgggtaccctgtggggtgtcgcgcgaggtgaagggccaggccatttccgtcgggtcagcgatttccgccttcgccccgctctcgcctggcctggtcagggcctgttttggtacttgttgcgccgattggagtcatctgcgacttgtttgccctcctctgaactcctgaaagccaggggctccgtctaggtctcctcctagtcttattctcccagctttcgttgttaagacaaattccttacgttcctggccctttacagaccggccctacagaacccacacccccagctccgactttcttctccagattgggtacttcccagggagtaaagggaatctgtagcttttgtggtttgtcctgctgggaaaatttgggggtaagtggtgggccttctctggacgaccacccacaaatctgtgtgcccaaacggagacaggacccagggtctggacatcaggcaaggggtactctgcagtaaacgtggacattggccgtttcgtgggtttgttttcactctgccaagtccttgaggcgtacacttttgtgtcactcatttatcttgaaagaaaaggttaacagcccaacagagtagttcgctttggtatctggagtggtaatcagagtgccagaactggagagaacattgccgtgtacagatgtttgccttttaccagggcactgaaggcataaaacccttagttaatgcttaactgagtgaaccatgaaagtcatgtgactccaaaggtcgactctagaaatgcggcagtccatgtagcactgtgatgtagaaattctatgatatatgggtcagtgttcacaggcagggagagggggagtcttcaacatctttgaattaaaaagcatctggggcaaaaacaaataaatacacacatatcagtgaactgctttaagttcagttagagaaggtgagattaaagaccagaagaaactcgagggagactgctgtataagtcccagttatctttccaaacagacaggttcatcacagcagtgaaggctagtcttcatctcccttcttgtgggattttctacattaatgtgcagatctgcccttggagaatggggcgtgcatgattgggctgtggtttgctggagtttcatcttactgaagttgcagacactgtgggtttctgtgacaatggtttacactgaaagtagcaaagtcaaggcatggtctggtatcagcatgccagaataaaacacacagacagctttttaaaaggtctgtgtccgtcctatctttagcctctcctggttgtaacttgaagtgactttgttgccgtgtttgttttgaccaggccgggacagtatggagagtatctttagatgtgacttatctgggttgcttagcaacagcatgcttcagattagaatggaagaaagttcctggatgtgaggagatttgaatgataaaagatacttacacctaaaaggagaccaggagggattgtgccctgttcttgctaactgggtgctcgtaactggagacggggtgtacctgttagcggtggttagacgaggtggatacagaatccagaatggtcacattgcagccatagggaacagatagatgcagagaagaggcttcagccctctgagttagggcagtgcatggccttgctctgctgaaatagcccagaggtcccatttgcttggtgacatctctcacttgaatagaaagctggctgtttatcagacactgttttcttaaatggcagctcctccacatctgcgtcatctccattatctcccctatccatctctttttggaaggaatccacgaagccctcatgactgtttgtttgtttttgtttttttgttgtcgttgttgttttttggagataggttctcactctgtcgcccaggctagaatgcagtggcgtaatctcggctcaccgcaacctccacctcccaaactcaagtgattctcctgcttcagcctcctgagtagctgggattacagtcatgtgccaccatgcctagctaatttttttgtatttttggtggagacggggttttgccatgttggccaggctggtcttgaactcctgacctcaagtgatccgccgcctcagcctcccaaagttctgggattacaggcgtgagccattgcatccagcccgccctcatggcttttacacctcttttcctggtttgcagaaagcaaggctggggtgtggaccctgcatcgaagctggttctgcttatgtccatgtgaagtgctttcaagtaaaatgctgatctgcaaaaagatgctgaaagtcctttgtctctttctggctaagttcaaatgccgaatttgattcagcaaatagttgtgagtgccttgaagtgcaaagaatgatccaggatcaggactccttccctacatatcattattttgatatgtatgtatgtatatatgtttagtgacggagtcttgctgtatcacccgggctggtctcaaattcctggcctcaagccatcctccaacctcagcctcctcagtcgttggggttacaggagtgagtttgccaggctctatatcattctttttagcatgacctctgataggaggctggcaggacagttcaggacttatcagaagcccaaatatcttacactgctgattaaagagagacctgtgtttgaaaaccaaacgggcatataataggattaacattctgctatgaacactaaggcatttgcgtagtgcttgtgggagtgataggaagggggtctgaaccgggggagccagggctttctgcaggaagtggtttggggtccttgtcaacagtgaatgctgcttaatggagccagagtgcccccctgcggaggtgggcagagaggtgccagtcaccccaaggtgccacagctctaagctgagatggtcagatagagggaagcaaacaagggccactccctagtcccaccttgtcagcagctcagacgggattccccatctctatctcagccagggagaagccatcgcgagaactggctatgagtgcgacagcttagagatgttgcaatgtctcttcaagttaggagtgaaattattatccattttgccccaaaatggactcttaaacccccatacacttggaatagcatgtattttgtgctttgaagccagaaataaacattctaaacaaagatttaaagttgcaatgaagaggaggtggttgtggacagacatgcagaacaaatgtttgagaaatgttccctttgcttccacagaaaaacaaaagaaaggcattttctcgtgtttgacaaaccatgttaaaaaaatattcttggccaggcacaggggcccagcactttgggaggccaagtgggcagatcgcttgagctcacaagttcgagagcggcctgggcaacatagcaaaactccatctctaaaaaaatacagaaattagccaggcatggtggtgcgcatctgtcatcccagctacttgggaaactgaggtgggaggatggcttgagcccaggaggtggaggttgcagtaagttgagatggtgccactgcattccagccggagtgatagagccagaccttatatcaaaaaaaaaaaaaaaaaaacctttcagtgctattttttgtggtatagttactgttattaaaaagcaaatggcatttctctttttttgtttactgtattcctgaaatagggtcgatttggccagcaaagtattgacactggggcccatcttgaaaacaactaactattgaagaaaataatttcattttataaaatagtagttgggtaattctcccttaggtaccaaaaagggctcttttctggaaaatgttaatgcaacaatatttccctcattcctttggtgttcatgggtgttctattgaatgctgttccattcttatttctttctagaagatagctcattctgactcctgctgtaaactgttcagagattattctttccagagtctgttacattcagaatgtcttgctagtctgtcacttgctgcccttctctttctacttagtttcagattactttgcatctcctctggcctcccgtttttaaccttttcattgatgtatacacacagaaaagtgcactgcttgatgagttgacatggcatgaacataacctgtacatccccaacgccagaagacccatgggcccccttaccaggcaagccctcttctattaagaaaagcgtttttcttgttgtaagcacaagaaaccactaatagtaattatactagggatggggcgcatacaggattcggaatttttgctttgtgttgcacatgaattcttactttactatgaacatgggttgctttgacaaatttaaaacaaaggcctgaaaggactccccttactcaagaaaaggaaaatgccttttttaaatgtttttttgaaatggttgtcttaaaatttctaaatattttttaaaattagattttatatagccacgcaaattgttctttaatggttatgtaggaatacaggctgcttggcctcccttgtccacagcctcctctttgtttctttgcgactttgactctgtgtttagaacatttatttccgggatgagtgcacaaaacaccatgctactccaaggcacagagtttcagagtcagcgctgagtctattttagagcaaaatgggtaacactactcataatttgaaaacacactattaaatacccaagctgttgctaactaaaagcagcctgtgaggttattttaatataaaaatgcaagctgaggccgggcccggtggctcatgcctataatcctagcactttgggaggccgaggtaggtggatcacttgagctctggagttagagaccagcctggccaacatggtgaaaccccgtctctacaaaaaaaaaacaaaaattacctgagtgtagtaacttaatgtctgtactgtcagctacttgcggaggctgaggcaggaggattacttgagcccaggaggtggaggttgcagtgagccaagatcgtgccactgcactccagcctgagtgacagagtgagaccctgtgttaaaaaaaaaaaaaaaaaaaaaatgcaagctggcgcggatgcagtggctgagacctgtaatcccagctacttgggaggctgaggtatgaggatcctttgagtccaggagttggagaccagcctggacaacatagggagacccagtctctacttaaaaaaaaaaaaaaaattcaacctagacttggtggcttgtgcctgtaatcctagctatttgggaggctgaggttgagggatcccttgaaccctaaagttcgagaccagcttgggcaacatagtgagatcctgtctcttagagaaagaaatctatgtgtgtgttcgtcattttgacatacaacatcttcacttttttctgacaatgaaaacaacccaaggttattgcaaaaaaaagatccagtaatacagaaacaagtgatacagaatggaaccgtctgctgcaattgctggggcagattcaggcagaaatttggattacttttattttattttattttattttattttgagacagagtctcactctgttgcccaggctggagtgtagtgatgaagtctcggctcactgcaccctccgcctcctgggttcaaacgattctcctgcctcagcctcccaagtagctgggattacagccaccatgcctggctaatttttgcatttttagtagagatggggtttccccatgttggaactcctgacctcaagtgatctgcctgcctcggcctcccaaagtgctgggattacaggtgtgagccaccacgcccagctagatttatatttgatagttatttgattccagaggatcttaagtgcaaacccagagaagcagagagtaaaaagcaaaaaggcaacaaaacccagcagatggtgagggaaagggaagaagccagggaggggcaagtggggacaggaagtgctctgaaacccgaccctctcttgctgggctttctccttttaaactgaggagctgctgtgtccatctcgcccgctgcttcctaggcggtacagagggtttcctgtagccttaagttttctctccgagaacagacagattcttggttgagccttaaacagggtccagtcttgggtgttagtcaagaatgctgttcaagtaaatacgttttactatcatttgactcccatgtgcccccaaacctggtattatttacaggtagttttgttgttgttttgtttttaaaccaaacaggttgacccattcactcaatctgagttaggaaatatattccaggcacaacctatcaggcggttgcctgcaagatcccagctgaaagcatcgctgggacaaaggtgatgctttggcagccaccctgttggctccgtccagcccacacctcagttgtctcaagctgctctttcagtgggaatgtgagatctggtagcagaggctcatttcaccccaattttctatttcagaaaaaggggccgggtgcagtggctcaagcctgtaatctcagtactttgggagtctgaggcgggtggatcatgaggtcaggagattgagaccatcctggctaacagggtgaaaccccgtctctactaaaaatacaaaaagttagccgaatgtggtggcgggcgcctgtagccccagctactcgggaggctgagacaggagaatggcgtgaacccgggaggcggagcttgcagtgagccgaaattttgccactgcactccagcctgggcgacagagcgagactctgtctcaaaaaaaaaaaaaaaaagaaaagaaaaaaggaaactcatccgaagcaagagaggcagccacggggtcccatcttggcagcacatcttctggtccccggtttagcgttctgtccttctcttgggtcatgttcttgtctctgttcttcctcatcccttcttcgtccttgtcatcgccacttctgacactgactgagtggggccacaaaaggtgagtcgtccttccggctgcccccaccacaatccagccctggctcaagagcagggaaggtgctgtcccccaggctgcagacgggggttagtacagcaacctcagacagcttcctctctggggggaccctgcgtgtcttgggtgcagtttcgaggaggatgcagagggatggatccctgccttcttctgtgtgacccctgcggtgggggagcatccctgctcagcccaggggatggcacttttcatgtttgccgtgagattcctctagcaaaagcagtgggttttgtgagtacttaggtaatggtgccagaaagcaccatgacaccctggtatgtccgccccatataatcagagaatctgactctgctcactgctgagaccccgatacccagggtagggcctgaattttcaatgcaattgcgataaattaatgactaaatggattctcagtttgaaatgtaaggcgtgacagaacgttcaacccagggaagattgagtcaggacccgggaccttgccggaacacctgtggccgttgctgctgttaactgaggtgtaattaacatgcagccaagtgcacagcttcacccagcagatccgtacgttttgacaactgtgaaacaagacgtagcacatcgccatcgcgcttctcagctccgccttcaccactctgggtgccagcaccggcaatttgtttggccagttccagagtgtcataaaaacagaatcctccattgtcactcctctgtccttgaagagatatgcatcgagttgtatgcggccactctgcgggctcccctcggcacatgatggtcttcagagagaggctgtttggaaatagagtggtgggtgtttgcttcttgtcacccggcaaatgattcatttttctgctgctctgacactttggaagaagccagggatgctgaggagatggcttgctctcacgtgggcagctgctcctttgagaaacaagccatgcgcagtgttagctgctgacatcctccacttttagcccttgagcccatttcactgatgagcaagacagtggcctgtatctgtcactaacgtgcttttctttttctcccctgttccccaaagacaggagtgtggagttcatgagtgttggatttttcaagctagtaaaccttgcagctgcaagtggtgtttaattcttgtggtatggatgagcacatgctaatctcccttgagcttctcttgagcagaagcctggtgtgctaacgggcaggactggggtggtgctttgagaggaagagggggaaggtggcccgagagggagatctactgagatgtgagctgcctggagtttggggtggggattcctggaggggctctggattttgcagagggacagctgttggtgcaccttcaccagtgtgctgggacagaaagtggggtgagtgggtgagtgaggaataagtgtttgaagggcaggagtaaagcagaaaggtggcagcaggtgttgagctgcaagtggttccattgcctggaaaggaggtggcagggaggcctgcccaagatgggtgcctgcagggtgcggacagcctgtcagaggtgcggaaagcctgacattgaaaatgtcagacagtgggtgcttgggccagagagaaagagcctgaggagctggaccaggggttggggggcggcctttagaagcagcgtctcatgcagccttcccagcgatcctgaggtaggtgggagaatcttcaggccacggctgagaagctgaagcgtgtggcgggagatccgtctcagaacacctgagatccctgcagggtctgggagcatgttaggggctcagagtgcaggtagggactggcagggaggagctgtgggcgggaagagagagaagggagggcagggcagtgtggccatggccagctgaacactgggagtctgctcctgaggtcatggatggaggccaggacacctctcaagccattaagagggtggcctttccaagcgcagcatgacttgttggtcttgaagcagtgccttcgaaggaggaggagtcccccgtggacttggggcattaggacagggactgccaaggagagagggcactaggaaacagggttgtttttggcttttttacctggggtgcaagtggagcaccctgtgggcatcatgagggtgtcaggaaacccttctggtaactgaaacgcagtccattctgtgtcccccagattctgagttttcagcacctgacagtggcgggggatggcagacacacctgtgggtgctggagacatcttggcggcccttcctccagtttggcatcatagtcccctgtgggctgagcacatggggctcctggacagttgttaccgatggagggtatccaggttcttgacatcttgaacaaagaattggacaaaacggcacaaacaaagcaagaaaaagatgaagcaacaaaagcagatttattgaaaacgaaagtacactccatagggtgggagcaggccctggttacagaattttctggggtttaaataccctctagaggtttcccattggttatttggtgcatgccctatgtaaatgaaagtgacctgcgatcagtctgattggttgaggaaagcagccaaccagaggctgaagtgaagttacaaagttacatcctatgcaaatatctgattcattgtggaaagcaaccaatcagaggctgaagtgaaattacaaagttgcactcctatataaatgaagacttggccggagaccagcttgattggttgcaggaggggaccaatcagaggtactttcagttcttgatctgcttggtagaaaagcaggtcggtgtgaagggagtagcctctggttcttttgttacttggggatggaaagttggggttttcctttggatttagttctaagaagtcagcatgaattggccttaggttccctgcctccagaccctattctcctgcctcacagtgatgttgatcagggggctcagcttggctctgccagttcagacaccagccccttccagctactgccagtccttggaggaaagcagtcttggtaccgtgtccggagaggtcatttccatgtaaaagaaatatgaggtctacaggcagctcaggagcacggagttgggggaagcagagaaggtgtgagtgccgaggcgcaagcacggcttttgtttgggtcaagcaggatcagtgcctccctccttgcatcgctccacctccggaaggcggagaactgcgatgcagacccaggaggccagccaggagagatttctcaccccaggctcgagcctttgaagctccaggttctaacttaaaaattcaagggagtggccgggctcggtagctcatgcctgtaatcccagcactttgggaggccaaggcaggtggatcacgaggttagggatcgagaccatcctggccaacattggcctgacaaggccaacaaccttgtctctactacaaatacaaaaattacctggttgtggtggcacatgcctgtaatcccagctacttaggaggctgcggcgtgagaatcgcttgaactcgggaggcagaagttgcagtgagccaagatcttgccactgcactccagcctgggcaacagagccagacaacatctcaaaaaaaaaaaaaaaaattcaagagagtttcgcattctcccgtgcaatacttccctgcttgttgtagtagagatgcgtcctgtgcctttttaggaacatgttctgaaagatggcttgggcaactgtgactttagtgctctatccccccagcactgccctggtacccatcctgtttagagggctcagagcagagagcacctgcctggcagggcccgtctctgactttgccttgctgctcctcccagcactgccctggtacccgtcctgtttagagggctcagagcagagagcacctgcctggcagggcctgtctctgactttgccttgctgctccccccagcactgccctggtacccatcctgtttggagggctcagagcagagagcacctgcctggcggggcctgtctctgactttgccttgctgctccgcacagcactgccctggtacccatcctgtttggagggctcagagcagagagcacctgcctggtggggcctgtctctgactttgccttgctgctccgcactgcactgccctggtacccgtcctgtttggagggctcagagcagagagcacctgcctggcggggcctgtctctgactttgccttgctgctccctgttatcagcactcttgtccctgtgtcctccgggtggcctgcagggcaatggaagatgagtacttagtagaaggttctaggtgggcacatgagggttccttgccagcaccagggctttgttcacacaggtgttgcatgaagccatccagccaagagccagggctccatgcctctgagccctcaggcactgcatcatgctgggcctcagctccatacctgccgcgtgtctgtctcaccatcactgtgctcaaggaaggtcgccaccagatgctcctctgtgcgccgggcctgctggggctgccctggggcctggaaagtgctttaagcaggtcctttgtctcgtgtcaggggatgggctccaaagttagtggttggaactaactttgccatctgctggagggctttgcccctgccatgccttgagcccacacatactccaggggtgactgacacagttggttttgcatcagaattggccattgccacctctgaggggctgggaaatgggtgaccctgccccacagtgcctgcactgcccccagcagacaatgctgggggagcagcttcccaccaggcctggcttggggcttctccagggaagcccaggtacacctcccagcctgtaggtgaaggtgcctggaatggaactcgctattcccagaggcacagagctcccgtcacagcggctgggtgacagcagtaattctcgcagatgttcaggccctgggaccccagaagtgaaatgacccagggcgtcagcaggaaaggaggccccactttttcaggacctctccctccaaccagctccacgtccttcccaaagctgggcccagcgtggccctcatagccagctccgtctctctctccttgggcctgctgtgactgcaggcacggatacactggggagacgggatgtagaaagctgtgggaagagggagcaacggcagggcaggggccagtggggttggggggggccgctggccctgcctttggatcatctccgacttgatcagcatgaacccctgactctagagggaggctgatgggccagggcacatgtgggtccccctcactgcctccgcagcagtggacctacagccatgctctttgaccccatctcttcctttcatgggcacacaggtgacccgagtctctgtttcgtgcaccttcctgcctcttctctgcccctcagttgggctgagacacatgaggtgctgtgatgcatgctgcatttggccctgacttaggtgtgacgcgtttccatttttaaatcgagtgtaaagaactggcctccagaaacacggaagcacttttagtagggatttgaaaatccgcagatcgttgtgtatctcagagcccagtgtttttcttgaaattcacactggaaacaaatgaggatactgggggaaatgtgcagtcccaggacatgagagatgcgagcttattacgaatctgtctttggtaccaagccacaatatagagatttgtgaaaatctttaaaaatcaacttgactgggccgggcgcggtgctcacacctgtaatcccagcgctttgggagggcaaggcaggcggatcatgaggtcaggagatcgagaccatcctggctaacaaggtgaaaccccatctctactaaaaataccaaaaaaattagccaggtgtggtagcaggcccctgtggtctcagctactcgggaggctgaggcaggagaatggcgtgaacccgggaggcggagcttgcagtgaaccgagatcgcgccagtgcactccagccttggggggcagagcaagactccatctcaaaaaataataataataaaaagatctggaacgttttcgtcccctcaggaagtcatccctgccccaggcatccacggaggtcaaggccttgccaaccccacttcctgggtccagctctcaggtggttctccctgtggcctccagacccgggctgtaccggctggtttcgcaggttgcctgtgctcatcctgccctctccggtgagagctgagccggtggtgtttttttcagagccagctggccctgcaggagctcagaaacctgggcggctgggcctatgggctctggagttctgcccagggtggccaggtgggcagcctttcccccgtgctggttcctgtagcaaggaggaggccgtgtgctggggcccttgtgtcaggagctgtctctggaaaggctgaatcgaggaaccagcctctgccttgtccgtcgatgttgtggggttagtggctttgtcccagagtttcaaagtgtgggtaagtggtttctgggtttgccagttttcttagcccttaggggaaagggggtgggagcctgccctcagctggcttcgtaaaaacacagtatctgtgcttgagttacacgcccggcgtccttttgcgttttgagacctcagtggagtgtgcgggccctgagtagtatgcacccactgacagtgaaccagatgctgcccccctgcggttccagtgtatgtcagtgccagccacgtgcccaggacccaccgttcccagggatacaagatcccgtggcccatggtggcagctgcggcacacagcgctgctttccagagctctcagtgcggacaacagaggccttgcattcagtcacctggaaaacccaccatccacattggaaacccagtctctccggaatgagaaatttggttggttttctttagctttttgtttttttgtttgttttgtttattttttgagacagaatctcactctatcgcccacgctggagtgcagtggcacaatcttggctcactgcaaccttggctcactgcaacctctgccgcccaagttcaagcaattctgttgcctcagcctcctaagtaactgggattacaggtgcctgccactgcgcccagctaatttttttgtatttttagtagagacagggtttcaccatcttggccaggctggtcttgaactcctgacctcatgatcggcctgccttggcctcccaaagtgctgggattacaggcatgagccaccgctcctggccctggttggttttaattaagaacattttcaaacatccacgtggcatacccgttatccagatctaacgcccattaatattttgccacttttttgctccaactaaattaaactaaattctggaacattctgtcattttgcccctgcatattccactgtgcatctgttaatataaaatatggactttttgtacataaccacaagactcttctcacacctgacaagattaacaccttcatctgttcttttagaggttttgttcctttgtgtgttctttgtcatctgttttgttttgttttgttttgtttcgtttcatttcgtttttgagtcagaatctcaccacgtcacccaggctggaatgcaatgacaccatctcagctcactgcaacctctgccacccgggttcaagcgattcttgaacctcagcctcctgagtggctgggatgacaggcacaccaccacgcctggctaatgtttgtatttttagtagagatggggtgtgttagtccattttcatgctgctgataaagacacaccagagactgggtaatttataaaggaaccaggtttaatggactcacggttgtacatggctggggaggcctcacaatcatggcagaaggcaaaagtcacgtcttacatggtggcaggcaagagagaatgagagccaagcaaaaagggaaaccccttataaaaccatcaggtctcgtgggacttattcactaccacaagaacagtatgggcgaaactgctcccatgactcagttatctcccaccaggtccctcccagaacatgtgggaattttgggagctacaattcaagatgagatttggggagggacagagccaaaccatatcatagtgtttcaccatgttggtcaggctggtctcaaactcctgacctcaagcagtccacctgcctggacctcccaaagtgctaggattacaggtgcgagccaccatgcttggccccagctttttgttgttgttgttgttgttgttgttgttgttgttgttgttttttgagatggagtcttgcactgttgcccagcctggagtgcagtggtgcgatcttggctcactgcaacctctgcttcttgggttcaagtgattcttccacctcagcctcctgagtagccgggattataggcacctgccatcatgcctggctaatttttatatttttgtagagacagggttttatcatgttggccaggctggtcttgaactactgacctcaggtgatccaccagccttggccttccaaagtgctcatattacaggcatgagccaccattcccggcctatttttaaagggtctggagtcaacagtgcatggatccagaaccgtgggaacaaaggggtgggcacaagggcggggtggggggtgtgagtttagagaggcttctccctataaagctgagcatgaactacttggcacacctgacgttgaaccaggagctgagaaccacacaagttaggagtcagagcagagctgctcaggacgtcagtgctggccctgtcccaggtcaaggggataccccgggaagtggctggactgagccaagtatcagctagtagtgggtgctcaaggctggtgtagaggggcaccgcctccctgccagcactgtcctgacacttggaccccatcagctcgttccagcagagaaccaccctggggaggggcctagctatctccactccgcagagaaggctccaggaatctgattaactaaggctgagccagcagagagaccagattcagcgtctaaattcctccccttgtcaggaaagggaaggttgtgcagaaacctggacagtggacgccgcgggcacttcccacccatggcagcaggagggcgggagctcagagaggctgggctcgccctgccagtggagtggggactgccagataaaagacgaggtctttcctgggcagtgagtgagtcctgggggcccaggggcttgcctccacaccttgcacctgcccccagcagctttcagctgcggatttcacggcctttcctgattgttgtttgactccgtcatttctgttggtgattccaaaatggtgactttctaattcagtcattatttctacttttattagctggcattcttctgtaaagaactttcctcaacgctgagatgaactacgcagttcctcctaaaaaaggaggatgaatgcagcatcttttcccatttatttatgggtttgtttatttatttatttttagagacagggtcttgctatgttgcccaggctgatctcaaactcctgggttcaggcgatcctcccacctcagccttccaaagtgctgggattacaggcatgagccaccacacccagccttccatcctttccttttttttttttttgagatggagtctcactctgttgcccaggctggagtgcagtggcgcagtcttggctcactgcagcctccacctcccgggttcaagcgattctcctgcctcagcctccacagtaactgggattacagttgcccgccaccaagcctggttaatttttgtattttttgtagagacagggttttgccatgttggccaggctggtcctgaactcctgacctcaggcagtccacccaccttggcctcgcaaagtgctgggattacaggcgtgagccatcacaccaggccccatcctttccttttaacgactaatttccaacttaaagaaccaaggcttctgttttccccttctcggtgcccagcacttggccggccagccttcctccctccattcctctcttcctttctatacaaacttccttgttaaataaaacaggggggctgctcctcccgcccctggattggatgcactttcctgatttaaaggagtccttggccactcgtgaccccgacttgaactgtggtgtcccccaaagtctctttctttccgcccaggagtgttcacttgctgggcggggaggagaaattggggtgtgacccactcagcacaaacccacgccctggtcataaagccgcaccatttcccctgcaaatccagccgttcactgccccggccaccgggctgctttgaagggggatgaggcatgggggctgctgaacccacaactgtcactggcagccactggctggagttgagagaagtcaggctggctggggccgttgaccctcggaaggaccactgtcataagatgtgagaccagtcaggggcagctcagatggggagagaggctggccagggcttccttcagctggggctgagcagtggagggcctggttccccatcctgcctgccctcctgggcctgggtcttcccagcgatgggggcgactgcagcgcctcttgggagggcgatcgtgagaggcagaggcctctgagtgctggctgaggggtgtccacccgtgggacatgctccgtgctcttctgtctcgcctgcctcacaagctgagcatgaggaagaccaggctgtgaggtgacgcgtcccccccacccttccccacaggtgtgaatgacagaggtggtgccatccagcgcgctcagcgaggtcagcctgcgcctcctctgccacgatgacatagacactgtgaagcacctgtgtggcgactggttccccatcgagtaagtggagcggattgcagggttggggagagcccgtgagcctcaggtgcagaagctgggcggcgggggtgggggcctcttgggcccttaggaccgtgctgcaaagatgggaatggcctggaggggccacaggggtcccaggttacccacctcatctagggacccctgctgctgggctctttccacctctcagggtgtgcagagttccccagaagggctctgtgagaaatttcagttacagagctatcgggtgtggtgctatttataattcagaaaatttagaagccactcaagtatcttcacagcaaggagttggttacatgcattagagtaattagagtatgtgcatataaaagtgcaatattattcagccgggaaaaaaaaacctgtcaaagagttatattttttgatagagaaatcttttttacaagatattaaaggagcctgtaatcccagcagtttgggaggccaaggagggcagatcacctgaggtcaggagttcaagaccagcctgaccaacatggagaaaccccgtctctactaaaaatacaaaattagccaggtgtggtggtgcgtgcctgtaatcctagctacttgggagactgaggcaggagaatcacttgaacccaggcggtggaggttgcggtgagccgagattgcgccattgcactccagcctgggcaacaagagcgatattccgtttcaaaaaaaagaaagaaagatattaaaggaaaaaagtcagtctagaaaatagtatgtaccacgatcctatttttatttgaaaacatgtacaagataaaattttataatgataggtatgaactgagcgggggtgaaaaaaattttacaagggggtatgtaccatttaacagtgtttcagtatttgaggtgggtagattaatattaggccctatgattgtttcttcttgtctgtcttgcctacaatatatgcacatacagcttttttgatgaaaaaagttgacacaaactttgaaaatggaaaataaacaagatcttgccagccaccagcatttccttgagtgttcacctcagactgactgaacctcatgctcttggcagggcggtggcagggacccctgtgcgtctttgtggaagcgggaactgtcacagtccaggtgatgtgggctggcggtggcaacatgagttaaaaaactgttcttggctgggcgcagtggctcacgcctgtaatcccagcactttgggaggccaaggtgggtggatcacctgaggtcaggagttcgagaccagcctggccaacatggtgaaacctcatctctattaaaaatacaaaaattgggccgggcgcagtggctcacgcctgtaatcccagcactttgggaggccaaggcaggcctgaggtcaggagttcgagaccagcctggccaacatggtgaaacctcatctctattaaaaatacaaaaattgggccgggcgcagtggctcacgcctgtaatcccagcactttgggaggccgaggcgggtggatcacgaagtcaggagttcaagaccagcctgtccaaggtggtgaaaccccgtctctactaaaaatacaaaaaaattatctgggcatggtgcaggcacctgtaatcccagctactcgggaggctgaggcaggagaatcgcttgaacccaggtggcagaagttgcagtgagccaagattgtggcactgcaccccaacctgagcgacagtgagactctgtctcaaaataataataataataataataataaataggcctggtggcacgcacctgtaaccccagctactcgggaggctgaggcaggagaatcacttgaacccgcgagtcagaggttgcagtgagctgagatcacaacactgaactccagtctgggtgacagagtgagactccatctcaaaataaaaataaaaacgtgttcttcagcccagcaatttaactgctggaaactaatctagagaaataaaagctgcagtgagtgcatagatcagactctgcccagggttgcctgagagccagtggagccacgctggaccgtgggccttggccatgtgagccacccagcctgcctgtctctcctgcagttctcgtgggcctaaggtctcaggttcccaagactgtgacatgaaccgggctgtgaggcagcaaaactaaccctacacaccctagaaactccatgtgcctctgtcctcctgaccttgtctctctggggctggggctggattcgcctgttaatgaccatgtcctgggcctttatgcccactgttttttttgcctgctccgctcagaggggtcttggcctcattgttgatgagcagccgttagcagcctcagcctcacattccccttaagggcgggttcctccctgtcagggaaggcattgtaaactcaaacgcctgtcagctgtgaacctggctcttcctggaatcactccactcccctagtcttcagtgtccagaagtctcacagattctcgtaggcactcctccagtgtccaagggtgagaagggccctaaaatcttcactcacctggtggaggaacagggccctgctgctgactctccatgagttgcttccatggagacagtttcatgtcggataaaattatttttcccgggccaggcgcggtggctcacacctgtaatcccagtactttgggaggccaagacgggcagatcacatgaggtcaggagtttgagaccagcctgaccaacatggagaaaccccatctctacttaaaaaaaaatacaaaattagccgggcgtggtggcacatacctgtaatcccagctactcgggagaccgaagcaggagaatcgattgaacccaggaggcaacggttgcagtgagccgagatcacgccattgcactccagcctgggcaacaagagcaaaactccgtctcaaaagaaaaaaattcccatcagagatccccagtcctgtctagacagatcactgctttaagaaggtggctgtgacagttaggtagagacttaagtgatgggcacactcctcggcagccttagagcagcaggcagaagtggcccagagctccctgtggttctgatgtctagagcacgaccatagttggacttgacctgtggcaggttcacctgagtatgttctgtttctcaggtacccagactcatggtatcgtgatatcacatccaacaagaagttcttttcccttgctgcaacctacagaggtgccattgtgggaatgatagtagctgaaattaagaacaggaccaaaatacataaagaggtacgtacgtgtgtgcagtgaggacttggcagtcactgtcattggacgggccaagggggcttgcgatggaatcatgctgcctgctccacagccgtcgtccaaggagcctgtgacccaaggaatccaagtggccaacgacacttgtccctggctggtgcttttctgtgtgtgtgtgtgtgtgatttcatggtgcgtgggcctccagtcgtgcccagcagcaggcttcataaccactgtcgttctgaagcaggcatgagcgcagatgatgcattgagaatctgcagttacaacgtgctatgaaaatacccctgatttgtgttggcggcagtgtcatagaaaccgctaagactgcttcagcttgttgaaggaaatgctagttacagttagaggtcagggaaagtacagagataattttttttcctctaacttcacagagccctttaagatctaagaaccctttgggcatccgtggacccacctcagtctcacttcaggctagcaaaccccagtctgaatgtaaacagtaagaccatggccatattgttccaaatggttgagtttagtcaagattctgtgtgatgatgttggtcatcccagcatctgaggtaatgtttaccacccgaggatttagccaaggagggaaaaacccaccaacaactggcagatggttcaatttgtttggcttgaggttatttctttaaaagttagagaaggggccgggcgcagtggctcatgcctgtaatctcagcactttgggaggccgaggcgggcagatcatctgaggtcaggagttcaagaccagcctggccaacatggtgaaaccccatctctactaaaaatacaaaaattagccgggcgtggtggcaggcgcctataatcccagctatttgggaggctgaggcaggagaatcgcttgaacccacgaggcagaggttgcagtgagccgagatcgtgccattgcactccagcccgagggacaaaagcaagacttcgtctaaaaaaaaaaaaaaagaagaagaagaaaagttagagaaggcctgggcacagtggctcacacctataaccccggcattttgggcagatcacgaggtcaggagttcgagaccagcctggccaacatcgtgaaaccttgtctctactaaaagtaaaaaataaattagccaggcatgatggcgcttgcctttaatcccagctactcaggaggctgaggcacaagaatcacttgaacccaggaggcagtggaggttgcagtgagcggagattgcacttttgcactccagcctgggtgacagagtgagactctgtctataaataagtaaataaaagtgcaagaaggcctgtctctccctttaaggacccgaatccactggcatctaccctgttttgcctgtggtcatactctgtctggcacagcttttttctcctgagtcactttttctgccctagcttcctcctgagcttttttctttgatttttaagagctaagatgtagcagaaagcaagtgtcaacattcttttctctcctcttttttttttattgaaacggagtctcactatcacccagggtggagtgcagtgatgcgatcctgatcccggctcactgcaacctccgcctctcaagtaggattttagacgtgcgccaccacaccaagctaatttttgtatttttagtggagatggggtttcaccatgttggccatgctgatctggaatccctggcctcaagtgatccgcctgcctcgcgggagtgctaggattacaggtgtgagccaccgtgcccagcctgatctctcttgttaatgggacacgtggtcccccccttcccccaatgactcattcccctgaaccccatccccctccgggtggctttcctgagtgccccctggtgactgtgtgcctgcccccaggtggcggctgggtctcttcctcctctggaatgtgtttgtgttccctcgaggccgacatggggaccctttggctcatgttcccggctctcagtagagggccctctggcctgcacgctggcactcattcatctggccccttcctctcaggcttagtgagttcaaggtcagggcaaagtagaccctgttaagagatgtcagctggggaacagacacccttcctgcaggcctggagtaacaagagtgataaggacgccttcctccctggactgacatatctgggtgaactgtggcttgaagagggctgggagagcagggagcctggacaggctgaccccagcccagcacgtgggagcagaaaggccttcttgttctttacgagttggaagatgataagagcctcatgctgatcagattcatgactcccacccggaattccatctctagaaccaagagatggtgggtggctttacgcaggtgtggcggtgtcctctgcctgtgggggcagcagaaggggttggacggccgcccaagtctcactcctccaagatcacctggggcagcgtgcgattctttaactgaacctctaaaactttgcatttgtccactgtcctgcatccaggcctaccaggtgacatgcgtgcattcccatgaggcccgcgtggtgctgtgtagttgctgccttcatgccataactttaccttgtgctggcatcagagcctcattcccgtccttggctaggcctcccacacacccctaggagaagctccttttgtgtgtgttcttcttttcagctgtttttcaccagaagggcataaacgctctcatttccttggggagtgggggcccctctccagtacctcttgattctgcccctcccagtcggtgtccctctggctgtcgtgggaagtcggtgcggagcccgcctgggccgggctgtgcagtgagccgtgcaccagacgtgtgagcctgactttctctctgactcttcctctaggatggagatattctagcatccaacttctctgttgacacacaagtcgcgtacatcctaagtctgggcgtcgtgaaagagttcaggaagcacggcataggtaagggcagccgggcccgcggcttggcgcccaccccacccccttgccctaccccacccccatcccatctgcacccagtctcttccctggccccaacaactctggctcgtgaacatccctcagtctcatcttccatcctcgttcccgtcttgggccagaccttcatcatccctcccctgccagcacacccaccaccttcagccatcctctttccacatgcccccaggcctttctgctgcagcctcgctcagcccccaggatggagctgaggaaactggcacctctcacttctgctgccgccacacgcacaactcgtgtattcactgctcacgattcagagtagaaagcgtgaacacgcacgaggaagcaacactcaccgtttctccgatgtcccaccccactcggccacacggccagtgagcggcagagtcttaattaattttaaacccaggcccatctagtccatgttttcctgggctcacatttaccctgtttgttgtctgaaagggagtctccatgcgggcccagcccatgggagggcgctaccaggccacctctgcagtccctcccagcagtctgtagctaccaggctccatctggccatgagattttagggactttgacagtggtggtgaagaaaggctggtctctgatacggtgggccgagacatctccgagagactcatgcaaagcccccatcctagcccagtcatccttccttcctaactgctctgcctgcattacctttacctcttctccccaaggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttatatccttaacttctgggggagagggactgtggcttcctgtccataaggtggcagagccagtgagcaagttggagctgtggtccccctcagatgatgttcaggtggccaagcttatggatgcttctctcccttacctgatcgtgttgtgggtaaacctgacacacatttgggtaaatcgagttgcacatattaccatgttgcccaggctggtctcgaactcctaagctcaaatgatccgcctgccgcagcctcccaaattactgggattataggcatgagccctgcacccagctggagagcctcctgctccacttgcactggggatcagcagtgcacaaaacggacaggatcccctgtcctcccagagcctgtgctagcagaggggaaacaagtgcggagagaagagatttttactttttttgaatacttgggttcaaaccttccttataggatgcatgacccaaaggtatgcccttccctgcttcttcctccttaactttcactggcccctgacaggtcagagggaagccaggaaactttataatagtcagaatgtggcccaaaaaaatgctgtgcgtgtgtgtgtgtgttttcaaattcatgagtctaggatttattcattacatagaataataagcaggaaagagaggggtgaccccacactccacaggccgtctagcttatgtgaagacaggcatccagggggtcagcactgttgaccccctccttgtcatatggacagggctctgtccctcttgctgccacaaaggttgagaatctagggagaaccagaagcacctgcccttctgccaggccccttccccaccccccgtgcatccctgggtgtggtgtccacatgcctgctgcctcactcagaaggcccttctgtccccagaccccaccctctgttgttttgcacagcagaggccacttcgtctcatgagcctttccagctctgcagaggcttagcgggctctcagcctccgaagcctggcttgccatctgcacacagtcccacaggccactgcgcgggcccctgatgactgtgccctggcgagcgtggtcagggcaagtcggaatcttccttaacagagccccacggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggtatgggagcttggtgcctccagccacaaaagtggaaggccctggatgggcacagagaacggcagagccggaaggggccgtggggactgcagagtccaccaccttatgcaccagcacagcccagaggtttggtgacttgtgccaagctaacacagcaggctccatggcaactgggctgtgcacccgactttggatccatcagtgcctttatttgtgtggggaccgagaggcgcctagtggctgcaggcagacaccatggcctggagaagggctcatgctcctggagcacccaggcccagctgtgtggcccataggcagggtgtggggtgggcagagtgtctccgccgggccttcaccctgccctgctcttctctttcccacaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattggagttcgtcaca

SEQ ID NO: 871 - DNA, 28973 bp, Homo sapiens; identical to SEQ ID NO: 870

SEQ ID NO: 872 - DNA, 29158 bp, Homo sapiens
tcttggctcgctgcgcctctgcctcccaggttcaagagattcttctgcctcagcctcctaagtagctgggattacaggtacacaccaccatgcccagctaattttttttttttttttttgagatggagtttcactcttgttgcccaggctggagtgcaatggcacaatctcagctcactgcaacctctgcctcccaggttcaagtgattcttctgcctcagcctcctgagtagctgagattacaggcatgcgccaccacacccagctaattttttacttgtagtagagtcagggtttctccatgttggtcaggctagtctcgaactcctgacctcaggtgatctgcccgcctcagcctcccaaagtgctaggattacaggcgtgagccaccgcacccggctttgtatttttttttttttttttagcagagatggggtttcaccatgttggccagctagtctcaaactcctgacctcaggtgatctgcctgcctcggcctcccgtagtgctgggattataggcgtgagccaccgcgcctgtcctcacatgtgggtttttaaccaggagcgacactcgtcagcaagagaagtgtctagagattggggcatattttgatggtagatctcacgggatgaggcatgggttgagagtaagtcaggtgctacaggccgggtcttggggcagccgtgcggcagagcttgcagagctcatgggtgtgttccgcctctgtgctgtactctacgggaaccactggccacatgtggcaagcacaactgaggaactgagttgagttctgcattttctttaattcttaagtaatttaagtgaaaatggccacatgtggctattggttactatattagacatcactgctctgaagttttttgtgtgagcccctggaaggatgaagttgccatgtactgaagcagagaaggttctgcacatgctccatttgccacgccgattggctgtccaggtggagatggtgcacaggtagctggtatgtgaaactagagcccagggaaagcccaggctggagctgggagctggggagcaatcagcacacagatggtattaaagccttgagggtaggagcagagccagcagaaaagacggggggtccaggaatgaaactctgactcgctccacttttgagaagcagagaaggtgacagactcctgcaaagaagtttggggatgtgctgctcggaagggaagaaaagcagctagagccagagcaggctggatcctggaggactaaggaagagggaagcaagctatcaaagccatcagctgcaaatgaagagggagagttgttgctagtgggttgaaaatgagagccagaaggtgaggattggttgtccaggagagagggagagtgagcagagcagggagacgtttatgtttgggctccttagaagagttagcatattctaggaagaaggggtgacacacacatcctaagaaagaagcctgtgcacagggctcagtgctaaatcctcattgtggttgtcatcaccttcctggcaacagctgcccatctgtggagcccagaaccattgtaagtccttagtgggtgccacccgatttgcgcctctccaagcctgtggaggaaagtctgaggcagagaaggagggcaggggaggacgaaacacaggacgtcaggctgctgcaagaggatgtgtgtccctcaggctgtccctttgtgtggccgctctgctgccgtcaggcaccctactgtgacaaagtccaagtaggaagcacgtcagctttctcccagctatgccctcctggttgtggcttcagtttgaggtgacattaggttttttggagagacccaggcgtcctggaattggtctctttagtacttagatgatcatttcctgagcgtgtgtcccgcagcctgtgagcatgtaactggggaagcacatgtttgtggtcacgtgtcccaaccaaaggtaggagctgacatgaacaggctagtggttgaatgcatgttaaaaatctgtggctggccgggcacggtggctcacgcctgtgatcccagcactttgggaggccgaggtgggtggatcacctgaggtcaggaattcaagagcagcctgaccaacatgtagaaatcctgtctctactaaaaatacaaaattagccgggcgtggtggcacatgcctgtaatcccagccacttgggaggctgaggcaggaaaattacttgaacctgggaggtggagattgcggtgagccgagatcgcgctatcacactccagcctaggcaacaagaacgaaactccgtctcaaaaaaaaaaaaaaaaaaatctgtggctggctgaacatggtggttctgcctataatcccaacactttgggaggctgaggtcggagggtcacttgaggccaggagttagagagcagcctgggtaacatagccaagaccctgtctctattaaaaaacatctgttgctgaggtttctgtttttgttattttccttccagattgcagatttgaaggcagccaggcagcttgcgtctgaaatcacctccaaaggagcatctctgtatgacttgctcggcatggaagtagagttgagggtaagcattccagtacttccttaaccatgcagattttctcttcaaggttttctttttcaattctgtttctcccttttcagttctgatttaatgaaatacacctggttgaatgagctaatgtgtggaaaggtgatagaggatattagctgtccttcctgcttctggtgggcactggtctagctttatttatttatttatttatttttatttatttatttttgagacggagtctcgctgtgttgcccaggctggagtgcagtggcgcaatctcgtctcactgcaagctccgcctcccaggttcacgccattctcctgcctcagcctcccaagtagctgggactacaggtgcctgccaccacacccggctaattttttgtatttttagtagagacagggtttcaccgtgttagccaggatggtctcaatctcctgacctcgtgatctgcctgccttggcctcccaaagtgctgggattaccggtgtgagccaccgcgcccggcactggtctacctttaacttcttgtttaggagtggcagctccatggcatgtgactgagctgtccttgttgtgcccactggcagactttattgatcatgatgtttttttctggtgtactctgcttcagcattttctcaaaaatgatcttctgagcttgcagttccccgaccttgctgcccagtgcaaacacctggggacctctaaagacttctgaagcctggctttcactctggggtccttgttatggaatgtgacctgggcattgggagttttcagattctcccgggtgattctaacagcagtttgggaccagcaatcttggcatcacttccagtcagctgaagttgatgttgcagtggagactgatttgatttgcaatccttattccagccaatgccagccaagaagtatgtgccatcacctacatttaagtagctgtttaagactggagtggtgtttattttttatttttttaattttgttattttttttgagacagtctcactctgttgcccaggctggagtgcggtggctcaatctcggctcactaaaacctccgcctcccaggttcaggtgattctccttcctcagcctcctgagtagctgcaattacagatatgtgtcaccacacccggctaatttttgtatttttagtagagatggggtttcatcatgttggccaggttggtctcaaactcctgatctcaagtgattcgccttcctcggcctcccaaagtgctgggattacaggcatgagccactgcgtctggcctagagtggagtagtgtttaatccttacctgtaaagatttatggcatttgaagcatatgtgctcaatctaatgctttaaaactaaatgaatttctttcattcacttcctagcaagagtgccagccatggcttctctctctcactgccttgcctgtgttctggcataccctgggagcaaactggaagtggaagtctggggaagagggacttaggtgctagattgctatgtctgctcatcatatattgacccggcagttgccacctgatgaagtgtggttggcagaatgaaactgccactgacatctgctagctaattcagatgatgagtaaggtacctccaggctttcccctgttctgtttgtagtgcagtggtgtacatatgtctgtacatgtccctaagagactcagagacaggagctggccacttgctgattgccactagagctgtggcatcattgtgagacttcatttccatcccacggggtctctttcaacaccatcctgtaaagaatgatgaagtaaccagtggctgaaactgttcccaaggaaaccatgagaccctgaatgtagtacttgtcaaattctgtgtgtagtcatgatccgaggaagagcgcctatccagtgtttgtttttctttcattcagtaaacatttactgaggtgcagcctcagccacaggcaaggcactgagctctgcctccttgactaagtcctcaccctgccctcagccattcccaccaggtgcaccgtggatgaaaggaagcacaagacgagttttgacacagtgcttcaggaaccttgtcttactttgttcaggctgccgtcccaaaacacaataagctgagtgacttataaataacagatttgtttctcacagttctggagattgggaagttctagatgaaagcactagcagcttcagtgtctggcgagggcttgttccccacagatggtgccttgttgctgagtcctcacatggcagcaggggtgagggatctccccagggtttctcttaggagctaatcacctcctaacatcatcacattgtggtttcgagtttcaacataggaattttggggtcacacaaacattgtctatagtaaacctcataactatatccacattacaatcccatgtctcagaagttttcagcactgatatgatagtcacagatgtctcccttgataggttaatggttcatgctaggggcagggccatggtcactgttcttatcggttgcgtttgttagtgataggcaactgagagggacttcatgctaagaaagatgcttagtttgggagtcacctggacagaatgcaggtaaagaagcaaattggggctgggcatagtgactcatgcctgtgatcctagcactgtgggagaccaaggaacgtggatcacttgagcctaggagtttgagcaacatagtgagaccctatctctatttaaaaaaaaaaaaaagaagcagcagcaaatttgggagaaaagataatggatgctaagttcagttttgctcatagagttggggtcacctaggcctctggctgaaaaggaggaccttgagctctggagagagctgggtaggcactcagataatggaagacattataggaggtgatggtggcagtgtttttgcatcagagatccacatggcaataaacttcggagaatcagtctataaggcacatctagatctaggaatactggttttgagaactccttttctgaaaatatacgtaaatgattttactgtttcctaggaaatgagaacagaagccattgccagacctctggaaataaacgagactgaaaaagtgatgagaattgcaataaaagagattttggtaagatgactttgcttttatataatgttttttatgcctgggattcaaaaatactgatttcttgcccatacaagacagaacaagctaggcttagtaacaagggatgtgttagtggggaaatgaaaaactcaagaggacattcgagcttacctaggtcacttactatcatttttttcccctcgttataaataaaaacagcttctcatgttattaaaaattgatcagtttcagtaatttgataattatcagttattcaataattttaataaataatgctctattttattttgtttaaccaattcctcactgcttagtatttaaatgatttcagggttttctaaattccagacagcactgtaataagtagaaggatcactattgtttactgctcgctcacatcagttatcctctcatctaaagcagtcagttggaaggcagatcatgagggtgactctagactcagattgcttgggtttgaattccactgtgtgatattaggcaagttacttaccctctctgtgcctcattttcctcatctgtaaaatggcaagaactgcattcccaactgtgtggggtccttataaacatgaatcacgacagggcatatcaagcctcgtctctgatgcacaattgataatcagtcatcactggtgatttattttactcagtagacacggatgagggcccctgtgtacattcagagtaggcataaaacaagaatttgctatgagttgtacaaaattctaaaaatcataggtttttaaaaatatgtaattcttttgtcattaaacagtaatacctgctgggcagcccagcctagggagtcagagcctcacagcgggagaagggcaccacagccctggtgggagattggtgacagataggcagatgggtcagataagtaaaaatatggcaaggataatggagccacgttcctcactgttggagaaaaaagtcacaaaaatgtcacaaaaatggaaagagagaaaattagggtgaacttgaaattggaggtgttggttaaacgcatagttttcaatatatagataggtataggaataaattttgatatacatgtatgcacatttaaggaattacgtatatatgtatataaatgttttatttatatacatacacgtagagacacccacactcatacatttcttagctctgagcacacgtagcacctggcttaatgccattctccactaaaaggaaccaggactcttaggggaaaatggctaattccagagttgggcaggagaagtacgagaaagtaaggaagagttcaaaggaggaaagggaactattggaagcatgcagaagccaacttaagtgggcttctcctggccaaagtaaggacaacttaagcatcaaaataaataagttagaataattaattttatggtataatagaatgaaataggaaaccatgagttttcactggcataaaaaaataaatgaatattggaggctgaggaggagcaggtcattcacacagattcgaagtaactttccacaaagtactttttttttcttttttttttttttgagacggagtcttgctctgttgcccaggctggagtacagtggcacaacctcggctcattgcaacctctgcctcccaggttcaagtgattctcctgagtagctgggattactggcgcacaccactacacccagctaattattgtatttttgttttattttatttatttatttgtttatttttttagacgaagtcttgctatgtcacccaggctgaagtgcagtagcgccatctcagctcactgcaatctctgcctcctgggttcgagcaattctcgtgcctcaacctcccaaatagctggaagtacaggcatgcgccaccacgcccagctaatttttgtttttttttttagtagagatggagttttgccatgtttggccaggcttgtctcaaactcctgacttcaggtgatccgcccgccttgacctctcaaagtgctgggattacaggcatgaggcattgtgcctggcccgcagagtacttattaattacagaggggaaaagagtcacttctcagggagaagcctgccagtcacccccttaatcaagagatcaaagtgaacatcatcgttacagaacaaatcaaaatcatgcacgcctggtaggatgcagtcacttctgagtattcctgccaacgatgcatatctgactctaatgagacaaagccggattgaggggcattctacagattaaccagcctgtatgctcccagagtgaaaaggttctgaaagtcaaggaaagctgagggggcatttcagactgagggaggctgtggagatgtgataactggacacataggcagctcctatctgctgttggggacttcactgggacaagtggggacagtggagtggggctggagttagacggtggtagtgtgttagtgctggcttcctgttttgatgattgtattgtggggatgtaggagaaagtccttatttgtaggaaatacacgctaaagtattcagggtattggaacgtctggtcagcaacttactgtcacctaggttgggaaaaacgctttgtgttgtacaacaggttttccgtaaatttttgattgtttctaaatttaaaaattaaaaaaaaattattatacctcttatccttgccagtgttctaactgaatcaggtgaacacggcatgaatgtgcccttagcactaatatgttaaaagtagaacacccaagagaggacagggttcatttcttggtagacatctcttaagactcctttcattgttagaaaatatctgtgatgtttgatcattctaaaaacaaccaaaacaacatgggtacttaaaagggtttggggagtacaggccatttatttcagaaaccagggaaaattgcttgtgtttacacagctgttttgcattgtggatctttcttgtttgaggaacagatatgtttaaggtgggataaatttactaggttttaatctgactttggttcgaggaaacagttgccattaactgaagttgtttagaaaggagacccacctttcttcctgtgagggtgaactcgcatttctcctgggggctctaaggcacttgcagcaaatcgatgataagggtctgattattttcatgaaagtatcttagaagtggctagtgtacttagaccaaaaaaattagaccataaacgcattgtcagtaacagtggctggttccaaaacacaccatgcctgagagttgtggagagtgtctgggcttcgtaggccatttctctgtggagcccatagcttttcagagacttgcaggaaaacagagtaaccccttcgtgggatgctacacataggcaaagagctggaggggaagccccaccttggccaccaggaacttaatgcagggctggaaagccagaaccctggggggcagttccacgctcagctgggtggcagtccagattcctcataaagagattggagcctgaaccccaggcatgtgatccagccagccaccggacaagacgcatgtgaagacggcgcactaccagtgactctacctgcttcaaatgaaccttctcttaggatagggagacttgtgtcaccgtcagtgggcccgtgtcccccttcccttctttactcagcctctgttgcccaagggcctctgtccaactgttgccctggaccccttccagagctggtgcacaccagtgtggccattgccactgtgggaactgctttcgtactgtcttcagagtggtttctcctcgtttttagtctgtagtcaagcttctgttgccagggagagggaagaggaccttctctcaatcccagcaggcagtgggttagggctgggaccagctgtttctttctctcccctcctagtagagcagtacttggtgtgtgtgggtattctgtaagtcgggtgtttgtaactaggggcatggcccgaatgataaaaaggcagactgaccgtccagagtgatgtgcaccttgttctaaccgagtgagccagagaaaagactgcaggcctctccaccttgaccaggacactcttctttgcatcttcacttctttccctgggtagaaatgcctgcttttcatggggaaaaaaaaagagatacctttttctggacctgtgtgacattctccctggaactagtgggttaagtgagtcattgcttggggaagtgtctatttgtttgcttttgtgtttgttgagcataatgttgctatgcctgaagagttgcaaaattcttctaagaattaggatggctgtttttattgccaccttgtctcattatttcccattaaatatagacacaggttcagaagactaaagacctgctcaataatgtggcctctgatgaagctaatttagaagccaaaatcgaaaagagaaaattagaactggaaagaaatcggaagcgactagagactctgcagagtgtcaggtagatatgaacacttggagaatgagtagaaagatgtcctggaaagttcaaacaaactgggcgtggtggctcatgtctgaaatctcagctactcatgaagctggggcggggggttctcttgagcccaggagtttgagaccagcctgggcagcataatgaaaccccatctctaaaaatttttaaaaattacctcagtatggtgatacacacctgtagtcccagctacttgggaggctgaggcgggaggattgcttgagcccaggaggttgaggctgcagtgagctatggttgcatcactgcactccagcctgagccacagaacaaggccgagtaacagaacaaggccctgactctaaaagaaaaaaaaagttagaacaaagacttaagagaatagaatgtgatcttaactcttctcaagcaatgaaaaaaagccttacataagggtatcttcacctcaaatgtacatgtgttgcctgtcataacaagcagatggctaaactcattctctttactgcttgcggtatgtctggaaaactgcttaaagcttgaactgccctttaagcttttatagcttcttggaactcaaggcagagtaagtgaatccagacggggaaatccagacgtggtctcctaagatcttgccataaattaggtagaaacagaaacatactcctgcctgtttgttggcatagattttagactttatttaaaccttgatcattcctcaccagtcagtaattcatctttcttcctacgttacctcattggaaatatatttcccaggaataccgatggagaatagtggtgccggctctctctctcttctcttcctcgttctgtgcctctttccctcccccatgcttctgctctttctcccttttcattcaccctttatttttctttcttcttggctccctcctcttcccagctgcctactctgctcggatgttttgcctttttggatgttggtggctggctacaccctgcccactgtcccgaggtctgtggggaggcagcacctggaggcagcgacagcaaccacagggagcgccctggctcctccctgcccagcgcaaggccaaggcccttcccctcctgaaactggctctttacctctggagcctcagagagggaaaaaaaaaaaaacagaagtcattgccgccatatagattgatctccttgacacattccacttttaaagcatcaattcatttttgttaagctccaaatcattttaacagaaaagtctctttgttttgctctagttcaaaagattataattatttctgagtttatctgcttatatttttaaaagagtagaattttccctttaaggtcaataataagaaaaaagaaaaagttcagcaaaccagtatagatttttatggttttttttgtttttgttttttttttttgagttggagtttcgctcttgttgccgaggctggagtgcaatggcgcgatcccggctcactgcaaactctgcctcccggattcaagcgattctcctgcctcagcctctcaagtagctgggattacaggcggccgccaccacgcccagctaatttttgtatttttagtagagacggagtttcaccatgttggccaggctggtcttgaactcctgaccttgtgatccacctgccttggcctcccaaagtgctgggattacaggcatgagtcatcatcacgcctggcctttttaaaaaattttttatcgtttaaaaacctctttagactgggcacagtgattcacgtctataatcccagcactttgagaggccaaggcgggcagatcgcttgaactcaggggttcaagaccagcctgggcaatatggcgaaaccccatctctacaaaaaaaaaatataaaaaatagctgggcatagtggcacatgtctgtagtcccagctacttgggggcctgagacaggaggatcacctgagcccaggcgttcgatgctgcagtaagccatgatcacaccactgcactgtagcctgggtgacaaagtgagaccctgtctcaacaaacaaaaaaaaaccaccagccttaattcgtaacaacctgtggtcccctttttagaggattgctttaaatttataatatcctgacagtagaacattattattattattattatttcttttgagatggagtctctctgtgttgcctaggctggagtgcagtggcgcaatctcggctcactgcaacctccacctcccaggttcaagcagttctcctgcctcagccacccgagtagctgggattacaggcatgtgccaccacgcctggctaatgtttgtatttttagtagagacgaggtttcaccatgttggccaggctggtctgaaactcctgacctcagttgatccacccgcctcagtctcccaaagtgctgggattacaggcgtgcgccaccgcacccggccaacagtagaacattatacccaaataagataataatatatatatttattgatttggagagatgtgtctggtatgtgatttttttgcctttagagatggggtctcaatgtgtcacccaggctggagggctggagtgccacggcaaggtcagaggatcctcactcactgcagccttgaactccagggctcaatcctcctcctacttcagcctcccaaagtgctagggttacaggtgtgagccgatgcacccagcctgatcatttttaactctattgagattacggtatattgaaatgaaataaagattataaaatttcttggtatatttaattttttttttaaatgcattcctatctatatttatgcatagaaaagtctggaaggatgtatgtcaactatcaagcgcttatacctggtgatgggattatcagtaatttttacgtcattcttcatactttcaggattatttcaagtttttacaaagagcacatcttatttatgatgaaaaagaagtatgttcattttggggggagaaagcagaaaagggaaaatatttttaagcattacaagaatgaaggaccttctctaattaagggtttccagagaaagccaccatggaatctgaaactgtgaatacccatttcaaactactgcatataattcacctttcctttttatttcatttgcttcttttaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggtgagctgagcctgtcctctgttcagccattccttctggtgtgttattttgtactgggtgacaggtcattttgttaatatcattgtgaaaaaaatatcagtacatgttttttctccctggtcagtctgaggattgctcatgtaatgtgtttgttttgctggcagtgtacactggactccagggttgtcaaatctttgatgtcatatttcatcaggtttggtcagttaagagaacagacagggccgacatgaggcctgtgtggctgcgtaagaccctgtgccgacatggggcctgtgcttgctttcaggccctgttgtcactgtcttgaaattcataataatttttaagtgcattttattttccactgatcccaaaaattatgtagctggtctcgagtgcagatttaaaagcttgcttggctttgggaggccaagacgagcggatcacttgaggtcaggagtttgagaccagcctggccaacatggtgaaacccctcctctcataaaaatacaaaaaattagccgggtgtggtcgtacacacctgtagtcccagctactcggcaggctgagacaggagaatcgtttgaacatgggaggaagaggttgcagtgagccaagatcgtgccactgtactccagcctggacaacagagcaagatcccatctccaaaaataagaaaataaagcttgcttagtcagttcacataaagattttcaaggcaaggtgcgatggcttatacttgtaatcccagcactttgggaggcttaggcaggaggatcactggagcccaggagtctgagaccagtttgggcagcataatgagaccctgtctctacaaagaagtaaaaataaattagctggacatggtgttacacacctgttgtctcagctacttgggaggctgagatggaaggattgcttgagcctgggagtttgaagttggagtgagccatgatcatgccactgcactccagctcggttgacagagcaagaccctgtctcaaaaagaaaaaaaaaaagggccgggcgcggtggctcacgcctgtaatcccagcactttgggaggccacagctggtggaccacgaggtcaggagtttgaaatcagcttgtccaacatggtgaaaccccgtctactaaaaatacaaaatttatctggtatggtggcgggcacctgtaatcccagctacttgggaggctaaggcaggagaattgcttgaacccaggaggcagaggttgcagtgagccgagattgcgccactgcactctagcctgggcgacagagcaagacaccatctcaaaaaaaaaaaaaaaaaaaaaaaaagaaagagattttcaagtcctggttaattgaatcaccagaatagctcattggagattgttttgtaaagaggaatggcagtttatttattgattgtgggaaataaatgtgtggccttgagcctgaccaaccatcttacaggttcctctcatccctgtgggtaaggccatttaggaaaagagtgttttagacccgagcatgagttgataaatgtggaatttagagcaaaggaaattgaaccaagttgtgatcagtttttgaattgccctatccttaacctgagaatggtcatttagactccattttcatgatgaaattggtctgcagtctccctttctcatgcccttgacagcttttggtattaaggttatgctaggcttcttacaatactgagcatttgagtttggcagagctattttgttgtccaggagggctaactgggagtacctaacgcatccgtgtggacacatgtcatcttgacgaggaattcattgctagcattactctgtggcagaggcaggccatggagaaatggtacgggacaggcacatttcgagggcactagaaagagcttggagtttagaacattttaaacattgggtacctgggaaagaacagtcaagggcagtgaaaagaaacgttggccatttttttgtattatctggggccacctctgggttcagagaacaaaccaaacagtatgcctcagagtggcaggtaggtggcccaggaaacttcccagggagcccctctaccctacccttccttcaacaagtacatctctttttctcttactcactctcgctctctgtcgttagaatacctgttccctcgaaataccccatgccggaaacacagtgctttatttttaatgtttagaacaacaatatataaagccaacttcctccctctgtctgtccctcccccccactctctctctttgtctctttctctttctcaacggggtctcactctgttgcctgccactctgtctggagggcagggtgtgattataactcactgtagcttcagacctcttgggctcaagcgatcctcccacctcagcttcttgagtagctgggactataggcacttgccaccatacctggctaaattttttaaatttgttgtagagatgaggtttccctatgttgcccaggctggtctcaaactcctgggctcaagtgatcctcctgccttggcctcccaaagcgtgggggttacaggtgtgagccaccacgcccagcccccattctctttcttgataataatcaaggccacattttatgatctgagatatttcctcctgtccccacccctgttcccatccttacctgtcccaccatttagcatcttttgagctggaatctgaaggcagggcaggaaagataaatgataaaatctatactttcttcctttgaaagcaggaggcctgtctctgccctaaaattagatgtgtctgttctgtgtccccaggtcatacaggcatgcgtgatgggcatttagttctcctcagaggcagggaaatgcaatcggagaagcatggggtggggcagctgcttcactctgggcgcccctgtccaccaggccacgaggcaaccgcagagagaaagggcagtaagtttcaggaccctggagttgctcaggcagtgttaattctcttccccttccttgagtttagctctttttttgttctgtagcacaaacttagcagtccttacacagtggtgaagaagaatagaacagtccagaaaagggccatctctcctgagtctgtatttcctcttccacaggaagctaaaaacactctctgcctgatacagaacaagctcaaggaggaagagaagcgcctgctcaagagtggaagtaaggctgggcttcgtagacgagcagtttactctggactagtattttcagccttgaaatatatatagagagatatatatatattttttaatatgtattttcttctttttttcagcagttttttttttactgtagtaagaacacttcactttacatcttcaattttgaaaagtataataaattattgttgactataggtacaaaaatattttcaaaaggcggttttctcacaacttctatattgggtaccattgtattcactcaagagtctggtttaaatatagcatttaaaacacatttcgttcttgtgccagttaagatagtgttttcccctgtttaaatgatagtttgaattatatatgatgcgtaactataagaaaacatggccctagatgtgtgtagggttctgtattttcaggctgaatgatggaaagcaagcactgggatgcagtgcagggagaggggccgctcgctttgtgatggtccccatgctgctgagatgccccccataatccagaatggctcagcaagacactcagctggagagacacagggttacgtccatgcaaagcctagattccgggaaggagctctctgtgaccaggcagcttcccttatccttgtgtgggcggcaagccgcccaggtgccgaggcaagagaccgagagcacgagctgttccagtataataaaatatataaaataagaatagttatactagatatagatcatagatatgattatatatgaatatcattaatcattagtttatagcaattactctttattccaatatcataataatcctcgctctacaatcataacctaggaaaaaacaggccatacagatataggagctgaggggacatggtgagaagtgaccagaagacaagagtgcaaaccttctgttatgcccagacagggccaccagagggctccttggtctagtgggaacaccagcgtctgggaagccgcccgttgccaagtggaccgtggtctagtggtagcgtcagtgtcaaggaaaaacacctgctacttagcagaccaggaaagggagtctccctttccccgggggagtttagagaagactttactcctccacctcttgtggagggcctgacatcagtcaggcccgcccgcagttatccggaggcctaaccatctcccggtgatactgtgcttcagtggtcatgctcctagtctgccttcatgttctgtcctgtacacctggctctgccttttagatagtagtagcaaattagtggaagtactaaaagtctctgataagcagaaataatggcgtaagctgtctctctctcctctctgtctctctgcctcagctgccaggcagggaagggccccctgtccagtggatacgtgacccatgtgaccttacctatcactgaagatggctcactctccttaccctgcccctttgtcttgtatccaataaatatcagcacagcctggcattcagggccactatcagtctccacgtcttcgtggtagtggtcccccaagcccggctgtcttttcttttatctctttgtcttgtgtctttatttctacagtctctcatctctgcacatggggagaaaacccaccgaccctgtggggctgtaccctacatccctgaacttcagtgtcaagtcactgtcagggaccggtagcagcccaggatcttcctgctgaattgatggccttgttgcacggagttcctcctcctcttgctggttgccctttcttttcttcagggtgaaatattctattcactctcatgttgagggcagcatacttgaggcatcaggcccacacacatgctcccacacacactctctctctctctctttctctttctttgccatttcccttgtatctctctcattttgcacctgttctgtgactctctcgtctgaatctcaggaaactttggaggaaggatagggactgctgggaaatcctccaggaacaaggttaggaaatttgaagggcctgtctagccaaagcagccctcccctttttagttccatgtcagccaggagcatgtgaagcagccctcagtgatcagcctgcatggggtttgtcccttgcgagaggcccagctcagctaggagccctggtttgttgcttgcatcccatgctgtccccgggccaggatgctaagacctgccattctgatcttgctttattcaccaagatttacctttgtgttttcttctaggagttctatagttttagctcttacatttaggtctctgatccactttgagttaatttttgtatatggtgtgagacagggggtccaacttcattcttttgcatgtggctattcggttgtcctattatcatttgtggaaaagactattatttccccattgagttatactcgcatgttgtcagccattaattttaattgtcactgtcagctcagtggtttcagtgtcagcatgcattaatgtcttagtctgttttgtgctgctgtaacagaatacctgagactgggtaattatatattttacataaaatatatacagcattgtatatatggatacatgcagtcatccctcaatatctgcgaagaactggtgccagaacccacctgtggataccaaaatccacagatgttcaagtccttttcatgtaacctatgcacatcctcccatatactttaagtcatctctagattacataaaatacctaacataatgcctatacatcacttcattcacatggattcaacatagtacttggtatgtggcaaattcaagttttgctttttggaactttgtagatcttttttgaactttgtagattttttttccaaataattcagatccatggttggctgaacccatggatgtgaaatccatggatacagagggccagttttgtatgtgtgtgtgtgtgtgtgtagtttatatatatatgtcatatatattattatatataatatatattatattatatattattatatataatatatattatattatatattatataattatattatattatatatattatataattatatattattatatgttatatattattatatattatatattattatatattatatattatataatattatatattattatatattatatattatataatattatatattatatattattatatattatatattattatatattatatattattatatattatatattattatatattatatattatatattatataatattatatattatatatattattatatattatatattatataatatatattatattattatatattatataatatatattatattattatatatatattataatataatatattatataatatattatataatatatattttataatataatttataatttataaatttatatttataattatatatgttatatagttatatattattatatataataatatatgacaattatataacatatataatatattagtattaggttatattattatcattataatcagaaacttacttgtctgaaatttaatgagccacagttctaggagcaagcccaagatcaaggagctgcatcttgccgcaccatcccatggcagaagggcaaagagagggcgagagagagcaagagatcaaactcacagcctcaagcccttttataaccagcattaatccattcttcaaggcggagccctcatgacctaaacacctcccagtatgccccacctcccaacactgttgcattgggatttaagtttccaacacaggcttttcggagacacattgaaatcatataatagcaattgactttagtttacctgctcacttctcaggtctgtattggtttgagttgtaagaagaaatcttattgagcctgaggtacatgtattaattttattttaaaattgattatataatttgatttgcattgcatgggataaggatttaatgtcttaatttcctggatagaataagaaatgaacaaatgacttttgcacacagaccttactgggcagagctgtttcgttgtgatcatgaagccactcctttgttttgcctgcttgtgttcctgctaggtaacgatgactcggacatagacatccaggaggacgatgaatccgacagtgagttggaagaaaggcggctgcccaagccacagacagccatggagatgctcatgcaaggtaccccggcgtctttcgctggacttcctccctgcgccctgtttcacagaacacctggccaggactggggcaggctgcttagtattgaggcccacaagcgtgctgcgaatggcccctagaagcagctcttgctcaggtttatcctgtcctgttgtttatggctcttgaactgctcagtggtcatgtttgctccttgtctgtgatcccaagactggatggttcatatttatggcttggtatttctcacagccacaagaacacattgcctctgccactctcagtgcagtgatatacttaatagcctgagaattaatgcagaaagggacttaaatgagcatctctgccttaaaaaaagttcttctaattcctttactcatcacaaaagattcaagcaacaaagctcagcgcagtggtgcacaccttattcccagctactcaggaggctgaggcagaaggatcatttgagcctaggagctcggagctgtagtatgtgatgattgtgtccgtgaatatccactgcattccggcccgggcaacatagaggggctcttaaaactaagttaagccaggcgcggtggctcacgcctgtaatcccagcactttgggaggccaaggcgggtggatcacgaggtcaagagatcgagaccatcctggctaacacggtgaaaccccgtctctactaaaaataaaaaaaaaattagttgggcgcaatggcgggcgcccatagtcccagctactcgggaggctgagacaggagaatggtgtgaacccaggaggcggagcttgcagtgagccgagatcacgccactgcactccagcctgggcgacagagtgagactccgtctcaaaaaaaaaaaaagagttaaaacaaaaaaagactcaggcaacaaaatttgtagagcaaatgtgaattctctcctggggtcttcctcatgtcccactcccacctgggagggctcatggctagtggccagggtgggtgtgtctttacagattacctttctgtacatatacatacgcacacacatacacatacaaagatcacctgaaaaaaatttaacctgagtgcaaccagacggtatgtatggttctgcaacttgcttttgtttttaaaaattaagtacaattggaactcttcctctgtcagcaatagatctgccccctaattttttttttttttctttttgagacaaagtctcgctcttggtccccaggttggagtgcaatggcatgatcttggctcactgcaacctctgcttcccggagggagcaattctcctgcaatcccaagtagctggggttacaggcccgtgccaccacacccagctaatttttgtatttttagtagagacggggtttcaccatgttggccaggctggtctcgaactcccaacctcaggtgatccacccgcctcggcctcccaaagtgctgggattacaggcctgagccaccactcctggcctgccccctactttttaatggctatgtcatattcctagcaggactgtacccatgatttactgggcgttctcgcattgatatttcccctcttttccttgtatatacatctttctgcatgtctgcatatctttaggttgcatcattaaaagtcaaattcttaggtcaaaggttccataaatttttattttaatactataaaattctcctatatttgcctttaaaaacatttcttatctaccacctgttaatgtttggagcacagttgcttttttttttttttttttttttttttttggagacagaatctcattctgtcgttcacgctagagtgcagtggcacgatctcagctcactgcaacctctgcttcctggtttcaagcgagtctcctgcctcagcctcccgagtagctgagactacaggtgtgaaccaccatacctggctaatgtttaaaaaaatttctgtagaaatgaggtttcattatgttgcccaggctggcctcaaactcctggcctcctgtctcagcctcccaaattcctgggattatacgcaaaagccaacatgcctggccagaaaacaaatcttgaatgctatttcctgctttattttccaagatttttatgacttcttcatgcttttgttgttctcaggaagacctggcaaacgcattgtgggcacgatgcaaggtggagactccgatgacaatgtaagtcccccgctcccctcagtggttctgtgcactctgggtttggctgtccccatagatgggagtggctgagttgctgtcagcagccagggagccgtctatggtcagcccggccgtgcctcgatgcgtggcagggtttggcctcatgaggctctggactcttcgttgctcgtggatggctcatctcttttcaagtgaatgtgcttgctctgctttttttgccttctcactgttctttccattctcgctttccaaagatggaagcagcaccagctctcttaggtaaatgcaagacttccagctccaagaagcaggttggttttctgttctgcctcatgtgtttgtgggtgtctgtcagccctcccggggccagccaggggcctctccctaggagtgatgcttcctctctcctgggcaaaaaggccactcaaaagagatcctgtggtgacagcgggatcactgaaggcccctgtgctaaagtggaggcgcaggcacggagcctggaggcggggaaagctcaggccgggccatcctcaggccctgggccgccacctagaaatgaaggaggacgccgagggccgggctcaggaccaacccccctccctgttctgtgctggggacggaatggtgaagcagcactgtccccagaccaggccctcgaggtgccaggcatgaggctgagacataagctgccttgagctttactgagtggataactccctggagcacttaagcaaaaggggattctaggggtcctcagtgaggtccagtcatcagggctctgccgcccattgctcaagcctacgttctttgttgcgtccctggcagtgctgctcggcccacacagcaaagggcgactcaacagagactgaccccaggctgcctccatgtgccctgaatttacagggcacagtctgtagagaagcagagagagcaactggaaaataattttcctaacaagctcgggtgtggatggtatacagcgtctctccgtcttgcccacccaagacagaagcagagggagtgtggcgtgggtgctggcaatgctgaggcagcaccgcctgcctcttctccagggtttgccttctctctcctcagagcgaatgcattagtcgcagctgagctttatgcctggtggtcacttgtttatttcaaggaggctgtgtccatgccgccctccaggcacagggttccatgctttacgtgttcaggcatccaacacgtgtctgttgagtgcctgccacatgccagtgctgtcgtggattatggggaacgcagcaggggcagaggcaagcccctgcttcatggctcacaccccagcaataatgatggattgtcggatcagggctcatggtgttaacaggaggaataacagcttcaggggacagggagtgacagggaacaaggagggggtggcgtcttctgcgaggtcagtgaaggcccctgacgtggtggtgtttgagcagggcctgagtggagggagcgagcgcatgggttggcggcacctgggcatgtggaatgcactcctcgcatcgaggagcagaggcagctggtgtgattgtgggtgagtgcgagaggcagcaggggccatgcagagctttgcagggtgagatgaagactctgttttctctgagtgtgaggggaaggccctgaagaatcatgagcccagaagggtcaagagctgatgatccctgtttgagagaagccagttaggaggcgcctgcacccgtggaggtcagaggtgacggtgcttggccgaaggtgtggcagcagaggtgttgagaaatggtcaggtcctgggtctctctaagaaccatcaggttttgtgaattgattggacataggctgttagagaaagagaaaaatgagggtgcctgggcttggtctaatcagcagaaagcagagtttcattttctgagatggggccgacttgacaaaggggcttggaaggcagatcgaaagtttgattttggacattctgaatgtgacagccacatgctagggttgagtagccaggtggaatttaagtctggagttcaagggccacgtctgggctagagattgaattttgggagccacccttatttggttggtatctaagccacaaggatagatgtgactgcctagggagagcaagtagaatgagaagagaggcgacccaaggtcctgagctgcatctgccctgcagaggtccgggaggaaggggcaggcagaggaggctgaggggcgtcagcagtgaggaagggggacctggactagagaaggggccctgggggatggagaagatgggttttaaggatgaaggggtgattccacagctcaagcaggatgaggcctgagaatcgatcccagtccgttgaatgtttccttcttgacaggagcagtgctggggtcagtaggtgagagcccgggggaactgaagcagtcgtgaggggcacaggtgtggacagtgagttcaacgactcgctcaggagctttgtgtgaggggagagagacagggcagagcagctggagaggaaggtgggattacctttggggttttttttcaagaaggaaattacagcatgagtgtgcaccgacaggaatgatctagatagaacgaccagccatcctggtttacatgggacgcaggaactgccgttttaaagctgggctgagttggtcaccctggagccctggatccgatgaggagagagagggtgtgtctttcactttgctccctttttttcttttttttcttttttttttgagatggagtcttgctttggagtgcagtggtgcaatctcggctcactgcacctctgcctcccaggttcaagcgattcttctgcctcagtctccggagtagctgggattcactttgctccttataccaatgtctatgttgctttccatccacaatctacaaaaagccaaaacaggcctcccttccctctctccaagcccctgtccttcttgccatctgtagggggagtctctaggtccagtggccctcagcgcagatgcagagtgcttcttagacgctgcgggaaagccagcccctgcagcaccacacccagatgcacctgcagtttggaggattctggttggatgataaattccagctggcagtacatagcctcagtcccatctgtatgccctcccacagcctgcttgccactctgccagcctcttccttcacacagggatgctgctatagaaagggaggcagagagtcttaggacaagatgtcaggaatgaggcaggatcccccgttgcatctgccatttttttcctataggaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtctttaaaaaaaagaaaaagaaaagcacgctgcttgtaaaaagcgtacagtaggtcaggcgtggtggctcatgcctgtaatcctagcactttgagaggctgaggtgggtagatcacctgaggtcaggggtttgagaccagcctggccaacatggcgaaaccccacctctactaaaaatacaaaaattagccgggcgtggtagcgcatgcctgtaaccccagctactggggaggctgaggcaggagaatcgcttgaacctaggaggcggaggttgcagtgagccgagatggcgccactgcactccagcctgggcagcagagtgagactccatctcaaaaaaaaaaaaaaaaaaaaaagcatacagtaaataaaaaagcacaaaacagttttcacttattttacaattaaaaagtcagaagacttctgaagttacttatcttttaatacatgtatttaacaccatacttcatattattaaataggttttacttaaaaatataattattgtatttgtacctgtcagatataaatacttattcaggagttcacaggtacgaaaagatacacataaattttaggaacttttgagttatttctgtcatttttgcttttttctctttcttttcctaaattttatgtataagattacccctaaaaaaaaaaaaacagccagtattcagtgaattcaccagtaatttgaaatgcaccatattgtaaatgatccactgacagggaagccagcgtgttggagccatgccagccacctcagacaccgtggctctaagatgcggaagagtcactgcatcttcttgaatgttacagatttggtttgcctgaatgtgacttgacttctgttttgaaaaaacatacgaatagagttctattttccttatgtgatgctttcttctaacacactttaacacagaagcctaacctagctacaaagagcctatccacagacataggcaacagctccaaagggtatttcattgtgtcacctgcttctagatcatctgttagttaactgactttgtgcaaggtctcaccatgtatagcactgccttgcttgagcacggaagtttctgtcaacagcaagctttatgtgctctatcatttttattaaagtatttcagtcaatagtgacccattgtagaatggatgcaggattcacatgtgcaagtgctttgtgacctggcaccatttggttttggccaagcagcagagcagacctcaggacctaacgaggatggttgtgattaggtcaaatagaaaactagcaggccattgctgacaatttttactatataattagaggacttcctaaaatgctttaaaaaaaaatgtgtatggatggaaaatacaaaggaatttttcaaatactcaatt

SEQ ID NO: 873 - DNA, 1939 bp, Homo sapiens
gtgcaggccttggcttttattgagatcagagctgtgggctccccggcctctcagggaggcggtggcgggggggcctgattctgcactcagcccggcctcccaggtacaagtggctgactggagtctaagcaggctgcaagggcacggccatgcttctattgcttctgcccctccctcggaacctcctcctcctccctctccccatcacattctcccgaggcccaggcctgggcgctgggccgctgcctgggccaccccatgtggcagggccactgccgggggccgagcccctcctgctcaggctgcctcctcggccatcctgcccctcctgtacccagtcctggcactcgggatccctatggcctctccagggccccagagcgggttctcttgcacaagggacacatggcctcttcccaggtcccccaggacctcttgggcctgagcctagaaggactaggctgggggagggcacccttgtctgggtccatgctggaactggaagctgaggaaagaggagagaaaggagtcacttgagggacccaaggggaggctgggggggaggctggcagcccaccctggggtttccagaatccgatattcttgaaaacagaagggaggagggcaatgcttcctccttaacagaatccccaggggagggaggaggttgagggaacagaatggttcaagctggaaggaccctcatctaacctgaaccctcattttacaagtgagaaaactgaggcccagcaagggagacagattccaaggcccctcaccgagtgtggagctggggcagtcacccagccctccctcccagatcctccctttttctcgcaccgctttgtccctggtggattctccagaccccgcttagctgtgcgtgatgcagagatggggacagattcatcaagatcttggccttctggggcatggtgccactgtggaggcttgggagtggagaagggcccgcctgaggccccagcccaaccatcccctagggtcttcccccgtgcccagtcctgccttgacagagctcaccactgcttcccaggctgtccctgggcaatcgggcttccagaagggctgaacagaggctgttacgtgggcccagagtcccctgtggcaggtccagggcccaggctgtgccctcaggctgtggcaggcagcccccagccataagccggcccagccagtggctctcacactggccagtgggtggcgggtggctctccaggtagaggcccaggccccggaggtggcgcagccggaagttcttgggcttgcttccctgggcactggggcactgcggctgcggggaccccaggcccccctcgtagatgttggggggtgcgtcagggtggccggggcgtccttgggcctggctcactgcatctgcagaggagacagcgggagggtggtggccagccccccacagcagccatgaggggagggtgcagtcacatacctctgagaccagctcacatgatgggctacacccccagccaacctggcctcagtttacctgtgtgtcaaatagtctcagtccactgcctcccctgcccatgcccaagacacgactcctcttcccactcccaaccaacagggaggcctgggaagcctcgggccttggtactaagagtgctttcaggacctcaagtcctttctactaccctgttctgcccgctaccctaggaagagtattctggtccccacagagaaattgcacagtgggtttgagagaaagtggccagcccaggggctcatggcctggcccagtggccattcccctctcccaagcatacatgtccctgaggccacccctcggctttgggcccaggtggggacagaagcctatctctcttcctgccactcctccccacagcccggcaccttctcttatgtgcagctcagaaaatgcacagaccaaggcttccat

SEQ ID NO: 874 - DNA, 7382 bp, Homo sapiens
ataactttagcaagagccttcattttaatgaaaattgaatttaaacaaaagttgtgtatcttcttctggctcacagttgtacagtaactgagttcaaatcctgggttcattcactagtttagtgacacggattttgcatccctacttataaaatggaaatgatactgcctaaatcacggttgtgctgagaattaagtattacatgggaatgtgtgtaaagtgcttagcacattgcctgggacatatacagtaactgcttcccaccatacagatactgaaaagcccaatcactaataacaatttgttatatttactttacgtggtgttttttatgtgagttcgcttatgagtaatgagatgcaaattcgacttgaaagttttcccacacacggtacatttaaaaggttccgctagcatgtggctcttctggtggcatgcaagttctgagtccaaagcaaaactttcctcgcatgttttgcacttatggggcctttcctctgtatgaatgttctgatgggaaataagctcagagaaacaaggaaaggtcatgtcacagtcaggacactgtaagggcttgaattttgagaatgagaagaaattgtccccatcatcgctgcagcgttcagagtcctcgtcgtggctcttctcggaaagggcaggatataaggactgcctgaagctcttcatgcacttagtgtgctggtactgggggcctgatacgaatgtttcctcaggcaaagcaagatttggtttctcattaaaatgtttatcacagttagtagattcgtaggtgttttcagcactgtggcttttctgatgctgtgccaatcctgggagccacataaaacctctaccacatatgctacatgtatagggcttctcctttacgtggctattcatgtgtcgggatagatgagagtgctggcgaaagctggcactgcacttggcacacttataaggtttctcaccagtatggattctcctgtgtgtcctcaggttggctctatgattgaagatctttccacagtcaccacatttatgttttttctctcctgaatgaattttctgatgcaaaactaggtatgaatgatcgctgaagttttggtcacactcaggacatttgtacacatttttggctccttcccagggagaatcaagaatttcagaaagtgtgttggttcctaaatattcagagagttctactaatggggtgtggttttcaatggtaactaaaaggctgatgacccttctcttgtaagtgggagttccacttaatattttcgcttcagggtttccaactccatcctcagaggatttttctgggtaagggacaaggggtgcagcaatggggtacttttctaaggcaagctcgtcaagttccatagactctaggcttaactgctgattaatctcaggcttgccttcctctcctgttgataaaaacaaaagaaagcaaaacatagacaatatcttcaagggatactggggaaaaagtaagctaaggtagttacaaacaggaccaggaaaccttagaagggttattctataacccagacactaaccacacaaaatcaggaccaagcagactctcctggcctcccagaagatccagttttgggtgaatatccaaaggtaaggagagaatagctataactaagtcagagtccagtgggataggtactaaggacaatctcagtagcagctatctagaggtgaacttttccatctaatctatttaggcctcaagagcctttcatttttgaagctatctcaagtgacagcagaacaattaacaattggaaaaaagattaggattcatatttatcaacaaagagaggggttgggcagtgtctcacgtctgtaatctcagcactttgggaagctgaggtgggagcatcacttgaggctaggagtttgagaccagtctgggcaacacagtgagaccccatctgtacaaaaaataatttttaaaaattagccaggcatggtggcacatgcctatagtcctagatactcaggaggctgagacaggaggatcacttgagctcaggagtttgagatgtgccattgcactccagcctaggtgacagagccagaacttgtttcttaaaaaaaaaaaaaaaagatgacagcaagaatgagtgggaaagaaaataatttttaaaaagaggctgggcacggtggctcacacctgtgatcccagcactttgggaggccgaggcgggtggatcacgagatcaggagatcaagaccatcctggctaacacggtgaaaccccatctctactaaaaaaaaatacagaaaattagctgggcgtggtggcctgcgcctgtcgtcccagctactcgggaggctgaggcaggagaatggcgtgaacccaggaggcggagcttgcagtgagccgagatcgcgccactgcactccagcctgggcgacagagcaagactctgtctcaaaaaaaaataataataataattaaaaaagaaaaaagaaaaaaaagcaatcaagtgagcatttttcttccataacaaagaaacacacgggttatcagaaatagttttattatcaccaggagaactctccaaaatctctttactcctcactgaggaaagatcaaggtagaaggctgtgtgtactgcatgaaaataacagccaatctacttacaagaatggctgacaaaactaacattcctgtgtaatattttccaagtattcttcagttataaagcaaatatatcaatacaaaaggaacttttctttccagagaaacaaagttctacagttttcccaactcactgactagaaagggctgcagtatagttcatgggaatccaaacagtaccaagtggttttgctgatttgaggggactgagttcagagatcagggatgccaaggcagctagaatttgaaagcaaaacagcaaagaggcagctgttcagaaagagagctcaggtcatctacatggggtccccttaagactttcctgaggctaggtacagtggctcaaacctgtaatcccagcacattgggaggctgaggtgggagaattgcttgagccacggagctcgagaccagcctgggcaacatggcaaagccccatccctacaaaaaaaaaacaacaaaaaaagacaagcatggtagtgcatgcctgtagtcccagctacttgggaggctgaggtgggaggactgcttgagcctgggaggtcagggctgcagtgagccgtgattgtgccactgcactccagcctgggtgacagatcaagatactgtatcaaaaaaaaaataaccccacaactttggctgagtagtaatctacaagtgcatgaagaaactacccaatgccgtggaaagaaccacctaaaaggaataacagagcaataaccagttcatgttgcctccagccaaagtggaaagacataagacattgagcagcaacgtccacagaaaaaaactgccttagcagtaactcaaataagtcctagcagaaaggttgatctgaacctatcctaacaaagcaaaaaaaaaaagcacaccttgaaacagtcaaactgactccaagtaacttaactgcctcccacaacaaagtccaaaatatttttaaaaatacaacgaaatcccgggtccaacaacataaaattcttaatctaacatccgaccaaaatttacccaggaagtaaagaaaatatagaaaatataacccataactagaagacaaatcaatcaatagaaacagacccagaaatgacatcaatgttaaaactagcaagaaaaaaaagtttaaataaccattataaatatactccatacatttacgcagacagaagacaacatgaacatgatgaagagagaagtggaagaaacaaaatatgagttattcagaataactagttactctagttatttttttctgactaggattgagtatctcaactattccaaactatttagaataactacttagaatagatagtttagatactcaatcctagtcagaaataaaatctagtcaggcacaggagtccatctgtgtatggttccccttaggtgagtaaggcatagcaccccttaagagtaaatcaatctccagtctttagcaaatgatagtgatcgatactaatgggatttcccaagtaaaattgtaaactgcaacaaatgtttgtgaaagattaccaaatactgccatctcttgtactaaaccacaggcactgtactagactgaatttttgtctttaagagatcatctcggccgggctcagtggctcatgcctgtaatcccagcactttgggaggccgaggcgggtgatcacaaggtcaggagattgagaccatcctggctaacacggtgaaaccctgtctctactaaaaatacaaaaaattagctgggcatggtggcaggcggctgtagtcccagctactcgggaggctgaggcaggagaatggcgtgaacctgggaggcgcggtttgcagtgagcagagatcgtgccactgcactccagcctgggcaacagagcgagagtctgtctcaaaaaaaaaaaatcatctcatattttaaaactttttctctcacacaattatcacctccacataaattactgagggacaggtcccactccaccataccaacatctggataaagcatgaagttctcctcctagaattgacaaaagttccagatgcaggaaaaacaattgccttacccatcaaagccgcatcctccaaagactcttttgtaccatctttgctgagggacctctgggcagggtgcagagtcacgcactcctcttgagaaaaatacacagccagatcctcaaagagtattggtccctgaaacacaagagcctgtgtcagcacaagagggtggagggtcagcccctcacttaacctaggaaggatgaaaagagctagaaacatcagatgcacgggataaaaggctcggtgtaaaaggttcttgagcgcagaagtagggcaaatgggttctaaggggtggggtgagggttgggaagaagagagtaaacatggacatacatttttaggcagtggtacaaggacggtggactgtgagaattattgtctatcttgaaagagaaaagatgagggaatggctcttagggaggcaaccattaagtgaggatgctctaagaaaaggagaggtttggggccgggtgtggtggctcatgcctgtaatcccaacactttgggagtctgagggggatgcagatgacttgaggtcaggtgttcgagaccagcctggccaatatggtgaaaccctgtctctactaaaattacaaaaattaaggctgggcacagtggctcacgcctgtaaccccagcactttggaaggtggaggcgagtggatcacctgaggtcaggagttcaagaccagcctgaccaacatggtgaaattctgtctgcactaaatacaaaaaattagccaggtgtggtggcgcatgcctataatcccagctacttgggaggctgaggcaggagaatcatttgaacctaggagaaagaggttgcagtaagccgagattgcaccattgcactccagcctgggcaacaagagtaaaactccgtctcaagcagagcttgcagtgagctgagatcgtgccactgcactccagcctgggcaacagagcgacactccatctcaaaaacaaaaacaaaaacaaaacaacaacaaaaaaaactctgtctcaaaaaataaattaaaataaaatgaaattagccagatgtggtggcatgcgcctgtagtcccagctacttgggaggctgggccaggagaatcgtttgaatccaggaggcagagattgcagtgagccgagatcgcgccattgcactccagcctaggcgtcgcagcgagactgtctcaaaaaaaaaaaaaaaaagaaaagaaaaggagaaagttgggcagcccaggaagaatcataaagagataaaggttacaggattctcccaacatccttccctttgctatttcctctcgtccccatgacactcattgctaagctcactccagcacttcatccaggcctaccccaccttctctaacggtgtgataaattaatcacttgggatttattattactcaacgagtgtggagtctagaaatgtgcttaatttaaaaattcattcaaattggagaagtaccaaatctgtaattttgggaaccattccagaaagtcacttttaatcctagcactttggggagccgaggtgggaggatagctgaaggccaggagttccttggcaaagcagcaagactccatctccataaagaagttttaggccgggcgcagtggctcacacctgtaattccagcactttgggagaccgaggcgggcggatcacaaggtcaggagattgagaccatcctggctaacacggtgaaaccccgtctctactaaaaatacaaaaaattagcagggcgtggcggcaggcgcctgtagtcccatctactcgggaggctgaggcaggagaatggcatgaacccgggaggcggagcttgcagtgagccgagatcgcgccactgcactccagcctgggcgacagagcgagactctgtatcaaaaaaaaaaaaaaaagaacttttaaaagtagccagacactgtggtatgcgcgcctctcagatactcgagaggctgaggcgtaaggattccctgagttccagacggagctatgatatcagcactgcactccagccagacaagcaacactccagcgacaaggccagaccctatctccaaacaaaacaaaacaaacagataagacattgagaaactctctcagagattcctccacaggtccctgctcccagttggtagttctgaaagaaggaagttggtaaaccattatgtgtgtggtcttggaacgaagaacacttggtcaaagggctatttggggctcaggagcactcctaccacaacaggcatgcccaactctcctccaaaggagggggtcaggcagagaccgaaagcagcaataaacttggacgaaaaaggtacctcgactcacctgggcctcgggcgtcgggggcatggacgccatttggcgggtggggaatgccttcttcaagacgccacagggacttcgtgacaaagctgcggggggagagaacagttcttaaagggaccaattccgctgccaagttcctccactacccctagcctccctcgattccctccgaacccccccttaaaaacctacgccgactgctcctcctcttggcccggcctcgaaaggggcccacttaccgctccgcggttaataacaggcctcgcgctccctgacaggagctgcagaaagcgacgcccgaccgagacgcgacgaagaacgccacggccactgcaaaactcccacgctctcatgctcctttacgcaggag

SEQ ID NO: 875 - DNA, 43297 bp, Homo sapiens
taagcaaccatttccgcttccgctggcggggtctcctccgtgagctccgggcctgtttgcctgctgaagtagagtcttagggtgaccccagggggacgtaatgtttccgagaagaaggacagaaagaagactgggagacaccggaactcgaaagaaaatcggtaacaaaatgtgggttcggccaacagtgccctgtaggcctgaaatttcggtctggccagagcaaggtgattgagagggcgggggttcgggcctagcctgggcttgagctgtcctttgtgtcttgagcggatggtggggccgtggaacatgaaggagtatctttgtgtacgttcacaacgttcacatcggtgtaggccaggttgctggactctgactcaaagtgttatagaggcattacgtattgtacccgcagctgcagcctaagcgagctgcttcagcttcctagtcacaggatcccacgcgagaatagagccataggttagcgtcgcaggacgttgttcgcccccggatacctcacatgcagcctaccctagagccagtcatttcctattgtgtgctgggggaggagggagtgccctggtgtaggcatttggaattggaaaattgagctcctccccaagctctgccactgattggttggtaatcttggccagtttacaactttgctttcctcagctgcaaacagctcagagtgcctctctgggctaactcagagggtaatttcaaagattataagataatgtaagtgaaagaaattgccagtttataaaggtgtttggggaaaaaaaaagacgaaaatgataggtaccttgatagaaaagcctgaaaagtctcaacatatttccttattccagtgccaggcacattcctgtatctaaaagcttaatgaatggctgcatggttattaaaacaatattaggagatttgacaacttaggtaatgtgattttgtggaatatctgataggatagtttcagctacaagtaacagaaaacccaccgaaaggatgttcaaagagcagttacaggttggttaattcggtggcccagtgacaacatcaaggtcccagtgcttctctgccaccctaagcatgttggtaacgttgacaatagaatccaggtaaaatatacagacatgtattgtgtcatgtacccatcctaaactagttattaccaagaataaataattgtttggggcccatcatgcttcagcccctgtcactaggggaaggacctagcctcccttgataatctacctgcacaaaattagggctttgttacaaatgaaaaaaagagatgtggaaaataagttagataagaaactagcagtatctgccacaaatgatatctcttgacagctaactaagagctagaccttgtggggatggatcacaaaagaggtagctgtgaagtcccagtaaaggtgcttccaggacaggtggaagaatggtaagaacaaacttgcctacaggctagaccagtccaaagcatatatgttgaagaagagctaatagcctgtatatgaaggtgtaagtaaaggagatgttcatggttgagtcactgtggtgttcacgtagtcatctttcccttcttggtttgtgcttatctcttttttttttttttttttgagacagtctcactctgtagccagactggggtgcagtggcacaatcctgactcactgcaacctctgcctccggggttcaaatgattctcctgcctaagcctcctgagtagctgggactacaggtgcccgccaccacgtccggctaattttttttttttgtatttttagtagagatggggtttcatcatgttggccaggatggtctcgatctcgtgacctcatgatccacctcggcttcccaaagtgctgggattacaagcgtgagccaccgcgccccgcctatttaatgctattcttacatcagcactgtctcattgtggtctgagattctccttatctggatttgtggctctttcaccaagaacaagagactcccgtggctctcttctttaaatcctgttgccataattacaaagaaataaacacagtttccaatgctttgaaatgaagcatgtggtattaactcagtggattaccagagagagagggatatacctgaaatgggagaggaaaaaatcttccctagactatctttcctaagagccatcaaaactataaacaagtggacaaagaaggaggaagcttgaaagctttatcttcctgaaaataaagagatgacatacaaagtccaagatagaccaagattgaaaaattagaccacattatatccctaactcaattttgtaaaaaatcacaaatgcttgactgtatacccactatatgttcaagtaacatgttttaatcatcaaaatttaaaaatccttccacgacaatcttttgcaagtttttccatttctgtctttaacatggtaccagtaataacaactacaacctgtttgtattgaaattatttctatagcccagcatctgctttctctgaaaattatctttttaaaaatagtaaaactaacatcattacaaaagtagtatatgtgcatttcagaaagttaggaaaggctgggtgcggtggctcacgcctgtaatcccagcattttgtgaggctgaggtgggcagatcacaaggtcaggagatcgagaccatcctggctaacacgatgaaaccccatctatactaaaaatacaaaaaattagccaggcgtggtagcgggcacctgtagtcccagctactcgggaggctgaggcaggagaatggcgtgaacctgggaggcggagcttgcagtgagccgagatcacaccactgcactccagcctgggtgacagagtgagactctgtctgaaaaaaaaaaaaaaaagaaaatacaggggaaaaaatggcaacacattcctgtcacccagagatcaccactatttactctttattatttgtttttttttttttgagacagtctcactgttgcccaggctggagagcagtggtgcgatctctgctcactgcaacttccgcctcctgggttcaagtgattcttgtgcctcagctaccagagtagatgagatgatgggcagatgccaccacaaccatttaatttttgtatttttagtagagatgcagttttgccatgttggccaggctggtctcaaactcctggcctcaagtgatccgcccatgtcagcctcccaaagtgctgggattacaggtatgagccaccgcacctggcctgctcactgcaacctccatctcccaggttcaagcaattcttctggctcagcctcccgagtagctgggactataggtgcgtaccaccacacctggcgaatttttgtatttttagtagaggacgggttttccccatattggccaggctggtctcgaactcctgaccttgtgatctgcccgccttggcctcccaaagtgctgggattacaggcgtgagcccctgcccccggcccctattcttaagtatatatcttttccctagtgatttttatgatgatgcagctgtatattgaaacggaaagatactcatttttgggagtaaaattggttatgaaacaaaaacaataacaaagttgcttttgaagactatgcgttaaaatggtagtggtagttatatttttaatttttatgggtacatagtaggtgtatatatttatgtggtacatgaaatattttgatgcaggcatgcaatgtgtaatcacttcaaggtaaatggggtatcttccctggcgatgtttaacatgatttccagaatgaattgctcactacgtttggtgtgttttccattcccagatggtactgccttttaaggtctattacttaaacataagtatggctctggttcttaccgcctttaccgtatccttcatgggaagttgatactgatcggaaactgacacagagccttctcacctacactaagggggcctaggtaagcaagattatctttctcccaacttcagcaagaggttttcttactggtgttcagaatgcttgattgagcagttagaaaactgttgctacctagtctccagtcttataaggggacaatggctgcaagtcatgcctgcaagaacaagaggctcacacagttttgaaattagcacaacttctagctggataggagtctttttagtttcatttagccttgagttgaaactaataggagtcttttaattagaaaaaagctcagggctctaaacgtaccttcaacatgttaattctgttaccaaaaactggcttggtctgtgttaactcccaacagaattctttttcagtcactgaggcagaggtgcttccagagaaagattcttgacctactcatactgaataattatcgttactagaagctgcaaccaaagactcctggagggtagtaagaggtacagagaatgcaggttagatacagtgaggacagagaagaaaggatgggttggaggctgggcgtggtcactcacacctataattccagctactttagaggctgaagcaagagaatcacttgagtccaggagttcgaggctgcagtgagctagcattgtgccactgcactccagcttggatgacagagcaagaccttgtctcaaaaaaaaaaaaaaaaaaaacatgggttgctttgtagtttagagaactacatgtttagatagttaatttttccccaaaagggcccatcagattgatactctgagatccagggtttgtctgacactcattagcctatgagttgtagagatgggatggccaggagtgaagtgatggccttgtgtctttctcccctgcagcatacagaaaggctgtacctggaggaaggaagtgcggagccagcctgagttgggagaagagctccagagagtgagtcaaagcgctctgtgtcctgctattaatgatgccctcatagtcagaggaagcctacttaagtgaaatccatttttgacctgtcaagtattaaatattctcttaatttttagtactgaatgatagaaggcgcctagtgaaacaaatgctttcacttttttgctaggagggtaaatgagtatattcttacgttaggtacacagggatacagtacaagtatgccagcctctttaaactataaagaagtaaacaagatttggtttaagcatcagtctcttgtgagtctgatgggtaagcccagtctcagggcacactgacaatgttagtggagaacgagactctcccagtgtgctgccctgaccctctgagattggtctgtgtagccacgtggtggtcatcctgtgccacctctggtttggttctaatcaaaggaagcagtatcatctgtggtgatccgtcttacacacttgcatcattttataccaaaggagaatttcttttgttaaaaatttatttttcattatctactcataaagaaggagccaaagggctgggcgcagtggctcacgcctgtaatcccagcactttaggaggtgaggcgggtagatctctggaggtcaggagttcgagaccagcctgcccaacatgttgaaaccccatctctactaaaaaatacaaaaatgtagccgggtgtgctgggcgtggtggctcacgtctgtaatcccagcactttgggaggccaaggcaggtggatcatgaggtcaggagatcgagaccatcctggctaacacggtgaaaccccatctttactaaaaatacaaaaaattagctgggcgtggtggtgggcacctgtagtcccagctacttgggaggctgaggcaggagaatggtgtgaacctgggaggtgacagttgcagtgagccgagatcacaccactgtactccagactgggcgacagagcaagactctgtctcagaaaaaaaaagaaaaatttagccaggcatggtggcgcccaactgtagtcccagctactcgggaggctaaggaagaagaattgcttgaactcaggaaatggaggttgcagtgagctgagatcgcaccactgcactccagcctgggtgacagagcgagaccccatctgatatggtttggctgtgtccccacccaaatctcatctgcaattcccatatattatgggagggacccagtaggaggtaattgaatcgtggggcaggtctttcccatgctgttctcatgatagtgaataagtctcacgagatctaatggtttttaaaaaggggagtttccctgcacaagccctcttttgtctgccaccatgtgagacatgccttttaccttccaccgtaattgtgaggcctccccagccacgtggaactgtaagtccattaaacctcttttttttgtaaattgcgcagtctcaggtatgtctttatcagcagtgtgaaaacagactaatacatcgtctcaaaaaaagagaaaagaagaagaaggaactaaagaagaatttctttggaagcaaaatatttggaagcaaaatatttggctcctgactgaaagggttttgatccatgcatacattaataaacccttcagaaccatgagttgggataattcactgtcccttgtgctagtctcatggagcttttctgctcttctgggagtgctcctggggtggtctggaggcctctcaggcagagcagaggctggtcagcaagccacagggcttgccatgaagtggtttgttcatgatttgtttctgggaccctgggaaaaatgttctcagggtctgcctaggaaggctggttttggaagcttgtggatttctttctgggtgagtcaggaaagttgtgctcctgctgggcgcagtggctcatgcctgtaatcccagcactttgggaggctgaggcaggcggatcacaaggtcaggagatcgagaccatcctggctaacatggtgaaaccccatctctactaaaaatacaaaaaattagccgagcgtggtggtgggcacctgtggtcccagctactcgggaggctgaggcaggagaatggtgtgaacccgggaggcggagtttgcagtgagccgagatcgtgccactgcactccagcctgggcgacagagtgagactccgtctcaaaaaaaaaaaaaaaaaaaaaaaaagaaagttgtgatccaagggaaagcatacaggttttaatgatgaactagtttgttcctttgtctcctggctttcattcttcatggcatgtgctcagggcagccagtggagagaggcatcattctgcatggtatagaagccttgggtgggtgtttcatcatctgtaaaatgaggacaacaatactgaactttcaaggccattgtaaattagaatgtacagtacaagcattgtaagttagaagtcaattagaacatgcaggagggattataactcagtgtttagcgtatagcagacacttagtaaataatgcatttactctgttccattctagaagctccattgttgtttgtacaacaaacacctctgttgcagtgcttatcagattgtcttgtaatcacgtaactcctcaaaggcaggatgtgtgtaataacacatttccttggtcaccatttgtacccagaatggggaaggaagaaatgaaaagaatccagtatctaagcccagcctccatttcacttgcacgccttttatttatgaaaatatagtacttgtccatgtaaataatatctctgaatggataccaggaaaatggtaagatgagttagctggagaacttgggtactgagttggagggagggtaacttatttttcaccaatgtatccttttgttttgctttaaaataatttaccacaggcatgcattacttctaaaaataaaaatgtttactgtcagaaaactcccccaagttaaaccaaaaccaaaatatgttagatacatctgtaacactcattataaaagatgacatataaatgcctcaaaaatagaaaaggtgatcaaacttactgagaaatgtgcattaaaacaatgagacctttttcagttagattgcagaaaggtaaagaataatacctggccaggtgtggtggctcacacctgtaatcctaacactttgggaggccaaggtgggtggatcacctaagctcaggagttggagaccagcctgggcaacatgacaaaacctcgtctctacaaaaaatgcaaaaactagtgaggcttggtggtaggcgcctgtactcccagctactcgggaggctaaggcagcggaatcacttgagcccaggaggcagaaattgcagtgagctgagaccacacgactgcattccagcctgggggacagagcaagaccctgtctcaaaaaaaaaaatgagcatggtggctcacaccagtaatcccagaatcccagcactttgggaggtaaggtggtcagatcacttgcaccaggagttcgagaccagcctgggcaatatagtgagactctgcctctacaaaaaataaaaaattagccaggtatggtggcgcatgcctgtactcccagctactggggagggtgaggtgggaggatcacttgagaccaggaggttgacgctgcagtaagccgtgatcacgccactttactccaacttggatgacagagtgagaccttgtctcaaaaaaattaaaaaagactaattccctatgttggtgaggctgcgggccatttgccctgctgtagtgggtgtagagtcttcacactcttggtatgagaataaattggtaaaactttctggcaggcaatctagggtttgtttccaaagttaaatgtggttaattaaaactaattttacttatgcctgtaatcctagcactttgggaggctgaggtgggcagattgcctgagctcaggcattcaagaccagcctgggcaacatggcgaaactctatctctactaaaaatacaaaaaattaaccgggcatggtggcaggtgcctgtagtcccagctactcaggaagctgaggcacgagaatcacttgagcccaggaggcagaagttgcagtgagccaaagattgtgtcacactccagccggaggggcagagcaagaccccgtctcaaaaaaaaaaaaagaatgcttggttgagcatggtggctcacaccagtaatcccagcactttgggaggtaaggtggtcagctcacttgcaccaggagttcgagaccagcctgggcaacatagtgagactctgtctctacaaaaaaatgaaaaattagccgggtgtggtggtacgtgcctgtagtcccagctactggggaggctgaggtgggaggatcacttgagaccaggaggtcgacactgcagtaagccgtgatcatgccactgcactccaacttgggtgacagagtgagaccttgtctcaaaaaaattaaaaaagactaatcccctatgttggtgaggctgcgggccgtttgccctgctatagtgggtgtagagtcttcacactcttggtatgagaataaattggtaaaactttctggcaggcaatctagggtttgtttccaaagttaaatgtggttaattaaaaataattttactcacgcctgtaatcctagcactttgggaggctgaggcaggcagattgcctgagctcaggagttcaggaccagcctgggcaacatggtgaaaccctgtctctactaaaaatacaaaaaattagctgggcatggtggcatgcacctgtagtcccatctactcaggaggctggggcaagagaatcgcttgaacctgggaggtgtaggctgcattgagccaagatccactgcactccagcctgggcaacagagtgagactctgtctccaataatgaaatcatgaaaaaaaatttttttttttgagacagagtttcgctctcgtccaggctggagtgcaatggcatgatctcagctcaccacaacctctgccttccaggttcaagcgattcttctgccttagcctctcaagtagctgggattacaggcacgcaccaccacgcctggctaattttgtatttttagtagagatggggtttctccatgttggtcaggctggtctcgaactcccaacctcaggtgatctgcctgcctcagcctccgaaagtgctgggattacaggtgtgagccactgcacccagctaataataataatttgaaccaacattctaggcattttccctaaggaaataatcagaacgtatgcagatttgtgtacaagattgtaagttgcaatattgtttttgacctgaatgtgtaggtttcagtggggaaacctgatccccagtccctgctctcctcccaccccaaccccatccatctactacctttcccaaatagagcttgcgtagggccattggtgtccaggatccagagcagggcatgggtttgtgggaggtggtggttggaatcacctggggttggatactggacttagttcctctatgggtaaatgagagcctggggattgtcggaaagaggcctagggtgaaaattaaaatgacttaatttcaggagcagtcttggccttggagattcatgggacttaagagaggaagggcagaggctgaccgtgtagatggtagcttgttgctctacctgggccagagaagcctgcttgcctccctatctccaaggctgaaagagggttgtgcagctgaagatacaggaatttaggatacaggcaagtgccatgacctggcagcttggtatgtcgctacactgcaggagcctgctggcttcccaccactgggagtgccgttaggtgtctgtgctagacccatggccagagggtgaaaggaggcatgagtaaataggcaagagaaaagcgataatatgctggaagaggccttagagccagagggagaaggagcagacagactctcataaataaggagttctggtgaaacagaatttctgcgagagattcaattatagcaaaactttatggaaccaaaaagcttaaaaaaaaatcagaagtttaatagataaactgaaggagagaatggtcagcacaaactgagtagcctgttagatcaagtggaagaaacactcaaacacagcaaaaaaagagagagagaaaggaaccatgaaagcaaagaggtggaggaccaatcagccctgaagtcgatggtgatcaacccattcctgaaccatccctgtgaccggcagatgtccctctgcttgacttgcttaggcaggggtcctctgaactcatcacagagccaagggagaatgggatgaccttaatgggttaaaccagttagggaacacactggaacaaggggtagagtctgtgccacaaacacaaagagaaagggtggaagtttttttagtgtacaaataaccttgaatatctcctgtagtgacacatggtgcctaaccgaatgaaccgttgtgaagataaatgagatcttgcataacatgtttaacacaatgcctcacacataagccgtggagaaatagttattttctcatttgtgttttaaaggagtatttttttcttttttgagactgtcactttgttgcccaggctggagtgcaatggtgcgatctcggctcgctgcaacctcggcctcccgggttcaagccattctcatgtctcagactcccgaatagctgggattacaggcatgtaccaccatgctcagcaaatttttttttgttgttgtatttttagtagagatggggtttcaccatgttggccaggctggtctgctggtctcgaacctcttgacctcaagtgatccacccgcgtcagcctcccaaagtgctgggattacaggcatgagccaccgggcatagccaaaaaagagtttttagttttttttttttttttttttttgagacggagtctcgctctgtctgtcacccaggctggagtgcagtggcgcgatctcagctcactgcaagctccacctcctgggttcacgccattctcctgcctcagcctcccaagtagctgggactacaggcacctgccaccacgcccggctaatttttctgtatttttagtagagacggggtttcaccgtgttagccaggatgctcttgatctcctgacctcgtgatccgcctgccttggcctcccaaagtgctgggattacaggcgtgagccactgcacccggcccaagttttgggtttttttgttttgttttgttttgagaaggagtcttgctctgtcccagactggagtacagtggcgcgatctcggctcactgcaacctccacgtcctgagttcaagcgattctcccacctcagccttttagtagctgggattacaggcacgcaccactatgcccagctaatttttgtatttttagtagcgacggggtttcaccatgttggccaggatggtctcgatatcttgacctcatggttcacccgacttgacctcccaaagtgctgggattacaggcatgagccaccgcgccctgcccaaaaaaagagtaaagtttgaagggatgtacatgctgttctgtttgccagttcatcttaacggtgctgtatttagaaccctggaaacagccgggcacggtctcaaaacaaacacacaccccgtggaaacaatagaatgttgttactctgttgttacttagggagtgttttttcaaactgtactgtgcttgttactcacatgggggtcttgttgaatgcagattctgaattaagtgcccattctgactcagtccaactgagtcctgaggttctgcatttttagcaagctcccaggtgatgccgctgctcctggaccgcagactgcactgagtagcaggcacctgagttttgcctgtttttatgattgattgggctccccacggcatccatcttctagccagtgggaaaggggagaggaagtacagagcgagcaatttcctttttttttttaaccccatcttttattttgaaaatttcaaacctcctcaatttttgaaagaataatgcgcttcaccagttgttaacaatttagcaatattcttttaagcacatgacacagaagttgccaacattgtgctctctcttgttcactggtgaaacttttggcacatagcctgatcctgctgcaggagaggctgagaaataaaagcctagcttgacagtgatctgcctgctgaagggggtgggattctgttactactagatgatgataaagcagttattttttaaaaggagaagatggcagagtaggacaatggatactaggggacagtttgacacgcagactcaaatctttttttttttagatggagttttgcttttgtcgcgcaggctggagtgcagtggcgcaatctcggctcactgcagcctccacctccagggttcaaacgattctcctgcctcagcctcccaggtaggtgggattatgggcacatgccaccacgcctggctaatttttttgtatttttagtagagacagggtttcatcatgttggccaggctggtctggaactcctgacctcaggtgatccacccacctcggcctccggaagtgctagaattataggcgtgagccaccacacccagccaagactcgaatcttataaccagttctcttcaaattggattctggaaagctcggagttgaaatatacagcccaggttggtcgtggtggctcacgtcagtaatcccagtattttaagaggcccaggcgggcagatcacttgaggccaggggttcaagaccagcctgggcaacataatgacattcccatccctacaaaaaaacaaaaaacccaaaaaacctgttttttaattagccaggcatggtggttcacacctgtagtctcggctacttgggagactgaggcggaggccaggagttggaggctgcagtgagccgagattgcgccccaggctgggagacagagaccctgtctcaacaacaaaaacttcgcgttagatcttgcattatagaacccctacaaccggagggcagcttaagttgcctgttttactcagggacagccctaaactgcctttcgccagaatcggacggctgagaatccagtgtcgtcgcggggtggtgctgccagctggctccgggtggtcggccaggagccagccttgtgcacctgctttcagttgttggccagccccggcgctgcaggccctcgcgagcttaggatgcgcctgccagggcctgtgcgggggggccactcggtagagccgcgggacctcggcccggaaaccgcgccaccggcgtccgcacacgctaggccggggagcccagaggtctggccggccatgtctcggcgacctcccggagcgagggacagggaaggagccggccctcaccagtgccccgcatacgggatcctgggcctggcttcgcacggagcctgcccgctcccaacctgcccgctcccaacatggcggcagcgccggcctcagggggcggggccacgtgggggcggcggccaatgggcttccgggctgcgctgccggcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgaggtggcggggggcggccgccggggctcggacctgcggcggggcgccgagggggcggggtaggcggggaggccgcgccggggtcaggggggccagcgcccaccgggtacgagcgcgctggtgaggcaggcccggccgcgcccgcgcccccggcgcacggtcctcccgggagccggtttcggggacggcggcggggagtgggcgctggccagggacgagggttgaggaggtcgcggctctcatgctgggtgggagtcgggccttctgcctgggggttgcgtcagtgtccgaccccgcgatgagtggtcgggacaatttgcaactagagggtggtcctcatgggtaccctgtggggtgtcgcgcgaggtgaagggccaggccatttccgtcgggtcagcgatttccgccttcgccccgctctcgcctggcctggtcagggcctgttttggtacttgttgcgccgattggagtcatctgcgacttgtttgccctcctctgaactcctgaaagccaggggctccgtctaggtctcctcctagtcttattctcccagctttcgttgttaagacaaattccttacgttcctggccctttacagaccggccctacagaacccacacccccagctccgactttcttctccagattgggtacttcccagggagtaaagggaatctgtagcttttgtggtttgtcctgctgggaaaatttgggggtaagtggtgggccttctctggacgaccacccacaaatctgtgtgcccaaacggagacaggacccagggtctggacatcaggcaaggggtactctgcagtaaacgtggacattggccgtttcgtgggtttgttttcactctgccaagtccttgaggcgtacacttttgtgtcactcatttatcttgaaagaaaaggttaacagcccaacagagtagttcgctttggtatctggagtggtaatcagagtgccagaactggagagaacattgccgtgtacagatgtttgccttttaccagggcactgaaggcataaaacccttagttaatgcttaactgagtgaaccatgaaagtcatgtgactccaaaggtcgactctagaaatgcggcagtccatgtagcactgtgatgtagaaattctatgatatatgggtcagtgttcacaggcagggagagggggagtcttcaacatctttgaattaaaaagcatctggggcaaaaacaaataaatacacacatatcagtgaactgctttaagttcagttagagaaggtgagattaaagaccagaagaaactcgagggagactgctgtataagtcccagttatctttccaaacagacaggttcatcacagcagtgaaggctagtcttcatctcccttcttgtgggattttctacattaatgtgcagatctgcccttggagaatggggcgtgcatgattgggctgtggtttgctggagtttcatcttactgaagttgcagacactgtgggtttctgtgacaatggtttacactgaaagtagcaaagtcaaggcatggtctggtatcagcatgccagaataaaacacacagacagctttttaaaaggtctgtgtccgtcctatctttagcctctcctggttgtaacttgaagtgactttgttgccgtgtttgttttgaccaggccgggacagtatggagagtatctttagatgtgacttatctgggttgcttagcaacagcatgcttcagattagaatggaagaaagttcctggatgtgaggagatttgaatgataaaagatacttacacctaaaaggagaccaggagggattgtgccctgttcttgctaactgggtgctcgtaactggagacggggtgtacctgttagcggtggttagacgaggtggatacagaatccagaatggtcacattgcagccatagggaacagatagatgcagagaagaggcttcagccctctgagttagggcagtgcatggccttgctctgctgaaatagcccagaggtcccatttgcttggtgacatctctcacttgaatagaaagctggctgtttatcagacactgttttcttaaatggcagctcctccacatctgcgtcatctccattatctcccctatccatctctttttggaaggaatccacgaagccctcatgactgtttgtttgtttttgtttttttgttgtcgttgttgttttttggagataggttctcactctgtcgcccaggctagaatgcagtggcgtaatctcggctcaccgcaacctccacctcccaaactcaagtgattctcctgcttcagcctcctgagtagctgggattacagtcatgtgccaccatgcctagctaatttttttgtatttttggtggagacggggttttgccatgttggccaggctggtcttgaactcctgacctcaagtgatccgccgcctcagcctcccaaagttctgggattacaggcgtgagccattgcatccagcccgccctcatggcttttacacctcttttcctggtttgcagaaagcaaggctggggtgtggaccctgcatcgaagctggttctgcttatgtccatgtgaagtgctttcaagtaaaatgctgatctgcaaaaagatgctgaaagtcctttgtctctttctggctaagttcaaatgccgaatttgattcagcaaatagttgtgagtgccttgaagtgcaaagaatgatccaggatcaggactccttccctacatatcattattttgatatgtatgtatgtatatatgtttagtgacggagtcttgctgtatcacccgggctggtctcaaattcctggcctcaagccatcctccaacctcagcctcctcagtcgttggggttacaggagtgagtttgccaggctctatatcattctttttagcatgacctctgataggaggctggcaggacagttcaggacttatcagaagcccaaatatcttacactgctgattaaagagagacctgtgtttgaaaaccaaacgggcatataataggattaacattctgctatgaacactaaggcatttgcgtagtgcttgtgggagtgataggaagggggtctgaaccgggggagccagggctttctgcaggaagtggtttggggtccttgtcaacagtgaatgctgcttaatggagccagagtgcccccctgcggaggtgggcagagaggtgccagtcaccccaaggtgccacagctctaagctgagatggtcagatagagggaagcaaacaagggccactccctagtcccaccttgtcagcagctcagacgggattccccatctctatctcagccagggagaagccatcgcgagaactggctatgagtgcgacagcttagagatgttgcaatgtctcttcaagttaggagtgaaattattatccattttgccccaaaatggactcttaaacccccatacacttggaatagcatgtattttgtgctttgaagccagaaataaacattctaaacaaagatttaaagttgcaatgaagaggaggtggttgtggacagacatgcagaacaaatgtttgagaaatgttccctttgcttccacagaaaaacaaaagaaaggcattttctcgtgtttgacaaaccatgttaaaaaaatattcttggccaggcacaggggcccagcactttgggaggccaagtgggcagatcgcttgagctcacaagttcgagagcggcctgggcaacatagcaaaactccatctctaaaaaaatacagaaattagccaggcatggtggtgcgcatctgtcatcccagctacttgggaaactgaggtgggaggatggcttgagcccaggaggtggaggttgcagtaagttgagatggtgccactgcattccagccggagtgatagagccagaccttatatcaaaaaaaaaaaaaaaaaaacctttcagtgctattttttgtggtatagttactgttattaaaaagcaaatggcatttctctttttttgtttactgtattcctgaaatagggtcgatttggccagcaaagtattgacactggggcccatcttgaaaacaactaactattgaagaaaataatttcattttataaaatagtagttgggtaattctcccttaggtaccaaaaagggctcttttctggaaaatgttaatgcaacaatatttccctcattcctttggtgttcatgggtgttctattgaatgctgttccattcttatttctttctagaagatagctcattctgactcctgctgtaaactgttcagagattattctttccagagtctgttacattcagaatgtcttgctagtctgtcacttgctgcccttctctttctacttagtttcagattactttgcatctcctctggcctcccgtttttaaccttttcattgatgtatacacacagaaaagtgcactgcttgatgagttgacatggcatgaacataacctgtacatccccaacgccagaagacccatgggcccccttaccaggcaagccctcttctattaagaaaagcgtttttcttgttgtaagcacaagaaaccactaatagtaattatactagggatggggcgcatacaggattcggaatttttgctttgtgttgcacatgaattcttactttactatgaacatgggttgctttgacaaatttaaaacaaaggcctgaaaggactccccttactcaagaaaaggaaaatgccttttttaaatgtttttttgaaatggttgtcttaaaatttctaaatattttttaaaattagattttatatagccacgcaaattgttctttaatggttatgtaggaatacaggctgcttggcctcccttgtccacagcctcctctttgtttctttgcgactttgactctgtgtttagaacatttatttccgggatgagtgcacaaaacaccatgctactccaaggcacagagtttcagagtcagcgctgagtctattttagagcaaaatgggtaacactactcataatttgaaaacacactattaaatacccaagctgttgctaactaaaagcagcctgtgaggttattttaatataaaaatgcaagctgaggccgggcccggtggctcatgcctataatcctagcactttgggaggccgaggtaggtggatcacttgagctctggagttagagaccagcctggccaacatggtgaaaccccgtctctacaaaaaaaaaacaaaaattacctgagtgtagtaacttaatgtctgtactgtcagctacttgcggaggctgaggcaggaggattacttgagcccaggaggtggaggttgcagtgagccaagatcgtgccactgcactccagcctgagtgacagagtgagaccctgtgttaaaaaaaaaaaaaaaaaaaaaatgcaagctggcgcggatgcagtggctgagacctgtaatcccagctacttgggaggctgaggtatgaggatcctttgagtccaggagttggagaccagcctggacaacatagggagacccagtctctacttaaaaaaaaaaaaaaaattcaacctagacttggtggcttgtgcctgtaatcctagctatttgggaggctgaggttgagggatcccttgaaccctaaagttcgagaccagcttgggcaacatagtgagatcctgtctcttagagaaagaaatctatgtgtgtgttcgtcattttgacatacaacatcttcacttttttctgacaatgaaaacaacccaaggttattgcaaaaaaaagatccagtaatacagaaacaagtgatacagaatggaaccgtctgctgcaattgctggggcagattcaggcagaaatttggattacttttattttattttattttattttattttgagacagagtctcactctgttgcccaggctggagtgtagtgatgaagtctcggctcactgcaccctccgcctcctgggttcaaacgattctcctgcctcagcctcccaagtagctgggattacagccaccatgcctggctaatttttgcatttttagtagagatggggtttccccatgttggaactcctgacctcaagtgatctgcctgcctcggcctcccaaagtgctgggattacaggtgtgagccaccacgcccagctagatttatatttgatagttatttgattccagaggatcttaagtgcaaacccagagaagcagagagtaaaaagcaaaaaggcaacaaaacccagcagatggtgagggaaagggaagaagccagggaggggcaagtggggacaggaagtgctctgaaacccgaccctctcttgctgggctttctccttttaaactgaggagctgctgtgtccatctcgcccgctgcttcctaggcggtacagagggtttcctgtagccttaagttttctctccgagaacagacagattcttggttgagccttaaacagggtccagtcttgggtgttagtcaagaatgctgttcaagtaaatacgttttactatcatttgactcccatgtgcccccaaacctggtattatttacaggtagttttgttgttgttttgtttttaaaccaaacaggttgacccattcactcaatctgagttaggaaatatattccaggcacaacctatcaggcggttgcctgcaagatcccagctgaaagcatcgctgggacaaaggtgatgctttggcagccaccctgttggctccgtccagcccacacctcagttgtctcaagctgctctttcagtgggaatgtgagatctggtagcagaggctcatttcaccccaattttctatttcagaaaaaggggccgggtgcagtggctcaagcctgtaatctcagtactttgggagtctgaggcgggtggatcatgaggtcaggagattgagaccatcctggctaacagggtgaaaccccgtctctactaaaaatacaaaaagttagccgaatgtggtggcgggcgcctgtagccccagctactcgggaggctgagacaggagaatggcgtgaacccgggaggcggagcttgcagtgagccgaaattttgccactgcactccagcctgggcgacagagcgagactctgtctcaaaaaaaaaaaaaaaaagaaaagaaaaaaggaaactcatccgaagcaagagaggcagccacggggtcccatcttggcagcacatcttctggtccccggtttagcgttctgtccttctcttgggtcatgttcttgtctctgttcttcctcatcccttcttcgtccttgtcatcgccacttctgacactgactgagtggggccacaaaaggtgagtcgtccttccggctgcccccaccacaatccagccctggctcaagagcagggaaggtgctgtcccccaggctgcagacgggggttagtacagcaacctcagacagcttcctctctggggggaccctgcgtgtcttgggtgcagtttcgaggaggatgcagagggatggatccctgccttcttctgtgtgacccctgcggtgggggagcatccctgctcagcccaggggatggcacttttcatgtttgccgtgagattcctctagcaaaagcagtgggttttgtgagtacttaggtaatggtgccagaaagcaccatgacaccctggtatgtccgccccatataatcagagaatctgactctgctcactgctgagaccccgatacccagggtagggcctgaattttcaatgcaattgcgataaattaatgactaaatggattctcagtttgaaatgtaaggcgtgacagaacgttcaacccagggaagattgagtcaggacccgggaccttgccggaacacctgtggccgttgctgctgttaactgaggtgtaattaacatgcagccaagtgcacagcttcacccagcagatccgtacgttttgacaactgtgaaacaagacgtagcacatcgccatcgcgcttctcagctccgccttcaccactctgggtgccagcaccggcaatttgtttggccagttccagagtgtcataaaaacagaatcctccattgtcactcctctgtccttgaagagatatgcatcgagttgtatgcggccactctgcgggctcccctcggcacatgatggtcttcagagagaggctgtttggaaatagagtggtgggtgtttgcttcttgtcacccggcaaatgattcatttttctgctgctctgacactttggaagaagccagggatgctgaggagatggcttgctctcacgtgggcagctgctcctttgagaaacaagccatgcgcagtgttagctgctgacatcctccacttttagcccttgagcccatttcactgatgagcaagacagtggcctgtatctgtcactaacgtgcttttctttttctcccctgttccccaaagacaggagtgtggagttcatgagtgttggatttttcaagctagtaaaccttgcagctgcaagtggtgtttaattcttgtggtatggatgagcacatgctaatctcccttgagcttctcttgagcagaagcctggtgtgctaacgggcaggactggggtggtgctttgagaggaagagggggaaggtggcccgagagggagatctactgagatgtgagctgcctggagtttggggtggggattcctggaggggctctggattttgcagagggacagctgttggtgcaccttcaccagtgtgctgggacagaaagtggggtgagtgggtgagtgaggaataagtgtttgaagggcaggagtaaagcagaaaggtggcagcaggtgttgagctgcaagtggttccattgcctggaaaggaggtggcagggaggcctgcccaagatgggtgcctgcagggtgcggacagcctgtcagaggtgcggaaagcctgacattgaaaatgtcagacagtgggtgcttgggccagagagaaagagcctgaggagctggaccaggggttggggggcggcctttagaagcagcgtctcatgcagccttcccagcgatcctgaggtaggtgggagaatcttcaggccacggctgagaagctgaagcgtgtggcgggagatccgtctcagaacacctgagatccctgcagggtctgggagcatgttaggggctcagagtgcaggtagggactggcagggaggagctgtgggcgggaagagagagaagggagggcagggcagtgtggccatggccagctgaacactgggagtctgctcctgaggtcatggatggaggccaggacacctctcaagccattaagagggtggcctttccaagcgcagcatgacttgttggtcttgaagcagtgccttcgaaggaggaggagtcccccgtggacttggggcattaggacagggactgccaaggagagagggcactaggaaacagggttgtttttggcttttttacctggggtgcaagtggagcaccctgtgggcatcatgagggtgtcaggaaacccttctggtaactgaaacgcagtccattctgtgtcccccagattctgagttttcagcacctgacagtggcgggggatggcagacacacctgtgggtgctggagacatcttggcggcccttcctccagtttggcatcatagtcccctgtgggctgagcacatggggctcctggacagttgttaccgatggagggtatccaggttcttgacatcttgaacaaagaattggacaaaacggcacaaacaaagcaagaaaaagatgaagcaacaaaagcagatttattgaaaacgaaagtacactccatagggtgggagcaggccctggttacagaattttctggggtttaaataccctctagaggtttcccattggttatttggtgcatgccctatgtaaatgaaagtgacctgcgatcagtctgattggttgaggaaagcagccaaccagaggctgaagtgaagttacaaagttacatcctatgcaaatatctgattcattgtggaaagcaaccaatcagaggctgaagtgaaattacaaagttgcactcctatataaatgaagacttggccggagaccagcttgattggttgcaggaggggaccaatcagaggtactttcagttcttgatctgcttggtagaaaagcaggtcggtgtgaagggagtagcctctggttcttttgttacttggggatggaaagttggggttttcctttggatttagttctaagaagtcagcatgaattggccttaggttccctgcctccagaccctattctcctgcctcacagtgatgttgatcagggggctcagcttggctctgccagttcagacaccagccccttccagctactgccagtccttggaggaaagcagtcttggtaccgtgtccggagaggtcatttccatgtaaaagaaatatgaggtctacaggcagctcaggagcacggagttgggggaagcagagaaggtgtgagtgccgaggcgcaagcacggcttttgtttgggtcaagcaggatcagtgcctccctccttgcatcgctccacctccggaaggcggagaactgcgatgcagacccaggaggccagccaggagagatttctcaccccaggctcgagcctttgaagctccaggttctaacttaaaaattcaagggagtggccgggctcggtagctcatgcctgtaatcccagcactttgggaggccaaggcaggtggatcacgaggttagggatcgagaccatcctggccaacattggcctgacaaggccaacaaccttgtctctactacaaatacaaaaattacctggttgtggtggcacatgcctgtaatcccagctacttaggaggctgcggcgtgagaatcgcttgaactcgggaggcagaagttgcagtgagccaagatcttgccactgcactccagcctgggcaacagagccagacaacatctcaaaaaaaaaaaaaaaaattcaagagagtttcgcattctcccgtgcaatacttccctgcttgttgtagtagagatgcgtcctgtgcctttttaggaacatgttctgaaagatggcttgggcaactgtgactttagtgctctatccccccagcactgccctggtacccatcctgtttagagggctcagagcagagagcacctgcctggcagggcccgtctctgactttgccttgctgctcctcccagcactgccctggtacccgtcctgtttagagggctcagagcagagagcacctgcctggcagggcctgtctctgactttgccttgctgctccccccagcactgccctggtacccatcctgtttggagggctcagagcagagagcacctgcctggcggggcctgtctctgactttgccttgctgctccgcacagcactgccctggtacccatcctgtttggagggctcagagcagagagcacctgcctggtggggcctgtctctgactttgccttgctgctccgcactgcactgccctggtacccgtcctgtttggagggctcagagcagagagcacctgcctggcggggcctgtctctgactttgccttgctgctccctgttatcagcactcttgtccctgtgtcctccgggtggcctgcagggcaatggaagatgagtacttagtagaaggttctaggtgggcacatgagggttccttgccagcaccagggctttgttcacacaggtgttgcatgaagccatccagccaagagccagggctccatgcctctgagccctcaggcactgcatcatgctgggcctcagctccatacctgccgcgtgtctgtctcaccatcactgtgctcaaggaaggtcgccaccagatgctcctctgtgcgccgggcctgctggggctgccctggggcctggaaagtgctttaagcaggtcctttgtctcgtgtcaggggatgggctccaaagttagtggttggaactaactttgccatctgctggagggctttgcccctgccatgccttgagcccacacatactccaggggtgactgacacagttggttttgcatcagaattggccattgccacctctgaggggctgggaaatgggtgaccctgccccacagtgcctgcactgcccccagcagacaatgctgggggagcagcttcccaccaggcctggcttggggcttctccagggaagcccaggtacacctcccagcctgtaggtgaaggtgcctggaatggaactcgctattcccagaggcacagagctcccgtcacagcggctgggtgacagcagtaattctcgcagatgttcaggccctgggaccccagaagtgaaatgacccagggcgtcagcaggaaaggaggccccactttttcaggacctctccctccaaccagctccacgtccttcccaaagctgggcccagcgtggccctcatagccagctccgtctctctctccttgggcctgctgtgactgcaggcacggatacactggggagacgggatgtagaaagctgtgggaagagggagcaacggcagggcaggggccagtggggttggggggggccgctggccctgcctttggatcatctccgacttgatcagcatgaacccctgactctagagggaggctgatgggccagggcacatgtgggtccccctcactgcctccgcagcagtggacctacagccatgctctttgaccccatctcttcctttcatgggcacacaggtgacccgagtctctgtttcgtgcaccttcctgcctcttctctgcccctcagttgggctgagacacatgaggtgctgtgatgcatgctgcatttggccctgacttaggtgtgacgcgtttccatttttaaatcgagtgtaaagaactggcctccagaaacacggaagcacttttagtagggatttgaaaatccgcagatcgttgtgtatctcagagcccagtgtttttcttgaaattcacactggaaacaaatgaggatactgggggaaatgtgcagtcccaggacatgagagatgcgagcttattacgaatctgtctttggtaccaagccacaatatagagatttgtgaaaatctttaaaaatcaacttgactgggccgggcgcggtgctcacacctgtaatcccagcgctttgggagggcaaggcaggcggatcatgaggtcaggagatcgagaccatcctggctaacaaggtgaaaccccatctctactaaaaataccaaaaaaattagccaggtgtggtagcaggcccctgtggtctcagctactcgggaggctgaggcaggagaatggcgtgaacccgggaggcggagcttgcagtgaaccgagatcgcgccagtgcactccagccttggggggcagagcaagactccatctcaaaaaataataataataaaaagatctggaacgttttcgtcccctcaggaagtcatccctgccccaggcatccacggaggtcaaggccttgccaaccccacttcctgggtccagctctcaggtggttctccctgtggcctccagacccgggctgtaccggctggtttcgcaggttgcctgtgctcatcctgccctctccggtgagagctgagccggtggtgtttttttcagagccagctggccctgcaggagctcagaaacctgggcggctgggcctatgggctctggagttctgcccagggtggccaggtgggcagcctttcccccgtgctggttcctgtagcaaggaggaggccgtgtgctggggcccttgtgtcaggagctgtctctggaaaggctgaatcgaggaaccagcctctgccttgtccgtcgatgttgtggggttagtggctttgtcccagagtttcaaagtgtgggtaagtggtttctgggtttgccagttttcttagcccttaggggaaagggggtgggagcctgccctcagctggcttcgtaaaaacacagtatctgtgcttgagttacacgcccggcgtccttttgcgttttgagacctcagtggagtgtgcgggccctgagtagtatgcacccactgacagtgaaccagatgctgcccccctgcggttccagtgtatgtcagtgccagccacgtgcccaggacccaccgttcccagggatacaagatcccgtggcccatggtggcagctgcggcacacagcgctgctttccagagctctcagtgcggacaacagaggccttgcattcagtcacctggaaaacccaccatccacattggaaacccagtctctccggaatgagaaatttggttggttttctttagctttttgtttttttgtttgttttgtttattttttgagacagaatctcactctatcgcccacgctggagtgcagtggcacaatcttggctcactgcaaccttggctcactgcaacctctgccgcccaagttcaagcaattctgttgcctcagcctcctaagtaactgggattacaggtgcctgccactgcgcccagctaatttttttgtatttttagtagagacagggtttcaccatcttggccaggctggtcttgaactcctgacctcatgatcggcctgccttggcctcccaaagtgctgggattacaggcatgagccaccgctcctggccctggttggttttaattaagaacattttcaaacatccacgtggcatacccgttatccagatctaacgcccattaatattttgccacttttttgctccaactaaattaaactaaattctggaacattctgtcattttgcccctgcatattccactgtgcatctgttaatataaaatatggactttttgtacataaccacaagactcttctcacacctgacaagattaacaccttcatctgttcttttagaggttttgttcctttgtgtgttctttgtcatctgttttgttttgttttgttttgtttcgtttcatttcgtttttgagtcagaatctcaccacgtcacccaggctggaatgcaatgacaccatctcagctcactgcaacctctgccacccgggttcaagcgattcttgaacctcagcctcctgagtggctgggatgacaggcacaccaccacgcctggctaatgtttgtatttttagtagagatggggtgtgttagtccattttcatgctgctgataaagacacaccagagactgggtaatttataaaggaaccaggtttaatggactcacggttgtacatggctggggaggcctcacaatcatggcagaaggcaaaagtcacgtcttacatggtggcaggcaagagagaatgagagccaagcaaaaagggaaaccccttataaaaccatcaggtctcgtgggacttattcactaccacaagaacagtatgggcgaaactgctcccatgactcagttatctcccaccaggtccctcccagaacatgtgggaattttgggagctacaattcaagatgagatttggggagggacagagccaaaccatatcatagtgtttcaccatgttggtcaggctggtctcaaactcctgacctcaagcagtccacctgcctggacctcccaaagtgctaggattacaggtgcgagccaccatgcttggccccagctttttgttgttgttgttgttgttgttgttgttgttgttgttgttttttgagatggagtcttgcactgttgcccagcctggagtgcagtggtgcgatcttggctcactgcaacctctgcttcttgggttcaagtgattcttccacctcagcctcctgagtagccgggattataggcacctgccatcatgcctggctaatttttatatttttgtagagacagggttttatcatgttggccaggctggtcttgaactactgacctcaggtgatccaccagccttggccttccaaagtgctcatattacaggcatgagccaccattcccggcctatttttaaagggtctggagtcaacagtgcatggatccagaaccgtgggaacaaaggggtgggcacaagggcggggtggggggtgtgagtttagagaggcttctccctataaagctgagcatgaactacttggcacacctgacgttgaaccaggagctgagaaccacacaagttaggagtcagagcagagctgctcaggacgtcagtgctggccctgtcccaggtcaaggggataccccgggaagtggctggactgagccaagtatcagctagtagtgggtgctcaaggctggtgtagaggggcaccgcctccctgccagcactgtcctgacacttggaccccatcagctcgttccagcagagaaccaccctggggaggggcctagctatctccactccgcagagaaggctccaggaatctgattaactaaggctgagccagcagagagaccagattcagcgtctaaattcctccccttgtcaggaaagggaaggttgtgcagaaacctggacagtggacgccgcgggcacttcccacccatggcagcaggagggcgggagctcagagaggctgggctcgccctgccagtggagtggggactgccagataaaagacgaggtctttcctgggcagtgagtgagtcctgggggcccaggggcttgcctccacaccttgcacctgcccccagcagctttcagctgcggatttcacggcctttcctgattgttgtttgactccgtcatttctgttggtgattccaaaatggtgactttctaattcagtcattatttctacttttattagctggcattcttctgtaaagaactttcctcaacgctgagatgaactacgcagttcctcctaaaaaaggaggatgaatgcagcatcttttcccatttatttatgggtttgtttatttatttatttttagagacagggtcttgctatgttgcccaggctgatctcaaactcctgggttcaggcgatcctcccacctcagccttccaaagtgctgggattacaggcatgagccaccacacccagccttccatcctttccttttttttttttttgagatggagtctcactctgttgcccaggctggagtgcagtggcgcagtcttggctcactgcagcctccacctcccgggttcaagcgattctcctgcctcagcctccacagtaactgggattacagttgcccgccaccaagcctggttaatttttgtattttttgtagagacagggttttgccatgttggccaggctggtcctgaactcctgacctcaggcagtccacccaccttggcctcgcaaagtgctgggattacaggcgtgagccatcacaccaggccccatcctttccttttaacgactaatttccaacttaaagaaccaaggcttctgttttccccttctcggtgcccagcacttggccggccagccttcctccctccattcctctcttcctttctatacaaacttccttgttaaataaaacaggggggctgctcctcccgcccctggattggatgcactttcctgatttaaaggagtccttggccactcgtgaccccgacttgaactgtggtgtcccccaaagtctctttctttccgcccaggagtgttcacttgctgggcggggaggagaaattggggtgtgacccactcagcacaaacccacgccctggtcataaagccgcaccatttcccctgcaaatccagccgttcactgccccggccaccgggctgctttgaagggggatgaggcatgggggctgctgaacccacaactgtcactggcagccactggctggagttgagagaagtcaggctggctggggccgttgaccctcggaaggaccactgtcataagatgtgagaccagtcaggggcagctcagatggggagagaggctggccagggcttccttcagctggggctgagcagtggagggcctggttccccatcctgcctgccctcctgggcctgggtcttcccagcgatgggggcgactgcagcgcctcttgggagggcgatcgtgagaggcagaggcctctgagtgctggctgaggggtgtccacccgtgggacatgctccgtgctcttctgtctcgcctgcctcacaagctgagcatgaggaagaccaggctgtgaggtgacgcgtcccccccacccttccccacaggtgtgaatgacagaggtggtgccatccagcgcgctcagcgaggtcagcctgcgcctcctctgccacgatgacatagacactgtgaagcacctgtgtggcgactggttccccatcgagtaagtggagcggattgcagggttggggagagcccgtgagcctcaggtgcagaagctgggcggcgggggtgggggcctcttgggcccttaggaccgtgctgcaaagatgggaatggcctggaggggccacaggggtcccaggttacccacctcatctagggacccctgctgctgggctctttccacctctcagggtgtgcagagttccccagaagggctctgtgagaaatttcagttacagagctatcgggtgtggtgctatttataattcagaaaatttagaagccactcaagtatcttcacagcaaggagttggttacatgcattagagtaattagagtatgtgcatataaaagtgcaatattattcagccgggaaaaaaaaacctgtcaaagagttatattttttgatagagaaatcttttttacaagatattaaaggagcctgtaatcccagcagtttgggaggccaaggagggcagatcacctgaggtcaggagttcaagaccagcctgaccaacatggagaaaccccgtctctactaaaaatacaaaattagccaggtgtggtggtgcgtgcctgtaatcctagctacttgggagactgaggcaggagaatcacttgaacccaggcggtggaggttgcggtgagccgagattgcgccattgcactccagcctgggcaacaagagcgatattccgtttcaaaaaaaagaaagaaagatattaaaggaaaaaagtcagtctagaaaatagtatgtaccacgatcctatttttatttgaaaacatgtacaagataaaattttataatgataggtatgaactgagcgggggtgaaaaaaattttacaagggggtatgtaccatttaacagtgtttcagtatttgaggtgggtagattaatattaggccctatgattgtttcttcttgtctgtcttgcctacaatatatgcacatacagcttttttgatgaaaaaagttgacacaaactttgaaaatggaaaataaacaagatcttgccagccaccagcatttccttgagtgttcacctcagactgactgaacctcatgctcttggcagggcggtggcagggacccctgtgcgtctttgtggaagcgggaactgtcacagtccaggtgatgtgggctggcggtggcaacatgagttaaaaaactgttcttggctgggcgcagtggctcacgcctgtaatcccagcactttgggaggccaaggtgggtggatcacctgaggtcaggagttcgagaccagcctggccaacatggtgaaacctcatctctattaaaaatacaaaaattgggccgggcgcagtggctcacgcctgtaatcccagcactttgggaggccaaggcaggcctgaggtcaggagttcgagaccagcctggccaacatggtgaaacctcatctctattaaaaatacaaaaattgggccgggcgcagtggctcacgcctgtaatcccagcactttgggaggccgaggcgggtggatcacgaagtcaggagttcaagaccagcctgtccaaggtggtgaaaccccgtctctactaaaaatacaaaaaaattatctgggcatggtgcaggcacctgtaatcccagctactcgggaggctgaggcaggagaatcgcttgaacccaggtggcagaagttgcagtgagccaagattgtggcactgcaccccaacctgagcgacagtgagactctgtctcaaaataataataataataataataataaataggcctggtggcacgcacctgtaaccccagctactcgggaggctgaggcaggagaatcacttgaacccgcgagtcagaggttgcagtgagctgagatcacaacactgaactccagtctgggtgacagagtgagactccatctcaaaataaaaataaaaacgtgttcttcagcccagcaatttaactgctggaaactaatctagagaaataaaagctgcagtgagtgcatagatcagactctgcccagggttgcctgagagccagtggagccacgctggaccgtgggccttggccatgtgagccacccagcctgcctgtctctcctgcagttctcgtgggcctaaggtctcaggttcccaagactgtgacatgaaccgggctgtgaggcagcaaaactaaccctacacaccctagaaactccatgtgcctctgtcctcctgaccttgtctctctggggctggggctggattcgcctgttaatgaccatgtcctgggcctttatgcccactgttttttttgcctgctccgctcagaggggtcttggcctcattgttgatgagcagccgttagcagcctcagcctcacattccccttaagggcgggttcctccctgtcagggaaggcattgtaaactcaaacgcctgtcagctgtgaacctggctcttcctggaatcactccactcccctagtcttcagtgtccagaagtctcacagattctcgtaggcactcctccagtgtccaagggtgagaagggccctaaaatcttcactcacctggtggaggaacagggccctgctgctgactctccatgagttgcttccatggagacagtttcatgtcggataaaattatttttcccgggccaggcgcggtggctcacacctgtaatcccagtactttgggaggccaagacgggcagatcacatgaggtcaggagtttgagaccagcctgaccaacatggagaaaccccatctctacttaaaaaaaaatacaaaattagccgggcgtggtggcacatacctgtaatcccagctactcgggagaccgaagcaggagaatcgattgaacccaggaggcaacggttgcagtgagccgagatcacgccattgcactccagcctgggcaacaagagcaaaactccgtctcaaaagaaaaaaattcccatcagagatccccagtcctgtctagacagatcactgctttaagaaggtggctgtgacagttaggtagagacttaagtgatgggcacactcctcggcagccttagagcagcaggcagaagtggcccagagctccctgtggttctgatgtctagagcacgaccatagttggacttgacctgtggcaggttcacctgagtatgttctgtttctcaggtacccagactcatggtatcgtgatatcacatccaacaagaagttcttttcccttgctgcaacctacagaggtgccattgtgggaatgatagtagctgaaattaagaacaggaccaaaatacataaagaggtacgtacgtgtgtgcagtgaggacttggcagtcactgtcattggacgggccaagggggcttgcgatggaatcatgctgcctgctccacagccgtcgtccaaggagcctgtgacccaaggaatccaagtggccaacgacacttgtccctggctggtgcttttctgtgtgtgtgtgtgtgtgatttcatggtgcgtgggcctccagtcgtgcccagcagcaggcttcataaccactgtcgttctgaagcaggcatgagcgcagatgatgcattgagaatctgcagttacaacgtgctatgaaaatacccctgatttgtgttggcggcagtgtcatagaaaccgctaagactgcttcagcttgttgaaggaaatgctagttacagttagaggtcagggaaagtacagagataattttttttcctctaacttcacagagccctttaagatctaagaaccctttgggcatccgtggacccacctcagtctcacttcaggctagcaaaccccagtctgaatgtaaacagtaagaccatggccatattgttccaaatggttgagtttagtcaagattctgtgtgatgatgttggtcatcccagcatctgaggtaatgtttaccacccgaggatttagccaaggagggaaaaacccaccaacaactggcagatggttcaatttgtttggcttgaggttatttctttaaaagttagagaaggggccgggcgcagtggctcatgcctgtaatctcagcactttgggaggccgaggcgggcagatcatctgaggtcaggagttcaagaccagcctggccaacatggtgaaaccccatctctactaaaaatacaaaaattagccgggcgtggtggcaggcgcctataatcccagctatttgggaggctgaggcaggagaatcgcttgaacccacgaggcagaggttgcagtgagccgagatcgtgccattgcactccagcccgagggacaaaagcaagacttcgtctaaaaaaaaaaaaaaagaagaagaagaaaagttagagaaggcctgggcacagtggctcacacctataaccccggcattttgggcagatcacgaggtcaggagttcgagaccagcctggccaacatcgtgaaaccttgtctctactaaaagtaaaaaataaattagccaggcatgatggcgcttgcctttaatcccagctactcaggaggctgaggcacaagaatcacttgaacccaggaggcagtggaggttgcagtgagcggagattgcacttttgcactccagcctgggtgacagagtgagactctgtctataaataagtaaataaaagtgcaagaaggcctgtctctccctttaaggacccgaatccactggcatctaccctgttttgcctgtggtcatactctgtctggcacagcttttttctcctgagtcactttttctgccctagcttcctcctgagcttttttctttgatttttaagagctaagatgtagcagaaagcaagtgtcaacattcttttctctcctcttttttttttattgaaacggagtctcactatcacccagggtggagtgcagtgatgcgatcctgatcccggctcactgcaacctccgcctctcaagtaggattttagacgtgcgccaccacaccaagctaatttttgtatttttagtggagatggggtttcaccatgttggccatgctgatctggaatccctggcctcaagtgatccgcctgcctcgcgggagtgctaggattacaggtgtgagccaccgtgcccagcctgatctctcttgttaatgggacacgtggtcccccccttcccccaatgactcattcccctgaaccccatccccctccgggtggctttcctgagtgccccctggtgactgtgtgcctgcccccaggtggcggctgggtctcttcctcctctggaatgtgtttgtgttccctcgaggccgacatggggaccctttggctcatgttcccggctctcagtagagggccctctggcctgcacgctggcactcattcatctggccccttcctctcaggcttagtgagttcaaggtcagggcaaagtagaccctgttaagagatgtcagctggggaacagacacccttcctgcaggcctggagtaacaagagtgataaggacgccttcctccctggactgacatatctgggtgaactgtggcttgaagagggctgggagagcagggagcctggacaggctgaccccagcccagcacgtgggagcagaaaggccttcttgttctttacgagttggaagatgataagagcctcatgctgatcagattcatgactcccacccggaattccatctctagaaccaagagatggtgggtggctttacgcaggtgtggcggtgtcctctgcctgtgggggcagcagaaggggttggacggccgcccaagtctcactcctccaagatcacctggggcagcgtgcgattctttaactgaacctctaaaactttgcatttgtccactgtcctgcatccaggcctaccaggtgacatgcgtgcattcccatgaggcccgcgtggtgctgtgtagttgctgccttcatgccataactttaccttgtgctggcatcagagcctcattcccgtccttggctaggcctcccacacacccctaggagaagctccttttgtgtgtgttcttcttttcagctgtttttcaccagaagggcataaacgctctcatttccttggggagtgggggcccctctccagtacctcttgattctgcccctcccagtcggtgtccctctggctgtcgtgggaagtcggtgcggagcccgcctgggccgggctgtgcagtgagccgtgcaccagacgtgtgagcctgactttctctctgactcttcctctaggatggagatattctagcatccaacttctctgttgacacacaagtcgcgtacatcctaagtctgggcgtcgtgaaagagttcaggaagcacggcataggtaagggcagccgggcccgcggcttggcgcccaccccacccccttgccctaccccacccccatcccatctgcacccagtctcttccctggccccaacaactctggctcgtgaacatccctcagtctcatcttccatcctcgttcccgtcttgggccagaccttcatcatccctcccctgccagcacacccaccaccttcagccatcctctttccacatgcccccaggcctttctgctgcagcctcgctcagcccccaggatggagctgaggaaactggcacctctcacttctgctgccgccacacgcacaactcgtgtattcactgctcacgattcagagtagaaagcgtgaacacgcacgaggaagcaacactcaccgtttctccgatgtcccaccccactcggccacacggccagtgagcggcagagtcttaattaattttaaacccaggcccatctagtccatgttttcctgggctcacatttaccctgtttgttgtctgaaagggagtctccatgcgggcccagcccatgggagggcgctaccaggccacctctgcagtccctcccagcagtctgtagctaccaggctccatctggccatgagattttagggactttgacagtggtggtgaagaaaggctggtctctgatacggtgggccgagacatctccgagagactcatgcaaagcccccatcctagcccagtcatccttccttcctaactgctctgcctgcattacctttacctcttctccccaaggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttatatccttaacttctgggggagagggactgtggcttcctgtccataaggtggcagagccagtgagcaagttggagctgtggtccccctcagatgatgttcaggtggccaagcttatggatgcttctctcccttacctgatcgtgttgtgggtaaacctgacacacatttgggtaaatcgagttgcacatattaccatgttgcccaggctggtctcgaactcctaagctcaaatgatccgcctgccgcagcctcccaaattactgggattataggcatgagccctgcacccagctggagagcctcctgctccacttgcactggggatcagcagtgcacaaaacggacaggatcccctgtcctcccagagcctgtgctagcagaggggaaacaagtgcggagagaagagatttttactttttttgaatacttgggttcaaaccttccttataggatgcatgacccaaaggtatgcccttccctgcttcttcctccttaactttcactggcccctgacaggtcagagggaagccaggaaactttataatagtcagaatgtggcccaaaaaaatgctgtgcgtgtgtgtgtgtgttttcaaattcatgagtctaggatttattcattacatagaataataagcaggaaagagaggggtgaccccacactccacaggccgtctagcttatgtgaagacaggcatccagggggtcagcactgttgaccccctccttgtcatatggacagggctctgtccctcttgctgccacaaaggttgagaatctagggagaaccagaagcacctgcccttctgccaggccccttccccaccccccgtgcatccctgggtgtggtgtccacatgcctgctgcctcactcagaaggcccttctgtccccagaccccaccctctgttgttttgcacagcagaggccacttcgtctcatgagcctttccagctctgcagaggcttagcgggctctcagcctccgaagcctggcttgccatctgcacacagtcccacaggccactgcgcgggcccctgatgactgtgccctggcgagcgtggtcagggcaagtcggaatcttccttaacagagccccacggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggtatgggagcttggtgcctccagccacaaaagtggaaggccctggatgggcacagagaacggcagagccggaaggggccgtggggactgcagagtccaccaccttatgcaccagcacagcccagaggtttggtgacttgtgccaagctaacacagcaggctccatggcaactgggctgtgcacccgactttggatccatcagtgcctttatttgtgtggggaccgagaggcgcctagtggctgcaggcagacaccatggcctggagaagggctcatgctcctggagcacccaggcccagctgtgtggcccataggcagggtgtggggtgggcagagtgtctccgccgggccttcaccctgccctgctcttctctttcccacaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattggagttcgtcaca

SEQ ID NO: 876 - DNA, 5158 bp, Homo sapiens
tacgtgcagggctgtccttggagggccagcacagccccttccaagtgggcaagacccaggggtggctcaaaagatagctgtgccctagccctggaacctctgaatgttgatttttgtagcaaaaaaggacttgcagatgtgagtaaaggctgttgagataaggacatcctccctgctctctgggaggaccccaaatgcaggtgcacagatcttaagaagaagaggcagagactggggtgatgcagccacaactaaggaaagccaaggattgctggcagcctgcagaaactggagggcaaggagcatcccccaaccgcccggagcctccaggaggcgcaaggtcctactgactccctgacttcagacgtccagtctccggaattttgagaggatccatttctgttattttaagcaaccaaacttgtggtagtttcaccagtctcaggaaatgaatacgaatggaaagtcaaagattccaagaaatgagtggcggggtgcggtggctcacacttgtaatcccagcatttgcgggaagattgcttgggctcaggacttggagaccttgtgtctgtgagaaacttaaaaaataggctgggtgcgatggctcacgcctgtaatcccagcactttgggaggccgaggcaggcggatcacaaggtcacgagtttgagaccagtgtgaccaacatggtgaaaccctgtctctactaaaaatacaaaaattagccgggtgtggtggtgcgtgcctgtaatcccagctactcgggaggctgaggcagaagaattgcttgaacccaggaagcagaggttgcagtgagccgagatagtattactgcactccaggctgggcagcagagcaagattccgcctcaaaaaaaaaaaaaaaaaaaaaaaaaaaaaaaaaaactgagcatggtagcatgcacctgtggtcctggctacgccggaggattgcctgaagccaggagttcaagaccagtctggacaaaagagcaagaccccatctctaccaaaaaaatttaaaaattagccaggcatggtgccgtacccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctggccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcaactttggatgtggctttggcctctttgtccaaagtgaccttggggcccccagacaagagacagggagactggagcccagccccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggtgagcaccaggtggagtgcctctgggtgactggccggtttggagcagggagggaggcttagagtctcatcctccagcagcgagtgaggcggaggctccagcgtccctcccgggcgggttttctggtggatggaggagtgactcggggtcctctacgtggtgccagctgtttggctttctggacgttgtaggaaagggtttcccccgcctgcgtccccctgaccttgagctccaccagcccctgccagctgggctccagaaggctggagtgctgtggcagggatgacgtctcacttctgttatgtctctgtgccctgtgctctcccaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcaggtgaggccagggcagcctccccccaaaagcagaggagctctggagtctagggctggtgggcagggccagccctatggagccacagggtgtcgggtgtggggtactgagcaccactgctcccagcacggtggaacaggctcttggctgtggaccaaggtcctcatccctgctgtgctgtccctggctggcagcaggagcccaggcagaaacatgaggctgcggttaaaccgagcaatgccacgagcatcagctgtggctccctttgtggcgctgtagggtccctgggtggcaccagccctgctcagcaccactgtggccctgcccccagatcctgagccgctatgacatcgccctggtccaggaggtcagagacagccacctgactgccgtggggaagctgctggacaacctcaatcagtgggtgacagtggcagggtcataggaaggtgacatctcgtccacggcacagcctcacttcacttgggccccaagggtggggacctgggcacagcctcgctatcggcagccagaggggtcccctatggcccccgccactgggaccttttgtttcttcaatccagggatgcaccagacacctatcactacgtggtcagtgagccactgggacggaacagctataaggagcgctacctgttcgtgtacaggtgggtggtctagaaagccaggaagcccctccctcacctgggagggccccaacagagcagggaagtagtttgtcctattagtttgtcctatggcaagaacctgaggcttcagagcagggtccagggtggagtgaaaacaccccaaggtcccggaccaatgggttgagcaggtgcctggctcccccgccctcctgtcgcctgggtcccggaccaatgggttgagcaggtgcctggctcccccgccctcctgtcgcctgggtcccggaccaatgggttgagcaggtgcctggctcccccgccctcctgtcgcctgggtcccggaccaatgggttgagcaggtgcctggctcccccgccctcctgtcgcctgggacgcgacgcctgcctcctgggaagcaggagtggggcagcttccagcctggggtcacctcctcctgcccggccttcccgcaggcctgaccaggtgtctgcggtggacagctactactacgatgatggctgcgagccctgcgggaacgacaccttcaaccgagagccagccattgtcaggttcttctcccggttcacaggtgggtgctgcctgggccagggtggggctcggcttggcgcttatggcctccaccccctcctagggaacctggaatgcctgtgtcacacactgccctcccagtccctggggcttgggttttccattcaagtcatttggaaaatatccaccccccggggggactgtcatgatacatagttccagctgacatggtgactgaacctgcccccagggagtgtgcctcacacgacgtggctgtctccacagaggtcagggagtttgccattgttcccctgcatgcggccccgggggacgcagtagccgagatcgacgctctctatgacgtctacctggatgtccaagagaaatggggcttggaggtgaggccctcccaggggcagtgggcaccagcggcctccgcatgtcccagggccacaggcagcgtttcctggtaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggtgagcagggcctcgcgcttagggcagactgagggcacctccaagggcagccgtgactcataggtcgggcttcagaagcctcaaagcctttgaacactcacccaactgagcttcagttgatccactacagggaacagaataacaagagccacgatttttaggttttttcggaaaagcacatctggggataagaggagaggcagacacctaggctgtcatgtggtttccacattgaggggcacagaccagggtgtgcagttttgggcacccacagacctgcactggcaggtcccagggctcttagtttagttcctgcgggtgctgagccaggcccatgtgtgaaaggggaacctactttctcttcccaacacccatcaggatcgtggttgcagggatgctgctccgaggcgccgttgttcccgactcggctcttccctttaacttccaggctgcctatggcctgagtgaccaactggtatgtgtcctcccttgcacagccacatgaggatgggacacaggagctcaggtaggctcagcccagaccctgtgcccacttgcctgcaggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtca

SEQ ID NO: 877 - DNA, 30404 bp, Homo sapiens
ttttaataaagcctttttggtttattgcacatcatataaaactgactgcactgtatttgaaacagacgaggacattcacaaggatggagaaaccaaggtttccttctttcctggccctcatcttcctccacactgctcctgaggctggaggcagctttaacccaaagaatggaatccgctagtgaacatgtttgttttgtggtggcatcagagttgttctgggcccttgtgcactgtccagtttggagactgctggtaacaatgacaagtgtccgggtagcacggctgggtcaggagaactgcatctgggctgtggcagtgcagggagcctcaggacacctggtctcaggctggcggtggctggggttggcctgagtgctgaggaggacgggcccgggctgccggggcaggctggacctgacgtccatctcaggacagacatgtagggcagctgtgcccaggactggtgggctcagagggtggcaaatgtggcagaataggccatgccctggccagctggtgatggcccactgccccctgggacagctgagggccctcttgggttaagggagacacactgggccgggcgcagtggctggcgcctgtgatcccagcactttgggaggccgcagcaggcggattgcctgagctctggagtttgtgaccagcctgagcaacatggtgaaaccccgtttctactaaaatataaaaaatcagctgggcgtggcagcgtgtgcctgtagtcccagctatctgggaggctgaggcaggagaattgcttgaacccgggaggcggaggttgcagtgagccgagattgtgccactgcactccagcctaggtgacacagcacgactgtctcaaaaagaaaaaaaaaaagaaaaccaaaaagggagacacactgtgagcacggacagaggaaggggctggagtctgtaaatccagtgggtgacatgctccaaatgccaccctagaaagcagagcccagaggaggaagccctggattgggctgtggtcatcatcacagcgcagagctgatgtggtccccaggcccagaaatgcctgtggaggcctgacccacgctgggtgtcccaggtcctccctgcaaatggcgggggtgggggctgctgatggcaggttggggtggggtcgggatggccccatcagttccgctccaccttcttcttgccccgaggctgccgcctcctgccctggagcttctccctgcgggtggcggcagtggtgaaggtgatacagtgggtgtccaggaagtccaacagcctgcgcgaggacacacggaggccgttctgcctcagctctgcctgcagctcccgcagctcaaagggctggtacagcagcaccttctggtacagggccggcttggagcggatgtagcacctcagcgcctcgtctgtgtccgccgcctgcacggctgcctgcgaggcactgacctccccctcgccctcctcttcacctgcagactcaaatgccgctccaaactcacaggaggaagaactgaaaagagccagaccaggacgttgtgcaacccctttctctccagcccctgagaccatgagcctctttaaaggaaggaaggtgtctacgggtcccatggagcctggcctgtggcacgatccccagcaaggcaggacgggcctgagagatccctgcaggctacgccagcgggatcctgccccagccagaaatgtctagcatgtggggcaggaaccaggaggcctgcgcagggctggggtcagggaaccagccccctaaacccacctggttttcccacaggtcaaacccagaaggtgacgggggtttttgaagattggccattaggtctcactcgtgccaaccctcacgcccacgggccagaggatacatgaggccactgaccccatcgcatccatccggttacctctgtgagctcaaggagctgtcactgccatccacagaggtggccacggattcttgagaggctgggatctgggcgtcatcattgaggcctggaggtgcctccttggtgggcgacctgcttgggggtgtgatgctttcatgatgcttcctttgatgtcgggggcccttggtcttagcaggtcccttgggcctatgggccccaggtcctgtggtggcctcctgctgggcatggacccctgcccttgaaggcttgtaggtctgggaggcgagggtctggcagtgaggcgcctgcaacagcggctgtgaggactggctctcgtcctcggagtctgagtccagggtctggtgagtgtactggaatatctccttcagcttcagaaccatctggcgtttaggcagagggcggactccaaacctgacggaggaacaggtggatctcaggacccacccacacagctggtccacactccacgttccctatcttagcaaagagtgatacccaatgcattcagcgaatggcttgtgtgacaaaccatagatgcctgacttctgtgagcatcagaggttagtgtctattctaggcgccaactaagcttactctgaatattccaaaagaaacattgccagccaggcacaatggctcacgcctacaatcccagcactttgggaggctgaggcaggaggacagtttgagctcaggagttcaaggccagcctgggcaacatagcaagaccccgcctctacaaaaaatacaaaaattagccaggcgtggtggtgtcacctgtagtcccagctactagggaggatgaggtaggatcgcttaagcccgggaggctgaggctacagtgagccaagatcacatcactctactccagcctgggcaacagagtgagatcctgtctccaaaaataaaaaataaacaaaagatatgctgctcccagttctgagggatggtggcagcagcagcttccccgggtgcccgagtggaagagcagtgtcatgtggatgtgagagttaaatgttcttttaaaaaaaatcaggcctccgccgggcacagtggctcacgcctgtaatcccagcattttgggaagccgaggcgggtggatcacgtggtcaggagttcgagaccagcctggccaacatggtgaaaccccgtctctactaaaaatacaacaattagcctggtgtggtggcgtgtgcctgtagtcccagctactcgggaggctgagtcaggagaatcgcttgaacccgggaggtggaggttgcagtgagccgggactgcgccactgcactccagcctgggcgacagagcaagactctgtctttcaaaaaaaaaatcagacctcctcactcagactgctctggctagggggccatttccatctacatggaatatggggacctgctgcccaggggtgacatgcacgaatcctgtgtgttgcctccctggggaatggtacgcagagagaactgggaggctcaccccggcacccagcagtcacacatgctccctaaggagctgactgcagacctttcttcccaagcccaggccagctgcatccaccagacccagagaccacacggggggcccttccgcccccaggtgtgtgaaacccagttacttatgggagggaaaagaccactgtgggcaacaagctttgaagaccgccaacctatccagttccttcttcagcaccggcgtctccataatggaatactgtggcatcggcgttatgggcactttggggggcaagttcttcttccgattagcaccttctgggtaaaacaaaagaagcacacgttttagcatgagggacacggatttcccacatctgatcccagtagcgtgaccaagaggaataatgcacttgaagataacccaagcatcgttttgctccatgaaagcaacagtggtcaccccttccctgtctggagcaggggcttcccaatgatagcatcggtgacacgcactgaggaccacaccttgtataacacgggtgccgggtgaacagagctcctggggccactgaacccaacagcccggcacgtgactaaaacttatgcatgtaaacttaaaaatatctgacccacagtgacaacttgagacaatgggccacactgatactcttcaaacaggcttagacatcagttttgctttttaaaaataattcatcaatttaaaaaaacccagttaaaaaatgggcaaaggggccgggcgcggtggctcacgcctgtaatcccagcactttgggaggccgaggtgggcggatcacgaggtcaggagatcgagaccatcctggctaacacggtgaaaccccgtctctattaaaaatacaaaaaattagctgggcgtggtggcgggcgcctgtagtcccagctgcttgggaggctgaggcaggagaatggcgtgaacctgggaggcggagcttgcagtgagccgagatcacaccactgcactccagcctgggcgacagagcaagactctgtctcaaaaaaaaaaaaaaaaaagggcaaaggatgtgaacagacatttctccagagaagatctacaaatggccaataagcacatgaaaaggtgcccgacatcattagtcatcagggaaatgcaagtcaaaaccacagtgagataccactgcacgcccactaggatggccataacaaaaaacacagagggtttgggcaaaatggcagaaccctatctctacaaaaaaaaaaaaaaaaaaatacaaaaaaagttagcagggtgtggtggcccaagtcaccaatgtgggcagctgtttgtggctggttccagctactcgggaggctgaggtgggaggatcacctgagccaggaaggttgaggctgcagcaagccatgaacacgccactgcactccagcctgggcgacagagcaagaccttgtctcaaaacaataacaacaacaacaaaaacagaataacaagtgttggtggagatttaaaatggtgcagtcactttggaaaacagtctcgcagttcctcacaatgctaaacacagttgccatatgacccagcaattccactcctaagtacagaaccaagaagaaggaaaacatgtctacacgaaaacttgcacatcaatattcctaagtggcattattaataaccacaaattaaaaacaacccgtgtgtccactagtagatgaatggataagcaaaatgtggcataccatcagtggggtattagacatacaaaggaatgtatgcccaaagccagggcaacatagcaagacccagtctctactaaaaaaaaaaaattagctgggcatggtggcagctgcctgtagtcccagctactcaggaggttgaggtgggaggatcacttgagcctgggaggtcgaggctacaatgagctgtaattgcgccactgcacttcagcctgggtgacagagcaagacccctgactcaaaaacaggccaggcacagtggctcaggcttgtaatcccagcactgtgggagaccaaagtgggtggatcacttgaggttaggagttcgagaccagcttggccaacatggtgaaaccccatctgtactaaaaatacaaaaaaattagccgggcatggcatggcgatgggcgcttgtaatcccagctactcgggaggctgaggcgggagaatcgcttggacccaggaggtggaggttgcagtgagccgagatcgtgccactgcactctagcctgggcaacagagagaggctccgtctcaaaaaaaaaaaaaaagaataaaaaggaataaaatactgatccatgctacaacatgtatgaatcttgaaaactgtatgctaactgaaagaagccagacacagacacaaaaggccacatattagttatatatggctctgtttatatgaaatgtccaggacaggcaaatccatagagacagaaaggttcttggttgccagggctgggggaaggggaaggtgagagactgctcatgggtacaggatttttgagatgatgaaaatgttctagaattagagagtggggacaattgtacaacactgtgaatgtactgagaagcactgaactgtccattttaaaagggtggatattatggtatgtgaattatatctaaataaagctgttactttaaaaaataataggctgggcgaggtggctcacgcctgtaatcccagcactttgggaggccgaggtgggcggatcacctgaggtcagcagctcaagaccagcctgatcaacatggtgaaacccgactctactaaaaatacaaaaattagctgggcgtggtgctgggtgcctgtaatcccagctactcgggaggctgaggcaggagaatcccttgaacccgagaggtggaggttgcagtgagccgagatagccccactgcactccagcctggtgacacattggaaacagtcagactttggttcttctgccttttatgaccatggagccctttgagcccccgatgaaagcggcaggctctgtctcctgagaaaagcacgattcttcctgtggccgcagcgtcgtcctgaagcccacctcagatctgctgtgcagcctcctgcagctgttctcacagcactgcctgggaactggttagaaatgcaaattcttagtcaccctcccgaagcaaggctctggggcaggctgggccacgggcgtgctataagaagctctccaggtgtttctgaagcccctgagggccgaggacactatcagtggcctcattcatctggattttgggaggaaatgggcccccaggccgcaggcaggtgctcactcacagcctggcctttctcccagtcatgctcagcccagcccggcctgtccttgccctccccggaggtgcctggatgggagcagcagcaccgagggggccgacacctggggctctgactctccccggggactgaaatgagcagggaggtggcatccctgcacctgggaggaccaggaagaacaggcctaacagcctctcacacttgtcccacctgattctttttttaattgaggtgaaattcacataaaaaaatcgtaaagggaataattcagtggcattaagtattcacaatgttgtacaaccatcacctctatctatttgcaaaacattttcaccaccccaaaaggacaccctgtatcccataagcagtcactccccattccccctccctccaacccaggccaaccactaacctgcattttctctggatttgcctattctagacatttcatatccatgagtgcagacagtacatgaccttctatgtctggcttctctcacccggcagcatgttttctgggtcgtccacgcggtagcgtgtggcagtgcctcactcctctttgtggctgaacactattccattttctagtggtctagatggaccacgtttggtttccctgttcatctcctgacgggcatttgggttgcttccagcttttggcgattgtgaacagcgcttctatgaacatgcatgtctgagtccctgtttttaattcttttggatatacaggtaaaagtggaattgctgggtcctgcagtcaatctacggttaacattctggagaaccaccctggtccaatcttaaggcatgccgatacttgctgaatgagttgtggcctttggaggtgccggctccgtgttctggagaagggtccacagatgtggatttttaacacatgcccaggtgagcactggagccaggcaagtttgggaaacactgacttactggctgagaagtgtagcatgagaaccagcccggctctcctccactgtggaggggagtctggaaggcagcggaagtgtcatgcctcaggtcagcaggcattcagagggcagcccctgggtctcatgactgatcttcccaccctcttagtgtaaaatagtaacaaagacagtccccttccccagctctcctggctactcactgggtgtctctaacccttcgggcttctgagctccaccagcgcttggcatctgggccggaggaggggtctctggaggcctctgctcttccccgtcccaaacgtcccacagagccgaattcagaaagctcggcctgctattccccagggagcccgcgcccgaggacttctcttgcaatttcctctgggtagtgcagcttcctcggatgggggtggtgtccaggagtcccggggagcgacagtcacggctgtcggcggcctcgttcatcctgcggctggggctgctggtgctcagggggccggtccgctccaggttccagtggtcaatgggaattggcgagaggggctccatgtgccagcagcagtcgtcaattggaattggggggtcactgtccagtggggggcttctgttggcctgatgggaggccacctcctgctcatcgtcactgtctccgacttccaccacttcacccgctggggtctggttcaggaagcttggcccaggcggcgagtgtttcaggaaccgcctgctgaagtgggcgcggtcccctgagatgggatgtggagccagcggagaggagtgcgggtggcccccggggtggggacgggaagggcttctgtggccttgccttctgccgtcagaagttcctggagagacgggagtgaggcatgaggacggtgtctggggcggtggtgtctggggcctgatgacagaaaacttctgtgcgacttcgttcccttccctgtttcctactgaggccctgggcgtgtgctgagtcaccgcctgcacggccagcccgctcctgaggctgctgatttgggtctgggaagaacagtcacggcttctgctggccagcggggtggcgggcaccagccacgaggtgtctgtggtgctggcctcgctggggctgctctcacggtcacagaacagccagggagcccctctcctgcccaaagagccccgattctccggcagcgccccctcatcctcctgctgcagcacagcttcgcttcttggtgggctctgggaaggttcctgatctgcatcaacatcaatgatggaaaacagctcacaggacctagggctaatttctagagctttcttttcttccagaggatcactagaaatggacttcattttggtttgttctagctccagctcctcatccgagtccagtaagaggatgacctcatcttcttcgttcagtttggatgaagatttctgagatctggagctcgaatggtcaggatttgactgggttaggtcaatagacggagatttttctgggaacatcaggacccccttatttctgcactccagcacggaccgacgctctttgcctttctggtgccctggctctttagacagcgtgaggatgctcctgtcccttttctgctttgatggcacagctggagacagcaaggttggggagcccacctgggaagttccgccacgggaccggggtgttgacagggacgacccacttgtgtgatgagacccgcggggactcccgccctggggaggccccaataggaagcggcacgggtgcggtggagatgcctgccagggagccaggcgatgagaaacctccagccccctttccctgacagcgccactttgttcctcgggctcacttgttatttgggacggctctgagatctctccctgagttgatgagaagagctgttcgtaatccccggcatcatctgagtgcggaagagagccttcttttctctctgcctggcagtccctggaagggctggagcagctggaatggccaagcgcctcctctggcgcctcctgctcaggggcctctgctccccgtgcccctgagtgctggccctggggtggcgggagagcgcactgtcccatcttctcccaggtggtggcggcctcatctcttcctggctccaacggctccatctcctccaccttgtcccactgtttctgcacctggacacctgctaggagttgcccagaaaccggactgccaccctccagccagtcagcgtcctcgccggcacccgctgccctttcttcctggagaagctttcgctgagtagctgcaaattcataaatttcttccatttctgcttcattcacgttttcttgatcttcttcgtggtccttggatttcaacaaagtctccgcttcctcctcttcatctgcccacattgacctcaagagttcctggaaattctcggccctgctttcgcaattctctgcttccttctcctcccatggtttgccctctgagtcagtggcaataggcacctgttcgcacaggtgaacgagctcactcacgccaaacctgcaacacgaaacatcgacagtcatcgcccctctgcgtggagatgggctctgggtgccccggtggggtggcggaccagagcagagtcttcaccaggaggaatgaccatgacccaggccctgcttccctttgaagacggtgtccacactccttgccagaaacacccaggccacttagttccagaaaccggggactgacaacacttaaagcagggcttcctaactatagctgcagacataaaggggtgtgtcggactgaatgtaaggtaacagggattggcagagctacaaaactggggagtctgtgctgcctcagaggctcttaagatatggtgtcagagccaggcattgtggctcatgcctgaaattccagcactttgggaagccgaggatcactcaaggccgggagtttgagatcagcctggacaacatagaaagtctccatctctacaaaaaaatgtaaaaattagcctaggagttcaaggctacagtgagctgtgatcatgccactgccatccagcctgggcaacagcaagagactctgtctctaaaaggataaaaaaggtcatgcatggtggctcatgcccataatcccagcactttgggaggcggaggcaggaggattgcttgaggtcaggagttcaagaacagcctgggcaacacagcgacactccgtctctccaaaaaataaaaaataaatgaaaagacatggcatcagacacaatccacagcacaccaagtccttgagtcagcccaggccaacgggcaagccagccagccacctgcttgaaggctctgtggcccgtcagtatatttccaactccagaggctgagctgttcctttcctaagaaagcagcggagggaggacgcaggctcggatcagcggcccaggccctgtccagaggcacaacacttgtccctctgagctgctgcctctctcctaagatgctggctggacaagccaggagagctgtggcatctgggatgcagcctaagcattctctccatgcctgttttatgggactctggaaaggactgctgttgttcaggtctagtggtggaacaatcactgagcagcagtgttggggggcgctgtagccaagggccattctcttatcacacctagggggttaaaaaccacgggactcaatagagtcctcctgatccagtgcttggcacccctgcaagggtctgttctggcctgactttcacctaacatgccctgttccacagggtcatcactggtcatggacttgggattaaaaggtataaacaggactgttagttctcttggcctcagccccgagccctctgcagcacaaccctccagagctgttaacctgccagtcctcgtcagttaatttcaaaagctggggagcaatccagacctgtgggccagggagctcagctcagagctaaggccaggaggaaggccagtgtccgcagtgtagagatagtgcaggaacgtgcgggcggcctcggtgctcacgtcacccagcaggacacgctgggtcagaaccccgtcctctacagcggagaagccttcattgttcacctgcaggtgaaatgcaacacagagggtttactgatcagagagttgtaacttggagcaaagcagacggtctggggtgtcctgcaagtcactagtctttttatttttctttttagagacagtgtctccccttgtcacccaggctagagtacagtggtgtgatcatggcttactgcagccttgaactcctaggctaattttaaattttaattaattttattattttgagttggaatctctctctgttgcccaggctggagtgcagtggtgagatctcggctcactgcaacctccacctcctcggttccagcgtattctcctgcctcagcctcccgagtagctgggattgcagccgcccaccaccatgcccggctaattttttatagtttcagtagagataaggtttcactatgttggccaggctggtcttggaactcctgacctcaggtgatccaccctcctcggcctcccaaagtgctgggattactggcgtgagccactgcgcccagcccctaggctaatttttaaatttttttgtagagatgggctctcactgtgttgttcaggctggtcttgaactcctggcctcaagcgatcctcccaccttagtctcccaaagtacggggatctcaggcatgagccgccgtgcctggtccctagtcttaaaagcagctccatgccccaggaaaagcattagccactgtttatgcagatttttggccaataattttacaggtgaggcctaacactcctcttttgtcaaatcgtattgggactagatattccaggaccccgttaagagtcctcctgatagacacatatgggatccagaactttgacaaagactgagaatagctccctgagttcctgcccacactcaagtcaaatgctttcaagtcagaaggcaggttcatcagcaactcatccctgaggagatcaattatgagcctttgtaattatgcaaatagagaaaagagaaaacaattctgggaaacaatggattttctttttgttttgttttgtttttgagacagagtcttgctctgtcgcccaggctggagtgcagtggtgcaatctcagctcattggaagctccgcctcccaggttcatgccattctcctgcctcagcctcccgagtagctgggactacaggcgcccgccaccatgcccggctaatttttttgtatttttagtagagactggtttcactgtgttaggatggtcttgatctcctgaccttgtgatctgcccgcctcggcctcccaaagtgctggaattacaggcgtgagccaccgcgcccggccaaacaatggattttcattcaacagaacgaaaacactgatgtttcccagttgtgaggccatcccctcacacccactcctaacctcaagcgtgggtctttatctcttctccacgtgttgcagaaacggatggttgggagggagaaggtgagaacatggtggggcaggaagtgagggagagtgggggggtggaaagggcacctgagacatgggaagacctggttggagaaaggcaggaggagagagggagagagaggaaaggagggcacacggcagcccacgtacttacatactggatgaggagcgggcatcgggcataaagcacgaacttgtgggcgtaaagcacctccccgctgtccgtctgaaactggacatcactcaggtgtgggttattgaccatggcgccaaagtcagcaaccagcagcccgagggagagctgaagcaggaggagaggaagagccgtcacctccccacctctgctctgctaactgggcagtgggaagctccccgcatggaggtggcgctagggtgggccgggagccaggacctgcattctcctttcctctccaaaacgcttcccacgatggcctcaacctctgagtgaccctaaggccctgagtagcacagaagagcaaagcactagcttgttcctctggctcttgccagtgggttccctggcccccgtggagatgccagacatggggctagatgtgaactcacagtgctggcagctcccgcactgagtgggacaggctgcgggatacctgggctttgaggaggtgcacccatcccctgtgacggacaagcaccctgagtccaagcagctcggggacctggccaagaggacagccgggtccagtctgtgatgatgtccctaggctggccttggcatgaagtgcttggttgacactgacatgcaaatgggaggaggtccactctagggaaaagccagttcccaccccggttcttccccagacagcgcactgacagggaggccaggccaggctgctcagctgtgctctggagcccaggacccgcacagaggggagggagagcaagcccttggtgagctcccaactactgaggaacgagcagagcgtgcctggatggggcaaccgcgctgagaaactgtggtccctctacactcctgggacccaggacagggcaggctctggggcctcaaccccaaggtgccccatggagtcacagacagaaaaggcagaagtctcgtggcagagcccccagaggggcgctgaggtggctgtgggtccgtggctctgctcacggatgtcaggatgtggcagccttctggaaagcagaggccttgagaggccactgcacttgcgttgggggccagaggccagcggtgagccaaccccaccacacacatggcaagtgggatggccgggaccagagagcgcgggccagagccagttcttaccaaggtgcggccgcccctgtccgggtgcttgtcctgcgatggcaccacaaacccagtcagaggaaggccgccgggcaccacgtccaaccctgagtggaggattcacaggttaaaggaacgtcacagcccagccacatccaccaccaagaagacagcgttgaccacaggctgagccagcccctgcggtgcctcggaaggtgcttgctatccgaggacaccttcatgcaaagcaaacccgcacaccctgtctcaccaccactccaccagggaggtaagagaagagcaaaacagacagttcacccagaggattcactcgctgtgggcagacagctctgtctttggttaaagtggaaggaaaatcatgacagagttgtctacaccacattgacctttgagaaaaaatgaaagcgcccagaggctgcgtgttctcccaccaggtcagagctgccgtcgcggcggcacaagagccagtccatggcagcctcagccgcggggaggggaggcccgggagggcagggctggccctagagtcccacccagcatctcacctgcagtcccttccgagccagccaggcccccactgccgggccacgggctggcgctcagtccctccctcgccaggtccacgaggtcctgcagggcctggtgctccctctggctggccgaaggcgacgggcccctggagccacagcctgcagtgggggtgccgtggagagcgggtgaccttcgctcgctcagctctgagtgctcaggtggcaccagaggcggcacgggctcctgcataaggccctgaaagaagccagtaaggagagtgaccacgtggtcactgtcattgacgcacacactgcagaagccatcacatgtggtatgcacggctggacctaaaactacagagcaggatgtgggctgtggggacagactgtccccggggctccagccacagcctggagcagtcctgggatgcttttccccagcactcatgtcaacatgctcctcctctgtcacggccaaggccaggcctgtggcatctgtttgcacaaaggcttgtcagaggccaggggggcccaggcctgccgccctcctgaagtcctccaagctgcctcaggcagctgcgtactgactgtagggctacctgccgcacgactgtctggagtgtgtgctccgaatgccagtttccgggctccatctgaggcattttgccagttgccctgggactctgttttttttttttttttcaagacagagtctcactttgttgcccaggctggagtgtaatggcacggtctcggctcactgcaacttccgcctccccggttcaagcgattcttctgcctcagtctcccaagtaactgggattacaggtgtgtgccaccatgcctggctaatttttgtattcttagtagagatggggtttcaccatattagccaggctggtctcgaactcctgacctcgtgatccgcccacctcagcctcccaaagtgcagggattacgggcgtgagccactgcgcccggccgggactctgcattttcaacaaactccaggaacacactctggtggacaccaagggtcctccctgatcctacccagagtaccatgtagttgctggacagagaagaaagctgcagccaccaagtgcccctctggcctcctcccgcctctgcctttccttcctggactttccatcacctggctgtgggtacccagtgttgcagttctgggattgccaacctcccccaaaagcctatccatgtgcctgaggggagggactcacctgggcaggccgctggggcacgagaggagggaccagcctggccgtgtagaagtcctccatggcccaggccccagtcagtgcgctgccctcccacagaaagctctgcttgcgttcaggtggaggaggacactggcccgctctttcccacccttcctttaaaatcctgctggcaggaagtggtggcgtgctagacaattccacttcctcagagaggagcagggccacacggtcctctatctgtcggcctgtggtttcagagtcctggactaacaacaatgggggggataccgggggtttcttcttgcgacttttattctctagagagaaacaaaagcgacaccatcaacggtggagtcggtccactcacccgggacctgctgatggcctctcccagggtcactcttctgatcacacaaacctgcttctggtcttatcctctcagaaaaggcactttccagcctgagcgctggtacagccgcacccggctccatctccgaccgggacagagccatggccaccagcaggtcctcggacggtgcctcgtccaccttccgcctcttccgtggctccttcttgctggtgggtcctctccgtttcagacctctactgtgatcactgaagctagaaaacagccaaagagaaaagttactggggctagaggagtgcacgcttctcaggttggtcacactggtctggagagggctgggcctgagagaaaagtgacggatgtggacctgccaggcagatgcgtcccccacttccactgccttgtgtgaactcattcaattccaggccagaagttcaacatggcccaggcacaggagggtctgggttccttcacgtgctgctgtccagcaggctcatggcagatgtacggagccatctgtggtacctgcacatcctcatgtggccaagcccatccaatggagtcaacaatcgatggctctgagcaggctccctggactcccaccaccttcacccatcaatacttccgatgctccttacacggtcctggccacaccggcagaaaaggatcccttccctcctgcaagggctccacggcagtgcctctgtccatggccagaaggaagggcttcccagcttaggctgccgatggtcaacattataccagccgccccgggactctgcactttcaacgggcagcagctcgtttggtttggaggaaatgaacaggagtttccggctggagagaacctaggctgcctgggtgactcccaataagctgggcaagaaggaggagggcagaggtgacaaaggaacttagcacaaaccgggcccaccttccctgcaatgcagtcatgcctctggcttttgcaaaagctcatgctctccagggtgccagggatggctcaagttcaccttcccaggaacgtggataatcacagcctcccagagggaaaggagctgcctgggcagcctgggaccctgcttctgtgaagggaacacagactgtgttccctcctcactccccagcaggccaggtttgggctgtggggaaagaatatgaggcactctggccggggcatgcgttctgatgaccacaggcttggcctttggggagggaggggttcaaagaccccatgagggcatccagctcctgtagttttctactctgacaaccttctaaacggatccacatacatctagtttcagtacttggaggtattctaaaggcagacatactttatctgagcaggtgcttttggcgtggtcctgccaagaaagaaacaatggcttagatgacgtctattctaaggcctcaaggcttgcacccctgccatgctaaatacagatgcgctcctccaccaagagaatcccctctgccctctgccatctcagccccgagccagctcagctgcccatgacctgtgtgcaaagcagggggcgggacaaacagctatcgcctttggccttccctttgctcctgacagcggtctcaaacctggaggagtcaaaggtccaagatgcctttgttcactatgaacctggtgtcagctctagcgtcctcagcagcagggcagcgtggagcagggccagccctctggcacttgtgtggctgtggtttgcatgctgaggacttgtttcctggctgtgagcaaggcaactcattttaacttttaagcattaattcatgcaagatttttaaaaaatagggtcctacacttctgttgcaccaactttgttgttgtttttgtttgttttatgaagacaggttcttgccctgtcgcccaggctggagtgcagtggtgcaatcacagctcattgcaaccttggcctcccaggctcaagtgatccttccgcctcagcctcccacgtagctgggactacaggtgtgcagcaccacagccagctaattttttaattttttgtagtgatgggtcttgctatgtagtccaggctggccttgaactcctgggctcaagtgatccttccgccctggcctcccaaagtattgagattacaggtgtaagctaccgtgcctggccaatcaccaaatctgtgaactgtgctgagtaatcttatgttaacagtgtgaaaactggactgtgctgaggtggaaaccatgctgtccaacaacgaaatggatggagtaaagtgactaccaaattcttagatgtggtaaagcagtagtccccaacctttttggtaccaggaactggtttcatggaagacaatttttccatgggacaggagtaggggaatggtttcagcatcaaagcattccacctcagatcatcaggctttagattttcataaggagagctcaacctagattccatgcatgtgcggctcacaacagggtttgtgttcctgtgagtctaatgccaccactgatctgacaggaggcggagctcaggcagtaaagcttgcctgcccgctgctcacctcctgctgtgtggccaggttcctaacaggccacagaccggtactggtccgaggctggggggttggggacccctgcactagagggtaccgactgtgggatcatgggattggaaactcaggaaggaccttgaggaaaacagtgcgaagatcatttctgcacccccctaaaggggcaggtccagagccttccagaatgcagattctgtcccctcctcactcccttctagactgtgcccgatttccgccctaagtgtttcatttccagaatcaaagagggctctttttccctccaacactataaaaagctttttttttttttttttttttttttttttggagacaggatctcactctgtccaggctggagtgcagtggtacgatcttggctcactgcaacctctaccttctgggttcaagtgattctcctgcctcagcctcccaagtagctgggactacaggcatgtgccaccatgctaatttttgtatttttagtagagacgagattgtaccatgtcggccaggctggtatcgaactcctgatctaaggtgatctgcccaccttggcctcccaaagtgctgcgattacaggtgtgaactactgcgtccagcccataaaaagcttttttaaatagaaaaagccctgagtgcacacagcattatttggcttggttttcttccttttcgtcgacttacctgaacatgggtgggctgctgctaccctcaggctgtgctgtctgcagccgcacagcctgaagcaggagctgggggccaacctccatcttcacagcacactgcttcaagtgactggttctgctctttaaggtaagaaacggtttcccacaaatcgggcactcagggatctgaggcacagaaggtcttagtgtcttttcagcttcatccaagcacctgaaggaaaacagtcaatacaggagaaccaccctccccaggaatgtggattggagcaaatgtgggtccaggtcaacacagacgtgctgtggtcaaagcaagttccccaaagccaatcccctctacacagcctggctccgtctcccggcagtcagcccctagacactacacttaggtatctgtcagcaaagttggctaaagaaagcaaggaaagattaaatgcagttacatgatgacttagaaattccactcctaagtagagaccccaaagaactgaaagcaggtacccaaacaaatacatgaaacccatgttcacggcagctctatccacaatcccaaagggtagaaatgctccaaatgtccgccaatggacgaaaggataaaccatggtcatattcctcatctaagaatgggaaaaacacagtctagccatacaatgagatactgctcagccataaaaaggaatgaagcctgctccatgctacaacatggatgaacctcaaaaacaacatattaagtcaaagaaggcagacacaaaaggacaactgtgcaatttcagaatcggcaaatccatccagacagaatgttgattagtggttgtcaggggagagaggggcaatagggagtggctgccaatgggtgtggggattcttttgggggtgatgaaaataatccagaagtgattgtggtgacagttgcccaactgtgtgaatatcccaaaagtagtgatttgttcagtttaaatgggtgaactatatgttctgtgaattgtatctcaacgaagttatttttaaaaaggggtaggttgacaacaaagctgaggtgctgttgtcatggtaaggtgtggagatccgcactccagccctggggtgcttggggattctggtcacatacacgggagaggcgacggcccaagctgcccccacctgttcacatgctgttcccttcgggtcacgttcatggctgagaggttcttttgacaaatctggcagaagaacaaacccttttcctccaggctatcatcatgtgccgatgctcctacccgtgcaaactcctgctgcagggtcaaggccaccgcagcgtcgctctctggggcagggggcccaagcccatacactgtggagaagcaccaaagatccgtgagaataaactccaaagacaagctcaccctcagacctctgctctgtcagctcctgcagaccatggggagcaggtggaacgcaaagaaaccagaacccagctccactctgcaggctggtgacttggacactgtccagtgagactgggcactaatcagcactccgggaacagccgtctccaactttaacatggatatgcattacctgggaagcttgtcgacactcagattcaaattcaaggggtccaggtgcagcctgagactctccgcatttctagcagcctccaggcttggcgatgctggcagcacaggaccactctgagtagcaaggacctaaactttcccacttctgctgaagttggctacctcgggcattgcaagttcacaaggctcatattccaacaaagctagatgttctcttcaaaactcaccctttcctgctgaccttttactgcccatgataaaaccagggcagagtgaaatgcctttggcgtttaaaaggcagcatctcttacttagcatcagactcaagaatggactgattctggtcttgagatggctcccagggtggcccatctgatattgctggagcagacccctgtcactcacaagggatatgccctgaacgcctcataaatccccaagttcttcatggctgtggcctaccagtgcctgccactgaggccagcaaaacagcacaccttcattttggtgccctgttttgtttgtttgtttgtttttgagatggagtctcacactctgtcgccaggctggagtgcaacgacgcgatctcagctcactgcaacctctgcctcccgggtccaagcgattctcctgcctcagcctcctgagtagctgggattacaggtgcccaccacacctggctaatttttagtagagacagggcttcaccatgttggccagggtggtcctgaattcctgacctcaggtgatctgcccgccttggcctccccaaagtgctgggattacaggcgtgagccaccgcgtccagcctggtttggtttcttaacaaacaaatggtttatctctttctgagcacttgctgggtgtgatgtgaagatacagagagaactgagtcaaatgctgggcaggggcggagctcacaccagctgggtgcctcctctgcaactcacatgtgcgtccaggactgatgcctcggcaggacatcaaatcactgcctgctgtggaccctggggtggcctgagactcctccgtgctactgcagtgaaatctgcaatgcaatgccaagatcctgcatacttattagctgtaggtctgccgataatggtttcttcctatttcttttccttttgtatattttcatcagagatgagaatccatattgttttggggatggagaacaggagcacctggcattattacgcttattgggccggtgccacaccaagtacacagcagctatggggcactgtcgccaccctgtctcacctgcagccaatgagcctctaatctactcagagtggggcaacccaatggttagaggaaggagttaacgatcccataaagaaataaatccagaaagtgggaaatcttataatacaattagcctagcctcttcaaaaactcagtgtcatagggctgggtgtggtggttcacacctgtaatcctagcactttgggaggctgaggagggcagatcccctgagctcaggagttcaagaccagcctgggcaacatggtgaaaccccatttctagtaaaaatacaaaaaaattagccgggtgtggtggtgggtgcttgtaatcccagctactcaggaggccgaggcacgagaatagcttgaacctgggaggcagaggttgcagtgaaccgagattgtgccactgcactctagccaagcctctgtcaaaaaaaaaaaaaaaaaaagtcagtgtcatggaaaacaaaaggaaatgggggactattctagaatctagaccttaggatactgctgagctacagcaatatgcagtgtgtgaacttactgaatccttgttcagaaaaaaaagaaaccagctacaaaaaataaccttgagacaaccagggaaatttgagtttgaactggacgccaggcactattatggaattaagcgtgctaatggtattgtggttatgcagcagaatctaggggtaaaggatcctaatgtctataatttaccttcagataatatggaagaaaaatatgtacgcttggctaggcacggtggctcacgtctgtaatcccagcactttgggagactgaggtggacagatcacaaggtcaggagttccagaacagcctggccggcatggtgaaaccccaactctactaaaaatacaaaaattagctggacgtggtggtgcatgcctgtagtcccagcttcctggaagctgaggcaggagaatggcttgaacccaggaggtggagtttgcagtgagccgagattgcgccactgcaccccaacctgggagacagaccaagactccatctcaaaaaaaaaaaaaaatgtatatttataaagacataaacaaatggccaaatgttaacatttgttaaatctagattgaggtataggggattaggggattcattgtaatttttttttttttttttttgagacagggtctcactctgttgccctggagtgcaatgatgcaatcacagctcactgcagctcaacgtcctgggctcaagcaatcctcccacctcagcctcccgagtagctgggactacagttgtgcaccatcatgcccagctaattaaaaaaaaatttttttttgagtcagagtcttgctctgttgcccaggctggagtgcagtggtgcaatctcggctcactgcaagctctgtctcccaggttcacgccattctcctgcctcagcctcccgagtagctgggactacaggcacccaccaccataccttgctaattttttgtatttttcatagagatggggtttcactgtgttagccaggatggtctcaatctcctgaccttgtgatctgcgcacctcggcctcccaaagtgctggcattacaggcgtgagccaccacgcctggcccctaaaatttttttgtagagatgggggtctcactatgttgtccaggctggtctcgaacttgtgacctcaagtagtcctcctgccttggcctcccaaagttttgggattataggcatgagccatcatgcctggcttcattgtaattaaaacaacaacaacaaaaaaaccttttctgaaaggaagagttctttgtgaatactgagggttatctttttaaaaggaaaaaactgaaagggaaagctttcataataaaaagtcataatttttaaaaaaaggaggccaggcacagtggctcacgcctgtaatcccagcactttgggaggccaaggcgggtggatcacgaggtcaggagatcgagaccatcctggctaacaaggtgaaaccttgtctctactaaaaatacaaaaaattagccaggcgtggtggtgggagcctgtagtcccagctactcgggaggctgaggcaggagaatggcgtgaacctgggaggtggagcttgcagtgagctaatatcgtgccactgcactccagcctgggtgacggagcgagactccatctcaaaaaaaaaaaaaaaaaaaaaaaaggaagagggccaggtgcaatggttcacgcctgtaatcccagcactttggggagctgaggtaggcagatcacttgaggtcaggagttcgagaccagcctggccaacttggcgaaaccctgtctctactaaaaatacaaaaattggccaggtgtggtggcacacgtctgtaatcccactggctggggcaagataattgcttgaacctgggaggcggaggttgcagtgagctgagatcatgtcactgcactccagcctgggtgacagagcaaggctctgtctcagaaaaaaaaacaaaacggtaccttatcaaggaagctaggtgggaaatgatcccagagactcttcattctctggctggatccagtgaagtggcaaaggtaaaacatcaagcagagagcctatccacagaagaaactcaacaaatgctgattccttcccgcctcccttcctcagagttgtattaacttatctctgtgtggaagacagaaacacactcatcataccattccccgccatcatctcctcttgaggatcctttgggacattttcttcccgcgcagcctcgagggagcactcttctgaagcgtgtctcaaacgctcggggtctgctctcttgaactgctgcattcgctgtaggaccaattgtgctgtgcggggtttggagggacttggcactgctgttgtcaaacaggaaggaggaggctgggagtcgctgttgggcacattctctggcaaggaggaaaatattcacaaccatctgttgtagctggagaaataaaagacttttctaccagatacaggttagacgcaagtttcaagagtcctttatcaactagtttaggtttgactcacaaatgtgaagaggactggttgcttgttggtaacctctttgtttatggcaatatagacataaatatcaataacaggaggggaatgggatgtgactgctaatgagcatggggtttatttttaggatgataaaactgttctaacgttaggtagtggtggtggttggacaagtctgtgaatatactaaaaaccactgaaccatacccttttaaatggtgaattttatggaatatcaattataccccaataaagctattattaaagaaatattaatgacaaaggtttatgtcctagatcagttcttctttaacttgggatccacggatgatcttcagtggggatccatgaaccccatgaagttgtgtgccagttttgcagatacgcgcatggatacgtgttttgggggaaccatgcatagatttcatccgactggcaaagagcacgagagaccagtaaagttggtgaggcaacactgctgatgccttccagtagtctatgcgacctgagactctaccaccactctactgagaggttattaagatcaggaagtgagggcaaaggaaatttagaaacagaactcaggagctcagagagcccatggtgtattatatatgcaagggtagttttcagttttgcatgaagaatgtgtagtaagcatatagctcagtataccaagggcagcagggcaagaaaactgctttaaacagttaaaaaattatccaggcacggtggtgggtgcctgtggtcccagctactcgggaggctgaggcagggaggactgcttgaacctgggaggtcaaggctgcagtaagctatgatagcaccactgcactccagcctgggtgagagaccaagatcctgtctctaaaaactaagtaagtaaataaatcaataacaataacaaaggaaaagattaaaaggtcttcagagagagaaagaaagaacctgaagattctcctgggacttgagcccacacagagtcctcatgcggccctctcagcagcctatccaaattggctggcccagtccaacttacccactttggaataaattcaagaaaacaagagaagcagcattattgtgttgtttgtgtaactcatgtcaatcatataacagaatttcataggaaattctgaaagagcagaggactccaaacacaatcatgtgaaaaattcacacgggttatgtttttcttgactgttgtttaaaccaggagtcagccgggcgcagtggcttacgcctgtaatcccagcactctgagaggctgaggcacgaggattgcttgagtccaggagttcaagaccagcctgggcaacatagtgagacctccagctctaaatttttttttaagcttaaaaattaaaaaataaaaacaaaccaaaagttagcaaactacggtcatgtggctggctgcctgtttttgtaaataaagttttactggcatatggccatgcctgttcatttacatattgtccacgcctgctttctcactatgacagcagagttgagtagttgtgacagagtctgtgtggcctacaaagccaaaatatttacgatctggccctttccaggaagttttccagcccctggtttaaaagagtacaaattacctctggttttctctctggaaaggtttggcgatggttcttgctggttacccgtctgggtgttttgtgctgtttcccggagcacaggtggatctggagcagaggcaagcacacccccctccccattcacagagtgggccggttcacttgcttgccatttggttaccctttgctttttagtcctaggggcctggctgccagacggaggtttcttctctgcagggccttgaagggttttggtcttggtagcagtttgtttggtccttttcaatttgcttcttatctgagtgccgtttgaggcagccttttgtgtcttcctttctcctgacacttccttgattccatgttttttcaccctttggaaaaagctagcgcagagttctttaaagtcctcatcagactcatccatcatctgaccagttttaaggctttcaggctggtcttcagaggagcgagggtcaatcccaggacaggcagacagatgagaaagtgaacccaagtagaagcctagctgagcctcattcacactcagtttcattagggttcttctctacttctccattagatacttggagagtttgcacaattgaacaaaaagtactgttttcctctctataatgattgaagtatctttgttcaaattgggcctgtggttaaacatgtttaaagcttccctctgttaaagtccacaactgggccgggcgcggtggctcacacttgtaatcccagctcttttggaggacgaggcggggggtggatcacctgaggtcagaagttcgagaccagcctggccaatatggtgaaacctcgtttcaactgaaaatacaaaaaattggccaggcgtggtagcagatgcctgtaatcccagctactcgggaggcagaggcaagagaatcgcttgaacctgggaggcggagattgcagtgagccgagatcgtgccactgcactctaacctgggcaacaagagcaaaactctgtctcaaaaaataataataataaataaataaagttcacaactgaaagagtgttttgttgtccaatagatgcctctgagatcgaatacatatgaacctggtgctcagataattctccaagatctccatgatgatgaaacatatatggttcacttaattacacatctgtggaaaaccaaaagcatgtaagtgtaatcagacattgtcattttatgccagttcttccagggagggacaagggcatgtggggtgagggaaaagtcttcggagtaacaatactgtcaaatactcagtccagcctggttaacatggtctaaccgtcctatcagacatcacaacaaaaggacctagaaacctgtcaaagcatgttgttcttccacaggtattaaaatatgtgcatcttgggagagtgttttcttaactgaaatttagggagcaaaccccataaaaggcagtcaccacagaaacaggatgatccccaaatctaggaaaactatctcctacactgatctaagacccctggctgttaaagaggctctttctgtaaatactgcaacataagagacagaaagagacattatattctcatgaacactcaggagagaaaaggtcacttttacttatcttctcaacccagcaaggctctccaaacctggatgactggaatgtcgcctgtgtgcaaaggctgggcctcgtgagcatggttgtttactttggcacacagctaagtggggttcaaaaatcaaaactgaatgacccaatggcagaaagttattcctttcaaatacaataatgcaatctccactgtccaaggaatctaattaatcattttgttttccagagctgaaaatactcctacctagaatctactttgtatggctggcgcattctcttctgtgtcttccccttagagaagtgtcctctaatcctttatggaccgtctccatccccgttaatccctatcatcgcccactgttttcacaatggcatctgtcataggttatcatcatatgaaacaggtaatatctatcgaatgcttactgtgtgccaagcactgttccaattgctttccaagtcaaactcgtttaatccttacaagaagcctatatggtggaatctcttgtcatcctgtctttacggcaaggaaacacgcgcaagcagaatgaggaactggcctaaagccagttcaggaacagctttcacagtggcagggctgggatcaaacccaggaagtgtggttcgaaactatccgctcttgtgtttttattcatcggcttattatctgtcccccattaagctcaacacttcaggagggtagagatccatctattactttgcaacctctttggctgatctggtgcctgacttgaaataagtgctccacaactacttgttgaattcatgaattgcaaagagttcggtataatgggagtagagagaaaggtgtaggagaaaacgctgcggggagaggaaaggattggctcacaagggcctggaaggtcaggctaggcaaagtgaattttatcctgttggatgcggggagcggctggaacaaattccacctccacaactgtgttgatctccgcatctctgttgatatgaacctcacaacagtctatctcctcctataggtgcccagtcaagatttactgaatgacataacggatcctgcaagcctgcaggtttccagagggaaggggacttgtgcctccttgcttcgtacctaccgcagcccacggctcacagcaggcgagggatgaatgaatggatcggtaaggggcggaccctcccgcttcccccaacccggcgacctacggaaaggggctgaggggttccccgtctgggaaaagggctgccaaagactctaacggctctaaagtcagacggagaaccccgatccccggactggcccggacggagaccaccgtggggatccggatccgccaccctcctccctccaggcgggccccggcccctctccacccgagtgcggctcctgcctctccgtcggggctgcgggcctgccgaggccacggagccagcgagggagacgggcgagaaaggctcttctcccttaggaaagagagaacggcccgaaatgacaggacctccgcctcccgggtgccgactcccagccccacagcccggctcctcctacctccggcgccgccgcggcaccttct

SEQ ID NO: 878 - DNA, 15816 bp, Homo sapiens
ctaaaaaacaaagtacaaactttattttgtttctttacaaaggcacggtggcctcttggtttttttctccccactttcttaacaaaatataatagcttctccttgaacacgaagacctcaaaattgtaaaaaaaaaaaaaaaagaaagaaaaaaaagaaaaacaaaacaaaaacagaaagcaaaccaaaaagaaataaaaaaccaacaacaaacaaaacaaaaagagagagacagacatttttggggtggaagatgagacctggaggcagaggtgggggctggggggtgggagagtggcgaattctagtgccgagatggggaagggggaggggggcacagcagcagcaaaccccaaccaagaagcaacggagacctccgggcccccagaatgccccagcctagtcttacccccaaccatgtaagtgcttaaaggagaaagaagaaaacccaaaaagaggaaggaaaggggattgaaggctgacaatcccaggctggctctgggcagggaagaaataacctggggttttgtttaattttccctgttcttaaaaaacatatttaaaggaaaaaatgctttttggcagagagaggccaggcatctccgtgtcagcttcctccagcccccggggccgaggccccgccctggggtgccgatgctcccacacgctctgcgacaccccagccccgggacctcgggttgagtggcttcgttcaaaggtcgatttacagtattgaaaaagaggtcataaaagagacccaaatgacatcgtaattttgtaaaaatttctcactcattcgcccatgtctctccctgtggctgccccggctccctccagcccccagaagggagaggagggctgggggggtagtcagggaagctccccgtcccccgacggctcctcccggctctggtccatggcgtcactgtctgaggcctcggagtcggaggcggtgtcagaggtgggggcctccgggcagctgcggacaggcttcacgatgacagctcgccgctgctcctcctccagctcctgcttttcctgggtgccctcgatgtgctggattgcctggacagggacgaaccactgagaaggctcggccggggatacatggccagccaggagacagtgggggctctcagccagccactgtcacccccaaaacacatagcccagaaaaaagcctggcaaagcagcaggggaggcccgctagagtacaggaaaaacaaactccttttactttttttttggagacaagctctcgctatatcacccaggctagagtgcagtggcatgatcatagcttactgcagtcagactcctgggctccagcgatcctcctactgctccctccctagtagctggaaccacaggggtgcgccaccatccccagctaacttctgtatttttggtagagacgagggggttcttgctatgttgcccaagctgatctcgaactcctgacctcaggcaatcttcctgcctcaacctccaaaagtcccgggattacaggcataagccaccacgcctgacccaggaacaaactttcaaaacccctctgttaagttgaaaaatccattctgggaagatgacagtcccagtgctgcttagaaattatattatatgtatcagccaggcgcagtggctcacgcctgtaatcccaacactttgggaggccaagacgggaggatcacctgacgtcaggagttcgagaccagcccctcaacagaggccagaagcctactaaaaatacaaaatttgccaggcgtggtggcacatgcctataatcccagctacttgggaggctgaggcaggagaatcacttgaacctgggaggaggaggttgcgatgagctgagatagcaccattgcactccagcctgggcaataagagcgaaactctatctcaaaaaaaaagaaaaaaaaagaaataatatggacctttcatatgtttttgtttgtttgttttttgagaaagagtctcaccgtgtcacccaggctggagttcagtggtgcaatctcagctcactgcaacttccacctcccatgttcaagcgattctcctgcctcagcctcccgaatagctgggattacaggcgtgcaccaccacgtcaggctaatttttgtatttttaatagagatggggttttcaccatgttggccaggctggtctcgaactcctgacctcaagtgatccacccactttggcctcccaaagtgctgggattgcaggtgtgagccaccacacccggccatatgtttatgtattttaaagcttgcctattaacttattaaaggcgtttgttattaattgtattacacaatttgcaaagtttatgagcaattaaaattcgaggagattgatggattttttttcctgttttggcttttttggttatttatttattatttactgatttctgatcttgggctcctcaaggggccctgttcaagggtgaatgcaactgtaacttcaggcttgacccacaaagcttcctcctctgtaggaggcccaactatcaccagccctgccacctgtatctccatccaggtcctaggagatggagctgagacaatgttccggaccaacccaagagctggatgcaggaactctgtaaccagggggctctgggagcaaaggaccctctccggaaaccccatattgagggaagggacagtcttcctggccaactcctcctactggcgtggtaggccctgccccgatctctggccctcacattctccacttgcagatccagggacggggccccccaaggcttccagccctccaccccttcccacacaagcaccatcttcctccgcttctgcccctcttttccagtctcccctaaagagcctgttcccggagtatgacccccacaagctgcccctttctcaagctcaggtacctgcacgatggtgtccagattttgccgggatgtggaaacagagttgatgaccgaggaggggcccatggtgacgacattgatgtggtgggagggaggaggaggcggtgctggcacgatcaccgtggggtggtgggtgggggccggagggggcagaagctgcaagacagaggccctcagcctttctctcaaggcttctcttggcccatccacctccctttcatgcagagctggccaatgtataactgcctctgcccctttatattaagaagcagagaggacgtggcctagggagaggcttccgccattcaagatcacctgtccccttcccggtccccagagcccactcccgggcgcctcctgctcacctgggtccgcagctgctgctgttcccgctccagcttctcctggtgcagcagcctcacctgttcctgctgctgctgcagctgcacctgctgcgcaatcaccttgagcttttccgggtacatgtgggcctccagcgagcgcacctggaggcaggacaacctgggctcagggccaaggccgggagcacaccctgccctgtcagtctcacagcagctcattcactcctgctgaaaaccctagcacagggcgggcccctctcaacagaggccagaagcctttccagagcccttcagcccccggctcctctcgcctcccacctcggcctccactggaccatgctccctcctgcccgagtctttgcctatgctattccctctgccgggaacacctttctctgtcctttggttaactatgagactcaacttcccacttccatggagatgccgtggggcgtcccttgaaaaacccctcctgatgccacagctccagcctggccttcaatatggttttttgtttttgttttttggtttttttgagccatggtctccttctgtcactcaggctgcagtgtagtggcacaatcatggctcactgcagcctccacctcctgggctcaagcaatcctcccagctcagcctcctgagtaaccgggactacaggcacaccccaccacacctggctaatttttgtatcttttttggtagagacagagtctcactatgcttcccaggctgatctcaaactcctgggctcaagcgatcctcccacctcagccccgcaaagtgctgggattataggtgtgagccaccatacccagcccatcacggttacatttttttttttttgagatggagtctcgctctgtctcccagactggagtgcagtggcacgatctcggctcactgcaagctctgcctcccaggttcacgccattctcctgcctcagcctcccaaacagcggggactacaggcacccaccaccacgcccggctaattttttttttttttgtatttttagtagagacggggtttcaccgtgttagccaggatggtatcgatctgctgacctcaggtgatccacccgcctcggcctcccacagcatggttacatttttgagatcctttggctaatctcccccaccccaacgcagacggtggcccccaagggcagagacgtgtctggcttgctccccactcctaggcctggcaccgcagtaggtgctcctgtaaatagggctccaccgagggccgcagagcaagaggcgcgaccccaggctccacgccctctgcaccgcgcgccgtgcccagcagagggcgctgcctcacctgctcctccagcatcatgcgcaccgagcgctccttgtccagctgctgccgcagctcaatcatctcccgccgcaggtcctccgccttctcgtcctcccagatgtccggggagcctatgccttcgtccttgtcctctgcccgccgtcgcttgggggacgagccgctcagctcctggggaccccaaggagtcggtcagtgtgcctgacacctcggtaccaccacggagattggggttccatcgcagccccccaaagctgcccaacacaggtgaatcttcattagggagccccttctgcaagtccaacaaaccagccaaatgccaggagaatgggctgctttacataacagtcacctggctccttccagagcccactccaccgcacttgaccgatggggaaactgaggccggggcaggaaaaaaagtgcctggaagtacttgtcagtgggcaagaaggggcctgcagccacacctgagtcccaggcccatggctgggtccaaggcatgcccatgccagggagagggagccatgaaggacagggcgcacctggatgaagcgcttgagctgtgtgttctgctgcaagagcctggtcttctcctgctccagggagaagatgtactcggctgtctgctggagaatggctgcctgagggcgtggaaaagccgagagtcaggctggcagtgtttaccagagctcactttcctctcccagcgggaacctgccggctcctccaggaagccctccctgctctcacccaccttgctgagcttctctccgtctgtgtgggggatgagggtcttgagggactggaatcccgcgttgatgctctgcatgcgtctccgctcgttgctgttggcgatctcccgccgaatccgccgctcctggtcccgctgagtctcgggggttagtggaatgttggcaaggctgccagagaggacagggacaggctcggccaaggcgccctcttcatcattcatctccagagggccccagtggaaactgcatccctcccctgctgcaaaagatgccaggccacccccagagagtgatggaggggtgctctctgggacaccggggcggactgaatcagctggctgcgggtaagatagtccgctcagaacccaccccgggccaggcacagtaatcccagttctttgggaggtcaaggccaaggatcattgagcctaagagtttgagatcagcctaggcaacgtagtgagaccctgtctctacaaaaaaataaaattagccaggtgtggtggtgcatgcctgtagtcccagctactcaggaggctgaagtgggaggatcgcttgagcccaggagttggaggctgcagtgagctatgatcacgccactgcacttcagtctgggcaacagagcaagaccttgtctcaacaacaacaacaaaaacccatcccctccctggctttcctcacagggagcagtctctcctccggaacagaattcccagtgtgtctgagcatcaaaacatccaagagcttagaaactatgcagacgacgggtgctggccccagcgtctgactagcaggcccggtggggcccagaaacgtgcgtggtgtgattctgatgcacgcgggatgcagacgacattcagggacgctgtccccgctcctggaacacttctgagtgatttgctaggcacctggagcgcctcttcagcgtctcaggctttgccaccccaggactgaggaagacgtccccactcccttcctaccctcacggccacgcctcccaccacaagccccagccccgctaggctaagacttcacagaagacaagtaccactcactccccaaaaagacaccaagccaacaacccctggggacacggctccccacagcccacccactccaagagatagacccaccctgcgccggagaagcgaggctcccaccatgctgtggggagcgctgctgacccttgcaggagcagtggccagtgcggtgagaaggcagcctgggggaagagggcgtggctgctggctgggggcgtggcttcggacgagggcggggcgtgtgcgccagggggcggggctgcgggccagggtgcagaggcagcggttgtgggcccaaggccacgctcccgagggttgggcttgtgtgtggcctggaggaggcatgtccccctccctggacctcccctgcaactccccccgcccctggcctgatggcttccagatgctgggctctcagcagaggctgccggccccacccgaagccgcagccccggcctcttcctgaggggccctcccggggtgccctgttccaggactgggccaagggggctcatgcccctgaatgtgggagaacaggaaaagggttctgggcagctcctgctccattgatgaaggcagtctggggtcaaggggctgccaagtctaactcccctgctgtgtgccctggccccttcgccagcctgcaggcggaaaggagtttgcacggaccccggaggcagcacatctgcaacagctggaaacagccgtggccttcctggccccacccagcctgcccatctgtccagccttggctccctgtgggaccctggacgcatcgctgccccttccccggcctcggcttcctctcccaatagagaggtgtccaacgccggaagtctggatgcaaatcagcctccttccgtcctcatcaagccaagccccctcctccatcaggacccaaaggcccagggcctgcacccagggtacaagtctcttacagggtcttgaaatgtccgcactgcaaaaggggcccgggccccccactttccatgagactttagggtgcagggcagagaggggatggttttagggtcggtcagctggatgtcagtgctctcacttctcccggttcccctgccctgaagtggaggtgatagggggactggagcaggcctgctgcacggctgtgtgtggcccagccttagggcggagtccaggctcccaggcctggcacaaactcagaccataccatgtctgagaggccagcaggccaaggggaccaggactgctctgcagtgggtggcttaaagctggggctctttggaggtaagaggtgggaagagatgtccataggaagccacaacacaaggtaagtgcaatcttgaggcatcaccatccccctcaggagagatgtggggagagacccctgcccacccagcccctgggtccctcctggcaatgcccaaaagccagagctgactagggggtgaaaagggagcaccaagtccagccttgggccacctgagagctggccctcctggagggtccacaacagagggatacatttttttttttaagtttttggcgagaattttctcactgaattgtcacaatgttcctgagtcaggtggcctgaagactcccatgtaaagaggggggcacagaggtttgggtagggtccagctgcagcaagcgctgggcgtgaaccctgaccccagagcaggtgtcaggccatagggcagaatgagctctgaccggcccacagagccagatgccccaactggcaggtgacagttatccctgtaaaagagaagactaggccgggcacagtggctcacacctataatcctagcactttgggaggccaaagtaggaggatcgcttgagccccagagttcaagaccagcctgggcaacatagtgagaccccatcactagaaaaaattaatcagccaggcatggtggagtgtccctattgttccagcaactgaggaggctaaggtgggaggatgtaataagcccaggaggttgaggctgcagtgagctgtgatcatgtcactgtactccagcctgggcaacagagtgagaccttgtctcaaaaaaaaaaaaaaaaaaaaaaaaaaaggaccaggcattcggaaatcgctgtaatcgtgtaactctttttattattcacagacctcgttgacatttttccctgcctgattctcacaaaacccagtggggtggccgagattacagtgagcaagcaatgcagggtcgtgggaaggaaggtgatgatcccaaggtcaagtagccagacctggcacaacagcaacctgcagatgccaacccactgaagcgcctctactgactgctagttcacacagcccgccacttatcagaagcgggtgtgtgactgcaagctcagccatcacccctgcccctctgaacacaagcccacaagtgaggtgacttgcccaaggtcacacccagcagctgggcagggcagggtgcagccagatgcacccttctgcacctcccggcccaagtcccaccaactcctctgctcttgggagctgaccctcagcctcttccgtcccttccccgcaaggcagcccactaactgggagaccaaaggagaccaccagaccccagtcccgaaaaccccagccggaagttctcacaaggaagaggagctggggctgggatcaggggcctgtgtcgcctcctcctctgcatcagaatctgccggcccagcttctccaatgctccatcctgcctccttcctctccaaagccatcagcccagtctcctggctcagaaaccagctgctggctaacctagtgcttaacttaggttaagcactttcttaaatccaagaaagcaaatttccccccaaaaggtacagttcctcgtgggacctgaatctgccaccaagaccctcaaatataactcacctaaattgccctggaagtacccgccgacagagtcctttaatagaatgcattctaaccaaggcttctgattggtggaataggagctaaccaggggttgtgattggtggagtgccgctaaccaggaattcttattggtggaatgctgaccaaccagggcttctgatggctgaccaaccaggggttcctgttgatgaaggatggttgattgaaatttccaggtgatactgcactgaataaagtggatttttctgcaaatgcctgaaagtttctgatagctctttctggggttttgcatttacggttaaggtctgtaaacgtcctacacacacagtaaaggtccactatcctctctctggccacttcagactcctccaggtgaaaatcaaaggtgacccaagtccaccaacaccgaggttctcttttttcttttgactgagtctcgctctattgcccaggctggagtgcagtggcacaatcttggctcactgcaatctctacctcccgggttcaagcgattttcatgcctcagcctcccaaataactgggattacaggcgtgatccaccaagcctggctaattatggggggcggagggggggttgagatggagtctcgctctgttgcccaggctagagtgcagtagcacaatctcagctcactgcaatttctacctcccgagttcaagcaattctcatgcctcagcctcccgagtagctgggattacagggacccaccaccacgcccggctaatttttgtatttttagtagagatggggtttcaccatgttggtcaggctggtctcgaactgttgacctcaaatgatccatccgcctcggcctcccaaagtgctgggattataggcatgagccaccatgcccagccacaccaaggctctcttgcttcttgcaagccagcctcctgggtccaaacaggggctgccctagatttaggaataaggtcactgagcagccaatggccaaggaacaaaatttgggcaccagccttggatgctaaggcaagagccgccacacctaccaccacagcacccacagaatctgctgagactgacgctggcgtcccaaccagacacttggaggcatggggcatgcccttcaagtctagaaccctgccaggtacctatccctcctgcccaggccaaagtcaagtacccccaatccctctacacctgcctgcccagctccagcctcaaaccggccactgagaactttcatttcacactgccctgaagtcactcacatacctcagggtcacttaacatctacacagtcaacgtgggaaagtccacacgggattctcccaaacccaaaaaagcactaaggcactcatccttctctaacctaatcagcccgaggttctcatccatgctccatccccgctgcttctacactactcacccatactctgtactctgacctggccagtctgctgcccttcccctcggtcccagaacacaccatgcccaggctgttgccatcagaaacatccctgcctccctcccttccccaaagctcctccagcccatcagtgggaaccctgcactgggctcaagtgaaaaagtccagccttgccacttactagctgtgcaacaccaagcctcggtttcctccgtctgtaaaatatggaaacactgcttcacttcacagggtcatggtgaagtttaaaagagatcaagaaaggccaggcacggtggctcatgcctgtaatcccagcactttgggaggctaaggtgggcagatcacctgaggtcagaagtttcagaccagccaggccaagatggtgaaaccccctctctactaaaaatacaaaaattagccgggtgtcgtgggacgtgcctgtaatcccagctactcgggaggtcgaggcccaagagttagtttgcacccaggtgtccaggacaacccatgaaactcttagggggtctacaagaccttttaagaccacaaggctgtgagctgctgaggacaggagtcacatcctgttcatggctgtatcctcagtcccggcagaatgttgttgcttcataaataaatcagggacccaataaacactccaaagccttcaattttcttgaactccttcttatgggagctttttaagttttattatttttttaatttatttttatttatttatttagaggcagggtctcactcccgtcacccaagctggagtgcaatggcatgatctcggcttactgtagcctcaacttcttgggcccaggtcgtcctccttcctcagcctcccaagcaactgggagtataagtgcacaccattcacacccggctagttttttgtatttttagtagaaacagggtttcgtcatgttgctgaggctggtctcgaactcctgggctcaagtgatcctcccgccttggtctcccaaagtgctagggttacaagagtgagccactgcacccagtcttactgttttttttaagagacagggtctctgttacccaggctagagtgcagtgctatgatcatagctcactgcaatctccaattcccaggctcaagccatcctcctgcctcagcctcccaaggagctgagactacaggcacatgccaccatgccgggctaatttttttattttttgtagaggtggggtcttgctatgttgcccaggctggtctcgaactcctgggctcaaatgattttttccccttggccttccaaagcactgggattacaggcttgagccaccgagccaggcctaggagctttatgatacagacagaggccaggcgcggtggctcacgcctgtaatcccaacactttgggaggccgaggtgggcagatcacgaggtcaggagatcgagaccatcctggctaacacagtgaaagcctgtctctaattaaaatacaaaaaattagccgggcgtggtggtgggcgcctgtagtcccagctactcgggaggctgaggcaggagaatggcgtgaacccgggaggccgagcttgcagtgagccgagattgcaccactgcactccagcctgggcgacagagcgagactctgcctcaaaaaaaaaaaaaaaaaaaaaaagatacagatggagagtccgggcacggtggctcacgtctgaaatcacagcactttgggaggacgaggcgggcagatcataagatcaggagatcgagaccatcctggccaaaatggtgaaaccccgtctgtactaaaaatacaaaaattagccggccatggtggagcgggcctgtagtcccagttacttaggaggctgaggcaggaaaattgcttgaaccccggaggcagaagttgcagtgagccgagattgcgccactgcactccagcctgtgcgacagagtgagagtccatctcaaaacaaacaaacaaacaaacaaacaaaacacaagatatggatggagactaccatatacctgcccatatacctgcttttaagactcagtggctgggcgcagttgctcatgcctgtaatcctagtactttgggaggccaaggtgggcagatcacctgaggtcaggggttcgagaccagcctggccaaccactatggtgaaaccccatctctactaaaaataaaaaaattagccaggcatgctgacacatgcctgtaatcccagctacttgggaggctgaggcaggaaagtcggttgaatctaggaggcggaggttgcagtgagccaagattgcactccattctgggtgacagagtgagactccgtctcaaaaaaaaaaagactgagtgtcatttttacagctaccaggcacttgccatacccatagctaattttctcacaggtgctctgtttcccagagactgagaaccattaggcgacaggtccaaaacctgcagcttgtgtgtgcagcaccgtgccctacaatcccctctggcaggcctgggagacagaaagacagggagatccctgctggtcactgagggatggagcaaagcccaccagcctgagatgaccctgagaagcaaatgcatctggccagaaggtcctgcctaatgaacacatttgatcccagactggcttcccacctcaccctgcaacccctactgaaggtaaacaaatccagggacccccaactccatgcctaatgcacagctgacaactgtcttgcaatggacgttgccatgtccaaccctggacgaaggccctacaccttcaagtccttggcctaccaagatccagctaccctgggggactgctggtatgctccaaaggaacgcttggggcagggataaattgaagccagaatctcagggggccctgagaggactcacccaaggcccaggcatggcagccagagggccccccaaccctgcccaggatcaggcccagaatgtcttctccagtaggcacagcggctcaactgcacctccgcgctgcccagcccagccctgcagcagcagcaaccccaggacaagggttcaagttccagttccaccacctgctgtagtggtcccttctccagtctctgtgtccgcctctttaagcggaatcaaaagacacttttgactcatagaaagattatgacaactcagtgagaaaattctagcaaagtgagtccccagaacataaaaagagctcaagaattttttttacttattattactgggccctccaggtgggcctcgtgcaagggccagccctcggggcatccctgccagctgccaaacccatcaactggcccaagtctaggtattgactgggaacttcagagtagccttaaggtggggacccccggggcagagggttgggcaggagtgtctacacgtgtgcagcaaccttccctccaggccggattctgcaggcgctagcgtccaccagcctgtgccacaccggcgggctcctcctccctcaatccccgcccagactgcctcgggcggcagagcacgtggctccagccctggggagccatttcgctcctggagcagcgcggcaggaaaggggccacaggtcccaaacttgcgcacgccgtagaacgcccacctcccccacaccacgcccagggggtcgttcaaaatgcagatgtccgggccccagcgatcagagttccaggcatgtgcattttaagaagtgtgcggggtggtttggctgtgtgtggtccttgagtccatcaccctttgggtttagagcaacctaggaccaaagcttgcaaagtggcttctggggaggcctgcggacctcgggccacccacccggctgggggacccgacgctttcggtttacggcaggggggaggggcgttggatgggaaagtttgcagaggaaacccacgtgcggcgggaagctgccctgcgaggctaggggcggcctcaggtgtcccttccccaaatggcctgcccacctggcctgccttgcccatcgtgcccgcgggggccgagctttgtgcagggaaagcgtggcccaggagcgcctacaaatcccacaatgctgcaccagcaggacacggagaactacagctcccgcgaggccgcgcgcagaggtccgcctactccaagagggctgcagagtcacgtccaggcctcgctagtaaacagcgcccgggcgcgggcgggcgagcgagcggcagccaacgtgccccgggccgcggcgcccctaccggccgcgcgggcccctcggggtccgcccacccccaacacccacacgcgagcacgcccccgaccccgctgcagccccgctctgcaaacacgcacagtgcccggctccccgcccccaccccgcgccgggagccgcggcatggctgcattgtagccgccctagctacacccccacgcgcgccccgggcccccagacccccttggatggggacgacctcagatcccgaggaaggaaggagaggaaggaagccgccgcaggagggggaaagaggaagcgcgggggggaaggccaccagcaccaagcatggccgggactgctgcagaaccacgtgggtctgtttgcaatttacaaacgtcgcgactcgcccgcctgcagcggacaaaagtggccggggccgcttggggcccccatgctccaaggaaggagggtcccggggcggcgcggacccggcgtgtggggctgcagccgtcccggcagctaagaaaggctagcggggtcggcggcgcgggccatgcgtgcgcacacgcgcgcccgcccgggcgggctggccgggggctgcagtggtaggaagggggtggggggaggaggagtacacacctacagagccctcctatcacttctttctctgttttcctgaaatgttgcaaagagggcaccttctgagtgggcaccatgaaatactccatagcgatcggcccccctcctctgcacgagccaggtcccgcgatcagccggagaatgcaagatggaaatccgaatcaaagggcagcgccggacggaggtgcagaatcggccggtcccagatgctggcggcggcggcggcggcgaggggagggaggcgggcgggaggggcgggagggaggtctctccggcctgcctccccgggcgtgtgtatgtgtgtgtgtgtgtgtgtgtgtgtgtgtgtgtgtgtgtgtgtgtg

SEQ ID NO: 879 - DNA, 7966 bp, Homo sapiens
tagcaacatagtctacctacgttgcccaggctggtctcaaacaatcctcctgccttggcctcccaaagtgccaggattataggcgtgagcctgacaagaagagtttcttgggggaaagaagtaggtttaaccctgaaaaactttctccgatcaaatgagaagaggtccccagaagcggcaagtcaacatcacagtcacaaatgtttatttggaggacctgacagccaggtctcaattgctaaagtgttgccacaagaaggaagtattaggcttgtcctgtgtggttcctgagggcaaggccaggtttgatgggcaagggtgacaagaaacccattttagctcaaggtgaaggaggatgttcaggttgaagctgcccaggagaggaacaggattgctgataaagaagtgtcctgtccctgcatgggttccagcagaggccaggtatgcagggacgggcactgctcaagtgctttccctccctgcttgtgcttaaagtctgattctagggaagactctggggctggtgcctcctggaggccctctgcctctgtccctacatcatttcctctggaactccggcctcactggtttctgcgggaggcgcttacgtgcaacaagcctggcccgcatccttgtctcaggaccgtgggctgtctctagggtggtgagggatttatccagcaagcagtgtccttgagatgaggctgcatctgccagcgggcatctgggtgggcagggactcttggaaagccaggggctgtgaaggaaaggagagcttctgcacgccgcatcccagccatttcagcaagggtcttgggggagggtctggatgggcctcctcgcctgcttcctttttttccacttcacttgcagagggctgctcctctcaaagctcaaagtgctcctcttctctgatggagaaaatccctgggacagggctcagagccacacgtcggtgattccggggaagatgcgggcctcagttgtcaaacagggcagccagcctcatagaactgctgtgagggacacgggagatgctggaggacacaggtcatgagtatgagctcactgaattatcacaaagcacgaagagcaggtgatgggggggacagggagtggagatgataagaaaggccacagcccctttaccgttctgggcacgcacttcctgtggctaagcccctctttggcagctgacttgctgtatcgtgccacacctcaaacggttcctcaaagggctaggaaaatcagattgaacatgacaactcaggtctctgaatccattttgtactcaagactgacccagcgttaacatgtaaccctcattgaaagtattgtcccatttatctcagaaatcataggttatctgtcttagagggacccaaattcccacccaagcagaaatcccttaacagccagccatccagcctctgaatactcccagcaacagagagctcactaccagacagctacagctctgctgttctgaagagtgtagggcctagaactagccacggtgctccaggtctcctcccaacttctaagtctcaactttcagccaaaagccaggagcaggccgggcgtggtggctcatgcctgtaatcccaacactttgggcagccgaggcaggtggatcacttgagtgttgcaggccgaaagagtgagggtcgtgatcaactcagtgcaccactggaggctatatgagtaaacagcaaactgttttcatgaaagcagggtgttggcaaactgacaaactgcgtctgccacccagaaggaatgctgagggcagtcacgacccagcacaagtgtttcttgtaatgagataaggtgaacctgtgatcaatcaagcagctgaccaattgttacctcctccaccctgctctttctaccgaatgagtatgaagggcggtagaggttcaaggcggctgcccttgctcactagaagcagggagccctcttcttcttcccctggccccttcctttaaaacagtttcttttgttttaagttttcatttctacgttcgtaccccttcgtttagtcccgtggtaactgtggcaaaccgcggcacttgaggtcaggagtttgagaccagcctggccaacgtggagaaaccccatctctactaaaaataccaggcgtggtggtgcacacctgtaatcccagctactcaggaggctgaggcaggagaaatgcatgaacccaggaggcagagccgagtaagccgagtattgtgcctctgcactccagcctgggtgacagagtgagactccatctcaaaaaaaaaaaaaaagccagggacatgcaccacaaggatcccatggagaatgagcactacctctctcctgatcgcaaccaagccaccccctgctaacccttatacctgacatctccttctcctacaacagaacagcagatacagagactcactctgtcgcctaggctggagtgcaatggcgtgatctcagctcactgcaacctccacctcctggatgcaagcaattctcctgcctcagccttctgagtagctgcgattacaggcgtgcaccactacagtccggctaattgttttgtatttttagatggggtttcatcatgttggtcaggctggagaacagcagtttgtcaattctctttgcaaccagaacgttcagagcactgtctacatctcccatagggcaggagacaataggagagataataaatgtgtatcaacagactaaccgctgatgtgtgtggcacctgcaaccccttcaaccttcacaaatcacctgcctatttattgaggccatccaccaagatagccggcaccctggggaaaacttgacttgggccccctaattcaggcaactttgcagctgtcattcttagctcctaattttttttaatttatttttatttatttatttttttggagacggagtcttgctctgtcactcaagctggagtgcagtggcacgatatcggctcactgcaagctccacctccagggttcaggcaattctcctgcctcagccccctgagtagctgcgactacagattttttgtattttggtagagacgggtttcaccgtgtagcccaggctggtctcgaactcctgagctcaggcaatccgcccgccttggcctcccaaagtactaggattacaggagtgagccaccacgaccagcctttgttgttgttgttttgagatgcagtcttgctctgttgcccaggctggagtgcagtggcacgatctcagctcactgcaacctccacctcccaggttcaagcgatcctcctgcctcagccccactagtagctgggattacaggcaggcaccaccatgcccagctaatttttgtatttttaatagagacggagtttcgccatgttggccacgctggtcttgaactcctgcccttgggtgatgcacctgccttggcctcccaaagtgctgggattacaggcgcgagccaccatgcccggccagctccttgttttctcaatcgggggtgtggtgggagaagctgctttggggaactcattcctttcttcagctgccagatttagagctggtcctgccgcagcccccagtcctatcccctcctctgtcagcacaggttcttgtcaaccaacagaataaacttgcgactcagcagggcaagaggagaaaggagacaaaggcagaggatgatataacgccatccctgcccaggacctgcaggacaagggaggccaagccggccaactcaacagagtgaaaatgacaaatgctacaaggccacacagcatcgaggaaagcacagacagacagctggttcaagaaaggacaggaggatggactaggatgcgggggaacaccgtggagccagaaacacaaaaaaatctgaagctgaggacagcatggccagctggctccaagaggctgtttgaggatttgcatgtgctttacatactggtctggggccagttagtcaactgataagggggccaaggtcacaggaagggacccctcttccactcaatagcccttcaaacatctagcagagctggggcatcgctctgctgcacggccaaagacacccccaaatcatggcaccaaaggcacgtttttattataacccacccagtaccagaaagacatagaaatggcctttctctataaaatatagcaagaaagcacgaactggaagtactagtggaagaaaaacaggaaggcacacagtatggaaccattcgtaagactaacgggaaaaaatgacaccatatatttcagtccctcacatgtgtgtaacttgaccacctgcccaattcagtgtccttaaaataagagcaaaccaaatgcttggaaggagtgaaattatttcaactattgagactcggcaagaatttcttctgagaatcctcgtaaagaggaaacagatacagcacaaggtaatgacacttgagaacattcttagaacagacatacattttccatgaagtttatccctaatagagactcttaaaatagggcaggggaccagccaggcgcggtggcttatgcctataataccagcacttcgggaggccaaggcaggtggatcagttgaggccaggggttggagaccagcctggccaacatggcaaaatcctgtctgtactaacaatacaaaaattagctgagcacggtggtgcatgcctgtaatcccagttactcgggaggctgaggcaggagaatcgcttgaacccaggaggcggaggttgcagtgagccgggatagcaccactgcactccagcctgggtgacaaaagtgaaacttcatctaaaaaaaaaaaaatagggcaggggaggccacagagaaccaagaatgcctggccccgcctcaaagaaatcaccccccaaacagggtccatgacacatgcttaggacacttctcctgaactgtcaccttacatgctgttggtaggagagaaaattggtaccatgcatttgggggatggtagctactaaaatctagttataatagccctaagttggaaacaacataaatgtccaccatggccaggtgcggtggctcatgcctgtaatcccagcactttgggaggccgaggtggatggatcacgaggccaggagttcaagaccagcctgaccaacatggtgaaaccctgtctctactaaaaatacaaaaagtagcagggtgtcgtggtgtgtgcctgtaatcccagctactcgggaggctgagacaggagaatggcttgaacctgggaggcagaggctgcagtgagctgagattgagctattgcactccagcctgggcgacagagcaagactctgtctcaaaaataaataaataaataaataaataaaaataaataaaatgtccaccactaggtgaatggataaacaaactgtggtctattcatacaatgaaatagtacttagcaagaaaaatgaacatttatgtttacataaaaacataaataaatctcagagatattgtgttgagcaaaagaagctagacaaaaagaacttacgtgttgtatgactgatacaagcttctagaacaggcaaaactccagcctggccaacatggtgaaaccctatctccaccaaaaaattgaaaaattaggccaggcgcagtggctcacgcctgcaatcccacaactttgggaggccgaggtgggtggatcacctgaggtcaggagttcgagaccagccaggccaacatggtgaaaccccgtctctactaaacaaaaattacctgggcgtggtggcgggcgcctgtaatcccaacaactcgtgaggctgaagcaggagaatcacttgaacccaggaggcagaggttgcagtgagctgagattgtgccactgcactccaacctgggcaacaacagtgaaactccacctcaagaaaaaaaaaaaaaaaattagccaggcgtgctggcacacacctgtggttcctgttactcgggaggctgagacgggagaatcacttgaatccaagaggtggaggttgcagtgagctgggatcatgcccctgcactccagcctgggcaacagagcgagaccctgtctcaatcaatcaatacacaacagcgaaaactaatatactgtgacaggaattaaaaccaaggccaggtgtggtggctcatgcctgtaatctcagatctttgggaggccgaggtgggaggactgcctgaggacaagagttttcagaccagcttgggcagcatggtgagaccttgttcctattttttaaaaaaagagaagaaattaaaactatggtgagattccaccatacacctaccagaatacctaaataatgataaatctgacaatactaagtgctggtgggaatgcaaggcaactggaactctcataaaaatggtagagaatagagaactacatacacataaaacattaaaaaacgtgtaaatctgagtaagtcccatgtacagtaccaatgtcaattacctggcttctatgctaactgtagctatgcaagatgttaacactgagggatactgggtgatctccctatacatctctttcttttaaaaaaaaaaaaaaaaaaaaagataggccaagagcagtggctgacgtcgtaatcccagcactttgggaggccgagacgggcagatcaccttaagtcagaagtttaagaccagcctggccaacatggtgaaacccgtctctactaaaaatacaaaaaaattagctgggcgtggtggcgcacacctgtaatcccaaataactcgggaggctgagaaagaagaatcacttgaacccgggaggcggaggtccactgcgctccagcatgggtgacagaccgaggctctgtctcaaaaacaaatagagatgaggtcttgctatgttgtccaggctagtctagaaatccagggctaaagccatcttcccccttcagcctctctagtagctgagactacaggttagaaccaccaacccagacttctccctgtacatttcaataattatttcaaaacttaaaaatctgaaagaaagcaaactgcttgatagtggcagaaagcaagcatgaggggattctggggcttgctgggggtgttggctacctgggtgtatgttcagtttgtgaaaattcacggagcgcctaagctatgcaccctcttctgaatgtgttacccagtactccaataaaaggcttttggccctggagaggtggctcacgcctgtaatcccagcactttgggaggccaaggcgggcggagcacctgaggtcgggagttcgagaccagcctgaccaacatggagaaaccccgtctctactataagtacaaaattagccgggcgtggtggcgcatgcctgcaaccccagctactcaggaggctgaggcggaaaatcgcttgaacccgggaggcgggggttgcggtgagcccagatcgcgccactgcactccagcctggtcaacatgagctaaattacgtctcaaaaaaaaaataaataaataaaacagccgagctggaggtgtgtgcctgtaatcccagctactcaggaggctgaggcgggaggctcgcttgagcccggaaggtggaggctgcagtgagccgagatcgcgtcactgcactccagcctgggcgacacagcacgactcttttaaaaacaggttttgttgagtgccgcattgatccggtccctcccacgccccctgtgcttcacaaaaacgtcaggtccgagctccggcgcggcggtctcctcctccgcgggtccgggccggaactcggcagaaggacgagcagctccttggggccggcagtctcccatcgcactgagattgacacggcaatgtttcggatactctgggtaaaaattaaatgtcttacgaaaagtcctgtcacccgtttcttgattactttttacggcggcttccagaacctttcgtcagcgcgagctccatgcccggaggccgccgtcacctgctctccgggaaggccctgggcaggcaggcagcgcgctgaaggagtcc

SEQ ID NO: 880 - DNA, 11682 bp, Homo sapiens
cgactccggagcccgagcccggggcgggtggacgcggactcgaacgcagttgcttcgggacccaggaccccctcgggcccgacccgccaggaaagactgaggccgcggcctgccccgcccggctccctgcgccgccgccgcctcccggtgagtttctgtggggctggggggctgcgggcggggaagggggcgccacggccaggctgtgcacacgcgcggggaccgccgccgcgcgcacacacgcactctcgggcgggaccgcggccccagccccacacggtcacctgggccgcccggcgggcaggccctgtacgctccctcccccgccgtcctggggcgccgacagccccgcggccggccagggtgcgcgcctgagtgtgcggtgagcccgcgaggctgcaagcagacaaaataaacaccccgtcccatgcttcctcctcccacggctgggcctccggcatgaccagttttatgaatcaaacccctttgagggggatagccaagccacaggcttgggtcacttttccctcctggggtccggcagtaggtgctgctgtgcagaagggctgcccggggtcctctggacccttgtcactcaaagcacagctgggggctacagatatgcagccctagggaggggcggggagtggctggtgggcgtccgatgcccatccctccaggtgggggatggacctgtactggccagggcccttagagcttcgggtatcaggcagggtgccgggtctctgcctctgccagggaaggggctttgcttgggctgcaaacccagtggcctggagccagcctagtcctttgtgtccctgggctggcagtgctggggcctgaggactgctgaggtcccctgtggtcactggcaggccagccgattggtgccaaccattctgcctctcccccattcgttaacgattgccacaccagggtcactgaccgcctcccctgctgtggcccaggggtggagtgtgcagggtggaaggaagaggtcctgggggtctaggtgtccccatgcctgccttttgcaccaaggacaggtgaggctctggagagaggcagcgggacctagagcccccttccccaggctgagagcctccagggctggggattggataaaatctccaaggtcccttcacactagactgtactttgggtgttgagggcatagaggggtggccgggctgggaccttccaagcagggtccattagggccagtccagggggcagcaaagtccaggatgggcccagctattgacaaaaacccaacagagctggggcaggcgggtgggggatggggagcagtcccctgagtttactctcttctcccaggggagttggcctggagcttctgtaaacagagtgtcagaggcaggaagaggctctggtgatgagcagcccagctggatcccctccagaccattatctagcctcccctgggcctggggagggaggatgcgcacacacatgccagcctgggggccgggcactgcctgtccccaccccgcccctgtctcctgcacgttggaacagctgtcctgctacctgtgggtccggagggtcagatggggatggggctgggggctggggtcccagggcatttgtccagatggcacctctctctccatattctgggaatgggagaatgggattcagcataaggagcctctcagacactgcccagacctgtgcttacccgaggaaggcccctctggcacgcagcccaggggccagggagatggcaagggagatgccccgggcaggagatgggtccgcggctcctagctcccattactgtcacccccactgacagccccgggggagctgggacaagtcccaagtacagaaaattaagtccttgcctgggcttataagtgggtcccaacacaacactgggcagcctctgggaacaagaaagcagggccctgctgagcccaggagggagctcccacctcagcaggccagacagccagtcctgccagtgagcagaggtgtgtagaggggaggctgcccacagggatggctatccctgaccactggccagccctgagctcatgggagggcagcaaggccacctaactctgttagtgacctctcctggaccccccatcagctgcccttagagtcccctccctgggctggggagcccaaggctctgtgctgccaagaaaaccagctcccctcactgctgtggaatttgcgtgagttcttggagaagggggagggtgcacgtgtgtgtgtgtgtgtgtgtctgcaggagcactgcccagtgggcgtgtgtctggcgtgggcgtgtctgtgtgcgcgtgactggagcagggctgtgtatttgggggtgggtgggggtgtttgggggagcctgcttgcaccaggaggggcagggcctcagcctccttccttttatcggtttccacattccagagtcagccggatcgctttccctccgcgctgggccgccggcctcccccgcttttcctcattccagcctccctgggtgtgaggaggctggaggaggctccctcaggccacctcggttttgggcagggggtgggggcaggcgaggggccagttattcttcagggttcgggacggcccccaccagactcttcgtggggaatgcaataaggttctgacattcctcaggggctgcctgagagatttaattaaggagggaggagggagccggcctacaccgggaaggggctggggcggccgctggggcccctgctggccctgggccccgagcccggctgggcattgagagcagtgcgggggcagggttgtggttcagtggccaggtcctgttctgcctccctgaatccatcccgcctgcccattgatcagctcacagaccccaggggcgccatttctgccacgggttggccaagaaccctgggtgattgtggggggttcggcatggggagcttgagaagggcaagaccccttccagggccacttccttctcagacccccaggcccaggaagcttagggctggcggccttccttggtgactaaggtgttcttctggcaagttcagggttaattgcaggttagggccttactagatgggtgcttgcccctgggtggggacagggcagtgaggaggccccgtgtgagggcccagccctggtggcatcacacctgccgcgtgccgaaagtggcatctggactggcccatttctagttgggctgcagccactgcacagctcccagggccacaggtgtcctccctgacaggttgcacctcttgtgactacgatggcacgtcccaccgccccaggggctcacttgagctggggcctggccttagtcactggtctccctgccctgggctaacaggtctggcagctgccaagtcacccacggtgctactgaaggcacccacctggggccgggccagcctcctgggtggagggaggagggaagaccctgtgcctgcccctctcccagccctgccagctggtccacacctgctccaggatacagagcctcctccctgcacaggaagacgagctgacatcctgactgtcccctttgcaaccctctgtcctggtgttctgaaccctggctgtgcggaggactcgctcaaggagcttctccaaaatacagctctgcctgggtctcactcctagacattctttttgtttttgagatggagtattgctctgtcacccaggctggagtgcagtggcgcaatattggctcactgcaagctccgcctcccaggttcacaccattctcctgcctcagcctcccaagtagctgggactacaggcgcctgccaccaggcctggctaatttttttgtatttttagtagagacggggtttcaccatgttagccaggatggtctcgatctcctgacctcgtgatcgtcctacctcggcctcccaaagtactgggattacaggcgtgagccaccatgcccggcagaatttcttgtttaattggcctgggggtggggccccagcatggaggttttttttagaaagcttcctggatgattctgatgtgcagcccggcgggcaaagccctggcgtcacaggtgggagacggaagcccagagaggggagcttgcttggatgaggtcacaaagcgtgtgagtgcctgactgagctcctggctgtggcattatctgtggaatgaagagcgccagcttggggtggtggatggagtaagaaagaggctgacacccatggggacccccgctcaatcaccagccaggggtccccgcgcctatagggagggtctacctgccgcagtccctgaggaactcgaggcccagccctctctgccccttctgtgagggcccacgacccctgacctctctgccctgcccttgggactgctgtgtcccaaggaaggggagacggggcggacccagccgggccctgagcctcctcggacacgtcagcgaaactggagccagccgtcctggccgccggcacagtcccgcctgcctggaggggttggcagactcccggggctgggctgctgccaggcctgaccggccacacagagccttggcgggccagcatgaggagcgggggcccggagtctcagggtcagacctgcagcgcctgtcctgcacccacgctgaagcatacggcacaggaggggcgtactggcctcagactgtctatctgtctgtccaagcctgtcccctactcagcaggcacaccgcctgccccagaatcagtgagatgttctcgccaggggctgatgtggtcaccagatgcctgggtcccaccccagccatgctatcccctggcccgtccccgcctgaccctgggcgtgtgtggtgtaccccagaggtgggtgggcgtccccctgggagttgagatgacgagtgccttgtcctccttactcatagggcccctccctgaagtcctgtgctgaaggggccgccaagggacagctcacccaccacgtgcccccttccagaaccagagataccccacccccgctccccagcccccagggtgaagggcagccttggtgtggggatgtctgatctgtgtaaagctggcctgaaaccctctcccttagtagtacccacgcccagggggcaggcagagttctgcgtttatgagtgacgccctccgcagtgaatgtttaccgaccacttggcaagtgctccgagcacagaccaagtcaccccagacacaggcaccacgagcaccacgagcagcgcccactgcacaatgggggctgaggtaggggtcgtggccgggctgtggaccctgtcgccctatgccagttactgtgccagggagggagcaaggccggcagcagcactcagcaaggctgaggaacttgggtggaggacggaggccccagacccttgcgtcatcttcccaccccccgacgtccccgaatcccaggaatcccagggctgcctccggaacacctcctgcaccaggcagaggaaaaggtctcacctccctgcctgactagtgatcaaatatcaaagcccaggtcctgggatcaccgggtgggagggtgggtgggcggcggcaaccaccgtgtgacctgtagacagcccccagccccacgcacacaccaagcacacgcccagaccccaggcgggcgggacagctcccagaacttgttaaaagaacttccccatttgaaaacaaacagaacaacagaaaactacaactccagagggtgagggggcagggctgcttgcaccaactccagaggtgagaaactgaggcccacagttgagaaaggaactctggcctctgtcccctgccaccgtcccctccacagtcagccttccctcgctgggttcctctcggggctggctgatgggttctcagtgccaggagtccctggcggtgccctcagagctgccagcctgtagcttacaaactctggggttttccaaagctccagcgctgcctcctccctcctccctttgatgtgggggtagaattggggctcaggcaaaagagctcaccgcacattttacggggctgggaagcaggctggctgccgcctgctggatggtcagcccaggaccccagcccacagtcctgacctagacccctgtcctgctaacaggaacgcacattccacagctcactacctgtcagccggaaagccaccctgtggccagatggacccacagcatcccctctcccttcacaaccttgctgattaaagacccaacagattacggagcccagagctatggctggtccccctccccagtgcagggtgaagagcaccccccagcacgtgcccctaagagctggcctgcacacctggccttgcagggctgaggactccacatgcatcccccactgcagccctgaagtgtcccagatactcagatgaagaaaccgaggtgtgagagcaaagtcactgtctgcggcctcacagcttggacacctctgagcacagggccgcctgcctggagtgagcgctcttaactgtgaccttaaacgaggcccaaggggagctgcggccacagtggtggccaggctggccaggctggccacgtggaggatcccctcccactctggaacctggctgcatccttcctgaccctggtctggccctgctgggagggctaattcaggcagaggtggcctcaccccccatatggacatggggtgggtgggggtcactcacagcccacatctggaggccaggccgcacccgccgtcctctgagtcagtgagggtggagcgggtcccatgggggaagagaaggctaggggtgtggccccagggccttaggtcatcagacacgagcccccctggggtgggctggccgggccagggacgcgtgcctggggtttggggtgctaacttcttccagtgctcagtgccaggccctcctgggctgttcactcagcagacctgagctaagtgggcctggagacacctatggcaaaggcaggctgggtctcaccttagggaggtgagggggcacacgacagcaagggggacaccgctaggttggggaggcttagcctgctggcctctgaagggtgcttgttgtcgctaactggctaggggctcagggtcggtagctcctaggggagacgactctggcagtgcgatactacacgtgggcagggcctgcgtgggcccaaccccggggacaagggcttcttccttcacctcgagctacccgcagaccccagtggtcacctcaccagtgacttgtctaatctgtcctgggaccacctgctcctcctcacattccaggaacccacgtacctgggggagagggagccctatggacgggtccccccagcctggggcggagtgcaggctgggtcggggtcgtgttccctggactacctgcacagcctgtgtgggggaaggggaagcccggactccagcacaaagggctcttgtgtgagctgcaggcgccactgggcaggatgcttcctggggatgggctggcaccccgtatgaggctcagggacttctaggggtgccaaagtggggagggctcttcctggggacggccccagcggtctccccaggagtctaggtgatgggggccagccacagacctgcctgacttgggcagtgcagctaagatctggagcctggagcggctggtgggagcccccgcccccagggccatctggagggcacgcacccttcacaggtggctgctgcacacctgggctctagctcggacttgctggcaccgcaatggcagcgagtccctgcacctccatgagccctgctttcttctgtctgccctgacgtggctgctggggggctacctgaggtgacggtaaacacttagtgttccttcgtccttcccacttcgctggcacatgggaaggacttgcaccatcactgccaaggggatggctgctgctcatctttcttggtgcccagctcagggcagaccccaagaaacagtagacgaagccgggcacggtggctcatgcctgtaatcccagcacttttggaggctgaggcgggcagatcacctgaggtcaggagttccagaccaacctgaccaacatggtgaaaccctgtctctactaaaaaaaaaaaaaaaaaaaatacaaaaattagccatgcatggtggctggcacctgtagtcccagctacatgggaggctgaggcaggagaattgcttgaacctgggaggcagaggttgcagtgagccgagatctcgccactgcactccagcttgggtgacagagcaagactccgtctcaaaaaaaaaaaaaaaaaagtagatgaatgactctgcagagttttcccaggcctggcactgcccctggggctgccatgtagccagtgtccccacctgagccctgtggccccccagctccagctctgtcaccagcctcagctccccgcctccctccctcacaggggacacctgccaatgcctgtggcctctgcccctcctccaggaaccttcccgccggccacttcctggcggcccgcagcccccagcctaagcaggtctgactgcccaagtggaaaaacatggatcccatagtttccatgtgaagtcttcccgctgcattccctcctccaaggagggcgggacacggagcgtggcagcaggagccggcggccaaggcagccagcttctctgcttacacacccacccagctgcctgcctgccccctcttccagaccctgtagggaggagctgccgctccaagtcccaccattctctccttcctggtccatctctgaggcaggggatgggggaacctacctaggcagaggcaggagggcctggggttcaggaggaagcagtgcatggtcactgcacgttcagtggatgtcatgccccatgatgacctctgtgtgcattgacaaggtcacacagtgagggagtgacggggctgggacagaacctgggtcggggcactggcgacctgactcataaccattgggttctcttgcatttgggggcagaagcagtgaattccctctggctcttcctggcgtgtctgccttctaggcccctgactcacagtcttctgtctctgcctcctctctgctcccagggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacagccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagagccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccgtctcacctatcgcaacctatcgggccctgataagcggctggtgacgctgcgactgcctgcctcgctcgctgagtacacggtcacccagctgcggcccaacgccacttactccgtctgtgtcatgcctttggggcccgggcgggtgccggagggcgaggaggcctgcggggaggcccatacacccccagccgtccactccaaccacgccccagtcacccaggcccgcgagggcaacctgccgctcctcattgcgcccgccctggccgcggtgctcctggccgcgctggctgcggtgggggcagcctactgtgtgcggcgggggcgggccatggcagcagcggctcaggacaaagggcaggtggggccaggggctgggcccctggaactggagggagtgaaggtccccttggagccaggcccgaaggcaacagagggcggtggagaggccctgcccagcgggtctgagtgtgaggtgccactcatgggcttcccagggcctggcctccagtcacccctccacgcaaagccctacatctaagccagagagagacagggcagctggggccgggctctcagccagtgagatggccagccccctcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttataagagatcctttcccatttattctgggaagatgtttttcaaactcagagacaaggactttggtttttgtaagacaaacgatgatatgaaggccttttgtaagaaaaaataaaagatgaagtgtgttt

SEQ ID NO: 881 - DNA, 11123 bp, Homo sapiens
atgcagaaaagaaatttattaccaagctataaattagaggcggcggggtgggcggggggagccgagcagtcacgtatggggcatctgccctttttctctgtcctcctgggcctggattttgagttcctcatccaggcgctcctttgcgcggaccacctagtgggtcacggataatcaggccgggaggccaagcctccgccccataccccttgcccacatgggatggcctattcccatcagcccaggtccattttttgaagggcagtgggtggataccaatgcttccttcagtggcaccccagggtcggggtggcctggggagacagagctgggctgcagggcccagcgcatgctgtgacctctgtgagctgagagctgtttctagcaccccacccatgggggctcctgctccttcgaagtcccagctgctgggagggagggctctatctggggtgacacagcctgagtggctggaccccgcaaagctgaagcagtcagaggggtggcagttcagggggcctccctgaggctggggcaccatgggaaagcctggcacagttttctgtgtgccaagcccttagctggccagctcccccaactaggaattgagccccaggtgagaagaaggggtcccatgacttcattcctcccagaatcaaagaccactcacctttgactgcaggtagaaggagccacccacggatttatcattcaccttaaataagtgttcatagttctgcagaggagaggggacgggtgagagggctgcagactgcaggcaagagatgttgggcaggctatgtggggccacgtgagagaggcaacaggactcctctccaccctgtgtgccacacccagctgttgtggccactgagaggcagagatggggacgggtaccctggagggcaactgagctgctactggaaggcactctttgtctctagactgtcctgcctcaggcctaaaacttcacgagcaacagtggctcccgaaagttggagtccgagctgggtgcagctgcagcctccacatcggacctccctggccaggcctcccttcactcttcccaccctggcagcctctccctctcaaactttggggtggcccagtggcctcaccttctggacctcctcagggctcagcttggacacgttgagaatctgctgtgcctcctggaggctgaggccggagaggttggaagcggctgcagaccggtgtccagcgcgtcctcgggcatcagctgcggcccggctggctgtgtggacatgtgggtgatcgctcagtcctcagcagcccacacttcaccctgggccttccgagttggtggctcacccctgccaccagcacaggatgagagacacagggacaggtggctaggagctgcctcttctccaggagtggtttcctttttagggggtagaggctgggaaagtgaggacagacgtgcctcactggagggtaagggcaggatctgaccgctaatcctggctcctggtccccaacctagaccatgagatgaccctgtcccccaacccccatatcccaggggaacagcaaattggggagctttaggctacgatggagactgtatagtggggctgcgggcatgagagggctctgcaggggcccagctgcccacctgtcacctagaccaccaaagccactgccttgggtgacctctcccctttcagtgaccccagaacctagaatcaggagctgctaaacttttcctaaaggctcagagagtagctattttaggctttgcgggctaatgagcctacactggaaccattcaactctgccttgaaagcagcctgtcggccgggcacagtggctcacgcctgtaatcccagcactttgggaggccaaggagggcagatcacgaggtcaagagatcgagaccatcctggccaaaatgatgaaaacctgtaaaatacaaaattactaaaaatacaaaaatcagctgggtgtggtggcacatgcctgtagtcccagctactggagaggctgaggcaggagcattgcttgaacccgggaggcagaggttgcagtgagccaagatcgcaccattgcactccagcctgggcaacacagtgagactccgtctcaaaagaaaacaaaagggctgggtgcggtggctcacgcctgtaatcccagtacttcaggaggccgaggtgggcatatcacgtgaggttgggagttcaagaccagcctgaccaacacggagaaaccccgtctctactaaaaatacaaaattagccgggcatggtggcgcatgcctgtagtcccagctactcaggaggctgaggcagaagaattgcttgaacccgggaggcagaggttgcagtgagccaagatcgcactattgcactccagcctgggcaacaagagcgaaaactccgtctcaaaaaaaaaagatttatttacaaaaccagggccgggcgctgtggctcacacctgtaatcccagcactttgaggcaggcggatcacctgaagtcaggcgttccagaccagcatggccaacatagtgaaaccccgtctctactaaaaatacaaaaattagcctggtatggtgtcgggtgcttgtattcccagctactcaggaggctgagggaggagaatcacttgaaccaggaggcagaggttgcagtgagccaagattgccccactgcattccagcctgggcgacagagtgagactccatctccaaaaaaagaaaaaacaagtttacaaaatcaggtatccagatgggccagtgtgccagctcctgccctggatgctcttgctaaccaggtaccactgaagaatgccccggtctggcatcaccccccaccatgggaagtgcctcaggccacgcacacttcagaaccgccaggcctgaggtgcccatggctacggggaaaatctgacctggagaggaactcccagcccacaggggagacggacccatgcttacctgcaaactcctgccgcaaggcccgtgcaaaggccctgcccaccacctgcacgcccatcacaatgatctgggccaggtacttggcctgtgggcaaagcaggcacccggttagcaggccactccctgtgggcccacagagatgggccctggaaacggctgccgaggggcaaggctcccggagacccgaggtcatgaagcacagagctgcagccccaggccaacccctccaaagcaccctgaatgaaagcttccatggtgggtggcttagttactcactggacaggcaggcaggcgggtgaacttgaccgagctcccagaggcagactggccccacctcatccttcaggaaaggcgtagaggagcaaggcaaagtggctgcaaccaccggcttcaggaagaaacactgtggtctgggagccagaacacagggacagccctggacctggcagtaactcactctcgaccctggggccgaccatcactcttcctgagtttctgagatcatcaggcccaacctttactttaccaacggggaaacagatctgtcctaattctcccaagtccgaagactttaagtccattccattcaataaaacaaacttactatgcaaacctgtttccatcttcaaggagctaaaagcccactaggagggtatttaaacacactatggaccaaatcatgagggagagtcaggctcgttcatttgtgcagccattggttcacccattcattcaaacatctgctgagagtctactctgctcagcacttgagcacaaagctacacagaacctggtccctgccccgagtcagagcacactgctggcctggcagggaaccccactgtcacacaccaggctgaacatgccggaacactgcacgtgtgattccatgccccgcagaggccctggggactcactaagatgtgagcggaagcaacagagtcgagggaaaactcaagactgagatgggattcggtgagaggagggggttctgtgtgagaggagggcgttccgtgagaggagggggttccgtgagaggagggggttccgtgagaggagggggttctgtgagaggagggggttctgtgtgagaggagggggttctgtgagaggagggggttccgtgagaggagggggttctgtgtgagaagagggggttctgtgtgagaggagggggttctgtgtgagaggagggggttctgtgagaggaggggactgtgtgacaggagggggttctctgagaggaggggactgtgtgagaggagggggttctgtgagaggagggggttctgtgagaggagggggttctgtgagagaaggggactgtgtgagaggagggggttccgtgagaggagggggttctgtgagaggagggggttccgtgagaggaggggattgtgtgagggggggttctgtgagaggagggggttccgtgagaggagggggttccgtgagaggagggggttctgtgagaggagggggttccgtgagagaagggggttccgtgagaggagggggttccgtgagaggagggggttctgtgagaggagggggttccgtgagaggagggggttctgtgagaggaggggattgtgtgagaggaggggattgtgtgagaggagggggttctgtgagaggagggggttccgtgagaggagggggttcctcctgggctgggctttgcagggtaggaagaatcatgatggaaatactagggctttctaggcagagggactgggttgagccaaaactggcaggagagaaggcagaagggagttcctgcgagcagccaatagcctaggctggcctgggaaagactgggaatctggcggatgacatggaaagatgcacagatctttgtgaaacaaagcgattatatatagacagcacatacaaaggatcttgtgactgcaaagccgtagacgcaggggggtggcgcgggctggaggcagctcggcataggttgaaagctcatgtggcacagccgagtgactttccctttcttcctagtgcttttctgtagatttgccttcagtcaacaagtatcaactgagtccacacaccaggcacggtgccaaacacgttcaattcattgtgccgtttaattctgacaactcaggggtgggggactgctgactggcccgaggacgtaacagcaggtgcctcggaggcagatcggaaacccaaggctggtgctatctgtcacagcagtcactacgcagggtcccggggtctgaaggtagggcacctgggcaagccgacaagtatcaagaacccaaccccgaggccagaggggcttgctccagattccagtggattcgactccagagctggccttgttcagcctccgaggacctgctctttccttaacaggtgggatgtcattatgggccattaggggaatgaacaaacaagtgggttaagatttcaaaagtaggtggaaacttcataacttctggatttcacagcagaaagagcccagagaagaccctcctgtgatcacagcgaggggcagggctgtggctgtactgcagatgagggagggtcagggatgcacctgatgacacctgcggtctcacctgacttcgcctccttcctaaagcccctcccgagtggaacaggaggctcagggatgggatgctggtgctgtctgaaggacagaggtgaaagtcagagggtcccctcggcttgaaacacggctcaggtctcagactacccctcacaccaacagccttcggtccctctgctgccatcgtacagccttgcaatcacttgtttacttttctgccaaggccaatgactgttgcaaaataatgaacggtaagagctgaggtcataactggggagcttccccgaccatcccctgcacacttcaaaccaaagcggcgtggtggcctgtggcttcagctgcctagagctgcagggcagaggggggctggcctgcaaagtttcagcagactggacggcccattgaggccagcaaggttcctataggaggcatctctgagaagacgcagtgtagtgtaatggttacacctgcaggctttgggatcacctgtgtgcaaaaatcccagctatctgacatagacacgttctcaactcctttgagcaacccagtttgcttacctgtaaaatgtggccaccaataaagctgagataatgcctgtcaaatgcctggcacacagcctaatggtacagcaggtgctcaataaacattggttttcattcattactactgtttcacaaaatctgacaatgaccaggcactatgaagtaacaaagcttctttcaaaatagcagctcatttgatacaggccctttgcttcctcaggggtgaaggctgcaaaacaccatactacattccctcagggagctgggaagcagcaaggaagcagaacgagaaccacgttgacctgggaccagaaccctagctttctttctcaatagctgtgtgaccctggacaaattactcaacctctctgaatctttttttgttttggtttgggtcttttattttttatttatttttttgagactgactctcgctctgtcacccaggctagagtgcagtggttcaatctcggctcattgcaacctccacctcaccagttcaaacgatcctcctgcctcaccctcccaagtaactgggattacaggtgaacacaaccaagcctagctaattttgtatttttaatagagacgaggtttcaccatgttggtcaggctggtctcaaactcctgacctcaggtgatccacccgcctcggcctcccaaagtgctgggattacaggcatgagacaccacacctggccttttttttggaagcagagtctaactctgtcgtccaggctggagtgcagtggtgcaatcatggctcacttgcagcctcagcctcccagcctcaagagattctcctgcttaagcctcccgagtagctggagctacttgtactcagcctccgaggacctgctctttccttaacaggcgggatgtgatatgggccattaggggaatgaacaaacacaagtgggttaggatttcacaagtaggtggaaatttcataacttctggaggctgagcacacgccaccacatttggctaaatgtacttttctggagagatggggtttcgccatgttgcccaggctggtcttgaactcctaggttcgcatgaactgccctcctcggcttcccaaagtgctaggattacaggtgtgagctactgtgcccagcctacctcagttttcttaactgcaagatggagagaataacaccctcctcacaagaggacagtaaggccctcaggaggcaatgcccattaacaccacatggacaaacagcggcaggtccagaactaggcggtgcaggcaagcccctcatccacctatccagtaccccaacatcccctgagcttctgccatgggtcaggctgagttcagagctcattcacagggagcagagctctgccagctgtggctaccatgggtgaccaaaacaaccactgcctgaggcccctcccagaggctccaaacatcccatagtccaccgactgacacttgggcctgagggtcccaggtgagaggacccagctgacttggcatccaacttcaggccacgcggctgtcagagagcagcagtcagaagcacaggatccaatcctggcatgcgtgggggcagcatgtgcacttcgttgttgggcagcaacctggcccaaggcaggaccagatcccagcagctgggaccacagacagtgctgtgggaggcactcagcaatggggcttacactgacttgtgtctttgagattcgcgtgcaatgcgcctttgaggccaagccccaggctctgggtagataagcagacagcctgagactcactctcaaggacactctggtcacccagggcccctgagaatagatacgggcatcacaactagacaggagaaaggtcaggaccacaactgtagcacgtgccacaacatcagggacctggccagtggctggcgcagtaagtgcccctggtgcatctgaatgaatatggctgttgcagctttgcccaatctgctgtctcatgaactccatgtccccaggcagggtttccaagcgcctcctaacccttctgcgggagggttctggccatctcccagtaaacacacaattctccaccgccgcctgcagatttggtccactccccagcttggcattcacagcgcctggtctggcctcaacttctcaacctcacctctctccacgctgcagccacaccctctgctcctagagccgctctcatacttctgtactcctcagggcctttgctgttctgagttcctccaccttgaacatcctcccttctaccctgatcctgtcaaaacccaacatccctcaggacctaatatcattccccatcccccgggtgaaaccctttccaggctctcccatgtataccttccgacagcactttcttttttttttggagatggagtcttgctctgtcgcccaggccggagtgcagtagtgcgatctcggctcactgcagcctctgcctcccgggttcaagaaattcttctgcctcagcctcctgagtagctgggactacaggcacacgctgccatgcccggctaattttttgtatttttagtacagagagggtttcaccgtgttgcccaggctggtctcgaacccctgagctcaggtaatccacccaaagtgctgggattacaggcgtgagccaccgtacccggcctagcactttctttttttttttttttttttgagacggagtcttgctctgtcacccaggccggagtgcagtagcgcgaccttcggctcactgcaagctcggcctcccgggttcaagccattctcctgcctcagcctcctgagtagctgggactacaggtgcctgccaccacacccggctaattttttgtatttttagtagagacggggtttcaccatgttagccaggatggtcttgatctcctgacctcgtgatccacccgcctgagacccccaaagtgctgggattacaggtgtgagccaccgtgcccggccagcactttcttttcctgttaatatactgtcatgctgggtgcggtggctcacgcctataatcccagcactttgggagtccgaggcaggaggactgcttgggcccagaagtttgagaccagcctggcaacatggcgaaactgcatctctacaaaaaatacaaaaaattagctgggcatagtggagcatgcctgttgtcccaactacccgggaggctgaggctactggggaggatgaaatgggaggatcacctaagccccaggaggttgaggctgcagtgagctgtgatcgtaccactgtactccagcctaggagacccatctggggcaacacagcaagaccccacctctacataaaatttaaaaattagccaggtgtgctggcactcacctgtaggcccaactacttgggggtctaaggtaggaggatggcttgagcctaggagttcaaggctgcagtgagctaggatcgctccactgcatcctagccggggcgacagacagacatcctatctcaaaaaacaaaccaaaaaaaccccatgagttttgggacagagctgggctcaaaagaggtctctgacaccatgggatgcatgactatggtggagtcaaaactgtctggggctcaggttccttatctgtaaaataaggacaatgacagcaggacttcataaacactaaatgagagactctacataaagccttagctcaggggctggcacttgtacgccgttagctgttacattatccttattactatgttagttaagaagtggctccccgaaccagctgcaacagagtcacttggggaacttacgtgtgcagaacctccagggatagagctcaagaacctgaactttttttttccccctctttttctttttgagagagttttgccctgtcgcccagactggagtgcagtggcacaatcttggttcactgcagcctctgcctcctgggttcaagcgatactggcgcctcaacttcccaagcagctgggattacaggtgtgtgccaccatgcctggctaacatatgtatatattatgtgtgtgtgtgtgtatatatatatataaaatacatgatatataaaaatatatataacataataatatgtagtatacataaatgtatacggtatatataatacatatatataattttttttttgagacgcagtctcaccctgtcgcccaggctagagtgcactggcggatctcggctcattgcaacctctgtctcgcgggttcaagcgtctgtcctgcctcagcctcccgggtagcttggactacaggcgcgcaccaccccacccggctaattttttaaattttttggtggagaccgggtttcatcatgttggccaggctggtctcgaactcctgacctcgtgatccgccgcctcggcctcccagagtgctgggattacaggcgtgagccaccgcgcccagccaaacctgcacttttaaagctaccctaggtgacctgacagtgtggcgcaggtctgttgactggctctacgtgccaacgatatcacacaaacgctccgtgctcggtgtctcggggcctagttcaagtcccaggtcagccacttccctggaaaggccagctttccactggggataacaacagggcagcaacatcgactctgcagcgctgtaaggttccagggcaggggaggcgctcaccagccagactcatgctccaccgctgcccacggctgctcgctcacacgcgggctaggcacagcgcgaccacgtttgcccggcctcttccaggcagacggttttccctggccctgaggccgccggtgccgccgctgccggcctcgattcccccgggtgcaacgcccccagaccatgcttcccgccgggcacgcagggggcgcacggcgcccgccgcccagcccggagctcgccgcccggcccccggcccccggcccgactcggcttcccctccccggtagcgcccgactcggggctcaccatggcagccgctctgcctccggggctcaaactccgacttcctggccccgcggccggggatcaagcgtggtcggcgggtcagaggtcaaggaaagccgcagagagcgcgtgcgcgatacggcgctgggcatgcgcattgcc

SEQ ID NO: 882 - DNA, 76712 bp, Homo sapiens
atgcagaaaagaaatttattaccaagctataaattagaggcggcggggtgggcggggggagccgagcagtcacgtatggggcatctgccctttttctctgtcctcctgggcctggattttgagttcctcatccaggcgctcctttgcgcggaccacctagtgggtcacggataatcaggccgggaggccaagcctccgccccataccccttgcccacatgggatggcctattcccatcagcccaggtccattttttgaagggcagtgggtggataccaatgcttccttcagtggcaccccagggtcggggtggcctggggagacagagctgggctgcagggcccagcgcatgctgtgacctctgtgagctgagagctgtttctagcaccccacccatgggggctcctgctccttcgaagtcccagctgctgggagggagggctctatctggggtgacacagcctgagtggctggaccccgcaaagctgaagcagtcagaggggtggcagttcagggggcctccctgaggctggggcaccatgggaaagcctggcacagttttctgtgtgccaagcccttagctggccagctcccccaactaggaattgagccccaggtgagaagaaggggtcccatgacttcattcctcccagaatcaaagaccactcacctttgactgcaggtagaaggagccacccacggatttatcattcaccttaaataagtgttcatagttctgcagaggagaggggacgggtgagagggctgcagactgcaggcaagagatgttgggcaggctatgtggggccacgtgagagaggcaacaggactcctctccaccctgtgtgccacacccagctgttgtggccactgagaggcagagatggggacgggtaccctggagggcaactgagctgctactggaaggcactctttgtctctagactgtcctgcctcaggcctaaaacttcacgagcaacagtggctcccgaaagttggagtccgagctgggtgcagctgcagcctccacatcggacctccctggccaggcctcccttcactcttcccaccctggcagcctctccctctcaaactttggggtggcccagtggcctcaccttctggacctcctcagggctcagcttggacacgttgagaatctgctgtgcctcctggaggctgaggccggagaggttggaagcggctgcagaccggtgtccagcgcgtcctcgggcatcagctgcggcccggctggctgtgtggacatgtgggtgatcgctcagtcctcagcagcccacacttcaccctgggccttccgagttggtggctcacccctgccaccagcacaggatgagagacacagggacaggtggctaggagctgcctcttctccaggagtggtttcctttttagggggtagaggctgggaaagtgaggacagacgtgcctcactggagggtaagggcaggatctgaccgctaatcctggctcctggtccccaacctagaccatgagatgaccctgtcccccaacccccatatcccaggggaacagcaaattggggagctttaggctacgatggagactgtatagtggggctgcgggcatgagagggctctgcaggggcccagctgcccacctgtcacctagaccaccaaagccactgccttgggtgacctctcccctttcagtgaccccagaacctagaatcaggagctgctaaacttttcctaaaggctcagagagtagctattttaggctttgcgggctaatgagcctacactggaaccattcaactctgccttgaaagcagcctgtcggccgggcacagtggctcacgcctgtaatcccagcactttgggaggccaaggagggcagatcacgaggtcaagagatcgagaccatcctggccaaaatgatgaaaacctgtaaaatacaaaattactaaaaatacaaaaatcagctgggtgtggtggcacatgcctgtagtcccagctactggagaggctgaggcaggagcattgcttgaacccgggaggcagaggttgcagtgagccaagatcgcaccattgcactccagcctgggcaacacagtgagactccgtctcaaaagaaaacaaaagggctgggtgcggtggctcacgcctgtaatcccagtacttcaggaggccgaggtgggcatatcacgtgaggttgggagttcaagaccagcctgaccaacacggagaaaccccgtctctactaaaaatacaaaattagccgggcatggtggcgcatgcctgtagtcccagctactcaggaggctgaggcagaagaattgcttgaacccgggaggcagaggttgcagtgagccaagatcgcactattgcactccagcctgggcaacaagagcgaaaactccgtctcaaaaaaaaaagatttatttacaaaaccagggccgggcgctgtggctcacacctgtaatcccagcactttgaggcaggcggatcacctgaagtcaggcgttccagaccagcatggccaacatagtgaaaccccgtctctactaaaaatacaaaaattagcctggtatggtgtcgggtgcttgtattcccagctactcaggaggctgagggaggagaatcacttgaaccaggaggcagaggttgcagtgagccaagattgccccactgcattccagcctgggcgacagagtgagactccatctccaaaaaaagaaaaaacaagtttacaaaatcaggtatccagatgggccagtgtgccagctcctgccctggatgctcttgctaaccaggtaccactgaagaatgccccggtctggcatcaccccccaccatgggaagtgcctcaggccacgcacacttcagaaccgccaggcctgaggtgcccatggctacggggaaaatctgacctggagaggaactcccagcccacaggggagacggacccatgcttacctgcaaactcctgccgcaaggcccgtgcaaaggccctgcccaccacctgcacgcccatcacaatgatctgggccaggtacttggcctgtgggcaaagcaggcacccggttagcaggccactccctgtgggcccacagagatgggccctggaaacggctgccgaggggcaaggctcccggagacccgaggtcatgaagcacagagctgcagccccaggccaacccctccaaagcaccctgaatgaaagcttccatggtgggtggcttagttactcactggacaggcaggcaggcgggtgaacttgaccgagctcccagaggcagactggccccacctcatccttcaggaaaggcgtagaggagcaaggcaaagtggctgcaaccaccggcttcaggaagaaacactgtggtctgggagccagaacacagggacagccctggacctggcagtaactcactctcgaccctggggccgaccatcactcttcctgagtttctgagatcatcaggcccaacctttactttaccaacggggaaacagatctgtcctaattctcccaagtccgaagactttaagtccattccattcaataaaacaaacttactatgcaaacctgtttccatcttcaaggagctaaaagcccactaggagggtatttaaacacactatggaccaaatcatgagggagagtcaggctcgttcatttgtgcagccattggttcacccattcattcaaacatctgctgagagtctactctgctcagcacttgagcacaaagctacacagaacctggtccctgccccgagtcagagcacactgctggcctggcagggaaccccactgtcacacaccaggctgaacatgccggaacactgcacgtgtgattccatgccccgcagaggccctggggactcactaagatgtgagcggaagcaacagagtcgagggaaaactcaagactgagatgggattcggtgagaggagggggttctgtgtgagaggagggcgttccgtgagaggagggggttccgtgagaggagggggttccgtgagaggagggggttctgtgagaggagggggttctgtgtgagaggagggggttctgtgagaggagggggttccgtgagaggagggggttctgtgtgagaagagggggttctgtgtgagaggagggggttctgtgtgagaggagggggttctgtgagaggaggggactgtgtgacaggagggggttctctgagaggaggggactgtgtgagaggagggggttctgtgagaggagggggttctgtgagaggagggggttctgtgagagaaggggactgtgtgagaggagggggttccgtgagaggagggggttctgtgagaggagggggttccgtgagaggaggggattgtgtgagggggggttctgtgagaggagggggttccgtgagaggagggggttccgtgagaggagggggttctgtgagaggagggggttccgtgagagaagggggttccgtgagaggagggggttccgtgagaggagggggttctgtgagaggagggggttccgtgagaggagggggttctgtgagaggaggggattgtgtgagaggaggggattgtgtgagaggagggggttctgtgagaggagggggttccgtgagaggagggggttcctcctgggctgggctttgcagggtaggaagaatcatgatggaaatactagggctttctaggcagagggactgggttgagccaaaactggcaggagagaaggcagaagggagttcctgcgagcagccaatagcctaggctggcctgggaaagactgggaatctggcggatgacatggaaagatgcacagatctttgtgaaacaaagcgattatatatagacagcacatacaaaggatcttgtgactgcaaagccgtagacgcaggggggtggcgcgggctggaggcagctcggcataggttgaaagctcatgtggcacagccgagtgactttccctttcttcctagtgcttttctgtagatttgccttcagtcaacaagtatcaactgagtccacacaccaggcacggtgccaaacacgttcaattcattgtgccgtttaattctgacaactcaggggtgggggactgctgactggcccgaggacgtaacagcaggtgcctcggaggcagatcggaaacccaaggctggtgctatctgtcacagcagtcactacgcagggtcccggggtctgaaggtagggcacctgggcaagccgacaagtatcaagaacccaaccccgaggccagaggggcttgctccagattccagtggattcgactccagagctggccttgttcagcctccgaggacctgctctttccttaacaggtgggatgtcattatgggccattaggggaatgaacaaacaagtgggttaagatttcaaaagtaggtggaaacttcataacttctggatttcacagcagaaagagcccagagaagaccctcctgtgatcacagcgaggggcagggctgtggctgtactgcagatgagggagggtcagggatgcacctgatgacacctgcggtctcacctgacttcgcctccttcctaaagcccctcccgagtggaacaggaggctcagggatgggatgctggtgctgtctgaaggacagaggtgaaagtcagagggtcccctcggcttgaaacacggctcaggtctcagactacccctcacaccaacagccttcggtccctctgctgccatcgtacagccttgcaatcacttgtttacttttctgccaaggccaatgactgttgcaaaataatgaacggtaagagctgaggtcataactggggagcttccccgaccatcccctgcacacttcaaaccaaagcggcgtggtggcctgtggcttcagctgcctagagctgcagggcagaggggggctggcctgcaaagtttcagcagactggacggcccattgaggccagcaaggttcctataggaggcatctctgagaagacgcagtgtagtgtaatggttacacctgcaggctttgggatcacctgtgtgcaaaaatcccagctatctgacatagacacgttctcaactcctttgagcaacccagtttgcttacctgtaaaatgtggccaccaataaagctgagataatgcctgtcaaatgcctggcacacagcctaatggtacagcaggtgctcaataaacattggttttcattcattactactgtttcacaaaatctgacaatgaccaggcactatgaagtaacaaagcttctttcaaaatagcagctcatttgatacaggccctttgcttcctcaggggtgaaggctgcaaaacaccatactacattccctcagggagctgggaagcagcaaggaagcagaacgagaaccacgttgacctgggaccagaaccctagctttctttctcaatagctgtgtgaccctggacaaattactcaacctctctgaatctttttttgttttggtttgggtcttttattttttatttatttttttgagactgactctcgctctgtcacccaggctagagtgcagtggttcaatctcggctcattgcaacctccacctcaccagttcaaacgatcctcctgcctcaccctcccaagtaactgggattacaggtgaacacaaccaagcctagctaattttgtatttttaatagagacgaggtttcaccatgttggtcaggctggtctcaaactcctgacctcaggtgatccacccgcctcggcctcccaaagtgctgggattacaggcatgagacaccacacctggccttttttttggaagcagagtctaactctgtcgtccaggctggagtgcagtggtgcaatcatggctcacttgcagcctcagcctcccagcctcaagagattctcctgcttaagcctcccgagtagctggagctacttgtactcagcctccgaggacctgctctttccttaacaggcgggatgtgatatgggccattaggggaatgaacaaacacaagtgggttaggatttcacaagtaggtggaaatttcataacttctggaggctgagcacacgccaccacatttggctaaatgtacttttctggagagatggggtttcgccatgttgcccaggctggtcttgaactcctaggttcgcatgaactgccctcctcggcttcccaaagtgctaggattacaggtgtgagctactgtgcccagcctacctcagttttcttaactgcaagatggagagaataacaccctcctcacaagaggacagtaaggccctcaggaggcaatgcccattaacaccacatggacaaacagcggcaggtccagaactaggcggtgcaggcaagcccctcatccacctatccagtaccccaacatcccctgagcttctgccatgggtcaggctgagttcagagctcattcacagggagcagagctctgccagctgtggctaccatgggtgaccaaaacaaccactgcctgaggcccctcccagaggctccaaacatcccatagtccaccgactgacacttgggcctgagggtcccaggtgagaggacccagctgacttggcatccaacttcaggccacgcggctgtcagagagcagcagtcagaagcacaggatccaatcctggcatgcgtgggggcagcatgtgcacttcgttgttgggcagcaacctggcccaaggcaggaccagatcccagcagctgggaccacagacagtgctgtgggaggcactcagcaatggggcttacactgacttgtgtctttgagattcgcgtgcaatgcgcctttgaggccaagccccaggctctgggtagataagcagacagcctgagactcactctcaaggacactctggtcacccagggcccctgagaatagatacgggcatcacaactagacaggagaaaggtcaggaccacaactgtagcacgtgccacaacatcagggacctggccagtggctggcgcagtaagtgcccctggtgcatctgaatgaatatggctgttgcagctttgcccaatctgctgtctcatgaactccatgtccccaggcagggtttccaagcgcctcctaacccttctgcgggagggttctggccatctcccagtaaacacacaattctccaccgccgcctgcagatttggtccactccccagcttggcattcacagcgcctggtctggcctcaacttctcaacctcacctctctccacgctgcagccacaccctctgctcctagagccgctctcatacttctgtactcctcagggcctttgctgttctgagttcctccaccttgaacatcctcccttctaccctgatcctgtcaaaacccaacatccctcaggacctaatatcattccccatcccccgggtgaaaccctttccaggctctcccatgtataccttccgacagcactttcttttttttttggagatggagtcttgctctgtcgcccaggccggagtgcagtagtgcgatctcggctcactgcagcctctgcctcccgggttcaagaaattcttctgcctcagcctcctgagtagctgggactacaggcacacgctgccatgcccggctaattttttgtatttttagtacagagagggtttcaccgtgttgcccaggctggtctcgaacccctgagctcaggtaatccacccaaagtgctgggattacaggcgtgagccaccgtacccggcctagcactttctttttttttttttttttttgagacggagtcttgctctgtcacccaggccggagtgcagtagcgcgaccttcggctcactgcaagctcggcctcccgggttcaagccattctcctgcctcagcctcctgagtagctgggactacaggtgcctgccaccacacccggctaattttttgtatttttagtagagacggggtttcaccatgttagccaggatggtcttgatctcctgacctcgtgatccacccgcctgagacccccaaagtgctgggattacaggtgtgagccaccgtgcccggccagcactttcttttcctgttaatatactgtcatgctgggtgcggtggctcacgcctataatcccagcactttgggagtccgaggcaggaggactgcttgggcccagaagtttgagaccagcctggcaacatggcgaaactgcatctctacaaaaaatacaaaaaattagctgggcatagtggagcatgcctgttgtcccaactacccgggaggctgaggctactggggaggatgaaatgggaggatcacctaagccccaggaggttgaggctgcagtgagctgtgatcgtaccactgtactccagcctaggagacccatctggggcaacacagcaagaccccacctctacataaaatttaaaaattagccaggtgtgctggcactcacctgtaggcccaactacttgggggtctaaggtaggaggatggcttgagcctaggagttcaaggctgcagtgagctaggatcgctccactgcatcctagccggggcgacagacagacatcctatctcaaaaaacaaaccaaaaaaaccccatgagttttgggacagagctgggctcaaaagaggtctctgacaccatgggatgcatgactatggtggagtcaaaactgtctggggctcaggttccttatctgtaaaataaggacaatgacagcaggacttcataaacactaaatgagagactctacataaagccttagctcaggggctggcacttgtacgccgttagctgttacattatccttattactatgttagttaagaagtggctccccgaaccagctgcaacagagtcacttggggaacttacgtgtgcagaacctccagggatagagctcaagaacctgaactttttttttccccctctttttctttttgagagagttttgccctgtcgcccagactggagtgcagtggcacaatcttggttcactgcagcctctgcctcctgggttcaagcgatactggcgcctcaacttcccaagcagctgggattacaggtgtgtgccaccatgcctggctaacatatgtatatattatgtgtgtgtgtgtgtatatatatatataaaatacatgatatataaaaatatatataacataataatatgtagtatacataaatgtatacggtatatataatacatatatataattttttttttgagacgcagtctcaccctgtcgcccaggctagagtgcactggcggatctcggctcattgcaacctctgtctcgcgggttcaagcgtctgtcctgcctcagcctcccgggtagcttggactacaggcgcgcaccaccccacccggctaattttttaaattttttggtggagaccgggtttcatcatgttggccaggctggtctcgaactcctgacctcgtgatccgccgcctcggcctcccagagtgctgggattacaggcgtgagccaccgcgcccagccaaacctgcacttttaaagctaccctaggtgacctgacagtgtggcgcaggtctgttgactggctctacgtgccaacgatatcacacaaacgctccgtgctcggtgtctcggggcctagttcaagtcccaggtcagccacttccctggaaaggccagctttccactggggataacaacagggcagcaacatcgactctgcagcgctgtaaggttccagggcaggggaggcgctcaccagccagactcatgctccaccgctgcccacggctgctcgctcacacgcgggctaggcacagcgcgaccacgtttgcccggcctcttccaggcagacggttttccctggccctgaggccgccggtgccgccgctgccggcctcgattcccccgggtgcaacgcccccagaccatgcttcccgccgggcacgcagggggcgcacggcgcccgccgcccagcccggagctcgccgcccggcccccggcccccggcccgactcggcttcccctccccggtagcgcccgactcggggctcaccatggcagccgctctgcctccggggctcaaactccgacttcctggccccgcggccggggatcaagcgtggtcggcgggtcagaggtcaaggaaagccgcagagagcgcgtgcgcgatacggcgctgggcatgcgcattgcctcagtctaagggcgggccaccgggagcgtcttagcggctcggggcggggtcggaggcggggtttgactgagcctgcgtcgggctctggataactgggggcgggcttgggagggcaaggggcgttaccgggagtctcaattgcccgcgtgcttaccccagtgcgctggagcagctaagcacatcggtcagacgtggggcgatttctgcccttgattttgccaaaatatttgggaatgcaacattatatgaaatcaatgaacataatatggagtaggatgctaaattctcaaaaatactttagaaaatagaaaacttcaaaataggtttcatccacattcctcctgcctgagaagctcgttcccttcttcaaatctttgctcaaatgtcacctcaatgaggcccacctggaccccttaaaacgccgtgacttgccctccatgaatgaaaaaagtaacagctttattgagatataatccatacactgtagatttcatgattttcaagtgcacagtccaatgccttttattcacagagctgtgccactgtcaccactattagttccagaacgttttcatcacccattagtcactccccagccccctcccccagcccctgtcaaccactcatttttctctctatggattcacaggttccggacatttcatagaaatggaatcatacaagccaggcgtggtggctcatgcctgcaatctcaaaactttgggaggccgaggtggatcgcttgaggtcaggaactcaaggccaggctgggcaacatggtgaaaccccatctctacaaatacaaaaattagccgggtgtggtggcaggtgcctgtaatcccagctacttgggaggctgagtggtggatctcttgagcccgggaggtacaggctgcagtgagctgtgatcactgcactccagcctgggtgacagagtcaggccctgcctcaaaaaaaaaaaaaaaaaaaaaaaaggtaaaaatgaaaaatgaaaaaaaagaagaaattgaatcatacaatgtgcagccttttgtgactggcttatcctcccttcttgtctctatttttcttccaagactctgatcaccctctaccataccacataatttacttatttattttatttatcattttgagacagggtctcaccctgtcgcccaggctggagtccagtggcacaatcctgcctcactgcaacctccacctcccaggttcaggcgatgctcatgctttagcctcctgagtagctgggattacaggcatggaccaccatgccccattaatttttgaatttttagtagagacagggtttcaccatgttggccaggctggtcttgaactactggtctcaaatgatccacccgccacagcctcccaaagtgctgggattataggcatgtgacactgtgcccaaccggttttttatttttaaattatttttccttttttttttttttttgagatgaagtcttgctctgtcacccaggctggagagcagtggcccaatcttggctcactgcgatctccacctcctgggttcaagtgatcctcccacttcagcctccgaaagtgctgggattacaggtgtaagccaccgtgcccagccaaaaaaaaatttttttttttcaagatagggtctcactctgttgcccaggctgcagtacagtagcatgatcatggctcactgcagtcttgaccttccagccttgagtgatactttcacctcagctttctgagtagctgggaccacaggcatgtgccaacacatgtggttaatgtttgttttttgtctttttgagagcgtctccctgttgcccagcctggagtgcagtggcatgacctcggctcactgcaacctctgcttcctgggttcaagagattctcttgcctcagcctcctgagtagctgggactacaggcatgggccaccatgtccggctaattttttgtatttttagtaaagacggggtttcaccgtgttagccaggatggtctcgtgctcctgacctcgtgatccgcctgccttggcctcccgaagtgctcggattacaggcgtgagccaccgcgcccagctaatgtttgtattctttgtagagacaagggttcccctatgttgcccagtctgacctcaaactcctgggttcaagcaatcctcccaccttggcctccctttatttttatgtttattgttgagaatctgtttccttccactagaatgggagttccttttgggcaagcatttcctctctcttctctgctgttagatgtcaagcgcctggaagagcatctggcgcacagcattcggcaaatggtgggatgaaagttgggccacctggaatcctactctacaccgctgcccttcttcctcttcctcctggcctccacattcctctctctgtgcccacattgtacttccttgcctcggaagtggctctctccctggctggctcctcatcagccttcaagtcttggctcttagctgaaagtcaccttctcaggccctgaattccctgcctcgctgcatcccagttgcttcctgtcccacaggtttttttgtttgtttgtttgttttttgagactgagtcttgctctgtcacccaggctggagtgcaatggcaggatcttgactcactgcaacctctgactcctgggttcaagcaattctcctccctcagcttcccaagtagcttggattacaggcgcttaccactacacctggctactttttgtatttttagtagagacagcgttttaccatgtgggccaggctggtcttgaactcctggcctcaaacgatcctcccaccttggcctcccaaagtgctagtattataggcatgagccaccgtgcccagccagtttctcttctttactgctgtcttcacactctatatgctcgtgtgcagtctggttcccctgcataaggaggctgtaagaagctgaaggtccttgcaagaccttatctctcctgtcctttatagcatcccgccatccagagcactgccaggaacctgcatggtgagcgaatgactcccagcagtgcgcaggtgattgggccttgggaccagagtgaggctgagataaaggggagcccagggccagacccctgtcacccacattcctgtccccttccctttccagccagcccagagaccacagcagcacaagaggtggccagcttaaaaaagtttaattgctgaaaacatccaaggcaggtgcgggccagtccctgcggggctcacaccccccttattggaccatcagctctgtgatgcccccttctcctggctacaaacctgggaagtagggcagctggtcccagggccctgagactggtgctgctctagaaggcctggtggggggccagcccccaaggcccttgaccagaactggaacagcaggcaagatggggcagcgtggggtgaccaaagatcctggatgaggccaatccaggctgggaccagcccaggtcagcagtgagaccaggggagacagggtgcccagggcctgcccagggacatgctgctgaccccccgccaccctgcacccctggccacatgctagcgggcagctgatgagcagcagctgaccccagagacagcagaggtgaaaacagtccctgggaactgccagaggcccagaggatgtggaagtgcccacgggaaggcaggagtgcaggggtgacatgtgccggggccagagaggtatcttccagcttgaggatgagccgtgaggtgtgcactaggaagtggcagcacaggtgaggtggaggtgacgggggcgcaggctagtcctggggcgaaacaccaagaggtgggagggagtcaggagggcctgggaagggaggaggcatgcaccgtggcatgtgcgagggaccgcgctgcctgccgggaagtgaggccactcactactcacccactcgtcctcgtccacgccttcaaaggagtcctgggggagtgggtcctcccggttccccagttttgccaccatggcattcagcagctgggagagagggcagaagaagggtaggtaagggaataggactccctgttccctctcccactccaagaacaaccctgacaaggctgtgaaaagaactttttttttttttttagacggagtcttgctctgtcgcccaggctggatggagtgcagtggcgcgatctcggctcactgcaagctctgcctcccgggtttacaccactgtcctgcctcagcctcccaaggagctgggattacaggcgcccaccaccatgcccggctaattttttgtatttttagtagagacgggggtttcaccgtgttagccaggatggtctcgatctcctgacctcgtgatccgcccgcctcggcctcccacggtgctgggattacaggcgtgagccacagcgcccggcctttttgtttgtttgtttgttttagagagagacaaggtcttgctctgtcaccaaggctggagtgcagtggtgcaatcatggctcactgcagccttgactttctgggtgcaagcaattctcctgcctcagcctcccaagtagctgggactacaagtgtgtaacaccacacctggttaatttttattttatttatttatttttttgagacagagttttgttcttgttgcctaggctggagtgcaatggcacaatctcggctcaccacaacctctgcctcctgggttcaagcgattctcctgcctcagcctcccaagtagctgggattacaggtatgcgccaccatgcccggctaattttgtgtttttagtagagacgaggtttcatcatgttggtcaggctggtgtcgaactcccaacctcaggtgatccgccctcctcggcctcccaaagtgctgggattacaggcgtgagccaccatgcctggccacacctggttaatttaaaaaatttttttgtagagatggggtttcactggtctcaggctgggtctcaaactccatcacttatatcctcttgctttggtctcccaaagtgctgggattacaggtgtgaaccaccatgcctggccaaaagagccactatattttatttttatttttatttttatttatttatttatttattgagacggagtctcgctctgtcacccaggctggagtacagtggcacgatttcggctcactgcaatctccacctcctgggttcaagtgattctcctgcctcagtctcccgagtagctgggatcacaggcgcccgccaccatgcccggctaaatttttgtattttagtacagacggggtttcaccgtgttgcccagggtggtctcaaactcctgagctcaagcaatccgcctgccttgggctcccaaagtgttaggattacagacatgaaccaccgtgcccggcctcaaaagagccattttaattacagccctgacaaaatcgatgggtttctattgaaaaagacacaaagaagagacagggggagtaagagactgagaggctgcggcatgtggcaccagatacaagggctactatctctgcacatggcctcaagtgctcaaaatatactccaaggtcccaaaagcacttgggcccagaactgccggcttaggctgggtttggcctggccagggcagggctcccactgccctcccccacttcccgggccccatggtcagtggtagggctctggaaggtctccccaccaggctctggtgtgaaggggacgtgacatgtggctgctgtcccagtctgggttggggatggagaactaaggggccgtggccaggtgcagccaggactctgtcacctccgcacagctgctctctcccatgcctacctcctccttcttttgctggtcagacttttcttccaggtactgcgctgaggatggggcccgacgagcaggggcctctcggggggcttggctcactgggacagagcaaggacacgtgtcagagagtccccttcgttagggctctttggtgccaagccctcggggatttctttctttcttttctttctttctttttttttttttttttttgagatggagttttgctcttgttgcccaggctggagtgcaatgatgtgacctaggctgactgcaacctccgcctcctctgggttcaagcgattctcctgcttcagcctctggagtagttgggattgcaggcgcccaccacgccaggctaattttgtatttttagtagagatggggtttcaccatgttggccaggctggtctcaaacccccgacctcaggtgatccactcgcctcagcctcctaaagtgctgggattacaggcatgagccaccgcgcctggccgacctaggggatttctatggcgcagatctaagaggtggtattaacagtcaatggagcctcactgtataagccctgccctagacaccacagtgtgtgcgtgtgtgtgtgtgttaggggtggggacctgtgatgaaaacacagaccacgagccctgccctccactggctcagagactgattgacacagccactccaccctcccaaaggccagaggattctgcgtgccaacaggaatggaacttcaacctgggccttctgtccctttctccaacccccatcccgcttcctccccacacccagtccctcggtgcacctgggctcatgtcaggaggctgcaggctgagaagccagggctgcccattagcgccttgcagccaggcctcggcactgagcacaggctcccagatcacagccgtgtctgggaacacgtcatcctggaagaactctttctgcagagggagaaacgggctgtcctgagacattgaccaggtgcccagggcacacgggcatctgttggggagggacagggcaagacctgggaccctcccaccagcctggggcttccatgagtttcagcatctcagcagaagggggtaggtgtccccatgaacaatgggtagggaagtttggaagctgggtcagacgggacccaaactcccctctaggcaccgagaaggcggtgggcatgggagtcccaggtccccaccctcacccggactcggggcagccggaaggccacaggctccagggaggactgacgcagccgcaggcaccgcatcagctccacttcccgcacgtcgcactccgtcttaggcaggaggacgaggccctgggggagcaagggagtcggagctgccgctgggacctagagctcatggctgggcacgtagtctccccagggtgccggcacccctcacttaggaccaccatgcctagggcctgtccctggacagtaacgtgttgatcatgttgaacaacctgctctctggagggaaagccctgatttgtggtgttttcctatttccacagtttacaaactcccaccatgggcagcttctacgtgccacctccactccctgaatgtggtgttgggaagagatgtaaatagcacatcatcctgcatttcctccatgcactccaacacagaaacatgtgacctcagcacaaataatagtaaaattggataaattaattagaagtgataaactgagtgtttattactttggtttttaatattatttttaggttcatattgtaggttcatatagtttaaccttatctagtgcaattttttgtttgttttgtagagatggggtcttgctatgttgcccaggctggtcttgaactcctgggctcaagcaattctcctgcctcagccttccgaagtgttgggattccaggccaccgtacccggcctacagtatgatttttaataatggttgagtatgacaatggctctcaaaattcctaaataattccagcagcaactcttcttgccagtcactgggcacagccccaggcccagccccagcccaggactctgacccccgacccacaggctcctgtacttgcccacatggccaccagggggcagggcagccttgtggtcccatcggggacgaggcgccagggtggcctcaccttgtgggggtcaggcgacgtgaagctgttgcactccaggaagaaaggggactcggggagcagctcgtacaggaatacacgggtgtcgccctgcggggaagaaggcaggctgggaaccctccggcaacactggccttccccccaccacctctcacctgccatcccgccctccagcccagcccaccttgccggtcaggagcaccaggccagtgtctgggtcgtagctgggcagcagggttgagggagccacgtccaggcccaacactgccaagggtccgccggccagggcctcagcttcatataggagcagctggcgctcactttggctgcaagggggtttgggggctgaagcaggtgtttcagagctgaaggggcctggggcagggagaaggcgcccacgtagcccctgctctgttctgggttgtaggcgaggcctagtgtggcccggcaccgcagccacatcctaacctgcccctccacctctgggttccccattgactctttctcctccactaatcactcacccatccatctacccctgactgcctcaccgcccctgcttccatctcccccagagccccttgtgcacccctgcatctatctccccccaacccctcacccacccctctatccatctccccactacccccaaaacatccctccatctcccctacccccctcaccctcccctgcatccatctcccccttacccccaactcatccatcgatctctccctaccccctcattcatccatccagccatccgcccatctatccccacattcattcatccacccatccatccattcacccacctatccatccacccatctacccactcatccaatcatctacccacccacccaaccatccagtgaggggcaggaatggtttctgaaagcctgacaaatgtatgtgactgtggagaagggggacacaggtggcttctgaagcctggggatggggatgcctgagtcctcacctgtcaaagccagacaccagcagacagcgaccatcacatacccagacaatgcgagctccgcgtcctcccttgggccctgggccttcctgttgagatacatcgcgtgacacccagccagcacccctgaaccaggtctgaggccactccccagcccctgtgtgctcacctgcaggggctcagggccactccggggcctgtagacccgcacacgcccatccttgcagacagtggccagctgctgcccatcaggactccaggccaggctgaagatctgggggcaggaagggatatgagagacagccttgcttcactgctggccccacctctccccactgctcctgcccctcctcactgctggcgccgcccctcctcactgctgttcccgcctctcctcactgctggtcttgcctctcctcactgctggcccccctctcctcactgctggccccccttctcctcaatgctagcccggcccctcctcaccgctggccctgcccctcctcaccactggcccccctctcctcactgctggccccacccctcctcgctgctggtcctgcctctcctcactgctggccccgccactcctcactgctggccccacctctccacactgctggccccgcctctccacactgctggccccacctctgcagccgtcctacctggtcttggtggccctgcagcttcagccgatcagctccagcctgaaggtcccagatgcgaacagtgaggtcataggaggacgaggccagcacattggctgccagtgggtggaagcgcagggagcagatcttctccgtgtggcctggaggaaggcaggggtgatcaggagcccttgggagacactggccaccccagccccattcctgagcctgcctgacctgtgagcacagtctctggcgtggtgagcacctcttccaggccctctgcgggtacccgccacagtcggatcctggcgtcctcaccagctgcagaggacagacaggggctcatcattgctgagcccaagacctctgggctccccagcccctatccgggacccaggaccctccctcaagcccaggcacccagcctccttacccacagcgaggcgatgggggtcaaaggggtcccaggccagatcagtcacagctgccccattctgcagcgtgggcagtgccgtgtcgggcaggcggccaggcttccgtagctgtgggaggtgcccccaccccgaggcccatcagtaccaggcagaaaagccagtccccaggggctgcgggcaagcagcatgtctgggagcccaccctctgcagcagaggctcccaccgctgggtgacccaagctctctgccctgaccaccttgcgctctgagccccaagtgccaaccacaaggccccagagagtgagggggcagcagcgtgaactggcgggaaaagctccggcttagggctcaggtggccgggcttcggatcccagctccaccacttacacagctgtgtgacccgggcaggtcactaaacctctctgtgcctcttctccctcatctgtaaaatggggataaaagtggcaggccccatggcaggtggctgggaggatcacaggacaggcgggcaggagcctgacacaaggtttgtgctccctgtgttgtgtgggtagctaaggccctccgcgtctttgccacaggcagggaactgaggggcagccctggtggggtggggccctcacctcaagcacagccacctgtcccccgctgctgagcagcggcacggccacacgcagcttgttggcacagaagccgtcactctcaccaggtgtggtgaggttgagccccttgaggttggtgatgtggctgtctcggtgcaggacagtgccctgagcatggcggaacttggaactggggcctggcaggtggcagggacatggaaccacgtgtgaggatgccgtccccgcccgccctgcactctttgagtcccggctgcccactcccctcaccccaggtggatgtacagcatggacctaggcccaggcctttgctaatccagtggatgcaactcgcccaggaataatgtctggaatgatataccctgttccatggtggctcggggaatcttggtggagcccagggctttggctgctcagaagctggtggccccagccgccctcctattttgcaggtgagactcagccaccacaccccagcccccaggacaaatgaccctgccagtgagtctgggtgaggggggtgccctgcatgaggcctgtgctcagcagtagggtacacaggaggatgacggggagtggggcagacagggctcctgcggtaggggtgagctccccgtcctgcctccttacccagcaggctctgcagcgacctcaaactggggctggtcccgatgccactggtgctggagagtgagggccccaggctggagggcgtggagggcgaggtcagcgaactgggaggggaagagaaaccctcctggggaggggcatggggtcagccagcctgctcctaggtgtactggccaaaaggagggggtgccagcggactccagggtcaccactctgggccccctgcggactggaggagcccccactgtgggcatgcgacaggagcggcggggggcacgggcataaacgcagacacacagggaagcagccgagcttcagaccgcggggacagcaagtggcagctgctggctcccagccctgcaggagggtgtgcccagtgggttagatctgccagtattttaagagaagccagaaatctagatctgtatgaaaattcttgctttttaagtgtttgcccaatttagaaagcactgtgcaagttccttctttatgctccacgtgtttctctgtctctgttacacttgacaaagaaggttggggccaggcgtggtggctcaaggctgtaatcccagcagtttgggaggccgaggagggcagatcacgaggtcaggagttcaaggccagcatggccaacatggtgaagcctgactctactaaaaaaaatataaaaattggccaggcgcggtggctcacgcctgtaatcccagcactttgggaggcccaggcgggtggatcatgaggttaggagttcaagaccagcctggccaacatggtgaaaacccgtctctactaaagatactaaagataccaattagccaggcgtggtggtgcgcgcctgtaatcccagcactttgggaggcccaggcaggtggatcatgaggttaggagtttaagaccagcctggccaacatggtgaaaacccatctctactaaagatactaaagatacaaattagccaggcgtggtggcgcacgcctgtaatcccagctactcaggaggctcaggcaggagaattgcttgaaactgggaggcggaggttgcagtgagccgagatcgcaccattgcactccagcctagacgacagggcgagactcatctcaaaaacaaaaacaaaaacaaaaattaggccaggtgcagtggctcatgattgtaatcccagcactttgggaggccgaggcgggtggatcacctgaggtcaggagttcgagaccagcctgaccaacatggtgaaaccccatgtctactaaaaatacaaaaattagccaggcatggtggcgggtgcctgtaatctcacctactcgggaggctgaggcaggagaatcacttgaacccaagaggcggagattgcagtgagccgagatcacaccattgtactctagcctgggcaataagagcgaaactctgtctcaaaaaataaattaaaatatagtcggccatggtggcacatgcctgtaatcccagctactcgggaggctgaggcaggagaatcgcttgaacctaggaagaggaggttgcagtgagccgaggttgcgccactgcactctagcttgggtgacagagtgagacactgtctcaaaaaaaaaaaaaggccgttcagccggtgaacactcagggcagccactgcagtgtcgctgagggaggatgggggcggccctggtacttacgcttgcgtctgcatcacccacgggtgtctccatcaccgcaggctgggctgtgtcagggaggggctccgcagggggcaccagacaggaagtgaagctcgggtggggccggcaggcggggttgaggctgaccttctgcacctgcatggaggccggcagtggggagatgggggcatgggctgcccggtcaggagggcccccatgggagggtcaactgggtagggatggggggcacccagcaggccagactgagttggcacacagccacacggggctaccagggactcggggaggctgggagaggtgagccagccctggtcctacctgctggttgtccccagcccaccagctatgggggtcggtggcaggcacacagccggcagtgtccgggaacaggtcctcgtggaactccacagcctggccgcagacaagcaggcagctagtgaggcccaggccccccgactccccagcccccgcagtccctcgcccaagtccccctcaccttgcggggcacatggtagccgatgggcacgatggctgtgtcgctcagctgtaggacgcggagtacctcgcagctcatgacggccagcgcctgccggggcacaagggcagccccacgcagcacgctctccaggacacactgggtcactgttgaggacaccataggggaacaggcaggatgggcaggggaggggagggtaggggatgggggcgaggaagcaaggcttacctgggctcagcgccggctgctgcgggaccacctcgtaacagtacagctgcctctcgccctgaaatgagtctgaactgagccccgtttgctgactgaacccctggggagggcccaggactggcatcagctcccccacaggtccccaaggacctgagccacagaaccacagtggctggagatggggctccccaacatgctgggcgctgagctgagccctaggctgactacctcacttgctcagcctcgttgcacatggggtgagcaccgggggtgtacgtcagtatttatggagtgctgactgtgtgctgacactgctctattctcggccttgttctcaggaaggccagtgttctaggagagctacagtcaccttggctgcacaggggaagacacagaggccctgttcgagttcctcctctctcttggggaaggccaggggctggactccaggctgtggatgtgggtgggagccccagcttctcactcacctttcctgccaggaccaggagcccagagtcagggtccagcagaggcacgagacacctggggaagagagggcaagatggcgggtcagggcagtgggagggctgccagactcgtaaccccatgtaggagcccaggacaggcaccacagtgactgggagccgcttggccatccagccatgttcagcctggtccccaggaaccccctcctcttcctgagcttcccacatgcccaacacacgcccacaccccagctgctcctccccagggcctccacctgcacacctgcgtcactccaggactggagtgggcacaggggaactcgggcccgatctcagccacagctcttcctccaagaagaccccacatgcattctgtgcccctcccaccttcgacagcctagacatcaggccagcattgccagggaaggtggagaggtgaggccggaggcgaggagcctcccgtccccactcggcactgcctgtggacaggcagcatccgggagcagtgcaggcagccctgccgttccgaatctgcactaaggtttggggccctctactcagttaccccacgtttcctgtgcctcagtgatatcttggaagctcagagacccccccatgctgagttaaagttcctgtgtccaaatctgagccacgtgcccgggagaaggggctcctccggccgctgggcttccctgcacaccccaggcctgctgccccggccgagcctgccagcagcatgctcccaggccttctctggtctcgaggcaggagcagggcggggtggcagctgggaatagagtgggcgggccggaagcccccagagcccctgccactctatgtccagctcagccttggccaactgcctgtcactggccgggctttatgcctccctcccggggcccctcagagacccctgcacagcccctcagccctgtgagagctgccttcccactccagggccttttgaggggaatggggacctggaaggactctgacagatgcccagatgcccagttgccttcctgtgtttcttgctcctgatctttgcttttttttttttttttttttttaagagacacggtctccctctgtcacccaggctggagtgcagtggcacaatcattgctcactgcagcctcaacctcctgggctcaagcaatcttcccactcagcctccagagtagctgggactacaggtgtgcaccaccatggctggctatttttacttctatttttgtagaaacaaggtctcactatgcttccgaggccggtctcaaactcctggcctcaagtgatactcccaccttagcctcccaaagtgctaggattataggcatgagccactgcacttggtcttggtttcttgtttctgggacctgcaggcctggaccctcccaacccagacactgacacccttaaacaggaccccgtccccactgtgttgccagggtcagaggtcacccagctgtggcagctgcctctatccctcactgcggtgacaaagggcccagccgccctccactgtccacccatcccctcctgccagccgaccactaagcagtcctgcccacctcccctccccacacttccaggagccacagagtggctgggaagctgggtggggccctgggtgtctccatgacttcctggagtgccttgggctggtcacctgtgagtaacacaggcccctacttactgagggcccagcagggtgagccgggctcagcaatgccctttgcatcccggcctgaccactgcttgtagaggtggaggcggaggcggagggtaggggaccaaggtggtgcgtgacctggagtgccctccacactgacactggctccactggggctggaagcaagtcccttcagcagctttgacagggctttcactcattcattcgttcacaatcattcactcctttgatgagctggtctgtgcctggtcctcggctcgacctgcatgtaggtatgcccagagatgagtgcaacagaccctgcctctgtcctcaaggtgctcacagcctagcacaagaggcagacagacacaatcccatagacaaacatgtgaagggaaggttcaccgaggacacacagtgacagagcagggggactgggcctcagcagtgggggaaggggtgatccctgcgatcccaaggtcatgcagaaatcaaacacctcacaggaagagagtttcagagagaacacaacctgtgcaaaggtcctgtggcaggtgggttcatggcctgtttgaggaacaagatggacaatgtgcctgacagcctggacagtgtgggtgagggctgaggctcaggatgggcaggtggaggctagacgggaaggggcctggtgcatgtggggagggggagttctgcctccagtggacgagcaatgaaaaggtgacggtgcgtttcaagcaaaagaggctaggccaggcctagtgactcatgtctgtgatcccagccagcactttgggaggctgaggtgggagaatcacttgagcccagtaggtcaacactgtgaccagcctgggcaacatcatgagaccatggctcttcaaaaaattaaaaattaaaaaattagcgaggtatgctggctcacgcctgtaatcccagcactttgggaggccgaggtgggtggatcactggaggtcagcagtttgagaccagccaggccaacatgatgaaaccctgtctctactaaaaatacaaaaattggccaagtgtggtggtgtgcatctgtaatcccagctaattgggaggctgaggcaggagaaccacttgaacccggcaggtggagtttgcagtgagccgagatggcaccaatgcattccagcctgggtgacagagtgagactccatctcaaaaaataaaattaaaaattagcctgctgtggtagtgcacacctgtggtccagctactcggctggctgaggcaggagggtcacttgagcccaggagtttgaggctgcagtgagtcaagatcgcatcgccagctgggcatggtggctcacatctgtaatcccagcactttgggaggccgatcactttgggtcaggagtttgagaccagcctggccaacatggtgaaaactcgtctctactaaaaatgcaaaaatgagctgagcatggtggcgtgcacctggaatcccagctactcaggaggctgaggcaggagaatcacttgaacccgggaggcggaggttgcagtgggccaagattgcaccactgcattccagccttggcaacagagtgagactccatctcaaaaaaaaaaaaaaaaaaaatcacatcagcctgggtaacacagcaagaccctatctcaaaaaaataaaaatagaaagaggataggaccagactggcacagagtagggatcacactggctgctgggggcacaggctgggaggagtggaaacaggtgccaggacagaagctgagggcaagtaggataggcaggtctcctgtggcccctctgctgcccttatgagaggtgggaaacaggcctggggccacctcatggcatcagaggctcacctgtgcgctgagccaactgcctgaggaggcctggtgctcagcctccctcacccccgttccatcgtcccagccagccagccactgactcaggagctgaggccgagtgggcaggaagtcagggagggcagggctggctcctctgacaggtcaggccagtcttccttgcctcaggcagagccatctggacaactctgccaggcaggggcatcctgtctgccgtggcacgggccaagaaatggggtcatggcacccagccccaaaggttggccaagtgttggcatgggcctgaccccaggctgtgtgaagagagccaagctgggtctgggtctggaacatggtacatgagccccagccaggcagagggccagaggtggtaagaggtattgccggcacctctcctgctggaatctgggcctgccactgggaagggctctgaccctgacccaggtccaggggtctgtcccaggcataaagttatagaaggtctaaagcccagatctgcccccgcccctcagccaggtcccaggagctagaagacaacctcagtaccaactgggaggcacgagcagtttcagcctccggataagccccgccagctctcccaggactcctgtgattagcaccgaggggaagcaccaagggtgtgcttgctacaaggagcagctgcaaggctcctcctctgtcctcccctccagcccatccctcccgctcaggccccttcccaccaacccagacattctgccattgcgccagttcaaagcaggctgggtcccttggatctgtccctatcacccaggctggagagttagttaggatcctttgacccccctccacccccacagcccctagctcccccgctgtgtgcagactgctggtaaccaggttctaaaggcgggtggcaccttgaaaccatacaaggcaatgttggataaactgagaggggtctcctaaaagcttcccttgagcctctgggtaagtggggacctgtgtaaggccagggcacaggattggggcagggggtgaacaccaggcagatggggtctctccgtctacaagaacctgccacagaggtgagaagcttcaaggacatcaggaggtcctgttccttgaggaaagccaggctggaggctcttggagccctctttacccctgaccctgggcatctgtggatgcttctgagggcttcagaggacacagggccaagggaagaggcagggaaacagtccgacaagaggctgcacagcactgattggaaactcagatggttctggggccgggcaggaaactcaagtgagtggacagcttggcaggaggcagcagggagtggtggggactggggtgacccatgagcccacattttggcagagggagcaaccgccactcagccccagctgagagttcctgttcaatgcaagctgggaagccccattttaatatgaaaccacctgatttttcaatgttagcagtgccttcaaagttgtaaaaactcccataaagcctgcactaaatgcacccaaaggccagccccaacccaggaacagaggtccgcaagccatgccctaatccatgtagaccgagaaacgtatgggttgtggagccctgccagccctggaaaggggccctgtggggagagggccctgtggacgggaggtccagaaggtgactgtcccagccaggccctgcttagcccttgacggctagacacagaggccatcctgccttctggagataactgagtcctccagagactaggaaaccctccagctggtgtggcccagcctcccagggataagccttcaggccccccaaagactagagctagcccagccaagggccttggctacaggccgggctggagggggtgtgggtgtcccaaggctctccggaagtcaggagctgagctgggcccccaaaggctctgaggcatgactgaccacaaacgcggagggggaggagggcagagtgttttcctggaatcctccaaggcaggggatttttctggactagtccggcccctggcacccgcccctcctgcccaatcaagggccactgtcaactgcagcccaggccccacccaccgacggtgaccacccctatgcctccacagctcaggcttgaagctgccagtaactgtggggccgtgggcagaccaccactgccctccctgacacagccccttcatctcataatatggtggggaagagagtccagggctgctcacaactcttaaggctgtcgtggctaagaggaccctgagctcagatttggcattggagtttatacttaggaggctcttgaaagggctttgtgtgggctgccaggagttttttgaaattgggattagctaccaacaataacacattgagagatttcacctaaaaatctggatttccagtttctcttcaaaaatccaaagctctagctggcccgggctggtcatgaggactcagcccttaccagccccactcccgccatcctgcctctccagggccgcagaggccctggggtggacttctggcatttgtcacctgcctggtgcctcataggcatctgggctgtgacgcttaggattcctaaatagtctctcgctttttacacaaaaagcagaaacctgcccagtgtcatccggcaaacccacgacgggcaaggtctccccgcgcaggtcaggtggccgcagggtgagggccagggcaacccggcccacgagcccctcggtggggaaggggcgtgtctccacgcggctccgccccggccaatggggagaggccccgcccctgccgcggcgggcccgccccccgggactcttaaggcgcgacctgcctccagcgagccgactccggagcccgagcccggggcgggtggacgcggactcgaacgcagttgcttcgggacccaggaccccctcgggcccgacccgccaggaaagactgaggccgcggcctgccccgcccggctccctgcgccgccgccgcctcccggtgagtttctgtggggctggggggctgcgggcggggaagggggcgccacggccaggctgtgcacacgcgcggggaccgccgccgcgcgcacacacgcactctcgggcgggaccgcggccccagccccacacggtcacctgggccgcccggcgggcaggccctgtacgctccctcccccgccgtcctggggcgccgacagccccgcggccggccagggtgcgcgcctgagtgtgcggtgagcccgcgaggctgcaagcagacaaaataaacaccccgtcccatgcttcctcctcccacggctgggcctccggcatgaccagttttatgaatcaaacccctttgagggggatagccaagccacaggcttgggtcacttttccctcctggggtccggcagtaggtgctgctgtgcagaagggctgcccggggtcctctggacccttgtcactcaaagcacagctgggggctacagatatgcagccctagggaggggcggggagtggctggtgggcgtccgatgcccatccctccaggtgggggatggacctgtactggccagggcccttagagcttcgggtatcaggcagggtgccgggtctctgcctctgccagggaaggggctttgcttgggctgcaaacccagtggcctggagccagcctagtcctttgtgtccctgggctggcagtgctggggcctgaggactgctgaggtcccctgtggtcactggcaggccagccgattggtgccaaccattctgcctctcccccattcgttaacgattgccacaccagggtcactgaccgcctcccctgctgtggcccaggggtggagtgtgcagggtggaaggaagaggtcctgggggtctaggtgtccccatgcctgccttttgcaccaaggacaggtgaggctctggagagaggcagcgggacctagagcccccttccccaggctgagagcctccagggctggggattggataaaatctccaaggtcccttcacactagactgtactttgggtgttgagggcatagaggggtggccgggctgggaccttccaagcagggtccattagggccagtccagggggcagcaaagtccaggatgggcccagctattgacaaaaacccaacagagctggggcaggcgggtgggggatggggagcagtcccctgagtttactctcttctcccaggggagttggcctggagcttctgtaaacagagtgtcagaggcaggaagaggctctggtgatgagcagcccagctggatcccctccagaccattatctagcctcccctgggcctggggagggaggatgcgcacacacatgccagcctgggggccgggcactgcctgtccccaccccgcccctgtctcctgcacgttggaacagctgtcctgctacctgtgggtccggagggtcagatggggatggggctgggggctggggtcccagggcatttgtccagatggcacctctctctccatattctgggaatgggagaatgggattcagcataaggagcctctcagacactgcccagacctgtgcttacccgaggaaggcccctctggcacgcagcccaggggccagggagatggcaagggagatgccccgggcaggagatgggtccgcggctcctagctcccattactgtcacccccactgacagccccgggggagctgggacaagtcccaagtacagaaaattaagtccttgcctgggcttataagtgggtcccaacacaacactgggcagcctctgggaacaagaaagcagggccctgctgagcccaggagggagctcccacctcagcaggccagacagccagtcctgccagtgagcagaggtgtgtagaggggaggctgcccacagggatggctatccctgaccactggccagccctgagctcatgggagggcagcaaggccacctaactctgttagtgacctctcctggaccccccatcagctgcccttagagtcccctccctgggctggggagcccaaggctctgtgctgccaagaaaaccagctcccctcactgctgtggaatttgcgtgagttcttggagaagggggagggtgcacgtgtgtgtgtgtgtgtgtgtctgcaggagcactgcccagtgggcgtgtgtctggcgtgggcgtgtctgtgtgcgcgtgactggagcagggctgtgtatttgggggtgggtgggggtgtttgggggagcctgcttgcaccaggaggggcagggcctcagcctccttccttttatcggtttccacattccagagtcagccggatcgctttccctccgcgctgggccgccggcctcccccgcttttcctcattccagcctccctgggtgtgaggaggctggaggaggctccctcaggccacctcggttttgggcagggggtgggggcaggcgaggggccagttattcttcagggttcgggacggcccccaccagactcttcgtggggaatgcaataaggttctgacattcctcaggggctgcctgagagatttaattaaggagggaggagggagccggcctacaccgggaaggggctggggcggccgctggggcccctgctggccctgggccccgagcccggctgggcattgagagcagtgcgggggcagggttgtggttcagtggccaggtcctgttctgcctccctgaatccatcccgcctgcccattgatcagctcacagaccccaggggcgccatttctgccacgggttggccaagaaccctgggtgattgtggggggttcggcatggggagcttgagaagggcaagaccccttccagggccacttccttctcagacccccaggcccaggaagcttagggctggcggccttccttggtgactaaggtgttcttctggcaagttcagggttaattgcaggttagggccttactagatgggtgcttgcccctgggtggggacagggcagtgaggaggccccgtgtgagggcccagccctggtggcatcacacctgccgcgtgccgaaagtggcatctggactggcccatttctagttgggctgcagccactgcacagctcccagggccacaggtgtcctccctgacaggttgcacctcttgtgactacgatggcacgtcccaccgccccaggggctcacttgagctggggcctggccttagtcactggtctccctgccctgggctaacaggtctggcagctgccaagtcacccacggtgctactgaaggcacccacctggggccgggccagcctcctgggtggagggaggagggaagaccctgtgcctgcccctctcccagccctgccagctggtccacacctgctccaggatacagagcctcctccctgcacaggaagacgagctgacatcctgactgtcccctttgcaaccctctgtcctggtgttctgaaccctggctgtgcggaggactcgctcaaggagcttctccaaaatacagctctgcctgggtctcactcctagacattctttttgtttttgagatggagtattgctctgtcacccaggctggagtgcagtggcgcaatattggctcactgcaagctccgcctcccaggttcacaccattctcctgcctcagcctcccaagtagctgggactacaggcgcctgccaccaggcctggctaatttttttgtatttttagtagagacggggtttcaccatgttagccaggatggtctcgatctcctgacctcgtgatcgtcctacctcggcctcccaaagtactgggattacaggcgtgagccaccatgcccggcagaatttcttgtttaattggcctgggggtggggccccagcatggaggttttttttagaaagcttcctggatgattctgatgtgcagcccggcgggcaaagccctggcgtcacaggtgggagacggaagcccagagaggggagcttgcttggatgaggtcacaaagcgtgtgagtgcctgactgagctcctggctgtggcattatctgtggaatgaagagcgccagcttggggtggtggatggagtaagaaagaggctgacacccatggggacccccgctcaatcaccagccaggggtccccgcgcctatagggagggtctacctgccgcagtccctgaggaactcgaggcccagccctctctgccccttctgtgagggcccacgacccctgacctctctgccctgcccttgggactgctgtgtcccaaggaaggggagacggggcggacccagccgggccctgagcctcctcggacacgtcagcgaaactggagccagccgtcctggccgccggcacagtcccgcctgcctggaggggttggcagactcccggggctgggctgctgccaggcctgaccggccacacagagccttggcgggccagcatgaggagcgggggcccggagtctcagggtcagacctgcagcgcctgtcctgcacccacgctgaagcatacggcacaggaggggcgtactggcctcagactgtctatctgtctgtccaagcctgtcccctactcagcaggcacaccgcctgccccagaatcagtgagatgttctcgccaggggctgatgtggtcaccagatgcctgggtcccaccccagccatgctatcccctggcccgtccccgcctgaccctgggcgtgtgtggtgtaccccagaggtgggtgggcgtccccctgggagttgagatgacgagtgccttgtcctccttactcatagggcccctccctgaagtcctgtgctgaaggggccgccaagggacagctcacccaccacgtgcccccttccagaaccagagataccccacccccgctccccagcccccagggtgaagggcagccttggtgtggggatgtctgatctgtgtaaagctggcctgaaaccctctcccttagtagtacccacgcccagggggcaggcagagttctgcgtttatgagtgacgccctccgcagtgaatgtttaccgaccacttggcaagtgctccgagcacagaccaagtcaccccagacacaggcaccacgagcaccacgagcagcgcccactgcacaatgggggctgaggtaggggtcgtggccgggctgtggaccctgtcgccctatgccagttactgtgccagggagggagcaaggccggcagcagcactcagcaaggctgaggaacttgggtggaggacggaggccccagacccttgcgtcatcttcccaccccccgacgtccccgaatcccaggaatcccagggctgcctccggaacacctcctgcaccaggcagaggaaaaggtctcacctccctgcctgactagtgatcaaatatcaaagcccaggtcctgggatcaccgggtgggagggtgggtgggcggcggcaaccaccgtgtgacctgtagacagcccccagccccacgcacacaccaagcacacgcccagaccccaggcgggcgggacagctcccagaacttgttaaaagaacttccccatttgaaaacaaacagaacaacagaaaactacaactccagagggtgagggggcagggctgcttgcaccaactccagaggtgagaaactgaggcccacagttgagaaaggaactctggcctctgtcccctgccaccgtcccctccacagtcagccttccctcgctgggttcctctcggggctggctgatgggttctcagtgccaggagtccctggcggtgccctcagagctgccagcctgtagcttacaaactctggggttttccaaagctccagcgctgcctcctccctcctccctttgatgtgggggtagaattggggctcaggcaaaagagctcaccgcacattttacggggctgggaagcaggctggctgccgcctgctggatggtcagcccaggaccccagcccacagtcctgacctagacccctgtcctgctaacaggaacgcacattccacagctcactacctgtcagccggaaagccaccctgtggccagatggacccacagcatcccctctcccttcacaaccttgctgattaaagacccaacagattacggagcccagagctatggctggtccccctccccagtgcagggtgaagagcaccccccagcacgtgcccctaagagctggcctgcacacctggccttgcagggctgaggactccacatgcatcccccactgcagccctgaagtgtcccagatactcagatgaagaaaccgaggtgtgagagcaaagtcactgtctgcggcctcacagcttggacacctctgagcacagggccgcctgcctggagtgagcgctcttaactgtgaccttaaacgaggcccaaggggagctgcggccacagtggtggccaggctggccaggctggccacgtggaggatcccctcccactctggaacctggctgcatccttcctgaccctggtctggccctgctgggagggctaattcaggcagaggtggcctcaccccccatatggacatggggtgggtgggggtcactcacagcccacatctggaggccaggccgcacccgccgtcctctgagtcagtgagggtggagcgggtcccatgggggaagagaaggctaggggtgtggccccagggccttaggtcatcagacacgagcccccctggggtgggctggccgggccagggacgcgtgcctggggtttggggtgctaacttcttccagtgctcagtgccaggccctcctgggctgttcactcagcagacctgagctaagtgggcctggagacacctatggcaaaggcaggctgggtctcaccttagggaggtgagggggcacacgacagcaagggggacaccgctaggttggggaggcttagcctgctggcctctgaagggtgcttgttgtcgctaactggctaggggctcagggtcggtagctcctaggggagacgactctggcagtgcgatactacacgtgggcagggcctgcgtgggcccaaccccggggacaagggcttcttccttcacctcgagctacccgcagaccccagtggtcacctcaccagtgacttgtctaatctgtcctgggaccacctgctcctcctcacattccaggaacccacgtacctgggggagagggagccctatggacgggtccccccagcctggggcggagtgcaggctgggtcggggtcgtgttccctggactacctgcacagcctgtgtgggggaaggggaagcccggactccagcacaaagggctcttgtgtgagctgcaggcgccactgggcaggatgcttcctggggatgggctggcaccccgtatgaggctcagggacttctaggggtgccaaagtggggagggctcttcctggggacggccccagcggtctccccaggagtctaggtgatgggggccagccacagacctgcctgacttgggcagtgcagctaagatctggagcctggagcggctggtgggagcccccgcccccagggccatctggagggcacgcacccttcacaggtggctgctgcacacctgggctctagctcggacttgctggcaccgcaatggcagcgagtccctgcacctccatgagccctgctttcttctgtctgccctgacgtggctgctggggggctacctgaggtgacggtaaacacttagtgttccttcgtccttcccacttcgctggcacatgggaaggacttgcaccatcactgccaaggggatggctgctgctcatctttcttggtgcccagctcagggcagaccccaagaaacagtagacgaagccgggcacggtggctcatgcctgtaatcccagcacttttggaggctgaggcgggcagatcacctgaggtcaggagttccagaccaacctgaccaacatggtgaaaccctgtctctactaaaaaaaaaaaaaaaaaaaatacaaaaattagccatgcatggtggctggcacctgtagtcccagctacatgggaggctgaggcaggagaattgcttgaacctgggaggcagaggttgcagtgagccgagatctcgccactgcactccagcttgggtgacagagcaagactccgtctcaaaaaaaaaaaaaaaaaagtagatgaatgactctgcagagttttcccaggcctggcactgcccctggggctgccatgtagccagtgtccccacctgagccctgtggccccccagctccagctctgtcaccagcctcagctccccgcctccctccctcacaggggacacctgccaatgcctgtggcctctgcccctcctccaggaaccttcccgccggccacttcctggcggcccgcagcccccagcctaagcaggtctgactgcccaagtggaaaaacatggatcccatagtttccatgtgaagtcttcccgctgcattccctcctccaaggagggcgggacacggagcgtggcagcaggagccggcggccaaggcagccagcttctctgcttacacacccacccagctgcctgcctgccccctcttccagaccctgtagggaggagctgccgctccaagtcccaccattctctccttcctggtccatctctgaggcaggggatgggggaacctacctaggcagaggcaggagggcctggggttcaggaggaagcagtgcatggtcactgcacgttcagtggatgtcatgccccatgatgacctctgtgtgcattgacaaggtcacacagtgagggagtgacggggctgggacagaacctgggtcggggcactggcgacctgactcataaccattgggttctcttgcatttgggggcagaagcagtgaattccctctggctcttcctggcgtgtctgccttctaggcccctgactcacagtcttctgtctctgcctcctctctgctcccagggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacagccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagagccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccgtctcacctatcgcaacctatcgggccctgataagcggctggtgacgctgcgactgcctgcctcgctcgctgagtacacggtcacccagctgcggcccaacgccacttactccgtctgtgtcatgcctttggggcccgggcgggtgccggagggcgaggaggcctgcggggaggcccatacacccccagccgtccactccaaccacgccccagtcacccaggcccgcgagggcaacctgccgctcctcattgcgcccgccctggccgcggtgctcctggccgcgctggctgcggtgggggcagcctactgtgtgcggcgggggcgggccatggcagcagcggctcaggacaaagggcaggtggggccaggggctgggcccctggaactggagggagtgaaggtccccttggagccaggcccgaaggcaacagagggcggtggagaggccctgcccagcgggtctgagtgtgaggtgccactcatgggcttcccagggcctggcctccagtcacccctccacgcaaagccctacatctaagccagagagagacagggcagctggggccgggctctcagccagtgagatggccagccccctcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttataagagatcctttcccatttattctgggaagatgtttttcaaactcagagacaaggactttggtttttgtaagacaaacgatgatatgaaggccttttgtaagaaaaaataaaagatgaagtgtgtttcttgggctcagccccagggtagaagggctgggtggagggagatgaagaaggagtggccctcgctctggggagccagggcccctcagcagcccctgggcttgggcagccctcccaggtgtcctgacctgggtgccatccaccctaggcttgaatgaggtgaggctgggcccaggtgggagcagggctgcctctggcctcggacaagaacgggtcagggagcctcaccttccccaggccctgtcttctgccagcaggggctctggcccatgtgcggctgggagaggcttgtggcacatgtggggccaggtgagtcccttgtgggttggtctgatgggcagttcactgcctgctttcctccagggacagggccctgggctctctcattccaggcctcatggatggtcccgggagcaagtggcctccgggaccttctctacagcgtcccgggagagccaagcggtttgcatggccccagccccatgccactccactgcccaccatgggcgcagcaggaaatcctgctccctgcctcctgcccctggctacagcgagggctctggtgggaggggaagtgtgaatcatcaaaggcagggaccccatgggtggggagaaaggggccgagccccagtgagcaggacaagctgggggacaggaacaaagggcccaggttggcttgcagacggtgccaggattggtggccttgggatgccccctcagcccctgcattagggatgtgcccaggctttctggaaaccctagaagtgggagcattttccaggaaggctgcatgctgaggtgggggcagtgatgctgagtgcagctgtggcctggactgggtgcagggggcttggggacagtgatggacacacagcaccttttcctgttaccctcagtgggatggaggggaggggacccactgggctgccgctgcaggggcacccagaacatgctggagtgagcctcctgcagaccccatgccactgtcccacaggtcatggccccggcccccagcactcaggctcacccctggtgggacagagtcagcccagccagacccagggagcaggccccgtggcgcgggtgttgatgtcagtgccgagtcaggcccagccacgcgaggctctggattcaattagcggctgctgagggctctggcacgaggagggaggaggcgggccgtgggtcatggcgggcagtgggtggtggcagtgggcctgggtggggccccttcttcctgaggcagcggcggcagcccaggtggatttcctgtaggcctgggtcccattaggggagtggctgcggccaggcctgcctcccccggcccgtggctgcatcgtcaaaggggcctttgtgggcctgaggctgctgctgaacacggcggctgctgaagaaatgttttcactgcaaagcaaacctggccgagtgggatggtggcagggggcagtggcgggggggtggcagggcccaaaaaaaggaagccttccctggaacagtgtctggagtgtgccatcagatcagggcttcggggaaggggagaacccagccagggggcgaccaagctgagatgcagcctcgacccgggacaagccccccgactctaggccagggaccaggggcagacgtgggggtgtgcgagcccccatcaccaggtgctgactgcagcaggccctgggccatgtgggtgacacatgctcttgtttcatgcccggcgacctcgtctattgaaaaggagtggccacagggagggaagacaacatgctcacagtaagtggagacaggaccccagcacctgctccccagccacgggtggggctgccggccacgcgggagggcttagggccactgtgagctacagaagcaatacaccctacttctatgggggtagggggtgatacagttcacccagccccctcacaggcattcacacactcatccccgctcaattcacacccagaagcgtggcacccaagacaggtgtatctctgcatctccaagaccaaagcatgagctgttccttcagtgcaggctgccagtccctctcgttatccccccacctccaccctgcgccaagcatggtaccaagcacacaaagtgctgggcagccctccgtggaggctgcctgagcacagacaggaccttggtgttcgaggctggcctggctcccagcccctgctcctctcactgtggctggcttccccttagatactccacaaatgtcaggggaagggcataggtgggaccacagcggaggcccctgggtgaggatgaggaggggacggggtgtgtgcacgaaccctggcctcctctagctctcataagggcacacactgttctgcccaagccaagatggaaaatctgtaaaacagaagaactcgagggtggtggagtggatgcagttgccaacctccccattagccgtgcccacagatgacactccagactttccatgctcagcctagatttgctcagaggccccggcaccccagggagttagtggggggctccagcttccaggacgcctgggggtgcaggggacctgccacctctcagaacagctggggggctggcacacatccttggcatccaccagcttcatgggggctggcagagcaggggccagggctcgggggcagaggggagaggaccctagcctggccacccatctgggagtgatttgagaaattccagtcctcactggtccttcgaggctattcttaactgtggtaattacagggtcagccttggccagtggcaccgtgaggtctgggcatcattaactcctccagaggccacactggggccgggcaggagacgctttcaggggatggggaccctgtcactgggggcagagcctggaaggcaggaagtggtgggtggaagtgactggtgccaggtcccttcacacaaatgcctccactgggggccctgcagggaaggggctgtctgacctagaaaggtctagaagacaagatgccaggcagctccgggcctgggatgggggacatggggccagatcctagacgtggagtctgaaggcccgggagctccgactcctcaaggcggggcgggtcccactgactcctccctgaatctccaatgcccagagcaggcaggaggctgagggcagccctgactctgcctcttaccctccatatggcttcagggaaggtgccgaatcttgctcacctttgcctccctcatctgtaaaatgggccttgccagcttctcagcccctccctgggtgtgacagggtgggaaagggcgtcactgtcaccctgacccctacccctcctctgggcggctctcagcccggggaagcccttggcaggagctctcgctggtactcaggtgggagctcttctggggactccccggaagatcccgcagccttccttacccccagacacatacccttgctgctcccagagcctggacaggtcactgttgcctgtgactcagtttcctcagttatgcaatggaagaatgaataagcttgccaagtaccacccctttcctggctctgacattctcggatccccctgcctgtgaagattccagcaaggcccttataagtcacggttgaagtttcagaaggcggatggagtccctgtctctccaccccggccctgcctggctacgtctctgaacaccccccccagcctcagtctccccagctgtgttgtgggtggtctgaacagatgagtcactcataaatgcttgccctgggcctcctggtgtctggctcctgagccgcagtgggccaaggccatctcggcacacagctgactgtgcctggccaggaccccgccaggcactgccaaaagccctctccacacacttctgggggcagatggaaggatgaggtgcacctggagccccccaggctgcctgggcaccagccccacctggggacatacctcaggatagaacaggacagccatgtggctggtgtggagtaggccgcataaacctcagtgggccgcataagccaaggcccacctccacctccacctccacctccacccccacccccaccctgccaggctgtccaacaatgcccacgtccaccctcctatcatagcctggagcctccctgggcctcagccctgccagaacatccacagaaaaatgaagcgtattcttgcacttctggatcacaccctctccctgaatgccaagcatacctgtgtcaacccccagccatgaaacctctggtgaccaagggcccactctgctaccaggggccagaggggcacctgagcacctgctgctcgtgacatctggaagctccgggggtacagggccaggtgtctgttgcaaggccttgcagcccagatcaggtaccccagaacaccccggagatcagcccgcctcactgacaggccggatcaggtgccctcacctgcggcgccttgggtcatcagccccccagcccacctgcgtgccgcagctcctacccaagcgaggtgtccaaggtgagggaggccagggcgctggagaagaaccgcgtgtcccacagcttcacttcgcgctcacgcatctgcagggagggcgagagaggggctcagaggggcctgtccctcagccccacccggggggctcccagggaaaccagcgcctgagggtgcagcctgacacggggcacctgccccagagcagggcttggagtgggggtgggagtcaccccagggaaagagaatctgggttttcatgttctgcccctttaagaacccttaggtgacaaaggatgaggggcggttccctctgtgttctcgggtccctgtagggccactatggctcctggggtcaggctgagctattacaaatggaatctgccagttttcagcagccgtcagtcccctgaggctctgagacccggcagcacagccaggccgtatatggacaggcctggaactggccctcagtcccccgcctcccattggtttcgtccccgcccaaagggctggacatgtccccacctggccgtgccctgctcctccaggaggaaccccctacctggttgaatccagtagacacaaggtgctcccaggtgcccatccatgccagccggctatccctgctgttctcatgggcctgcgtgctctgcaggaggcaagaggtggacctgagcccccagggccctgctggtgggcggggccccctggaatgggcctgagctggggaacttctgctgcccacctgcctgaaagcctcacagagggtgggaagggctgggtccttctccacgtccccactgggaccaagggtggtctccgaagcaccccggggatcagccccgcctccgccccagttgagggcagctctgcacccagaggccaacctggctgctcctcccgagtgtccctcctaccaaggagagggctgcctcactccccagctccaggccccttccctgctgcgccaggggctaaaggcactggcactttcttgcccctaagagctgtgtgatcctggggatgtcacactctgtcaatgcctcatttctctcgcttgtgtaaggggctcacgatgcggtgccacccgcttcccagggctgtcaccatgtggaagggcagggcttgtggcaaagcaccgtgtaaactgggggatttcgaggatcactgtggctgccccaggcaagaggcagggcctgggacccacctctgggcaacgtccagagagcgccaagtagtgcctctcctggccctcccgaggtgctggagctgccagcaggaaggctcccggcccctgggaggagagggaagctcacatggtgggtggggccctgtcctcctgggccctggcagtggggagctgagggggccagaggaaatgcaaacagctcctcccagtcaccctggcccctggagcctgagacgaaggaccctgttaccaaaaatagctcaccccaaaccatggccagcttcctccgaacttcccacgatctccttgggaatgaatgagggagggaagcagcctgcgaggagctggcctggggccccctccccagcccgtggaggctgactccagcgtgggagaccatcggaaacggctccaggtcccgtccttcgaggggcttttctcactgttcccttcccaccaggctgtggccggcacaggaagttggggctggagcctgagaaccaaggccccactgccctctctccacgtaagaggggatatcgggtcaggacaagggtcgagccattggccagccctgccctcaacacccggagagggtcacagtgtcattcaggctcctgccctctcgttggtgtttgttgtgcaaatatctgcgtgtgtgcagcccaccaggtggctcttagcttgtccaaaagtcactcattcattcaagaaacacacaaggcctcccaggggccagaactgtgctaggagctggcagtggggccggatggttctcagatagagggcaggtgctggggggaagcagtgcccctcactcatctgttctctcgtcatatgggtatttgagccacacactattcgagatgacatggtgaataaaatggggaaagtccctgtgcccgtggaataaacacatcggggaggtagatgtaggccaaagagaaatcagtgtgtcattccctgtgactatgcatgccatgggggagccgcacggtgttaggggaggaagctctggaggtggacccaggagagccccagcctggccacctcccttggtgggtcagtcactagctctgtgcctcagtttccatgtctgtaaaaagcactgtaacagaatttactttttttttttaacctttcctatggtgctgaaggacctacttttgaagacggccacaaggagtaagagggaacacttgtagaaggctcaggattgtgtctgacacgtgtcaagtgtgcatgtctcacagctgatagcagggtaccgccagactgtaagtgagggaagacctagcgtcattcctgctaggctgggagggttgataggcgtgagccaggtatgggaactggcatctgcaaagagttggaaactggaagcagagagacccgctcagccagcaggtggggacgagggaggcggaggctgggccaagcctgcagggtcccccaggggctgccactgagcacttttcacctaggggcacaggctaaggctaggggtgggacgcccttggcctgtagctcccaccttcctaattcacatgtgggaagcctaaaggcacagagagacgaagccatggtgcaaagtggcttggccccagctgtctcctccacctgcacaagatggacgtgaggctcagagtggtgatgaggcttgcacaaagtcgcagctaggaggcagcagggaagggaggaggagccgcccaggaccacagctgccccagaaacgctctgcttccagcaaacatcctgggccagctcttgctccctggagcattcagcccagccttcagaggtccaggtaagagctttgtccgtgcccagccactccccaatgtgggtacacccagctcagtttgcccagagaccacaggaagcccccaggtgagggagggggtcagtggcccaccccttaccctgtaactcctcatcaatggagtgatcaccagtatcaaaaatgagaggtgggctgggcgcaatggtacctgccgtaatcccaacactttgggaggctgtggtgggaggacggcttgagcccaggagttccagagcagcctgggccacaaactgaaaacttctctcttaaaaaaacaaacactaggccggcacagtggctcacacctgtaatcttggcattttgggaggccgaggcgggtggatcacctgaggtcaggagttcaagaccagcctggccaacatggtgaaaccccatctctaccaaaaatacaaaaattagctgggcatggtggcaggcgcctgtaatcccagctactcgggaggctgaggcgggagaatcgcttgaacctgggaggtggagctcgcagtgagccgagactgtgcccctgtgctccagcctgggtgacagagcaagactctatctcaaaaaacaaacaaacaaacaacccaactagcttgacgtggtggtgcgtgcctgtagtcccagctaccagggaggctgacgcaggaggattgcttgagcccaggaggtcaaagctacagtgagccgtgttggcgccactgcactcccgcctgggcgacagagcgagacccgtttgccagcctcagcaagcctcagagaagagccgtctccccagctcctcattctcctgcatagggggcaagaacaggggctgcagctgggacccaggcatcctgctaccctgcagccccaagagggcccccaccacctagctctgagaataggaggggctgtggcagggcaggagcagtgtcagccccgcagggggtgcaggaggggaggcgcgtgcccgccccttcatcaccatggcgacacttcctgtgcagggcaggatggttccaggagcagccctggctccttgctggggtgaggggacctgcttcaatagtaagaccccccacttacccccttccctcctctgaggttcaccaccccccactggcctgtctgatgcactgagattcctagagggctcaatccggggccccctcccgcccagacaagggttctgaggcctcgacactcatttggggctgccactttcccagaacagcctgggctccagggcctcacccagccccagctgggccggttgtaaagggaaggggcggcagtgggggtcctgggggttctgcatccagaggggcgagcctgcctctgtcaccctgaggtgggaccatggagaagccacagaaccatccgactctcggggtctgcacctccgaggaagtggaatatgccaagtgcctggcgcataacaaagggtcatacatgcagtataagaaccaagcatgggtgtgaggaggagcctccccagggtcccctgctcaaagctcacgcctgaggcagggctccaacaagacagtggagggcggactccctggcccactctgggctccgggatagcaccagggctcaggtggggtgggacccacagaggacagaggttggatggagggcaggcggccccgctccctgacccccagccacaccccactaggcaggaaggaggattgccagagaaggagctcccagaaggcctctccctcgagccggcccctcggctcacaccggccctggctgccagcagcggttttcctaatagaagccaggtgtgggccagatgccctgggcggaagtggggggcagggccacacggagagcggcattccaggcctgctgcccccgcaccagggcccgagcacaggccccagccagcagctggaaggggtgggagccacccacgctcttcccaggtctcctcgccccaaagccccgcaggggggctccctccagaaccagatcctctccctctctcttcgaggagctgggagccccttggatagcagccactctatccccacctcggcatcagtcaccgccccagccctgctggaagaggaggggagaggaggaggaaggctggaaagagggggcggaggaggggagaataggaagaatcacgtgggcccagtgagctggctcagagccatgcccggtaggtcgggggcagaagcataggtgccccagcagtgccctgggctctggagaggagagtgcaacctgagaaagtgaagggggccgggggaagcctctgtggcaccttcaagctgagcctgggccccgctttctgggcaaaggcttggaggtcaaagaaagctacctagtgaggataccgtacacacccacactgccttgagatgcagacagccaccatctaccaggcccaggtcccacatgacgaagaggtcagccagcctcaccagcaagtacgaccagggtgtggccaaaaccaccctgcctggctagtttcactgcttaaatgggagtcctctcggtcttcagctggacaaaagtggaactgactgtaccgtttggactaaaaagctgcaatcttccatgtgactgggtttctctcctgagtcttgtgtgtgtagggggctctggggctccgggctaccactagtttggtttgggctggtggtttgcccttgaccccgggtggggaaaacgtcctagaaatggggagggggtatctatgatgggcctaggtctttgctggggagctcctctcctgagctaacagtaggaccctaaacttcaccttcctcagggaataagcctcctcagcttctagaaagttctttttagaaatgtaaatccatggccaggagcggtagctcacgtctgtaatcccagcactttggcaggccgaggagggtggatcacaaggtcaggagttcgagaccagcctgaccaacatggtgaaaccccgtctccactaaaaatacaaaaaaattagccgggcatggtggcgggcacctgtagttccagctacacaggaggctgaggcagtaaaatcacttgagcctaggaggcggagtttccagcgagccgagattgcgccactgccctccagcctgggtgaaagagcaagactccatctccccacccaaaaaaagaaatgtaaatctactcatcgcacttcctgcttaaaactccctaatggtggccggacacggtggctcaggcctgtaatcccagcactttaggaggccaaggcgggaggatcacgaggtcaggagatcgagaccatcctggctaacatggtgaaacccagtctctactaaaaatacaaaaacaaaaatagccgggcgtggtggcggtcgcctgtagtcccagctactcgggaggctgaggtgagagaatggtgtgaacccaggaggcggaacttgcagtgagccgagatcacaacgctacactccagcctgggcgacagagcgagactccgtctcaaaaaaaaaaaaaaaaaaactctctaatggcttcccacagcccaggtaaccatgggcccgtatcccccagcgcccctcgcgcagacccctcagacaagcccgtcctccttcaggccatctatgtctgcccccttggcattactcaggcctctgctcccgggccagttactcagggaagcactaaaccagcccagcaagagaagcccccagcaactacctgcctagcacaggcaatgtttacggagccagacacagggccctgtcccagggttgttgctcctgcctacaaggtctctgtagggcaaatgaacggtgtcccagtggctggatgcctgcagcatgagccaggtcccagcttccccgcttggaactgaaatggccacgcacactccatgcacagacacaaaccagaacacgctcagtccctggaccctgtacgttttgacaggtcccacccagggtcttcctgcagaggacaggggttgtttctttttggctcctctgcagctggtctctgctgaccgtgccagggtgaaggtctcaaaggaaggaagtgggaatcccagatcgctgcctgaagccacacgatggcctccgtggagagcctgggggaagcttagcttctgccacccggtgatcaaagccaggccctcccaggacccacaacacacttcacaggaagagctcccagcagtggtggtccacctcctggggacccctggtgctgcagaacatgtctgccaggaccccaggcctgcccctacctccacctgctagaaccactgggtcctcagcctcagtggaggcttcaacccaccccagcttgcccacacaactcacctgagaggcccgcggctttgttctggggtcaaagatccgcagctgcttgtcctggaaaagcagagaggaggaaacaacttgcgattagggctggagggtccctggaagccagcctgctcccctcacctcccaacccccagctctgagcagcccatccccagcacgcagggctgccatcacacaccagggcatccctcctcagccctgttcctcctcctcagcacagcagcaaccaccacccagtcccccaggtttctgtgaggagtgttcagctgcctgagacctactcagtgaggagtgttcagcttcctgagacctgctccacgtcaggcatcccagacactcgacccctcctactcttccaactaccctatgaagtggtactatcaccatgatccctcacagacagacaaacggaggtccagaaccaaactctaggctgtcagcgccccacacatgctcagccctgtactaggcccagcctggagaggctcatatgacgacctcatttctgcacttacagaatttagcactaaccaggaagacgagcttacacttccgaaccatccattcggcagttattgattcagattatccaaagggaggatggaaacagacaaaaagcagaaaaaaatgtactgaaataaagcactcatgctttgtatagaccttctttctgtggaacaatgtgtgtgtgcatgcacacgttgtgtgtgtgtgtgtacacaaacattcatgcataaagaaccagggcacaatctgtatccactactacaggctgggccataataattttttttttcttttttgagacagagttttgctctgtcacccatgctggagtgcaatggtgcaatcttggctcactgcaacctctgcctccctggttcaagcgattctcctgccttagcctcccgagtagctgggattacaggcgcccaccaccacatctggctaatttttgtatttttggtagagacggggtttcaccatgttggcaggccggtctcaaactcctgacctcaggtgatccgcccgcctcggcctcccaaaatgctgggattacaggcgtaagccaccatgtttggccataataaattaagtgcaaaaaggaagttgtagaataacatggcatagtgtgattctactgtggtaaaaatcaacaaaaatctccatttgtgtgaccacgatcctgtttgtttttattgatacccaactatcatacagcccatacattttacaagtttgctgagcaaggagaaaggtctggactaacacaggcctgtgtgctaatgctaggtatcaagggtggggaagatgggggctggttaacttttcctttttacgtcttagcacaggtctattttgtttcattcagcacagattcctgttttcatattttgaaaaacagtaaacaactggaatttgaaatgaaaaacaccaccagccaggcatggtggctcacgcctgtaatcccagcactttgcgaggctgaggtgggtggatcacctgaggtcaggagtttgagactagtctggtcaacatggtgaaaccccgtttctactgaaaataaaaaaattagccgggcatggtggcaggcacctgtaatcccagctactcagggggcggaggcaggagaatcgtttgaacctgggagacagtggttgcagtgagctgagattgcaccactgcactccagcctgggcaacagagtgagactcaatctcaaaaaaaaaaaaaaagaaagaaagaaagaaaaacaacatcatttgcaccagtacagataaaaaaaacttgaaatactcatgctcctcaacatacaatggagttacatcccaataaacccgtcttaaattgaaaatatagtaagtatggccaggagaggtggttcatgctggtaatcccagcactcagggaggctgaagcggcagatcacttgaggtcaggagttcgagaccagtctggccaataaggtgaaacctcgtctctaccaaaaatacaaaaattaaccgggcatggtggcacgcacctgtaatcccagctactcgggaggctgagtcaggagaatcacttgaacctgggagacggaggttgcaatgagcttgcagtgaaccgagatcgtgccactacactccagcctgggaaacagactgagactccgtctaaaaaaaaaacaaaaaagctgccgtaggccaggcacagtgggtcctgcctgtaatcccaacactttgggaggccaaagtggaagaatcacttgagccccggaatttgagaccagcctgagcaatacggcaaagtccatcaatggacatttctctctttttgtatttgtttttgtttttgagatggagtttcattcttgtcacccaggctggagtgcagtggcgcgatctcggctcactgcaacctctgcctcccgggttcaagcgattctcctgcctcagcctcccgagtagctgggattacaggtgcacgccaccacgccaggctaattttttgtatttttactagagtcggggttttgccatgttggacaggctggtgtcgaattcctgacctcaggtaatctgcctgccttggcctcccaaagtgctgggattacaggtgtgagtcactgtgcctagccttttttgtttgtttgtttttgagacagagtctcgctctgttgcccaggcccaagcgcagcagtgcaatcacagctcactgcaaatcaacctcctggactaaagcaatcctcccacctcagcttcccaagtatgtgggaccacaggcacaagccaccaggccctgctaatgttttaatatttctttcgtagagatgaggtctcactatcttgagcaggctggttttgaactcctggcctcgagtaatccttctgcctcagcctcccaaagtgctgggattacaggtgtgagccaccaggcctggtttgaatatacattttaaaaatatatatatagaaatggccaaaaagcgtatgaaaatatgttcaatatcactaaccattagagaaacacaaatccaaaccacagtaagatatcccctgacacccattaggatgcctattacatttttaaaaatagcaagtatcaggccgggcgcggtggctcacgcctgtaatcccagcactttgcgaagccaaggctggggggaatcacttgcggtaaggagctcgagacgagcctggccaacatggtgaaaccccgtctctactaaaaatacaaaaattagccgggcgtggtggcgtgcacctgtaataccagctactcgggaggctgaggaaggagaattgcttgaactcaggaggtggaggttgcagtgaaccgagatcatgccattgcactccagcctgggcaacagagcaagactccatctgaaaaaaaaaaaaaaaattgcaaggctgggcgtggtggctcacacctgtaatcccagcacttggggaggccaaggcgggcggatcacaaggtcaggagttcaagaccagtgtggccaacatagtgaaactccgtctctactaaaaatacaaaaattagctgggtttggtggtgtgagactgtgttcccagctactggggaggctgaggcaggagaatcgcatgaacccaggaggcgggggttgcagtgagctgagatggcaccattgcactccagcccaggtgacagtgcgagactccgtctcaaaaaaaaaaaaaaaacaaaaccaactgttggtgggtacgtgaagttagaacccttgcacactgttgatgggattgtaaaatggtgcaactgctatggaaaacagtatggcagttcctcaaaaaattaaaaatagacctagcatgtcttccagcaaccccacttctgggtacatatccaaaagaactgaaagcaggccatgaagagatatttgcacacccatgttcatagcagcactactcgcaatagccaagaagtggaaacaacccaagatctactgatggataaatggataaacaaaatgtggtctgcgcatactatgcagtcttcaaaggcaaggaaatcctactgcacgccacgagtaacccttgacgatgcagcatttcattatgctcagagaaataagtcagccccaaaagagcaaatagtatatgattccacttatgtggggcatctaaagtagtcaaattatagacacagaaaattatagacacagaaagtggaatgccaattcctaggggccgggaggtagggcaaaggggaactgctgtttaatgggtatagagtttcagttctgcaagatgagaaaattctcaaatctgtttcacaacagtgtaaatatacttaacactactgaactgtacacttaaaaatggttaagatggtgaattttggcactttgggaggtcaaggcgggaggatcatttgagcccaggagtttgagaccagcctaggcaacacagtgagatccctgtcgctacagaaaatttaaaaagtagctgggcgtggtggcacgtgctagtagtcccagctactcaggagtctgaggtgggaggactgcttgagccttagagtttgaggctgcagcaagctaaaaaaaaaagaagaaggtaaattttatgatatgtgttttcttaccacaatttaaaaaaatagctattagcccacaaaaatacattgctaagttaaagaagccaatctgaaaagctacatactacataccatataattccaactatatgacattctggaaaagtccaacatacagacaatgaaaagatcagtgcttggcagtgatctgggaggagggcggaagggatgaacaggtggaacccaggggatgttaagagcagtgaaactactccgtatagtggttacattatgtcatgcatttatcacaacccatagaacatacaacacagactgacccctcatgtaaactgtgagctttagttaataataatgtatcaggctgggtatggtggctcaggcctataatcccagcacttcgggaggctgaggtgggtggatcacttgaggtcagaagtttgagaccagcctggtcaacaaggtgaaaccccatctctaaaaatacaaaaaaattaggccaggcatggtggctcacacctgtaatcccagcactttgggaggccgaggtgggtggatcacctgatgtcaggagttcgagatcagcctgaccaacatggagaaaccccgtctctactaaaaatacaaaattagctgggtgtggtggcacatgcctgtaatcccagctactcgggacggggaggcaggagaatcacttgaatctgggaggcagaggttgcggtgagctgagatcgtgccattgcgctccagcctgggcaacaagagtgagactctgtctcaaaaacaaaaacaaaaacaaaaacaaaaaaacaaaaagtagccgggtgtggtggcacgtgcctgtagtcctaactacacaggaggctgaggcatgagaatcacttgaacccagaaggcggagattgcagtgagctgagatcgtgccaatgcactccagcagtgcaataataataataataataataataataataataatgtttaccattggttcctcaattgaaacaacgtaccacactcacgcaggatattcatcacagacactgggggaggaggtaaggaatatggaaaatccttatacaacttgctcactttttctgtaaacttaaaactgttctcgaaaatagtccatcaactaaaacaacccaaaaagaaatgcaggggaaaaccaagtgaattcccgctccatgtgcagcccctccctgagagatgagtagcctccctgctactaccaagttccaggctaagtgctggactctggggcctggaggttgtcacgggaaaccgcggggaagaacttagacctggtcatggaaggacaaacagagcttgtgctgggaaggcaaaggcattcgaggaaggtaaaatagcatgagcaaagaggtggagaaaggaacttgctggtgtgtggcgttgggggaggagaggccacgtgaggaggcagatggtgggaaccaagggggccgtgggcacacgcatggctggcagaggcgggggcctgtctggagagggcctcaaaagccaggtctccctggtctgcctcagcagggccctggttttatgccgctcctggcaaagccctgccagctgcagtttaccaagcacctgctgcgtgccaggcgggcaccaggtacagtccagggactggctcttaaaactccactactccacacctcggattcagagggatggcgagggacagagagaggaggatgagagacagaagacagagaccagagagagaacagcgagggacagcaagggatgagagaggacagagtgggacagaaacagagcacaatgacagagcgggccagagagagcaagtagagatcaaggacagatacaggggacagcaggagacaggcaggacacgagcgacagcaagcgacagaggctctcaggagatgaagggcaggacacgacatccagcagtcagggctgctcctgccccacagaggtgcagagaccgacagcccgagtccagatgccaacaccaccactgaccagctatgacgtgggcaagcccccgagccccctatggtttctttttttcctttttttttttttttgaggttttagtttgtttgtttgtttgttttgagacagagtcttgctctgtcgcccaggctggagtgcaatggtgtgatctcggctcaccgcaacctccacctcccaggttcaagttattctcttgccacagcctcccaagtagctgggattacaggtgcatgccaacatgcctggctaatttttgtatttttagtagaggaggggtttcactatgttggccaggctggtcttgagctccttacctcaggtgatccgcctgcttggcctcccaaagtgctgggattacaggcgtgagccactgcacccggccagttttgttgttgttgttgttgttgttgttttttaagagagagggtcttgctccatcgcccaggctggagtgaagtggctcaatccgagctcacttcagcctcgaactcctgggctcaagcaatcttcctgcctcagcctgggaccacaggcgcgtgccaccatgcctgtctaatgtttgcattttttttgtagacatggggtttcaccatgttgcccgggctgatcttgaactcctgggctcaagtgatcctcccacctcgtcctcccaaagtgctgggatgacaggcgtgagccagcgaccggccacccgcccagccctgtgaactgtgaggatgcggacagcgccacccctgggcagggctgggcgctggggctaagggcggaactcacagcacacactccatgagggcagctgggccaccctcatggaggagcttaacgcggggtccaaaccagggttcagagtgggcactgaggctgctctggctcagcggagaggaactgggctgcagaggccgcgtcctccccggctcatcaggctcaaccatgccgggagtcaggagcgcagcaggccggaatgggccatccgtgaggagagcgcgccccctagcggcctcctgccccttctctcccagctcgggaggccccttcacccagtgggagtagctgagagggagcaggagggggctttggtggtcctgggaggcagacctgctcacacagaggcaggacaggagtggaagccaggggcacggaggcttccccgccaggaaggagatggggcgggggtgggggcacactctggtggaaagtcccatgaccccccacccccatccccatcaggcagcccgtggcatgagcagctccagtgcataaacccagagccaggtgcggctgcaaagaggggctcacgctcgctcctggtgtggggtgggcccatccagcagctccagccacagctcaggacaagccctcgctctctgcacactcatgggcatcactggctgccctaccacagtcaggccgccccccactcccggctccatactgccagggtttccagtgtaggatgcccccaccaggaccccgatgtactccctttacagcaaaagaaggtggcagccgacccagggctgaggtacccattggccctagactgtgctgacaggtgcggcttggaggcaatgctgcgtccccgcaggcggaattcctaggtccaggaaccagggaaggagggggagtcgttccactaagcatcactcccacgacccacttaggaaatgtgtgcttctcgtccctgcaactttaagctctgggtttagcgggggaaaacacatccactggggaagcagcaggagctcctccgtctgtgactcctatgactcttcctgcaagacaccagtaagcaaggagaagagtggccaagccggtggcccatggggctgctcactgtccttccctacacaactgtgatagtaaatagggctcggacccccaggaggagggcctggaccaccacacctgtgacagaggggcagagacagtttctcaaagaaagatgtcacggtcccaaggcagccatccctgagtcctgctgagactacccaggccatcccctctgcctgggacgcccgtcccctccttctcagccagggctcatccctcaaggaccggcctcgagctcactctgcctgggaagccgtccccagcagggttaggtcaaagcacgcataccaggtctccccagaaggggctccctgggggccttattggcccccagagcttaggccagtctctcaggactctctgctcaacgcacaccacagaggaaaaactgatcaagactgggagatgcggcttccacaaaagcagagtacagaaaagaaagttagactagggtccctccaagtatgcagagccctggggcggaatgctcaggtctggtaggcctccctgccctgctagctcctgttcggctccattcccaggcctctcagccattcttcatgtgtcttcaggctcggcacacctccagaagggccctgatgggtgccctcattcccagcaaccccgacaggtcttcagagacccttggtggtacccacggccgcctccctggggaagccctttggccctggtttcaggctccagcctggtcctggctttcctcctcccacctcctcccctgcaggctcttctcatcccctcctgggggcagcactatgtggtcagcaaatcaaacaaacgggaccttttcacctgcagccggattctgctcagagcccctctgggcccagactccactgacacctccaggtaccgccggcagctcagcaaggctgcagccaccctggagcggctctgcctagaacattcacaccaggtgctcctctagcgccccctctctgccacagcacatccccgtcccagtgacaggcctctcctactgcctcaggaccgccacgcctcccacccaatccttctccaacacttggcttcctcctcccaaaggtctccgccactcccggcagagaacagctctcacctccccgcaggctgccacgcatccccctgtagacactgcccctcctgccacacactgtccatgtggttccaaatgcgaatccgctcccctcactgcaccacctgccctactctggcctttaacacttcattgccttcccattacccctacggcaacaggcacaacccttactcaccacccagcacccgcctgccccgcacctgcctgtcctggccccgatccctgcctgaggccacgcgtccctggcctgtccaaccagctcaaagcaccatgtccctcttgcagagcccaggtcacgggtcctcttgtctgtactgtcctcgacggaagtcacctccccagcaactggggcctggcccagcacctgcggccgaatgctgcttaacaagagtcttgcagaaaggctggcggttcagacagaccagacaggcggccagaggaggctgcctgagggtggcgacattagggcgcaaaccagggaccagcgtgggctctcatctgacaggggcctaggcaaggtaggggcttccagatgtaggtgagcgggggtgtgaggagcagctagggggcagggcacacagatgaccatcctgacctcagtgctccactgcctcctaaacaacaagcctggaaggcccagcccagggggtcccagcccaggaggcctgcacagagccccacagggcatccccacctgcctgctcaccttgcacgccgtgcccaccagggctccatctcggctccagacggcgctctgcaccaggtccccatgggctgccagctctgcagagaagcagtcacagtcaggtcccgggcagtgagggcaccagggaagtgggtgggggcgggccttgctggggggaactcccagagcaaaggcagcagctacgagggtccttttcagccaagggggcaagggcagcagcttctcccagacaggcttcccctgcaccacaggctgcttccttcaccccacctttgtgcagccgtacatcactcaactaccttccgaggcttcccgctcctggcctggctctctcatccctcccaggctcacttccaacatagctccccaccaacagggtcactcctgccctaagcctctattcctgccatctatactctccctcgctagtgtgaggtcttaaaatacttctctacattctctgcaactcctgttccaggttaaattgtgctcccctaaaaagatggtgaagtcctaacccccactacttttcggaggcttgctctgtcacccaggctggagtgcagtggtgcaatctcagctcactgcaatctccgcctcctgggttccagcaattctcctgcctcggcttcccaggtagctgggattataggcacctgccaccatgcccagctaatttttgtatttttagcagggacggaatttcaccatgttggccaggctggtctcgaactcctaacctcaagtgatccgcccacctcggcctcccaaagtgctgggatcacaggcatgagccaccgtgcccggcctattattattttttgagacagcatctcactctgttgcccaggctggaatgcagtggtgtgatcatagctaactgcagctttcacctcctgggttcaagtaatcctcccacctcagcctcttgagtacctgggacacagacaggcacacgccaccacgcctggctgattttttaattttttgtagagattgtgtctcactatgttgctcagactaattctcaaaatattgggctcaagcgatcctcccattttggcatcccaaagtgctgggattacaggtgtgcgccacgacgcccatccaagaaggtttttttttggtttttttgttttttgttttttgttttgagatggagtcttgctcttgtcccccagggtggagtgcaatggcacgatctctcttcgctctccatagccactgcaacctctgcctcctgggttcaggcaattctcctgcctcagcctcctgagtagctgggattacaggcacccgccaccacacccagctaagtttttgtatttttagtagagacgcggtttcactatgttggccaggctagtctcgaactcctgacctcgtgatccacccgccttggcctcccaaagtgctgggattacaggcgtgagccaccgcgcccggccaaagttattttttatttttatttttttgagacggcatctcactctgtcacccaggctggagcgcagtggtgcaatctcggctcactgcaacctctgcctcctgggttggagcaatactcttgccgcagccttctgagtagctgggattacaggtgtgtgccaccacgcccggctaatttttgtatatttagtagagacggggttttgccatgttggccaggctggtcttgaactcctgacctcaggtgatccacctacctcggcctcccagagtgttgggattacaggcatgagccaccgcgcccggccattatttttttaaatggagaaaaacaacagaaaaaaaaaaaaacaggtaagaggatgaaactgatggctacggagagcaaagagagatggggtgtttattacagcctcatagaatcttaagacttttatactatgtaagtgtaaaactttgatatctgtttttaaatttatgtgactaaacatgccaacaaagaaacggagtgctgtccagagtggggctgccctgggaagggcaggccagggtggcctgtacctgtcaggggctgctgcttggctgcgtcccagaccttcacagtggtgcctgctgcgctcaccagaatgccgtcagaggtggggtggaactgcagtacctccactgggaggtcctcggggcccagcaccaccccgggtgctgagggcagggcctggccaggccctggcagtcgccagagttttacctgcaagaaagaccaagtccgtgagcacagggctgagggcctcactgccttgagtcagctgccgtgaccccagtgaggtcccgtgttggaactaggctgctccaggagaccacacaccttggccttgggaggagcgcccacccgcctcagcttgcttgggccaggggctgcataccccacatccgagaaaggagggagggaatctcagctcctagaccacacggtgtggtcccagagttggggaagtggctctactgtttctggcagcatccccacctgctgtcctcgggctccaggtcaggtcagagccacggctccaagcaagcccttgggagccagtgtgggaccaggaattcagaccagccccgcagccctggggagtggggtggggctggactgggaggcagcagagccctgtggggatggcgctggggctcagaaggccctggactacgggctgggacatagagcagctcttccaactggctccactcaccgtcctgtcagccgagcctgtggccaggaggaagtcatcaaagggcgagaagtccaagtcggtgactaggtctgtgggagaggaatggctgaacccaccggaatgtcctgtttccaacccagtatgaagcaaagcccagggcttccgaggtgacacttttgtgtgcacacagaaacaggctacaagtctacaagggccctctggacaccatgggggcaaatgccacaggcccctcctgcgacatacgtccccgagggccctgctgacccagggtggccaagggctctggcatcaggaggttggcaggaaatgggcaggaagccgcttgagtcaccaggcacctgcaggaacgcagctgcccagcccgacccctcctagggcagcacagcccactgctccttcagtcgtggaaggtccccaggactcaactaagaaattgctttttggttaagcaagccggagttggctttagttctttgcaaccaaagaacctgaatggtggccgggcatggtggctcatgcctgtaataccaatactttgggaagccaaggtgggcagatcacttgggctcaagagttcaagaccagcctgggcaacacggtgaaaccccgtctctacaaaaaatataaaaattagttgggtgtggtggcgggcgcctatagtcccagctactcaggaggctgaggcaggagaattgcttgaactcaggaggcagaagttggagtgagcagagatcacaccactgcattccagcctgggcagcagagccagaccttgtctcaaaaattaaatactaagaacttgaacggctcagctccagaggtggggaggggtaggtggggtgcacagagtgagccagaccccagagggaaatgcggtgggtggttggggaggtagagactaggcatggagggtggcggggtttcggggtgtgaacaggacgagaggtatcaccagagctgggagcacagcgaccacctgctgctgtctgcctcccaacagggctgagcaggactgtcttcctcccggcctcaggagacagggaaaagataggacggacgtgcacaggcacatcttgggatagccctggcctggaatcccagctggcaggaccacaacattcctgggcctaaagccacagaacccctgctgccctcactctggggtgtgcttgctgggccctgcagggcaaagcaggtccctgggcaggtgtagcagctggcacaggcgggctggcatctcaggcgtgaatgagatgtgatgacataagcaatctgagtgctcagcatgtgctggcaccacagatgcccaggggttgacacgcagggacctcactgaatcctcataaggatgcagcaggtggcactgcagcagcatcccctactggaggatgaggacgccaaaacccagagagggtgagtaactgccccaagtcacgcggctaagagacagggccagcttcagaacctgtgctgctcagcatgacatgctgctgccttttcccactggagcgggccccagctgccgccccacagcctggacatcagaaacgcacccagaagttgctcaccctctgctcccctggctgctgggcggaagggcaagagtggccctgagctgagaggctgaaggggcctctgaaggcagggcaacagccagagccccacctggccatttctcccgacaccggcacctctgaggcagaagggcacctggtgcctctagggcaggttccaggggtgctggagctcaccttcccatgagcagtttcccggcagggctgctcatgcaggcaaggctctgaacagttgcagccacagtgaggctatggacttgcctacaggaccctggtccagcttctacttgaagagccctagtagcagagggctcaccaccttgcaagcatcaccaacttgggctagctccctcatagataaaaagcatcaaaaagtcaaacatgaagccaggtacattggctcatgcctataatctcagcactttgggaggccaaggtgggaagatcacttgaggctaggagttcaggaccagcctgggcaacacagcaaaaccccatctccacaaaacataaaaaaatcagctgggcatggtggtgtgtgcctatagtcccagctactagggaggctgaggatagacgatcccttgagcccaggagttcaagactgcagtgaactatgattgcaccaccacactccagcctggatgacagagacagagaccctgtctctaaaaagacaaacccaaacacaggctcctatagacctgggttctgattctggccctgccataacaatgggtaagttcctaaccttgcaggagtctcagttttcatagctataaaatgggttgttttaaaacctacttcaaagagatctgagattagatgagaacagacttgttatacaagctgccacacacatgtatctctaaaacaacatgctacgtgaaagatgccagattccaaagaccgtgtattgtgcgattccatttgcgtgagatgcgcaaaagaggcccctctatagaggagaggccagtaaacgtctcctgcgaagggcaaggcggtaaatattctaggatttcagggctcaacagtctcggtcacaactcaactctgcagttgttgcaagaaagcaaccacagactatacatcaatgaatgggcgtggcagcgttccaataaaactatttacaaaaacaggcagccagctggatctggccgtgacagtagtttgcagacctctgccacagaggcaggaagcagatcagctgttgcctgaggctgtggtattggaggtggaaatggattaactgcaaaggggcatgcgggatcttttggggatgatggaaacgttccaaaactggatggcagtgcacatgactcggtcactttaataagaatcatcaggctctttacttaaaacaggtaatctgacggggccccaaaactttgggaggccaaggcgggaggatagctcgaggccaggagttcaagaccaggctgggcaacataacaagaccccattttacaaaaaatttttaaaaattagctggaggggtggtggcataaacctgtggtcctgacaacttgggaggctgaggtggaagaattgcttgagcccaggaggtcaaggctacagtgagccatgattatgccactgcactccagcctgagtgacagagcaagaccctgtcacaaaaacaaacaaaaaacaggtaacgttggctgggcctggtggatcacacctgtaatgccagtactttgggaggttgacttgggaggattgcttgagcccagaagtttgagaccagcccgggcaatatagcaagacctcgtctctatatactttttaaaaattttttaaaaaagtttagatgagaaaactcagctaacgtacttagtacagagagcaatctccataaatctttactattgttattaaccaccatcattatcatatcagaacccctccacgaccctgcacacccagcctgaggaccaggcatcaactgccttccctcacccgaaggcctccaaacaagcagccagaaatgcaggccagagagactgggcccgcggccgctgcagctggacagtgagaggcgaggccagctgggctgctctgcctccatctgaggcgagcaaactgttccctcgaggcggacagcctgccaggcaggctgctggacgcccccagaagcagctgcggcacacaaaaggtctctttgtgagggcccatctccacccctgcagcccaacacagcgacctccttggagggccccgagcggctgggctggggaggatgcctggtggagaggggactccagcagaagacggagggctcagagccatccaacgtggagtcctcggcagggacagggagccagcatcagcctggagcctggggcggccactgcacaccccgctccatccagctcacaaccggagcacacagcttccctcctcactgcccaggccggaattctacaccaggaggaagccttctgagccccactgtctctcagagagtgcacagacagggcgacaggagggacctggcaagccatgcggcagtgggaccaggtgaggatgaatttctggccctggagagggaggtgcaagtttcaggcttcacccactagtcagacacccactcacctgaatggcagcccaggtgggccacgcgtcgcttgtcctctccttggccttgcagaggcacaatgcccagtacacctgttaaacaaacacggggactctgacttcaggccccacagggccacccacctccttgcccagggatcccagagatgaaatccagcagctcagcctcggaccttcccagagcctctaccaatcacaagatcatatcctctgcacgtagcaatggcctgtgggtaggttctggccccatgcatgagccatccatgcctcagatggatacagaagacattaggcgagaggtcctctctttttaacacgggtcatacgaaaggggcgtggggctttcgtatggggcttgcagctaccgtcagccacttttcgcacttttacttgagaaagaagccaacacccaaggtggcagagctgagagacccagagaggtcagggccgacagtacatgtgagcctttgggcaccgatctgcctgaagcccctgatctcttagttaggctgaaacattatccattttttgcttaagccagcttgagggtctgagttaccactagcaatcaagagagtgccaaccaacacacgggcttttcaagcctttctgttcctactgtccccagccatccagggcccaaagatgaggagcagggagcacagagggacagctggaaatacaagcgtcagtcccctcccagccctcctggccatgctcttgcctgtggtttgtacacacatatgtcctaatcaaaagcaatcagattactgcgcctggaccagtttgtgggggtctaaggtctggcatggggctcacctctgagccccccaaagcagttccgttccaagtctccaaatacaccaagcctgcccctgctccccaccccatctatggtgacgatgaccgaatatgtgagcaaatatccacactcatggccattccctaccaggacggtcggagttgaaggcgatcaagctgcagcttgatttgatgtggttcctgcatgaaggggcggttcctgctcgaatgtcactgatccaggactgaaaatcaagagtaaagaagtatgtggtgagagccagggttccacctccatgcatgcctaaagcaagaggtggggcataatctggggaactctagctcacagctgcaccattcgagatgcattcttttatttactttttttttctttttgagacagggtctcactctgtcacccaggctagagtgcagtggcgcgatcttggatcactgcaatctctgcctcttgggttcaagtgatcctcctgcctcagcctcctgagtagctgggattacaggcgcccaacaccaagcccagctaatttttgtattgttagtagagatggggtttcaccatgttggccaggctggtctcgaactcctggcctcaagtgatctgcctgccttggtctcccaaagtgctgggattacaggcatgagcctccgcccccagccgtgttgtgttacttcaaatcaaactctgtccccactcacgaagtcccttaggaaatgtaaaatgtgggccaggtgcggtggttcatgcctgtaatcccagcactttgggaggctgaggcagacagatcatcctgaggtcagaagttcgaaaccagcctggccaacatggtgaaaccttatctctactaaaaatacaaaaattatccaggcatggtggcgggcacctacatacaattccagctactcaggaggctgagggaggagaatcacttgaacctgggaggcggaagttgcagtgagccgagatcatgccactgcactcctgcctgggcaacagagcgagactccatctcaaaaaaaaaaaaaaaaagaaaatgcaaaatgtggccaggcctcctccaagtacccggagaaaaacacccaagctcagagaggggaaccaccaaggcctggcctcatcaggacacacctttccacaaagtctcataagtcagtaaaagaaacacccccacccaaggggaggcagaggagcacgtttctgaaactaagatctgcaaggtccacacattttctctgttgtcaaagcaccgctcagcactccttcctgccctcgatgacaggacacccatgtttcccactccacccacccatagcaccccggaaaccacctccaccacctgaagtttctatatcagtgttcacctgccatggttacagcatcagtcccaccctattatttctccctcctgattcatgtttactgtataaacacagtgactgcaaatatctctgaaaagaacagatcacctgttctcccgcctccctaacataaactgttttaagctctccctacagtctgtagttccatgcctatctgtttatgttgctggactaaggcccacccaggagcaagaattagggcccctcaagtattctccagacccctccaagcagtacttaactgcactcagagccaccggctgtcttgatgcaaacctaggtacctcctcctaacttttcttgtttgtttttttctttttttgagacagtgtctcactctattgcccaggctggtgtgtagtggcacaatctcggctcactgcaacctccacttcctcggctcaagagatcctccaacctcagcctcccaagtagctgggaccacgggagtgagtcaccacacctggctaatttttttttctttaacttgttgttcagaggggtttcgcaatgttgcccaggctggtctcgaactcctgagctcaaagcagtccacccaaagtactgggattaccgtgagtcatggtatccagcccctccccctaacttttcaatggctctgcactgcaatcagaataaaacccaacttcttccggtggcccttgggttctgcaggaccactctggactcatctgtcaccatactgctccggccatcccctccatccactcatgctcactttccatttctccaccaggctctttctcaattctcacccttctggcctcagctaaaatgccatctactccaggcagcctttcctgaccacgctactgagactggccccctccattctccatcccagtccctcatgtgtgttcttcaatgtcgttatgaaaacctccaatgctcttgtttgtctgcttgctgtctccctcatgaggctacaagtgccacaggggaaggaaaatgccgttgtgttcaccgggatgtctccagcagcttagcacagcataaagtggaagcagaggaaatatagtccacactacaaaaacggaacctctacccagactgccctgacttgctctgggaccctgatggggtcacttgaggtcaactcctaggcccagttatcggaggacactcccaggccttacaaataacacggaaagcggaagagcagagctgacatcgtttccaaggcgcacccctcatcagtcctcctgccgtttcgggggtccgaagggtctcccggcacctggctcagcaattctttggggctccacctgctcaggcttccccaggccccacccagccgtggcagcatcaccgagataaagaaagagcttgcgccagcggcgagaggaggaagcaccggcggaaacccgagggaggggcgcgtgcggccgaggggctccctccccaccactgacacacttgggctcgccggggccagaggagagaggggcgtctccccacagcccagccaggggcaggggcgacccggggcggcagggaggaggagccaggcgccggcagcgccccgagccccggctcccggcgaggccgaccggaagctgggaaggcaggcggcctcgcaggcctgggccccggctaggagggctgcgccgcctcgggggtcccggggcgaggtgggcgaggcgggcagaccgccagggtcaccgagcgccagagcgagtcacgggagtgccggactctgccctccggcggcgacgaaacggcccggacgccggggccctggcctgaaggggggttccccggggatggaggtctcggggttccagacggccctggagggcacccctgtggggtccgggcagggggaggggcagccggacggggcccgaggcgacagcgcccggtcctcgggccggactcacctcgcggcggggcggccgagcctcggtgtgccggaacttggacaccctgaagcggttcatggcgacgggcacggcggcggacgcgtcttcgaggaccccgggcgtcgggtctcaggtgcacgctgagcaaccgcgactcccgctgcctcggccccacccgggacccaatgccgcggtcacgcccccggcgcgccccactgccaatcgcagccgtctccggccccctgggccacgcccccaagcccctctcctttcgcgcgcgcaccaccggtcccgcctcccggccaatccaggtacggccgccccgcgaggccacgccctgataccgaggggacggactggcgcgggtgggaggtcacgtggggcgcagctgtcagcccacgtctcctgcggtgcttgcttgcgtggggtctcggctgcagcattcgcgattttgtgtgcaggatttgctgtggagtctttgcggtgtacctagcacgccttccagcactatctacctcttc

SEQ ID NO: 883 - DNA, 62421 bp, Homo sapiens
gtggccagcttaaaaaagtttaattgctgaaaacatccaaggcaggtgcgggccagtccctgcggggctcacaccccccttattggaccatcagctctgtgatgcccccttctcctggctacaaacctgggaagtagggcagctggtcccagggccctgagactggtgctgctctagaaggcctggtggggggccagcccccaaggcccttgaccagaactggaacagcaggcaagatggggcagcgtggggtgaccaaagatcctggatgaggccaatccaggctgggaccagcccaggtcagcagtgagaccaggggagacagggtgcccagggcctgcccagggacatgctgctgaccccccgccaccctgcacccctggccacatgctagcgggcagctgatgagcagcagctgaccccagagacagcagaggtgaaaacagtccctgggaactgccagaggcccagaggatgtggaagtgcccacgggaaggcaggagtgcaggggtgacatgtgccggggccagagaggtatcttccagcttgaggatgagccgtgaggtgtgcactaggaagtggcagcacaggtgaggtggaggtgacgggggcgcaggctagtcctggggcgaaacaccaagaggtgggagggagtcaggagggcctgggaagggaggaggcatgcaccgtggcatgtgcgagggaccgcgctgcctgccgggaagtgaggccactcactactcacccactcgtcctcgtccacgccttcaaaggagtcctgggggagtgggtcctcccggttccccagttttgccaccatggcattcagcagctgggagagagggcagaagaagggtaggtaagggaataggactccctgttccctctcccactccaagaacaaccctgacaaggctgtgaaaagaactttttttttttttttagacggagtcttgctctgtcgcccaggctggatggagtgcagtggcgcgatctcggctcactgcaagctctgcctcccgggtttacaccactgtcctgcctcagcctcccaaggagctgggattacaggcgcccaccaccatgcccggctaattttttgtatttttagtagagacgggggtttcaccgtgttagccaggatggtctcgatctcctgacctcgtgatccgcccgcctcggcctcccacggtgctgggattacaggcgtgagccacagcgcccggcctttttgtttgtttgtttgttttagagagagacaaggtcttgctctgtcaccaaggctggagtgcagtggtgcaatcatggctcactgcagccttgactttctgggtgcaagcaattctcctgcctcagcctcccaagtagctgggactacaagtgtgtaacaccacacctggttaatttttattttatttatttatttttttgagacagagttttgttcttgttgcctaggctggagtgcaatggcacaatctcggctcaccacaacctctgcctcctgggttcaagcgattctcctgcctcagcctcccaagtagctgggattacaggtatgcgccaccatgcccggctaattttgtgtttttagtagagacgaggtttcatcatgttggtcaggctggtgtcgaactcccaacctcaggtgatccgccctcctcggcctcccaaagtgctgggattacaggcgtgagccaccatgcctggccacacctggttaatttaaaaaatttttttgtagagatggggtttcactggtctcaggctgggtctcaaactccatcacttatatcctcttgctttggtctcccaaagtgctgggattacaggtgtgaaccaccatgcctggccaaaagagccactatattttatttttatttttatttttatttatttatttatttattgagacggagtctcgctctgtcacccaggctggagtacagtggcacgatttcggctcactgcaatctccacctcctgggttcaagtgattctcctgcctcagtctcccgagtagctgggatcacaggcgcccgccaccatgcccggctaaatttttgtattttagtacagacggggtttcaccgtgttgcccagggtggtctcaaactcctgagctcaagcaatccgcctgccttgggctcccaaagtgttaggattacagacatgaaccaccgtgcccggcctcaaaagagccattttaattacagccctgacaaaatcgatgggtttctattgaaaaagacacaaagaagagacagggggagtaagagactgagaggctgcggcatgtggcaccagatacaagggctactatctctgcacatggcctcaagtgctcaaaatatactccaaggtcccaaaagcacttgggcccagaactgccggcttaggctgggtttggcctggccagggcagggctcccactgccctcccccacttcccgggccccatggtcagtggtagggctctggaaggtctccccaccaggctctggtgtgaaggggacgtgacatgtggctgctgtcccagtctgggttggggatggagaactaaggggccgtggccaggtgcagccaggactctgtcacctccgcacagctgctctctcccatgcctacctcctccttcttttgctggtcagacttttcttccaggtactgcgctgaggatggggcccgacgagcaggggcctctcggggggcttggctcactgggacagagcaaggacacgtgtcagagagtccccttcgttagggctctttggtgccaagccctcggggatttctttctttcttttctttctttctttttttttttttttttttgagatggagttttgctcttgttgcccaggctggagtgcaatgatgtgacctaggctgactgcaacctccgcctcctctgggttcaagcgattctcctgcttcagcctctggagtagttgggattgcaggcgcccaccacgccaggctaattttgtatttttagtagagatggggtttcaccatgttggccaggctggtctcaaacccccgacctcaggtgatccactcgcctcagcctcctaaagtgctgggattacaggcatgagccaccgcgcctggccgacctaggggatttctatggcgcagatctaagaggtggtattaacagtcaatggagcctcactgtataagccctgccctagacaccacagtgtgtgcgtgtgtgtgtgtgttaggggtggggacctgtgatgaaaacacagaccacgagccctgccctccactggctcagagactgattgacacagccactccaccctcccaaaggccagaggattctgcgtgccaacaggaatggaacttcaacctgggccttctgtccctttctccaacccccatcccgcttcctccccacacccagtccctcggtgcacctgggctcatgtcaggaggctgcaggctgagaagccagggctgcccattagcgccttgcagccaggcctcggcactgagcacaggctcccagatcacagccgtgtctgggaacacgtcatcctggaagaactctttctgcagagggagaaacgggctgtcctgagacattgaccaggtgcccagggcacacgggcatctgttggggagggacagggcaagacctgggaccctcccaccagcctggggcttccatgagtttcagcatctcagcagaagggggtaggtgtccccatgaacaatgggtagggaagtttggaagctgggtcagacgggacccaaactcccctctaggcaccgagaaggcggtgggcatgggagtcccaggtccccaccctcacccggactcggggcagccggaaggccacaggctccagggaggactgacgcagccgcaggcaccgcatcagctccacttcccgcacgtcgcactccgtcttaggcaggaggacgaggccctgggggagcaagggagtcggagctgccgctgggacctagagctcatggctgggcacgtagtctccccagggtgccggcacccctcacttaggaccaccatgcctagggcctgtccctggacagtaacgtgttgatcatgttgaacaacctgctctctggagggaaagccctgatttgtggtgttttcctatttccacagtttacaaactcccaccatgggcagcttctacgtgccacctccactccctgaatgtggtgttgggaagagatgtaaatagcacatcatcctgcatttcctccatgcactccaacacagaaacatgtgacctcagcacaaataatagtaaaattggataaattaattagaagtgataaactgagtgtttattactttggtttttaatattatttttaggttcatattgtaggttcatatagtttaaccttatctagtgcaattttttgtttgttttgtagagatggggtcttgctatgttgcccaggctggtcttgaactcctgggctcaagcaattctcctgcctcagccttccgaagtgttgggattccaggccaccgtacccggcctacagtatgatttttaataatggttgagtatgacaatggctctcaaaattcctaaataattccagcagcaactcttcttgccagtcactgggcacagccccaggcccagccccagcccaggactctgacccccgacccacaggctcctgtacttgcccacatggccaccagggggcagggcagccttgtggtcccatcggggacgaggcgccagggtggcctcaccttgtgggggtcaggcgacgtgaagctgttgcactccaggaagaaaggggactcggggagcagctcgtacaggaatacacgggtgtcgccctgcggggaagaaggcaggctgggaaccctccggcaacactggccttccccccaccacctctcacctgccatcccgccctccagcccagcccaccttgccggtcaggagcaccaggccagtgtctgggtcgtagctgggcagcagggttgagggagccacgtccaggcccaacactgccaagggtccgccggccagggcctcagcttcatataggagcagctggcgctcactttggctgcaagggggtttgggggctgaagcaggtgtttcagagctgaaggggcctggggcagggagaaggcgcccacgtagcccctgctctgttctgggttgtaggcgaggcctagtgtggcccggcaccgcagccacatcctaacctgcccctccacctctgggttccccattgactctttctcctccactaatcactcacccatccatctacccctgactgcctcaccgcccctgcttccatctcccccagagccccttgtgcacccctgcatctatctccccccaacccctcacccacccctctatccatctccccactacccccaaaacatccctccatctcccctacccccctcaccctcccctgcatccatctcccccttacccccaactcatccatcgatctctccctaccccctcattcatccatccagccatccgcccatctatccccacattcattcatccacccatccatccattcacccacctatccatccacccatctacccactcatccaatcatctacccacccacccaaccatccagtgaggggcaggaatggtttctgaaagcctgacaaatgtatgtgactgtggagaagggggacacaggtggcttctgaagcctggggatggggatgcctgagtcctcacctgtcaaagccagacaccagcagacagcgaccatcacatacccagacaatgcgagctccgcgtcctcccttgggccctgggccttcctgttgagatacatcgcgtgacacccagccagcacccctgaaccaggtctgaggccactccccagcccctgtgtgctcacctgcaggggctcagggccactccggggcctgtagacccgcacacgcccatccttgcagacagtggccagctgctgcccatcaggactccaggccaggctgaagatctgggggcaggaagggatatgagagacagccttgcttcactgctggccccacctctccccactgctcctgcccctcctcactgctggcgccgcccctcctcactgctgttcccgcctctcctcactgctggtcttgcctctcctcactgctggcccccctctcctcactgctggccccccttctcctcaatgctagcccggcccctcctcaccgctggccctgcccctcctcaccactggcccccctctcctcactgctggccccacccctcctcgctgctggtcctgcctctcctcactgctggccccgccactcctcactgctggccccacctctccacactgctggccccgcctctccacactgctggccccacctctgcagccgtcctacctggtcttggtggccctgcagcttcagccgatcagctccagcctgaaggtcccagatgcgaacagtgaggtcataggaggacgaggccagcacattggctgccagtgggtggaagcgcagggagcagatcttctccgtgtggcctggaggaaggcaggggtgatcaggagcccttgggagacactggccaccccagccccattcctgagcctgcctgacctgtgagcacagtctctggcgtggtgagcacctcttccaggccctctgcgggtacccgccacagtcggatcctggcgtcctcaccagctgcagaggacagacaggggctcatcattgctgagcccaagacctctgggctccccagcccctatccgggacccaggaccctccctcaagcccaggcacccagcctccttacccacagcgaggcgatgggggtcaaaggggtcccaggccagatcagtcacagctgccccattctgcagcgtgggcagtgccgtgtcgggcaggcggccaggcttccgtagctgtgggaggtgcccccaccccgaggcccatcagtaccaggcagaaaagccagtccccaggggctgcgggcaagcagcatgtctgggagcccaccctctgcagcagaggctcccaccgctgggtgacccaagctctctgccctgaccaccttgcgctctgagccccaagtgccaaccacaaggccccagagagtgagggggcagcagcgtgaactggcgggaaaagctccggcttagggctcaggtggccgggcttcggatcccagctccaccacttacacagctgtgtgacccgggcaggtcactaaacctctctgtgcctcttctccctcatctgtaaaatggggataaaagtggcaggccccatggcaggtggctgggaggatcacaggacaggcgggcaggagcctgacacaaggtttgtgctccctgtgttgtgtgggtagctaaggccctccgcgtctttgccacaggcagggaactgaggggcagccctggtggggtggggccctcacctcaagcacagccacctgtcccccgctgctgagcagcggcacggccacacgcagcttgttggcacagaagccgtcactctcaccaggtgtggtgaggttgagccccttgaggttggtgatgtggctgtctcggtgcaggacagtgccctgagcatggcggaacttggaactggggcctggcaggtggcagggacatggaaccacgtgtgaggatgccgtccccgcccgccctgcactctttgagtcccggctgcccactcccctcaccccaggtggatgtacagcatggacctaggcccaggcctttgctaatccagtggatgcaactcgcccaggaataatgtctggaatgatataccctgttccatggtggctcggggaatcttggtggagcccagggctttggctgctcagaagctggtggccccagccgccctcctattttgcaggtgagactcagccaccacaccccagcccccaggacaaatgaccctgccagtgagtctgggtgaggggggtgccctgcatgaggcctgtgctcagcagtagggtacacaggaggatgacggggagtggggcagacagggctcctgcggtaggggtgagctccccgtcctgcctccttacccagcaggctctgcagcgacctcaaactggggctggtcccgatgccactggtgctggagagtgagggccccaggctggagggcgtggagggcgaggtcagcgaactgggaggggaagagaaaccctcctggggaggggcatggggtcagccagcctgctcctaggtgtactggccaaaaggagggggtgccagcggactccagggtcaccactctgggccccctgcggactggaggagcccccactgtgggcatgcgacaggagcggcggggggcacgggcataaacgcagacacacagggaagcagccgagcttcagaccgcggggacagcaagtggcagctgctggctcccagccctgcaggagggtgtgcccagtgggttagatctgccagtattttaagagaagccagaaatctagatctgtatgaaaattcttgctttttaagtgtttgcccaatttagaaagcactgtgcaagttccttctttatgctccacgtgtttctctgtctctgttacacttgacaaagaaggttggggccaggcgtggtggctcaaggctgtaatcccagcagtttgggaggccgaggagggcagatcacgaggtcaggagttcaaggccagcatggccaacatggtgaagcctgactctactaaaaaaaatataaaaattggccaggcgcggtggctcacgcctgtaatcccagcactttgggaggcccaggcgggtggatcatgaggttaggagttcaagaccagcctggccaacatggtgaaaacccgtctctactaaagatactaaagataccaattagccaggcgtggtggtgcgcgcctgtaatcccagcactttgggaggcccaggcaggtggatcatgaggttaggagtttaagaccagcctggccaacatggtgaaaacccatctctactaaagatactaaagatacaaattagccaggcgtggtggcgcacgcctgtaatcccagctactcaggaggctcaggcaggagaattgcttgaaactgggaggcggaggttgcagtgagccgagatcgcaccattgcactccagcctagacgacagggcgagactcatctcaaaaacaaaaacaaaaacaaaaattaggccaggtgcagtggctcatgattgtaatcccagcactttgggaggccgaggcgggtggatcacctgaggtcaggagttcgagaccagcctgaccaacatggtgaaaccccatgtctactaaaaatacaaaaattagccaggcatggtggcgggtgcctgtaatctcacctactcgggaggctgaggcaggagaatcacttgaacccaagaggcggagattgcagtgagccgagatcacaccattgtactctagcctgggcaataagagcgaaactctgtctcaaaaaataaattaaaatatagtcggccatggtggcacatgcctgtaatcccagctactcgggaggctgaggcaggagaatcgcttgaacctaggaagaggaggttgcagtgagccgaggttgcgccactgcactctagcttgggtgacagagtgagacactgtctcaaaaaaaaaaaaaggccgttcagccggtgaacactcagggcagccactgcagtgtcgctgagggaggatgggggcggccctggtacttacgcttgcgtctgcatcacccacgggtgtctccatcaccgcaggctgggctgtgtcagggaggggctccgcagggggcaccagacaggaagtgaagctcgggtggggccggcaggcggggttgaggctgaccttctgcacctgcatggaggccggcagtggggagatgggggcatgggctgcccggtcaggagggcccccatgggagggtcaactgggtagggatggggggcacccagcaggccagactgagttggcacacagccacacggggctaccagggactcggggaggctgggagaggtgagccagccctggtcctacctgctggttgtccccagcccaccagctatgggggtcggtggcaggcacacagccggcagtgtccgggaacaggtcctcgtggaactccacagcctggccgcagacaagcaggcagctagtgaggcccaggccccccgactccccagcccccgcagtccctcgcccaagtccccctcaccttgcggggcacatggtagccgatgggcacgatggctgtgtcgctcagctgtaggacgcggagtacctcgcagctcatgacggccagcgcctgccggggcacaagggcagccccacgcagcacgctctccaggacacactgggtcactgttgaggacaccataggggaacaggcaggatgggcaggggaggggagggtaggggatgggggcgaggaagcaaggcttacctgggctcagcgccggctgctgcgggaccacctcgtaacagtacagctgcctctcgccctgaaatgagtctgaactgagccccgtttgctgactgaacccctggggagggcccaggactggcatcagctcccccacaggtccccaaggacctgagccacagaaccacagtggctggagatggggctccccaacatgctgggcgctgagctgagccctaggctgactacctcacttgctcagcctcgttgcacatggggtgagcaccgggggtgtacgtcagtatttatggagtgctgactgtgtgctgacactgctctattctcggccttgttctcaggaaggccagtgttctaggagagctacagtcaccttggctgcacaggggaagacacagaggccctgttcgagttcctcctctctcttggggaaggccaggggctggactccaggctgtggatgtgggtgggagccccagcttctcactcacctttcctgccaggaccaggagcccagagtcagggtccagcagaggcacgagacacctggggaagagagggcaagatggcgggtcagggcagtgggagggctgccagactcgtaaccccatgtaggagcccaggacaggcaccacagtgactgggagccgcttggccatccagccatgttcagcctggtccccaggaaccccctcctcttcctgagcttcccacatgcccaacacacgcccacaccccagctgctcctccccagggcctccacctgcacacctgcgtcactccaggactggagtgggcacaggggaactcgggcccgatctcagccacagctcttcctccaagaagaccccacatgcattctgtgcccctcccaccttcgacagcctagacatcaggccagcattgccagggaaggtggagaggtgaggccggaggcgaggagcctcccgtccccactcggcactgcctgtggacaggcagcatccgggagcagtgcaggcagccctgccgttccgaatctgcactaaggtttggggccctctactcagttaccccacgtttcctgtgcctcagtgatatcttggaagctcagagacccccccatgctgagttaaagttcctgtgtccaaatctgagccacgtgcccgggagaaggggctcctccggccgctgggcttccctgcacaccccaggcctgctgccccggccgagcctgccagcagcatgctcccaggccttctctggtctcgaggcaggagcagggcggggtggcagctgggaatagagtgggcgggccggaagcccccagagcccctgccactctatgtccagctcagccttggccaactgcctgtcactggccgggctttatgcctccctcccggggcccctcagagacccctgcacagcccctcagccctgtgagagctgccttcccactccagggccttttgaggggaatggggacctggaaggactctgacagatgcccagatgcccagttgccttcctgtgtttcttgctcctgatctttgcttttttttttttttttttttttaagagacacggtctccctctgtcacccaggctggagtgcagtggcacaatcattgctcactgcagcctcaacctcctgggctcaagcaatcttcccactcagcctccagagtagctgggactacaggtgtgcaccaccatggctggctatttttacttctatttttgtagaaacaaggtctcactatgcttccgaggccggtctcaaactcctggcctcaagtgatactcccaccttagcctcccaaagtgctaggattataggcatgagccactgcacttggtcttggtttcttgtttctgggacctgcaggcctggaccctcccaacccagacactgacacccttaaacaggaccccgtccccactgtgttgccagggtcagaggtcacccagctgtggcagctgcctctatccctcactgcggtgacaaagggcccagccgccctccactgtccacccatcccctcctgccagccgaccactaagcagtcctgcccacctcccctccccacacttccaggagccacagagtggctgggaagctgggtggggccctgggtgtctccatgacttcctggagtgccttgggctggtcacctgtgagtaacacaggcccctacttactgagggcccagcagggtgagccgggctcagcaatgccctttgcatcccggcctgaccactgcttgtagaggtggaggcggaggcggagggtaggggaccaaggtggtgcgtgacctggagtgccctccacactgacactggctccactggggctggaagcaagtcccttcagcagctttgacagggctttcactcattcattcgttcacaatcattcactcctttgatgagctggtctgtgcctggtcctcggctcgacctgcatgtaggtatgcccagagatgagtgcaacagaccctgcctctgtcctcaaggtgctcacagcctagcacaagaggcagacagacacaatcccatagacaaacatgtgaagggaaggttcaccgaggacacacagtgacagagcagggggactgggcctcagcagtgggggaaggggtgatccctgcgatcccaaggtcatgcagaaatcaaacacctcacaggaagagagtttcagagagaacacaacctgtgcaaaggtcctgtggcaggtgggttcatggcctgtttgaggaacaagatggacaatgtgcctgacagcctggacagtgtgggtgagggctgaggctcaggatgggcaggtggaggctagacgggaaggggcctggtgcatgtggggagggggagttctgcctccagtggacgagcaatgaaaaggtgacggtgcgtttcaagcaaaagaggctaggccaggcctagtgactcatgtctgtgatcccagccagcactttgggaggctgaggtgggagaatcacttgagcccagtaggtcaacactgtgaccagcctgggcaacatcatgagaccatggctcttcaaaaaattaaaaattaaaaaattagcgaggtatgctggctcacgcctgtaatcccagcactttgggaggccgaggtgggtggatcactggaggtcagcagtttgagaccagccaggccaacatgatgaaaccctgtctctactaaaaatacaaaaattggccaagtgtggtggtgtgcatctgtaatcccagctaattgggaggctgaggcaggagaaccacttgaacccggcaggtggagtttgcagtgagccgagatggcaccaatgcattccagcctgggtgacagagtgagactccatctcaaaaaataaaattaaaaattagcctgctgtggtagtgcacacctgtggtccagctactcggctggctgaggcaggagggtcacttgagcccaggagtttgaggctgcagtgagtcaagatcgcatcgccagctgggcatggtggctcacatctgtaatcccagcactttgggaggccgatcactttgggtcaggagtttgagaccagcctggccaacatggtgaaaactcgtctctactaaaaatgcaaaaatgagctgagcatggtggcgtgcacctggaatcccagctactcaggaggctgaggcaggagaatcacttgaacccgggaggcggaggttgcagtgggccaagattgcaccactgcattccagccttggcaacagagtgagactccatctcaaaaaaaaaaaaaaaaaaaatcacatcagcctgggtaacacagcaagaccctatctcaaaaaaataaaaatagaaagaggataggaccagactggcacagagtagggatcacactggctgctgggggcacaggctgggaggagtggaaacaggtgccaggacagaagctgagggcaagtaggataggcaggtctcctgtggcccctctgctgcccttatgagaggtgggaaacaggcctggggccacctcatggcatcagaggctcacctgtgcgctgagccaactgcctgaggaggcctggtgctcagcctccctcacccccgttccatcgtcccagccagccagccactgactcaggagctgaggccgagtgggcaggaagtcagggagggcagggctggctcctctgacaggtcaggccagtcttccttgcctcaggcagagccatctggacaactctgccaggcaggggcatcctgtctgccgtggcacgggccaagaaatggggtcatggcacccagccccaaaggttggccaagtgttggcatgggcctgaccccaggctgtgtgaagagagccaagctgggtctgggtctggaacatggtacatgagccccagccaggcagagggccagaggtggtaagaggtattgccggcacctctcctgctggaatctgggcctgccactgggaagggctctgaccctgacccaggtccaggggtctgtcccaggcataaagttatagaaggtctaaagcccagatctgcccccgcccctcagccaggtcccaggagctagaagacaacctcagtaccaactgggaggcacgagcagtttcagcctccggataagccccgccagctctcccaggactcctgtgattagcaccgaggggaagcaccaagggtgtgcttgctacaaggagcagctgcaaggctcctcctctgtcctcccctccagcccatccctcccgctcaggccccttcccaccaacccagacattctgccattgcgccagttcaaagcaggctgggtcccttggatctgtccctatcacccaggctggagagttagttaggatcctttgacccccctccacccccacagcccctagctcccccgctgtgtgcagactgctggtaaccaggttctaaaggcgggtggcaccttgaaaccatacaaggcaatgttggataaactgagaggggtctcctaaaagcttcccttgagcctctgggtaagtggggacctgtgtaaggccagggcacaggattggggcagggggtgaacaccaggcagatggggtctctccgtctacaagaacctgccacagaggtgagaagcttcaaggacatcaggaggtcctgttccttgaggaaagccaggctggaggctcttggagccctctttacccctgaccctgggcatctgtggatgcttctgagggcttcagaggacacagggccaagggaagaggcagggaaacagtccgacaagaggctgcacagcactgattggaaactcagatggttctggggccgggcaggaaactcaagtgagtggacagcttggcaggaggcagcagggagtggtggggactggggtgacccatgagcccacattttggcagagggagcaaccgccactcagccccagctgagagttcctgttcaatgcaagctgggaagccccattttaatatgaaaccacctgatttttcaatgttagcagtgccttcaaagttgtaaaaactcccataaagcctgcactaaatgcacccaaaggccagccccaacccaggaacagaggtccgcaagccatgccctaatccatgtagaccgagaaacgtatgggttgtggagccctgccagccctggaaaggggccctgtggggagagggccctgtggacgggaggtccagaaggtgactgtcccagccaggccctgcttagcccttgacggctagacacagaggccatcctgccttctggagataactgagtcctccagagactaggaaaccctccagctggtgtggcccagcctcccagggataagccttcaggccccccaaagactagagctagcccagccaagggccttggctacaggccgggctggagggggtgtgggtgtcccaaggctctccggaagtcaggagctgagctgggcccccaaaggctctgaggcatgactgaccacaaacgcggagggggaggagggcagagtgttttcctggaatcctccaaggcaggggatttttctggactagtccggcccctggcacccgcccctcctgcccaatcaagggccactgtcaactgcagcccaggccccacccaccgacggtgaccacccctatgcctccacagctcaggcttgaagctgccagtaactgtggggccgtgggcagaccaccactgccctccctgacacagccccttcatctcataatatggtggggaagagagtccagggctgctcacaactcttaaggctgtcgtggctaagaggaccctgagctcagatttggcattggagtttatacttaggaggctcttgaaagggctttgtgtgggctgccaggagttttttgaaattgggattagctaccaacaataacacattgagagatttcacctaaaaatctggatttccagtttctcttcaaaaatccaaagctctagctggcccgggctggtcatgaggactcagcccttaccagccccactcccgccatcctgcctctccagggccgcagaggccctggggtggacttctggcatttgtcacctgcctggtgcctcataggcatctgggctgtgacgcttaggattcctaaatagtctctcgctttttacacaaaaagcagaaacctgcccagtgtcatccggcaaacccacgacgggcaaggtctccccgcgcaggtcaggtggccgcagggtgagggccagggcaacccggcccacgagcccctcggtggggaaggggcgtgtctccacgcggctccgccccggccaatggggagaggccccgcccctgccgcggcgggcccgccccccgggactcttaaggcgcgacctgcctccagcgagccgactccggagcccgagcccggggcgggtggacgcggactcgaacgcagttgcttcgggacccaggaccccctcgggcccgacccgccaggaaagactgaggccgcggcctgccccgcccggctccctgcgccgccgccgcctcccggtgagtttctgtggggctggggggctgcgggcggggaagggggcgccacggccaggctgtgcacacgcgcggggaccgccgccgcgcgcacacacgcactctcgggcgggaccgcggccccagccccacacggtcacctgggccgcccggcgggcaggccctgtacgctccctcccccgccgtcctggggcgccgacagccccgcggccggccagggtgcgcgcctgagtgtgcggtgagcccgcgaggctgcaagcagacaaaataaacaccccgtcccatgcttcctcctcccacggctgggcctccggcatgaccagttttatgaatcaaacccctttgagggggatagccaagccacaggcttgggtcacttttccctcctggggtccggcagtaggtgctgctgtgcagaagggctgcccggggtcctctggacccttgtcactcaaagcacagctgggggctacagatatgcagccctagggaggggcggggagtggctggtgggcgtccgatgcccatccctccaggtgggggatggacctgtactggccagggcccttagagcttcgggtatcaggcagggtgccgggtctctgcctctgccagggaaggggctttgcttgggctgcaaacccagtggcctggagccagcctagtcctttgtgtccctgggctggcagtgctggggcctgaggactgctgaggtcccctgtggtcactggcaggccagccgattggtgccaaccattctgcctctcccccattcgttaacgattgccacaccagggtcactgaccgcctcccctgctgtggcccaggggtggagtgtgcagggtggaaggaagaggtcctgggggtctaggtgtccccatgcctgccttttgcaccaaggacaggtgaggctctggagagaggcagcgggacctagagcccccttccccaggctgagagcctccagggctggggattggataaaatctccaaggtcccttcacactagactgtactttgggtgttgagggcatagaggggtggccgggctgggaccttccaagcagggtccattagggccagtccagggggcagcaaagtccaggatgggcccagctattgacaaaaacccaacagagctggggcaggcgggtgggggatggggagcagtcccctgagtttactctcttctcccaggggagttggcctggagcttctgtaaacagagtgtcagaggcaggaagaggctctggtgatgagcagcccagctggatcccctccagaccattatctagcctcccctgggcctggggagggaggatgcgcacacacatgccagcctgggggccgggcactgcctgtccccaccccgcccctgtctcctgcacgttggaacagctgtcctgctacctgtgggtccggagggtcagatggggatggggctgggggctggggtcccagggcatttgtccagatggcacctctctctccatattctgggaatgggagaatgggattcagcataaggagcctctcagacactgcccagacctgtgcttacccgaggaaggcccctctggcacgcagcccaggggccagggagatggcaagggagatgccccgggcaggagatgggtccgcggctcctagctcccattactgtcacccccactgacagccccgggggagctgggacaagtcccaagtacagaaaattaagtccttgcctgggcttataagtgggtcccaacacaacactgggcagcctctgggaacaagaaagcagggccctgctgagcccaggagggagctcccacctcagcaggccagacagccagtcctgccagtgagcagaggtgtgtagaggggaggctgcccacagggatggctatccctgaccactggccagccctgagctcatgggagggcagcaaggccacctaactctgttagtgacctctcctggaccccccatcagctgcccttagagtcccctccctgggctggggagcccaaggctctgtgctgccaagaaaaccagctcccctcactgctgtggaatttgcgtgagttcttggagaagggggagggtgcacgtgtgtgtgtgtgtgtgtgtctgcaggagcactgcccagtgggcgtgtgtctggcgtgggcgtgtctgtgtgcgcgtgactggagcagggctgtgtatttgggggtgggtgggggtgtttgggggagcctgcttgcaccaggaggggcagggcctcagcctccttccttttatcggtttccacattccagagtcagccggatcgctttccctccgcgctgggccgccggcctcccccgcttttcctcattccagcctccctgggtgtgaggaggctggaggaggctccctcaggccacctcggttttgggcagggggtgggggcaggcgaggggccagttattcttcagggttcgggacggcccccaccagactcttcgtggggaatgcaataaggttctgacattcctcaggggctgcctgagagatttaattaaggagggaggagggagccggcctacaccgggaaggggctggggcggccgctggggcccctgctggccctgggccccgagcccggctgggcattgagagcagtgcgggggcagggttgtggttcagtggccaggtcctgttctgcctccctgaatccatcccgcctgcccattgatcagctcacagaccccaggggcgccatttctgccacgggttggccaagaaccctgggtgattgtggggggttcggcatggggagcttgagaagggcaagaccccttccagggccacttccttctcagacccccaggcccaggaagcttagggctggcggccttccttggtgactaaggtgttcttctggcaagttcagggttaattgcaggttagggccttactagatgggtgcttgcccctgggtggggacagggcagtgaggaggccccgtgtgagggcccagccctggtggcatcacacctgccgcgtgccgaaagtggcatctggactggcccatttctagttgggctgcagccactgcacagctcccagggccacaggtgtcctccctgacaggttgcacctcttgtgactacgatggcacgtcccaccgccccaggggctcacttgagctggggcctggccttagtcactggtctccctgccctgggctaacaggtctggcagctgccaagtcacccacggtgctactgaaggcacccacctggggccgggccagcctcctgggtggagggaggagggaagaccctgtgcctgcccctctcccagccctgccagctggtccacacctgctccaggatacagagcctcctccctgcacaggaagacgagctgacatcctgactgtcccctttgcaaccctctgtcctggtgttctgaaccctggctgtgcggaggactcgctcaaggagcttctccaaaatacagctctgcctgggtctcactcctagacattctttttgtttttgagatggagtattgctctgtcacccaggctggagtgcagtggcgcaatattggctcactgcaagctccgcctcccaggttcacaccattctcctgcctcagcctcccaagtagctgggactacaggcgcctgccaccaggcctggctaatttttttgtatttttagtagagacggggtttcaccatgttagccaggatggtctcgatctcctgacctcgtgatcgtcctacctcggcctcccaaagtactgggattacaggcgtgagccaccatgcccggcagaatttcttgtttaattggcctgggggtggggccccagcatggaggttttttttagaaagcttcctggatgattctgatgtgcagcccggcgggcaaagccctggcgtcacaggtgggagacggaagcccagagaggggagcttgcttggatgaggtcacaaagcgtgtgagtgcctgactgagctcctggctgtggcattatctgtggaatgaagagcgccagcttggggtggtggatggagtaagaaagaggctgacacccatggggacccccgctcaatcaccagccaggggtccccgcgcctatagggagggtctacctgccgcagtccctgaggaactcgaggcccagccctctctgccccttctgtgagggcccacgacccctgacctctctgccctgcccttgggactgctgtgtcccaaggaaggggagacggggcggacccagccgggccctgagcctcctcggacacgtcagcgaaactggagccagccgtcctggccgccggcacagtcccgcctgcctggaggggttggcagactcccggggctgggctgctgccaggcctgaccggccacacagagccttggcgggccagcatgaggagcgggggcccggagtctcagggtcagacctgcagcgcctgtcctgcacccacgctgaagcatacggcacaggaggggcgtactggcctcagactgtctatctgtctgtccaagcctgtcccctactcagcaggcacaccgcctgccccagaatcagtgagatgttctcgccaggggctgatgtggtcaccagatgcctgggtcccaccccagccatgctatcccctggcccgtccccgcctgaccctgggcgtgtgtggtgtaccccagaggtgggtgggcgtccccctgggagttgagatgacgagtgccttgtcctccttactcatagggcccctccctgaagtcctgtgctgaaggggccgccaagggacagctcacccaccacgtgcccccttccagaaccagagataccccacccccgctccccagcccccagggtgaagggcagccttggtgtggggatgtctgatctgtgtaaagctggcctgaaaccctctcccttagtagtacccacgcccagggggcaggcagagttctgcgtttatgagtgacgccctccgcagtgaatgtttaccgaccacttggcaagtgctccgagcacagaccaagtcaccccagacacaggcaccacgagcaccacgagcagcgcccactgcacaatgggggctgaggtaggggtcgtggccgggctgtggaccctgtcgccctatgccagttactgtgccagggagggagcaaggccggcagcagcactcagcaaggctgaggaacttgggtggaggacggaggccccagacccttgcgtcatcttcccaccccccgacgtccccgaatcccaggaatcccagggctgcctccggaacacctcctgcaccaggcagaggaaaaggtctcacctccctgcctgactagtgatcaaatatcaaagcccaggtcctgggatcaccgggtgggagggtgggtgggcggcggcaaccaccgtgtgacctgtagacagcccccagccccacgcacacaccaagcacacgcccagaccccaggcgggcgggacagctcccagaacttgttaaaagaacttccccatttgaaaacaaacagaacaacagaaaactacaactccagagggtgagggggcagggctgcttgcaccaactccagaggtgagaaactgaggcccacagttgagaaaggaactctggcctctgtcccctgccaccgtcccctccacagtcagccttccctcgctgggttcctctcggggctggctgatgggttctcagtgccaggagtccctggcggtgccctcagagctgccagcctgtagcttacaaactctggggttttccaaagctccagcgctgcctcctccctcctccctttgatgtgggggtagaattggggctcaggcaaaagagctcaccgcacattttacggggctgggaagcaggctggctgccgcctgctggatggtcagcccaggaccccagcccacagtcctgacctagacccctgtcctgctaacaggaacgcacattccacagctcactacctgtcagccggaaagccaccctgtggccagatggacccacagcatcccctctcccttcacaaccttgctgattaaagacccaacagattacggagcccagagctatggctggtccccctccccagtgcagggtgaagagcaccccccagcacgtgcccctaagagctggcctgcacacctggccttgcagggctgaggactccacatgcatcccccactgcagccctgaagtgtcccagatactcagatgaagaaaccgaggtgtgagagcaaagtcactgtctgcggcctcacagcttggacacctctgagcacagggccgcctgcctggagtgagcgctcttaactgtgaccttaaacgaggcccaaggggagctgcggccacagtggtggccaggctggccaggctggccacgtggaggatcccctcccactctggaacctggctgcatccttcctgaccctggtctggccctgctgggagggctaattcaggcagaggtggcctcaccccccatatggacatggggtgggtgggggtcactcacagcccacatctggaggccaggccgcacccgccgtcctctgagtcagtgagggtggagcgggtcccatgggggaagagaaggctaggggtgtggccccagggccttaggtcatcagacacgagcccccctggggtgggctggccgggccagggacgcgtgcctggggtttggggtgctaacttcttccagtgctcagtgccaggccctcctgggctgttcactcagcagacctgagctaagtgggcctggagacacctatggcaaaggcaggctgggtctcaccttagggaggtgagggggcacacgacagcaagggggacaccgctaggttggggaggcttagcctgctggcctctgaagggtgcttgttgtcgctaactggctaggggctcagggtcggtagctcctaggggagacgactctggcagtgcgatactacacgtgggcagggcctgcgtgggcccaaccccggggacaagggcttcttccttcacctcgagctacccgcagaccccagtggtcacctcaccagtgacttgtctaatctgtcctgggaccacctgctcctcctcacattccaggaacccacgtacctgggggagagggagccctatggacgggtccccccagcctggggcggagtgcaggctgggtcggggtcgtgttccctggactacctgcacagcctgtgtgggggaaggggaagcccggactccagcacaaagggctcttgtgtgagctgcaggcgccactgggcaggatgcttcctggggatgggctggcaccccgtatgaggctcagggacttctaggggtgccaaagtggggagggctcttcctggggacggccccagcggtctccccaggagtctaggtgatgggggccagccacagacctgcctgacttgggcagtgcagctaagatctggagcctggagcggctggtgggagcccccgcccccagggccatctggagggcacgcacccttcacaggtggctgctgcacacctgggctctagctcggacttgctggcaccgcaatggcagcgagtccctgcacctccatgagccctgctttcttctgtctgccctgacgtggctgctggggggctacctgaggtgacggtaaacacttagtgttccttcgtccttcccacttcgctggcacatgggaaggacttgcaccatcactgccaaggggatggctgctgctcatctttcttggtgcccagctcagggcagaccccaagaaacagtagacgaagccgggcacggtggctcatgcctgtaatcccagcacttttggaggctgaggcgggcagatcacctgaggtcaggagttccagaccaacctgaccaacatggtgaaaccctgtctctactaaaaaaaaaaaaaaaaaaaatacaaaaattagccatgcatggtggctggcacctgtagtcccagctacatgggaggctgaggcaggagaattgcttgaacctgggaggcagaggttgcagtgagccgagatctcgccactgcactccagcttgggtgacagagcaagactccgtctcaaaaaaaaaaaaaaaaaagtagatgaatgactctgcagagttttcccaggcctggcactgcccctggggctgccatgtagccagtgtccccacctgagccctgtggccccccagctccagctctgtcaccagcctcagctccccgcctccctccctcacaggggacacctgccaatgcctgtggcctctgcccctcctccaggaaccttcccgccggccacttcctggcggcccgcagcccccagcctaagcaggtctgactgcccaagtggaaaaacatggatcccatagtttccatgtgaagtcttcccgctgcattccctcctccaaggagggcgggacacggagcgtggcagcaggagccggcggccaaggcagccagcttctctgcttacacacccacccagctgcctgcctgccccctcttccagaccctgtagggaggagctgccgctccaagtcccaccattctctccttcctggtccatctctgaggcaggggatgggggaacctacctaggcagaggcaggagggcctggggttcaggaggaagcagtgcatggtcactgcacgttcagtggatgtcatgccccatgatgacctctgtgtgcattgacaaggtcacacagtgagggagtgacggggctgggacagaacctgggtcggggcactggcgacctgactcataaccattgggttctcttgcatttgggggcagaagcagtgaattccctctggctcttcctggcgtgtctgccttctaggcccctgactcacagtcttctgtctctgcctcctctctgctcccagggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacagccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagagccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccgtctcacctatcgcaacctatcgggccctgataagcggctggtgacgctgcgactgcctgcctcgctcgctgagtacacggtcacccagctgcggcccaacgccacttactccgtctgtgtcatgcctttggggcccgggcgggtgccggagggcgaggaggcctgcggggaggcccatacacccccagccgtccactccaaccacgccccagtcacccaggcccgcgagggcaacctgccgctcctcattgcgcccgccctggccgcggtgctcctggccgcgctggctgcggtgggggcagcctactgtgtgcggcgggggcgggccatggcagcagcggctcaggacaaagggcaggtggggccaggggctgggcccctggaactggagggagtgaaggtccccttggagccaggcccgaaggcaacagagggcggtggagaggccctgcccagcgggtctgagtgtgaggtgccactcatgggcttcccagggcctggcctccagtcacccctccacgcaaagccctacatctaagccagagagagacagggcagctggggccgggctctcagccagtgagatggccagccccctcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttataagagatcctttcccatttattctgggaagatgtttttcaaactcagagacaaggactttggtttttgtaagacaaacgatgatatgaaggccttttgtaagaaaaaataaaagatgaagtgtgtttcttgggctcagccccagggtagaagggctgggtggagggagatgaagaaggagtggccctcgctctggggagccagggcccctcagcagcccctgggcttgggcagccctcccaggtgtcctgacctgggtgccatccaccctaggcttgaatgaggtgaggctgggcccaggtgggagcagggctgcctctggcctcggacaagaacgggtcagggagcctcaccttccccaggccctgtcttctgccagcaggggctctggcccatgtgcggctgggagaggcttgtggcacatgtggggccaggtgagtcccttgtgggttggtctgatgggcagttcactgcctgctttcctccagggacagggccctgggctctctcattccaggcctcatggatggtcccgggagcaagtggcctccgggaccttctctacagcgtcccgggagagccaagcggtttgcatggccccagccccatgccactccactgcccaccatgggcgcagcaggaaatcctgctccctgcctcctgcccctggctacagcgagggctctggtgggaggggaagtgtgaatcatcaaaggcagggaccccatgggtggggagaaaggggccgagccccagtgagcaggacaagctgggggacaggaacaaagggcccaggttggcttgcagacggtgccaggattggtggccttgggatgccccctcagcccctgcattagggatgtgcccaggctttctggaaaccctagaagtgggagcattttccaggaaggctgcatgctgaggtgggggcagtgatgctgagtgcagctgtggcctggactgggtgcagggggcttggggacagtgatggacacacagcaccttttcctgttaccctcagtgggatggaggggaggggacccactgggctgccgctgcaggggcacccagaacatgctggagtgagcctcctgcagaccccatgccactgtcccacaggtcatggccccggcccccagcactcaggctcacccctggtgggacagagtcagcccagccagacccagggagcaggccccgtggcgcgggtgttgatgtcagtgccgagtcaggcccagccacgcgaggctctggattcaattagcggctgctgagggctctggcacgaggagggaggaggcgggccgtgggtcatggcgggcagtgggtggtggcagtgggcctgggtggggccccttcttcctgaggcagcggcggcagcccaggtggatttcctgtaggcctgggtcccattaggggagtggctgcggccaggcctgcctcccccggcccgtggctgcatcgtcaaaggggcctttgtgggcctgaggctgctgctgaacacggcggctgctgaagaaatgttttcactgcaaagcaaacctggccgagtgggatggtggcagggggcagtggcgggggggtggcagggcccaaaaaaaggaagccttccctggaacagtgtctggagtgtgccatcagatcagggcttcggggaaggggagaacccagccagggggcgaccaagctgagatgcagcctcgacccgggacaagccccccgactctaggccagggaccaggggcagacgtgggggtgtgcgagcccccatcaccaggtgctgactgcagcaggccctgggccatgtgggtgacacatgctcttgtttcatgcccggcgacctcgtctattgaaaaggagtggccacagggagggaagacaacatgctcacagtaagtggagacaggaccccagcacctgctccccagccacgggtggggctgccggccacgcgggagggcttagggccactgtgagctacagaagcaatacaccctacttctatgggggtagggggtgatacagttcacccagccccctcacaggcattcacacactcatccccgctcaattcacacccagaagcgtggcacccaagacaggtgtatctctgcatctccaagaccaaagcatgagctgttccttcagtgcaggctgccagtccctctcgttatccccccacctccaccctgcgccaagcatggtaccaagcacacaaagtgctgggcagccctccgtggaggctgcctgagcacagacaggaccttggtgttcgaggctggcctggctcccagcccctgctcctctcactgtggctggcttccccttagatactccacaaatgtcaggggaagggcataggtgggaccacagcggaggcccctgggtgaggatgaggaggggacggggtgtgtgcacgaaccctggcctcctctagctctcataagggcacacactgttctgcccaagccaagatggaaaatctgtaaaacagaagaactcgagggtggtggagtggatgcagttgccaacctccccattagccgtgcccacagatgacactccagactttccatgctcagcctagatttgctcagaggccccggcaccccagggagttagtggggggctccagcttccaggacgcctgggggtgcaggggacctgccacctctcagaacagctggggggctggcacacatccttggcatccaccagcttcatgggggctggcagagcaggggccagggctcgggggcagaggggagaggaccctagcctggccacccatctgggagtgatttgagaaattccagtcctcactggtccttcgaggctattcttaactgtggtaattacagggtcagccttggccagtggcaccgtgaggtctgggcatcattaactcctccagaggccacactggggccgggcaggagacgctttcaggggatggggaccctgtcactgggggcagagcctggaaggcaggaagtggtgggtggaagtgactggtgccaggtcccttcacacaaatgcctccactgggggccctgcagggaaggggctgtctgacctagaaaggtctagaagacaagatgccaggcagctccgggcctgggatgggggacatggggccagatcctagacgtggagtctgaaggcccgggagctccgactcctcaaggcggggcgggtcccactgactcctccctgaatctccaatgcccagagcaggcaggaggctgagggcagccctgactctgcctcttaccctccatatggcttcagggaaggtgccgaatcttgctcacctttgcctccctcatctgtaaaatgggccttgccagcttctcagcccctccctgggtgtgacagggtgggaaagggcgtcactgtcaccctgacccctacccctcctctgggcggctctcagcccggggaagcccttggcaggagctctcgctggtactcaggtgggagctcttctggggactccccggaagatcccgcagccttccttacccccagacacatacccttgctgctcccagagcctggacaggtcactgttgcctgtgactcagtttcctcagttatgcaatggaagaatgaataagcttgccaagtaccacccctttcctggctctgacattctcggatccccctgcctgtgaagattccagcaaggcccttataagtcacggttgaagtttcagaaggcggatggagtccctgtctctccaccccggccctgcctggctacgtctctgaacaccccccccagcctcagtctccccagctgtgttgtgggtggtctgaacagatgagtcactcataaatgcttgccctgggcctcctggtgtctggctcctgagccgcagtgggccaaggccatctcggcacacagctgactgtgcctggccaggaccccgccaggcactgccaaaagccctctccacacacttctgggggcagatggaaggatgaggtgcacctggagccccccaggctgcctgggcaccagccccacctggggacatacctcaggatagaacaggacagccatgtggctggtgtggagtaggccgcataaacctcagtgggccgcataagccaaggcccacctccacctccacctccacctccacccccacccccaccctgccaggctgtccaacaatgcccacgtccaccctcctatcatagcctggagcctccctgggcctcagccctgccagaacatccacagaaaaatgaagcgtattcttgcacttctggatcacaccctctccctgaatgccaagcatacctgtgtcaacccccagccatgaaacctctggtgaccaagggcccactctgctaccaggggccagaggggcacctgagcacctgctgctcgtgacatctggaagctccgggggtacagggccaggtgtctgttgcaaggccttgcagcccagatcaggtaccccagaacaccccggagatcagcccgcctcactgacaggccggatcaggtgccctcacctgcggcgccttgggtcatcagccccccagcccacctgcgtgccgcagctcctacccaagcgaggtgtccaaggtgagggaggccagggcgctggagaagaaccgcgtgtcccacagcttcacttcgcgctcacgcatctgcagggagggcgagagaggggctcagaggggcctgtccctcagccccacccggggggctcccagggaaaccagcgcctgagggtgcagcctgacacggggcacctgccccagagcagggcttggagtgggggtgggagtcaccccagggaaagagaatctgggttttcatgttctgcccctttaagaacccttaggtgacaaaggatgaggggcggttccctctgtgttctcgggtccctgtagggccactatggctcctggggtcaggctgagctattacaaatggaatctgccagttttcagcagccgtcagtcccctgaggctctgagacccggcagcacagccaggccgtatatggacaggcctggaactggccctcagtcccccgcctcccattggtttcgtccccgcccaaagggctggacatgtccccacctggccgtgccctgctcctccaggaggaaccccctacctggttgaatccagtagacacaaggtgctcccaggtgcccatccatgccagccggctatccctgctgttctcatgggcctgcgtgctctgcaggaggcaagaggtggacctgagcccccagggccctgctggtgggcggggccccctggaatgggcctgagctggggaacttctgctgcccacctgcctgaaagcctcacagagggtgggaagggctgggtccttctccacgtccccactgggaccaagggtggtctccgaagcaccccggggatcagccccgcctccgccccagttgagggcagctctgcacccagaggccaacctggctgctcctcccgagtgtccctcctaccaaggagagggctgcctcactccccagctccaggccccttccctgctgcgccaggggctaaaggcactggcactttcttgcccctaagagctgtgtgatcctggggatgtcacactctgtcaatgcctcatttctctcgcttgtgtaaggggctcacgatgcggtgccacccgcttcccagggctgtcaccatgtggaagggcagggcttgtggcaaagcaccgtgtaaactgggggatttcgaggatcactgtggctgccccaggcaagaggcagggcctgggacccacctctgggcaacgtccagagagcgccaagtagtgcctctcctggccctcccgaggtgctggagctgccagcaggaaggctcccggcccctgggaggagagggaagctcacatggtgggtggggccctgtcctcctgggccctggcagtggggagctgagggggccagaggaaatgcaaacagctcctcccagtcaccctggcccctggagcctgagacgaaggaccctgttaccaaaaatagctcaccccaaaccatggccagcttcctccgaacttcccacgatctccttgggaatgaatgagggagggaagcagcctgcgaggagctggcctggggccccctccccagcccgtggaggctgactccagcgtgggagaccatcggaaacggctccaggtcccgtccttcgaggggcttttctcactgttcccttcccaccaggctgtggccggcacaggaagttggggctggagcctgagaaccaaggccccactgccctctctccacgtaagaggggatatcgggtcaggacaagggtcgagccattggccagccctgccctcaacacccggagagggtcacagtgtcattcaggctcctgccctctcgttggtgtttgttgtgcaaatatctgcgtgtgtgcagcccaccaggtggctcttagcttgtccaaaagtcactcattcattcaagaaacacacaaggcctcccaggggccagaactgtgctaggagctggcagtggggccggatggttctcagatagagggcaggtgctggggggaagcagtgcccctcactcatctgttctctcgtcatatgggtatttgagccacacactattcgagatgacatggtgaataaaatggggaaagtccctgtgcccgtggaataaacacatcggggaggtagatgtaggccaaagagaaatcagtgtgtcattccctgtgactatgcatgccatgggggagccgcacggtgttaggggaggaagctctggaggtggacccaggagagccccagcctggccacctcccttggtgggtcagtcactagctctgtgcctcagtttccatgtctgtaaaaagcactgtaacagaatttactttttttttttaacctttcctatggtgctgaaggacctacttttgaagacggccacaaggagtaagagggaacacttgtagaaggctcaggattgtgtctgacacgtgtcaagtgtgcatgtctcacagctgatagcagggtaccgccagactgtaagtgagggaagacctagcgtcattcctgctaggctgggagggttgataggcgtgagccaggtatgggaactggcatctgcaaagagttggaaactggaagcagagagacccgctcagccagcaggtggggacgagggaggcggaggctgggccaagcctgcagggtcccccaggggctgccactgagcacttttcacctaggggcacaggctaaggctaggggtgggacgcccttggcctgtagctcccaccttcctaattcacatgtgggaagcctaaaggcacagagagacgaagccatggtgcaaagtggcttggccccagctgtctcctccacctgcacaagatggacgtgaggctcagagtggtgatgaggcttgcacaaagtcgcagctaggaggcagcagggaagggaggaggagccgcccaggaccacagctgccccagaaacgctctgcttccagcaaacatcctgggccagctcttgctccctggagcattcagcccagccttcagaggtccaggtaagagctttgtccgtgcccagccactccccaatgtgggtacacccagctcagtttgcccagagaccacaggaagcccccaggtgagggagggggtcagtggcccaccccttaccctgtaactcctcatcaatggagtgatcaccagtatcaaaaatgagaggtgggctgggcgcaatggtacctgccgtaatcccaacactttgggaggctgtggtgggaggacggcttgagcccaggagttccagagcagcctgggccacaaactgaaaacttctctcttaaaaaaacaaacactaggccggcacagtggctcacacctgtaatcttggcattttgggaggccgaggcgggtggatcacctgaggtcaggagttcaagaccagcctggccaacatggtgaaaccccatctctaccaaaaatacaaaaattagctgggcatggtggcaggcgcctgtaatcccagctactcgggaggctgaggcgggagaatcgcttgaacctgggaggtggagctcgcagtgagccgagactgtgcccctgtgctccagcctgggtgacagagcaagactctatctcaaaaaacaaacaaacaaacaacccaactagcttgacgtggtggtgcgtgcctgtagtcccagctaccagggaggctgacgcaggaggattgcttgagcccaggaggtcaaagctacagtgagccgtgttggcgccactgcactcccgcctgggcgacagagcgagacccgtttgccagcctcagcaagcctcagagaagagccgtctccccagctcctcattctcctgcatagggggcaagaacaggggctgcagctgggacccaggcatcctgctaccctgcagccccaagagggcccccaccacctagctctgagaataggaggggctgtggcagggcaggagcagtgtcagccccgcagggggtgcaggaggggaggcgcgtgcccgccccttcatcaccatggcgacacttcctgtgcagggcaggatggttccaggagcagccctggctccttgctggggtgaggggacctgcttcaatagtaagaccccccacttacccccttccctcctctgaggttcaccaccccccactggcctgtctgatgcactgagattcctagagggctcaatccggggccccctcccgcccagacaagggttctgaggcctcgacactcatttggggctgccactttcccagaacagcctgggctccagggcctcacccagccccagctgggccggttgtaaagggaaggggcggcagtgggggtcctgggggttctgcatccagaggggcgagcctgcctctgtcaccctgaggtgggaccatggagaagccacagaaccatccgactctcggggtctgcacctccgaggaagtggaatatgccaagtgcctggcgcataacaaagggtcatacatgcagtataagaaccaagcatgggtgtgaggaggagcctccccagggtcccctgctcaaagctcacgcctgaggcagggctccaacaagacagtggagggcggactccctggcccactctgggctccgggatagcaccagggctcaggtggggtgggacccacagaggacagaggttggatggagggcaggcggccccgctccctgacccccagccacaccccactaggcaggaaggaggattgccagagaaggagctcccagaaggcctctccctcgagccggcccctcggctcacaccggccctggctgccagcagcggttttcctaatagaagccaggtgtgggccagatgccctgggcggaagtggggggcagggccacacggagagcggcattccaggcctgctgcccccgcaccagggcccgagcacaggccccagccagcagctggaaggggtgggagccacccacgctcttcccaggtctcctcgccccaaagccccgcaggggggctccctccagaaccagatcctctccctctctcttcgaggagctgggagccccttggatagcagccactctatccccacctcggcatcagtcaccgccccagccctgctggaagaggaggggagaggaggaggaaggctggaaagagggggcggaggaggggagaataggaagaatcacgtgggcccagtgagctggctcagagccatgcccggtaggtcgggggcagaagcataggtgccccagcagtgccctgggctctggagaggagagtgcaacctgagaaagtgaagggggccgggggaagcctctgtggcaccttcaagctgagcctgggccccgctttctgggcaaaggcttggaggtcaaagaaagctacctagtgaggataccgtacacacccacactgccttgagatgcagacagccaccatctaccaggcccaggtcccacatgacgaagaggtcagccagcctcaccagcaagtacgaccagggtgtggccaaaaccaccctgcctggctagtttcactgcttaaatgggagtcctctcggtcttcagctggacaaaagtggaactgactgtaccgtttggactaaaaagctgcaatcttccatgtgactgggtttctctcctgagtcttgtgtgtgtagggggctctggggctccgggctaccactagtttggtttgggctggtggtttgcccttgaccccgggtggggaaaacgtcctagaaatggggagggggtatctatgatgggcctaggtctttgctggggagctcctctcctgagctaacagtaggaccctaaacttcaccttcctcagggaataagcctcctcagcttctagaaagttctttttagaaatgtaaatccatggccaggagcggtagctcacgtctgtaatcccagcactttggcaggccgaggagggtggatcacaaggtcaggagttcgagaccagcctgaccaacatggtgaaaccccgtctccactaaaaatacaaaaaaattagccgggcatggtggcgggcacctgtagttccagctacacaggaggctgaggcagtaaaatcacttgagcctaggaggcggagtttccagcgagccgagattgcgccactgccctccagcctgggtgaaagagcaagactccatctccccacccaaaaaaagaaatgtaaatctactcatcgcacttcctgcttaaaactccctaatggtggccggacacggtggctcaggcctgtaatcccagcactttaggaggccaaggcgggaggatcacgaggtcaggagatcgagaccatcctggctaacatggtgaaacccagtctctactaaaaatacaaaaacaaaaatagccgggcgtggtggcggtcgcctgtagtcccagctactcgggaggctgaggtgagagaatggtgtgaacccaggaggcggaacttgcagtgagccgagatcacaacgctacactccagcctgggcgacagagcgagactccgtctcaaaaaaaaaaaaaaaaaaactctctaatggcttcccacagcccaggtaaccatgggcccgtatcccccagcgcccctcgcgcagacccctcagacaagcccgtcctccttcaggccatctatgtctgcccccttggcattactcaggcctctgctcccgggccagttactcagggaagcactaaaccagcccagcaagagaagcccccagcaactacctgcctagcacaggcaatgtttacggagccagacacagggccctgtcccagggttgttgctcctgcctacaaggtctctgtagggcaaatgaacggtgtcccagtggctggatgcctgcagcatgagccaggtcccagcttccccgcttggaactgaaatggccacgcacactccatgcacagacacaaaccagaacacgctcagtccctggaccctgtacgttttgacaggtcccacccagggtcttcctgcagaggacaggggttgtttctttttggctcctctgcagctggtctctgctgaccgtgccagggtgaaggtctcaaaggaaggaagtgggaatcccagatcgctgcctgaagccacacgatggcctccgtggagagcctgggggaagcttagcttctgccacccggtgatcaaagccaggccctcccaggacccacaacacacttcacaggaagagctcccagcagtggtggtccacctcctggggacccctggtgctgcagaacatgtctgccaggaccccaggcctgcccctacctccacctgctagaaccactgggtcctcagcctcagtggaggcttcaacccaccccagcttgcccacacaactcacctgagaggcccgcggctttgttctggggtcaaagatccgcagctgcttgtcctggaaaagcagagaggaggaaacaacttgcgattagggctggagggtccctggaagccagcctgctcccctcacctcccaacccccagctctgagcagcccatccccagcacgcagggctgccatcacacaccagggcatccctcctcagccctgttcctcctcctcagcacagcagcaaccaccacccagtcccccaggtttctgtgaggagtgttcagctgcctgagacctactcagtgaggagtgttcagcttcctgagacctgctccacgtcaggcatcccagacactcgacccctcctactcttccaactaccctatgaagtggtactatcaccatgatccctcacagacagacaaacggaggtccagaaccaaactctaggctgtcagcgccccacacatgctcagccctgtactaggcccagcctggagaggctcatatgacgacctcatttctgcacttacagaatttagcactaaccaggaagacgagcttacacttccgaaccatccattcggcagttattgattcagattatccaaagggaggatggaaacagacaaaaagcagaaaaaaatgtactgaaataaagcactcatgctttgtatagaccttctttctgtggaacaatgtgtgtgtgcatgcacacgttgtgtgtgtgtgtgtacacaaacattcatgcataaagaaccagggcacaatctgtatccactactacaggctgggccataataattttttttttcttttttgagacagagttttgctctgtcacccatgctggagtgcaatggtgcaatcttggctcactgcaacctctgcctccctggttcaagcgattctcctgccttagcctcccgagtagctgggattacaggcgcccaccaccacatctggctaatttttgtatttttggtagagacggggtttcaccatgttggcaggccggtctcaaactcctgacctcaggtgatccgcccgcctcggcctcccaaaatgctgggattacaggcgtaagccaccatgtttggccataataaattaagtgcaaaaaggaagttgtagaataacatggcatagtgtgattctactgtggtaaaaatcaacaaaaatctccatttgtgtgaccacgatcctgtttgtttttattgatacccaactatcatacagcccatacattttacaagtttgctgagcaaggagaaaggtctggactaacacaggcctgtgtgctaatgctaggtatcaagggtggggaagatgggggctggttaacttttcctttttacgtcttagcacaggtctattttgtttcattcagcacagattcctgttttcatattttgaaaaacagtaaacaactggaatttgaaatgaaaaacaccaccagccaggcatggtggctcacgcctgtaatcccagcactttgcgaggctgaggtgggtggatcacctgaggtcaggagtttgagactagtctggtcaacatggtgaaaccccgtttctactgaaaataaaaaaattagccgggcatggtggcaggcacctgtaatcccagctactcagggggcggaggcaggagaatcgtttgaacctgggagacagtggttgcagtgagctgagattgcaccactgcactccagcctgggcaacagagtgagactcaatctcaaaaaaaaaaaaaaagaaagaaagaaagaaaaacaacatcatttgcaccagtacagataaaaaaaacttgaaatactcatgctcctcaacatacaatggagttacatcccaataaacccgtcttaaattgaaaatatagtaagtatggccaggagaggtggttcatgctggtaatcccagcactcagggaggctgaagcggcagatcacttgaggtcaggagttcgagaccagtctggccaataaggtgaaacctcgtctctaccaaaaatacaaaaattaaccgggcatggtggcacgcacctgtaatcccagctactcgggaggctgagtcaggagaatcacttgaacctgggagacggaggttgcaatgagcttgcagtgaaccgagatcgtgccactacactccagcctgggaaacagactgagactccgtctaaaaaaaaaacaaaaaagctgccgtaggccaggcacagtgggtcctgcctgtaatcccaacactttgggaggccaaagtggaagaatcacttgagccccggaatttgagaccagcctgagcaatacggcaaagtccatcaatggacatttctctctttttgtatttgtttttgtttttgagatggagtttcattcttgtcacccaggctggagtgcagtggcgcgatctcggctcactgcaacctctgcctcccgggttcaagcgattctcctgcctcagcctcccgagtagctgggattacaggtgcacgccaccacgccaggctaattttttgtatttttactagagtcggggttttgccatgttggacaggctggtgtcgaattcctgacctcaggtaatctgcctgccttggcctcccaaagtgctgggattacaggtgtgagtcactgtgcctagccttttttgtttgtttgtttttgagacagagtctcgctctgttgcccaggcccaagcgcagcagtgcaatcacagctcactgcaaatcaacctcctggactaaagcaatcctcccacctcagcttcccaagtatgtgggaccacaggcacaagccaccaggccctgctaatgttttaatatttctttcgtagagatgaggtctcactatcttgagcaggctggttttgaactcctggcctcgagtaatccttctgcctcagcctcccaaagtgctgggattacaggtgtgagccaccaggcctggtttgaatatacattttaaaaatatatatatagaaatggccaaaaagcgtatgaaaatatgttcaatatcactaaccattagagaaacacaaatccaaaccacagtaagatatcccctgacacccattaggatgcctattacatttttaaaaatagcaagtatcaggccgggcgcggtggctcacgcctgtaatcccagcactttgcgaagccaaggctggggggaatcacttgcggtaaggagctcgagacgagcctggccaacatggtgaaaccccgtctctactaaaaatacaaaaattagccgggcgtggtggcgtgcacctgtaataccagctactcgggaggctgaggaaggagaattgcttgaactcaggaggtggaggttgcagtgaaccgagatcatgccattgcactccagcctgggcaacagagcaagactccatctgaaaaaaaaaaaaaaaattgcaaggctgggcgtggtggctcacacctgtaatcccagcacttggggaggccaaggcgggcggatcacaaggtcaggagttcaagaccagtgtggccaacatagtgaaactccgtctctactaaaaatacaaaaattagctgggtttggtggtgtgagactgtgttcccagctactggggaggctgaggcaggagaatcgcatgaacccaggaggcgggggttgcagtgagctgagatggcaccattgcactccagcccaggtgacagtgcgagactccgtctcaaaaaaaaaaaaaaaacaaaaccaactgttggtgggtacgtgaagttagaacccttgcacactgttgatgggattgtaaaatggtgcaactgctatggaaaacagtatggcagttcctcaaaaaattaaaaatagacctagcatgtcttccagcaaccccacttctgggtacatatccaaaagaactgaaagcaggccatgaagagatatttgcacacccatgttcatagcagcactactcgcaatagccaagaagtggaaacaacccaagatctactgatggataaatggataaacaaaatgtggtctgcgcatactatgcagtcttcaaaggcaaggaaatcctactgcacgccacgagtaacccttgacgatgcagcatttcattatgctcagagaaataagtcagccccaaaagagcaaatagtatatgattccacttatgtggggcatctaaagtagtcaaattatagacacagaaaattatagacacagaaagtggaatgccaattcctaggggccgggaggtagggcaaaggggaactgctgtttaatgggtatagagtttcagttctgcaagatgagaaaattctcaaatctgtttcacaacagtgtaaatatacttaacactactgaactgtacacttaaaaatggttaagatggtgaattttggcactttgggaggtcaaggcgggaggatcatttgagcccaggagtttgagaccagcctaggcaacacagtgagatccctgtcgctacagaaaatttaaaaagtagctgggcgtggtggcacgtgctagtagtcccagctactcaggagtctgaggtgggaggactgcttgagccttagagtttgaggctgcagcaagctaaaaaaaaaagaagaaggtaaattttatgatatgtgttttcttaccacaatttaaaaaaatagctattagcccacaaaaatacattgctaagttaaagaagccaatctgaaaagctacatactacataccatataattccaactatatgacattctggaaaagtccaacatacagacaatgaaaagatcagtgcttggcagtgatctgggaggagggcggaagggatgaacaggtggaacccaggggatgttaagagcagtgaaactactccgtatagtggttacattatgtcatgcatttatcacaacccatagaacatacaacacagactgacccctcatgtaaactgtgagctttagttaataataatgtatcaggctgggtatggtggctcaggcctataatcccagcacttcgggaggctgaggtgggtggatcacttgaggtcagaagtttgagaccagcctggtcaacaaggtgaaaccccatctctaaaaatacaaaaaaattaggccaggcatggtggctcacacctgtaatcccagcactttgggaggccgaggtgggtggatcacctgatgtcaggagttcgagatcagcctgaccaacatggagaaaccccgtctctactaaaaatacaaaattagctgggtgtggtggcacatgcctgtaatcccagctactcgggacggggaggcaggagaatcacttgaatctgggaggcagaggttgcggtgagctgagatcgtgccattgcgctccagcctgggcaacaagagtgagactctgtctcaaaaacaaaaacaaaaacaaaaacaaaaaaacaaaaagtagccgggtgtggtggcacgtgcctgtagtcctaactacacaggaggctgaggcatgagaatcacttgaacccagaaggcggagattgcagtgagctgagatcgtgccaatgcactccagcagtgcaataataataataataataataataataataataatgtttaccattggttcctcaattgaaacaacgtaccacactcacgcaggatattcatcacagacactgggggaggaggtaaggaatatggaaaatccttatacaacttgctcactttttctgtaaacttaaaactgttctcgaaaatagtccatcaactaaaacaacccaaaaagaaatgcaggggaaaaccaagtgaattcccgctccatgtgcagcccctccctgagagatgagtagcctccctgctactaccaagttccaggctaagtgctggactctggggcctggaggttgtcacgggaaaccgcggggaagaacttagacctggtcatggaaggacaaacagagcttgtgctgggaaggcaaaggcattcgaggaaggtaaaatagcatgagcaaagaggtggagaaaggaacttgctggtgtgtggcgttgggggaggagaggccacgtgaggaggcagatggtgggaaccaagggggccgtgggcacacgcatggctggcagaggcgggggcctgtctggagagggcctcaaaagccaggtctccctggtctgcctcagcagggccctggttttatgccgctcctggcaaagccctgccagctgcagtttaccaagcacctgctgcgtgccaggcgggcaccaggtacagtccagggactggctcttaaaactccactactccacacctcggattcagagggatggcgagggacagagagaggaggatgagagacagaagacagagaccagagagagaacagcgagggacagcaagggatgagagaggacagagtgggacagaaacagagcacaatgacagagcgggccagagagagcaagtagagatcaaggacagatacaggggacagcaggagacaggcaggacacgagcgacagcaagcgacagaggctctcaggagatgaagggcaggacacgacatccagcagtcagggctgctcctgccccacagaggtgcagagaccgacagcccgagtccagatgccaacaccaccactgaccagctatgacgtgggcaagcccccgagccccctatggtttctttttttcctttttttttttttttgaggttttagtttgtttgtttgtttgttttgagacagagtcttgctctgtcgcccaggctggagtgcaatggtgtgatctcggctcaccgcaacctccacctcccaggttcaagttattctcttgccacagcctcccaagtagctgggattacaggtgcatgccaacatgcctggctaatttttgtatttttagtagaggaggggtttcactatgttggccaggctggtcttgagctccttacctcaggtgatccgcctgcttggcctcccaaagtgctgggattacaggcgtgagccactgcacccggccagttttgttgttgttgttgttgttgttgttttttaagagagagggtcttgctccatcgcccaggctggagtgaagtggctcaatccgagctcacttcagcctcgaactcctgggctcaagcaatcttcctgcctcagcctgggaccacaggcgcgtgccaccatgcctgtctaatgtttgcattttttttgtagacatggggtttcaccatgttgcccgggctgatcttgaactcctgggctcaagtgatcctcccacctcgtcctcccaaagtgctgggatgacaggcgtgagccagcgaccggccacccgcccagccctgtgaactgtgaggatgcggacagcgccacccctgggcagggctgggcgctggggctaagggcggaactcacagcacacactccatgagggcagctgggccaccctcatggaggagcttaacgcggggtccaaaccagggttcagagtgggcactgaggctgctctggctcagcggagaggaactgggctgcagaggccgcgtcctccccggctcatcaggctcaaccatgccgggagtcaggagcgcagcaggccggaatgggccatccgtgaggagagcgcgccccctagcggcctcctgccccttctctcccagctcgggaggccccttcacccagtgggagtagctgagagggagcaggagggggctttggtggtcctgggaggcagacctgctcacacagaggcaggacaggagtggaagccaggggcacggaggcttccccgccaggaaggagatggggcgggggtgggggcacactctggtggaaagtcccatgaccccccacccccatccccatcaggcagcccgtggcatgagcagctccagtgcataaacccagagccaggtgcggctgcaaagaggggctcacgctcgctcctggtgtggggtgggcccatccagcagctccagccacagctcaggacaagccctcgctctctgcacactcatgggcatcactggctgccctaccacagtcaggccgccccccactcccggctccatactgccagggtttccagtgtaggatgcccccaccaggaccccgatgtactccctttacagcaaaagaaggtggcagccgacccagggctgaggtacccattggccctagactgtgctgacaggtgcggcttggaggcaatgctgcgtccccgcaggcggaattcctaggtccaggaaccagggaaggagggggagtcgttccactaagcatcactcccacgacccacttaggaaatgtgtgcttctcgtccctgcaactttaagctctgggtttagcgggggaaaacacatccactggggaagcagcaggagctcctccgtctgtgactcctatgactcttcctgcaagacaccagtaagcaaggagaagagtggccaagccggtggcccatggggctgctcactgtccttccctacacaactgtgatagtaaatagggctcggacccccaggaggagggcctggaccaccacacctgtgacagaggggcagagacagtttctcaaagaaagatgtcacggtcccaaggcagccatccctgagtcctgctgagactacccaggccatcccctctgcctgggacgcccgtcccctccttctcagccagggctcatccctcaaggaccggcctcgagctcactctgcctgggaagccgtccccagcagggttaggtcaaagcacgcataccaggtctccccagaaggggctccctgggggccttattggcccccagagcttaggccagtctctcaggactctctgctcaacgcacaccacagaggaaaaactgatcaagactgggagatgcggcttccacaaaagcagagtacagaaaagaaagttagactagggtccctccaagtatgcagagccctggggcggaatgctcaggtctggtaggcctccctgccctgctagctcctgttcggctccattcccaggcctctcagccattcttcatgtgtcttcaggctcggcacacctccagaagggccctgatgggtgccctcattcccagcaaccccgacaggtcttcagagacccttggtggtacccacggccgcctccctggggaagccctttggccctggtttcaggctccagcctggtcctggctttcctcctcccacctcctcccctgcaggctcttctcatcccctcctgggggcagcactatgtggtcagcaaatcaaacaaacgggaccttttcacctgcagccggattctgctcagagcccctctgggcccagactccactgacacctccaggtaccgccggcagctcagcaaggctgcagccaccctggagcggctctgcctagaacattcacaccaggtgctcctctagcgccccctctctgccacagcacatccccgtcccagtgacaggcctctcctactgcctcaggaccgccacgcctcccacccaatccttctccaacacttggcttcctcctcccaaaggtctccgccactcccggcagagaacagctctcacctccccgcaggctgccacgcatccccctgtagacactgcccctcctgccacacactgtccatgtggttccaaatgcgaatccgctcccctcactgcaccacctgccctactctggcctttaacacttcattgccttcccattacccctacggcaacaggcacaacccttactcaccacccagcacccgcctgccccgcacctgcctgtcctggccccgatccctgcctgaggccacgcgtccctggcctgtccaaccagctcaaagcaccatgtccctcttgcagagcccaggtcacgggtcctcttgtctgtactgtcctcgacggaagtcacctccccagcaactggggcctggcccagcacctgcggccgaatgctgcttaacaagagtcttgcagaaaggctggcggttcagacagaccagacaggcggccagaggaggctgcctgagggtggcgacattagggcgcaaaccagggaccagcgtgggctctcatctgacaggggcctaggcaaggtaggggcttccagatgtaggtgagcgggggtgtgaggagcagctagggggcagggcacacagatgaccatcctgacctcagtgctccactgcctcctaaacaacaagcctggaaggcccagcccagggggtcccagcccaggaggcctgcacagagccccacagggcatccccacctgcctgctcaccttgcacgccgtgcccaccagggctccatctcggctccagacggcgctctgcaccaggtccccatgggctgccagctctgcagagaagcagtcacagtcaggtcccgggcagtgagggcaccagggaagtgggtgggggcgggccttgctggggggaactcccagagcaaaggcagcagctacgagggtccttttcagccaagggggcaagggcagcagcttctcccagacaggcttcccctgcaccacaggctgcttccttcaccccacctttgtgcagccgtacatcactcaactaccttccgaggcttcccgctcctggcctggctctctcatccctcccaggctcacttccaacatagctccccaccaacagggtcactcctgccctaagcctctattcctgccatctatactctccctcgctagtgtgaggtcttaaaatacttctctacattctctgcaactcctgttccaggttaaattgtgctcccctaaaaagatggtgaagtcctaacccccactacttttcggaggcttgctctgtcacccaggctggagtgcagtggtgcaatctcagctcactgcaatctccgcctcctgggttccagcaattctcctgcctcggcttcccaggtagctgggattataggcacctgccaccatgcccagctaatttttgtatttttagcagggacggaatttcaccatgttggccaggctggtctcgaactcctaacctcaagtgatccgcccacctcggcctcccaaagtgctgggatcacaggcatgagccaccgtgcccggcctattattattttttgagacagcatctcactctgttgcccaggctggaatgcagtggtgtgatcatagctaactgcagctttcacctcctgggttcaagtaatcctcccacctcagcctcttgagtacctgggacacagacaggcacacgccaccacgcctggctgattttttaattttttgtagagattgtgtctcactatgttgctcagactaattctcaaaatattgggctcaagcgatcctcccattttggcatcccaaagtgctgggattacaggtgtgcgccacgacgcccatccaagaaggtttttttttggtttttttgttttttgttttttgttttgagatggagtcttgctcttgtcccccagggtggagtgcaatggcacgatctctcttcgctctccatagccactgcaacctctgcctcctgggttcaggcaattctcctgcctcagcctcctgagtagctgggattacaggcacccgccaccacacccagctaagtttttgtatttttagtagagacgcggtttcactatgttggccaggctagtctcgaactcctgacctcgtgatccacccgccttggcctcccaaagtgctgggattacaggcgtgagccaccgcgcccggccaaagttattttttatttttatttttttgagacggcatctcactctgtcacccaggctggagcgcagtggtgcaatctcggctcactgcaacctctgcctcctgggttggagcaatactcttgccgcagccttctgagtagctgggattacaggtgtgtgccaccacgcccggctaatttttgtatatttagtagagacggggttttgccatgttggccaggctggtcttgaactcctgacctcaggtgatccacctacctcggcctcccagagtgttgggattacaggcatgagccaccgcgcccggccattatttttttaaatggagaaaaacaacagaaaaaaaaaaaaacaggtaagaggatgaaactgatggctacggagagcaaagagagatggggtgtttattacagcctcatagaatcttaagacttttatactatgtaagtgtaaaactttgatatctgtttttaaatttatgtgactaaacatgccaacaaagaaacggagtgctgtccagagtggggctgccctgggaagggcaggccagggtggcctgtacctgtcaggggctgctgcttggctgcgtcccagaccttcacagtggtgcctgctgcgctcaccagaatgccgtcagaggtggggtggaactgcagtacctccactgggaggtcctcggggcccagcaccaccccgggtgctgagggcagggcctggccaggccctggcagtcgccagagttttacctgcaagaaagaccaagtccgtgagcacagggctgagggcctcactgccttgagtcagctgccgtgaccccagtgaggtcccgtgttggaactaggctgctccaggagaccacacaccttggccttgggaggagcgcccacccgcctcagcttgcttgggccaggggctgcataccccacatccgagaaaggagggagggaatctcagctcctagaccacacggtgtggtcccagagttggggaagtggctctactgtttctggcagcatccccacctgctgtcctcgggctccaggtcaggtcagagccacggctccaagcaagcccttgggagccagtgtgggaccaggaattcagaccagccccgcagccctggggagtggggtggggctggactgggaggcagcagagccctgtggggatggcgctggggctcagaaggccctggactacgggctgggacatagagcagctcttccaactggctccactcaccgtcctgtcagccgagcctgtggccaggaggaagtcatcaaagggcgagaagtccaagtcggtgactaggtctgtgggagaggaatggctgaacccaccggaatgtcctgtttccaacccagtatgaagcaaagcccagggcttccgaggtgacacttttgtgtgcacacagaaacaggctacaagtctacaagggccctctggacaccatgggggcaaatgccacaggcccctcctgcgacatacgtccccgagggccctgctgacccagggtggccaagggctctggcatcaggaggttggcaggaaatgggcaggaagccgcttgagtcaccaggcacctgcaggaacgcagctgcccagcccgacccctcctagggcagcacagcccactgctccttcagtcgtggaaggtccccaggactcaactaagaaattgctttttggttaagcaagccggagttggctttagttctttgcaaccaaagaacctgaatggtggccgggcatggtggctcatgcctgtaataccaatactttgggaagccaaggtgggcagatcacttgggctcaagagttcaagaccagcctgggcaacacggtgaaaccccgtctctacaaaaaatataaaaattagttgggtgtggtggcgggcgcctatagtcccagctactcaggaggctgaggcaggagaattgcttgaactcaggaggcagaagttggagtgagcagagatcacaccactgcattccagcctgggcagcagagccagaccttgtctcaaaaattaaatactaagaacttgaacggctcagctccagaggtggggaggggtaggtggggtgcacagagtgagccagaccccagagggaaatgcggtgggtggttggggaggtagagactaggcatggagggtggcggggtttcggggtgtgaacaggacgagaggtatcaccagagctgggagcacagcgaccacctgctgctgtctgcctcccaacagggctgagcaggactgtcttcctcccggcctcaggagacagggaaaagataggacggacgtgcacaggcacatcttgggatagccctggcctggaatcccagctggcaggaccacaacattcctgggcctaaagccacagaacccctgctgccctcactctggggtgtgcttgctgggccctgcagggcaaagcaggtccctgggcaggtgtagcagctggcacaggcgggctggcatctcaggcgtgaatgagatgtgatgacataagcaatctgagtgctcagcatgtgctggcaccacagatgcccaggggttgacacgcagggacctcactgaatcctcataaggatgcagcaggtggcactgcagcagcatcccctactggaggatgaggacgccaaaacccagagagggtgagtaactgccccaagtcacgcggctaagagacagggccagcttcagaacctgtgctgctcagcatgacatgctgctgccttttcccactggagcgggccccagctgccgccccacagcctggacatcagaaacgcacccagaagttgctcaccctctgctcccctggctgctgggcggaagggcaagagtggccctgagctgagaggctgaaggggcctctgaaggcagggcaacagccagagccccacctggccatttctcccgacaccggcacctctgaggcagaagggcacctggtgcctctagggcaggttccaggggtgctggagctcaccttcccatgagcagtttcccggcagggctgctcatgcaggcaaggctctgaacagttgcagccacagtgaggctatggacttgcctacaggaccctggtccagcttctacttgaagagccctagtagcagagggctcaccaccttgcaagcatcaccaacttgggctagctccctcatagataaaaagcatcaaaaagtcaaacatgaagccaggtacattggctcatgcctataatctcagcactttgggaggccaaggtgggaagatcacttgaggctaggagttcaggaccagcctgggcaacacagcaaaaccccatctccacaaaacataaaaaaatcagctgggcatggtggtgtgtgcctatagtcccagctactagggaggctgaggatagacgatcccttgagcccaggagttcaagactgcagtgaactatgattgcaccaccacactccagcctggatgacagagacagagaccctgtctctaaaaagacaaacccaaacacaggctcctatagacctgggttctgattctggccctgccataacaatgggtaagttcctaaccttgcaggagtctcagttttcatagctataaaatgggttgttttaaaacctacttcaaagagatctgagattagatgagaacagacttgttatacaagctgccacacacatgtatctctaaaacaacatgctacgtgaaagatgccagattccaaagaccgtgtattgtgcgattccatttgcgtgagatgcgcaaaagaggcccctctatagaggagaggccagtaaacgtctcctgcgaagggcaaggcggtaaatattctaggatttcagggctcaacagtctcggtcacaactcaactctgcagttgttgcaagaaagcaaccacagactatacatcaatgaatgggcgtggcagcgttccaataaaactatttacaaaaacaggcagccagctggatctggccgtgacagtagtttgcagacctctgccacagaggcaggaagcagatcagctgttgcctgaggctgtggtattggaggtggaaatggattaactgcaaaggggcatgcgggatcttttggggatgatggaaacgttccaaaactggatggcagtgcacatgactcggtcactttaataagaatcatcaggctctttacttaaaacaggtaatctgacggggccccaaaactttgggaggccaaggcgggaggatagctcgaggccaggagttcaagaccaggctgggcaacataacaagaccccattttacaaaaaatttttaaaaattagctggaggggtggtggcataaacctgtggtcctgacaacttgggaggctgaggtggaagaattgcttgagcccaggaggtcaaggctacagtgagccatgattatgccactgcactccagcctgagtgacagagcaagaccctgtcacaaaaacaaacaaaaaacaggtaacgttggctgggcctggtggatcacacctgtaatgccagtactttgggaggttgacttgggaggattgcttgagcccagaagtttgagaccagcccgggcaatatagcaagacctcgtctctatatactttttaaaaattttttaaaaaagtttagatgagaaaactcagctaacgtacttagtacagagagcaatctccataaatctttactattgttattaaccaccatcattatcatatcagaacccctccacgaccctgcacacccagcctgaggaccaggcatcaactgccttccctcacccgaaggcctccaaacaagcagccagaaatgcaggccagagagactgggcccgcggccgctgcagctggacagtgagaggcgaggccagctgggctgctctgcctccatctgaggcgagcaaactgttccctcgaggcggacagcctgccaggcaggctgctggacgcccccagaagcagctgcggcacacaaaaggtctctttgtgagggcccatctccacccctgcagcccaacacagcgacctccttggagggccccgagcggctgggctggggaggatgcctggtggagaggggactccagcagaagacggagggctcagagccatccaacgtggagtcctcggcagggacagggagccagcatcagcctggagcctggggcggccactgcacaccccgctccatccagctcacaaccggagcacacagcttccctcctcactgcccaggccggaattctacaccaggaggaagccttctgagccccactgtctctcagagagtgcacagacagggcgacaggagggacctggcaagccatgcggcagtgggaccaggtgaggatgaatttctggccctggagagggaggtgcaagtttcaggcttcacccactagtcagacacccactcacctgaatggcagcccaggtgggccacgcgtcgcttgtcctctccttggccttgcagaggcacaatgcccagtacacctgttaaacaaacacggggactctgacttcaggccccacagggccacccacctccttgcccagggatcccagagatgaaatccagcagctcagcctcggaccttcccagagcctctaccaatcacaagatcatatcctctgcacgtagcaatggcctgtgggtaggttctggccccatgcatgagccatccatgcctcagatggatacagaagacattaggcgagaggtcctctctttttaacacgggtcatacgaaaggggcgtggggctttcgtatggggcttgcagctaccgtcagccacttttcgcacttttacttgagaaagaagccaacacccaaggtggcagagctgagagacccagagaggtcagggccgacagtacatgtgagcctttgggcaccgatctgcctgaagcccctgatctcttagttaggctgaaacattatccattttttgcttaagccagcttgagggtctgagttaccactagcaatcaagagagtgccaaccaacacacgggcttttcaagcctttctgttcctactgtccccagccatccagggcccaaagatgaggagcagggagcacagagggacagctggaaatacaagcgtcagtcccctcccagccctcctggccatgctcttgcctgtggtttgtacacacatatgtcctaatcaaaagcaatcagattactgcgcctggaccagtttgtgggggtctaaggtctggcatggggctcacctctgagccccccaaagcagttccgttccaagtctccaaatacaccaagcctgcccctgctccccaccccatctatggtgacgatgaccgaatatgtgagcaaatatccacactcatggccattccctaccaggacggtcggagttgaaggcgatcaagctgcagcttgatttgatgtggttcctgcatgaaggggcggttcctgctcgaatgtcactgatccaggactgaaaatcaagagtaaagaagtatgtggtgagagccagggttccacctccatgcatgcctaaagcaagaggtggggcataatctggggaactctagctcacagctgcaccattcgagatgcattcttttatttactttttttttctttttgagacagggtctcactctgtcacccaggctagagtgcagtggcgcgatcttggatcactgcaatctctgcctcttgggttcaagtgatcctcctgcctcagcctcctgagtagctgggattacaggcgcccaacaccaagcccagctaatttttgtattgttagtagagatggggtttcaccatgttggccaggctggtctcgaactcctggcctcaagtgatctgcctgccttggtctcccaaagtgctgggattacaggcatgagcctccgcccccagccgtgttgtgttacttcaaatcaaactctgtccccactcacgaagtcccttaggaaatgtaaaatgtgggccaggtgcggtggttcatgcctgtaatcccagcactttgggaggctgaggcagacagatcatcctgaggtcagaagttcgaaaccagcctggccaacatggtgaaaccttatctctactaaaaatacaaaaattatccaggcatggtggcgggcacctacatacaattccagctactcaggaggctgagggaggagaatcacttgaacctgggaggcggaagttgcagtgagccgagatcatgccactgcactcctgcctgggcaacagagcgagactccatctcaaaaaaaaaaaaaaaaagaaaatgcaaaatgtggccaggcctcctccaagtacccggagaaaaacacccaagctcagagaggggaaccaccaaggcctggcctcatcaggacacacctttccacaaagtctcataagtcagtaaaagaaacacccccacccaaggggaggcagaggagcacgtttctgaaactaagatctgcaaggtccacacattttctctgttgtcaaagcaccgctcagcactccttcctgccctcgatgacaggacacccatgtttcccactccacccacccatagcaccccggaaaccacctccaccacctgaagtttctatatcagtgttcacctgccatggttacagcatcagtcccaccctattatttctccctcctgattcatgtttactgtataaacacagtgactgcaaatatctctgaaaagaacagatcacctgttctcccgcctccctaacataaactgttttaagctctccctacagtctgtagttccatgcctatctgtttatgttgctggactaaggcccacccaggagcaagaattagggcccctcaagtattctccagacccctccaagcagtacttaactgcactcagagccaccggctgtcttgatgcaaacctaggtacctcctcctaacttttcttgtttgtttttttctttttttgagacagtgtctcactctattgcccaggctggtgtgtagtggcacaatctcggctcactgcaacctccacttcctcggctcaagagatcctccaacctcagcctcccaagtagctgggaccacgggagtgagtcaccacacctggctaatttttttttctttaacttgttgttcagaggggtttcgcaatgttgcccaggctggtctcgaactcctgagctcaaagcagtccacccaaagtactgggattaccgtgagtcatggtatccagcccctccccctaacttttcaatggctctgcactgcaatcagaataaaacccaacttcttccggtggcccttgggttctgcaggaccactctggactcatctgtcaccatactgctccggccatcccctccatccactcatgctcactttccatttctccaccaggctctttctcaattctcacccttctggcctcagctaaaatgccatctactccaggcagcctttcctgaccacgctactgagactggccccctccattctccatcccagtccctcatgtgtgttcttcaatgtcgttatgaaaacctccaatgctcttgtttgtctgcttgctgtctccctcatgaggctacaagtgccacaggggaaggaaaatgccgttgtgttcaccgggatgtctccagcagcttagcacagcataaagtggaagcagaggaaatatagtccacactacaaaaacggaacctctacccagactgccctgacttgctctgggaccctgatggggtcacttgaggtcaactcctaggcccagttatcggaggacactcccaggccttacaaataacacggaaagcggaagagcagagctgacatcgtttccaaggcgcacccctcatcagtcctcctgccgtttcgggggtccgaagggtctcccggcacctggctcagcaattctttggggctccacctgctcaggcttccccaggccccacccagccgtggcagcatcaccgagataaagaaagagcttgcgccagcggcgagaggaggaagcaccggcggaaacccgagggaggggcgcgtgcggccgaggggctccctccccaccactgacacacttgggctcgccggggccagaggagagaggggcgtctccccacagcccagccaggggcaggggcgacccggggcggcagggaggaggagccaggcgccggcagcgccccgagccccggctcccggcgaggccgaccggaagctgggaaggcaggcggcctcgcaggcctgggccccggctaggagggctgcgccgcctcgggggtcccggggcgaggtgggcgaggcgggcagaccgccagggtcaccgagcgccagagcgagtcacgggagtgccggactctgccctccggcggcgacgaaacggcccggacgccggggccctggcctgaaggggggttccccggggatggaggtctcggggttccagacggccctggagggcacccctgtggggtccgggcagggggaggggcagccggacggggcccgaggcgacagcgcccggtcctcgggccggactcacctcgcggcggggcggccgagcctcggtgtgccggaacttggacaccctgaagcggttcatggcgacgggcacggcggcggacgcgtcttcgaggaccccgggcgtcgggtctcaggtgcacgctgagcaaccgcgactcccgctgcctcggccccacccgggacccaatgccgcggtcacgcccccggcgcgccccactgccaatcgcagccgtctccggccccctgggccacgcccccaagcccctctcctttcgcgcgcgcaccaccggtcccgcctcccggccaatccaggtacggccgccccgcgaggccacgccctgataccgaggggacggactggcgcgggtgggaggtcacgtggggcgcagctgtcagcccacgtctcctgcggtgcttgcttgcgtggggtctcggctgcagcattcgcgattttgtgtgcaggatttgctgtggagtctttgcggtgtacctagcacgccttccagcactatctacctcttc

SEQ ID NO: 884 - DNA, 62421 bp, Homo sapiens; identical to SEQ ID NO: 883

SEQ ID NO: 885 - DNA, 30971 bp, Homo sapiens
gcgcctctacgcgcgcccgccgttcccgcgaggcccacctagagccgggcggcgcaggcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggtgagggcaggttccaacttccgagtggcggtttcagggcctagaaaagagtgagtctcctcgctgtgactacggctgcaggggtagtggggtggagggtgtcttccgacgcggatgcacaattgccggagacacagacaggcaggaggcggggaggccccagtggctgctcagccgtcaaggaagggagagaagcgtggagcccccggcggcggtgatgaaacgccccgtagatcgtgaaccttcacctctctgtcaacatttctggaggccgctgctccctcgtcctcttcctttcccatctctccaccttctagcccgtagcggaagggaagagctaactgccattcggagaggcctaggtactttgttacaacaaccctgcaagatgcctgccgtcatcaccattttaaagaatgagaaactgagattcaacggaggaatcgaccagcccaaggtcatggagttagactagaagagttgtctcaaacccaaagcagtcatgtcatagtttacgctctttctaccacgtggtgctaattgaagggcacagttaacaatctttttagaagtctttagttggtgattgtaataataacacagtcagacatttattgagcacttactgttggccaggcatggttttccccttacatcacatttccacatgataggcactgttattccattttataaagatactgaggcttagatgttaaaccacttataaatgtcacaaggaggtggaggcttgatatcattgcctgagatgacactgaattatacattaagccttgaagtgcttagtcatgttttcttttcttttcttttctttttttttttgaaactgaatcttgctctgttgcccaggccggagtgcagtggctcaatctcgactcactgcaacctccgactcctgggttcaagagattatcctgcctcagcctccccagtagctggaactagaggcatgcgccaccacgcctggccaatttttgtatctttaatagagacgggatttcgccatgttggccaggctggtctcaaactccagacctcaggtgatccgcctccccttggcttcccaaagtgctgggattacaggcgtgaaccaccgtgccctgcttagccttcttttcttatgccgtgtgttttgtgctgtgtgttgtacgtacctgaattgtgctagttttgtgtcctctagaatttgtgcaaatggtatttaagctatctataaatttataaagattaattaaagggccctgacaagataatttataccaactaacttcctgttgcaatccagtttgtaatagttacatagtagacaatcattaaagtatcagtaattgtggttacttcatgcaatgtaaagaaaagagcctgggcttcaggggtgaacttccccagcgtctgtgagcggggtgtattatttaaccccttcgagcacctgtctgaaaattcattcattcacaggtgttaattgaggccaattgtatgccagccactgttctgggcactgaggagatggcagagaacaaagagattggatgtgtgtttggttaagagaatgattatttatgtatttaattattttttaagacagggcctcctgttgcccagactggtgcagaggcacaattacaactcagtgcaaccttgacctcccaggttcaatcgatcctccatcctcagcctcctgagtagctgggactacaggcatgcaccaccacacccagctagttttctgtagatggggtttcaccatgttacccaggctgggctaaagtgattcccttgcttcagcttcccaaagtgctggggttacaggcatcagccactgcacctggccaacagaatgaattttttttttttttgagacggagtctcgctgtgttgcccaggctggagtgcagtggcgctatctcagctcactgcaagctccgcctcccgggttcacgccattctcctgcctcagccttctgagtagctgggactacaggcgcccgccaccacgcccagctaattttttgtatttttagtagagacagggtttcaccgtgttagccaagatggtctcgatctcctgaacttgtgatccacccgcctcagcctcccaaagtgctggaattacaggcttgagccaccgcgaccggccttatttttattttgagatggactcttgctctgttgcccaggccaaattgcagtgatgtgatcctggctcacttcagcctcccaagatgctgggcttataggtgtgtgccaccatgccaggctagatttttcaacatgagcaaaagtggccatttttagagcttgctaacattttctaatgtcaaggttgttttaaatagaatctggctgcatcttttcattcaaatattaatccttaggtgacttgttttattaagccaaatttgttcatgttccagctgtacaaatttgggagcactcgttattattgtgtatgtgaaagagagaaacaggcactaaacactaagctttgtgtgaagctgtgactaaggaactgcggttagctgtcttgttccccaagtgagctcataacctgccatgggcaagttttatatcaggtagtgtacacaggtgagaggtggcatccttcagggtacgtgctgttttcacagatagagtcatcaactggttgggcggggtggctcacgactgtaattccagcgctatgctggcgctgaggcaggaggatcacatgagcctagcagtttgggaccagcctgggcaacataggcagatcccatctctacaaaaagattttttttttttttttttttttttgagacggagtctcactctgtcgcccaggctggagtgcagtggcacgatctcggctcactgcaaactccgcctcccgggttcaggccattctcctgcctcagcctcccgagtagctgggactacaggcacctgcaaccgcgcccagctaattttttgtatttttagtagagatggagtttcactgtgttagccaggacgtctcgatctcctgacctcgtgatccacccgcctccgcctcccaaagtgctgggattacaggtgtgagccaccgcgcccggccaagattttttttgtttgtttgtttgagacggagtcttgctctgtagccaggctggagtgcagtggtgcgatctcggctcaccatgatcttgactcaccgtgatctcggctcaccgcatcctccgcttcctgggttcaagtgatcctcttgcctcagtctcctgagtagctgggactacaggcacgtgccaccactcccagttaatttttgtatttttagcagatactggatttcaccatattggccaggatggtctcgatctctttacccatgatctgtccacctcagcctcctaaagtgctgggattacaggtgtgagtcaccgcgcccggcctacaaaaagatttttaaaaattagctgactgtggccggacatggtggctcacgcctgtaatcccagcactttgggaggcctatgcgggcggatcacctgaagtcaggagtttgagaccagcctgatcaacatggagaaaccccgtctctacaaaaaatacaaaattagccaggcctggtggcgcatgcctgtaaacccgggtactcgggaggctggggcaggagaattgcttgaacgtgaaagtcggaggttgccgtgagccgagttagcgccattgcactccagcctgatcaacaagagcgaaactgtgtctcaaaaaaaaaaaaattagccaactatggtggcaactgcctgtactcccagctgcttgggaggctgaggtgggagtttcacttgagcccagaaggttgaggctgcagtgagccatgatgatgccactgcactccagcctgggcaacagagtatgactctttctctaccaaaaaattaataaagtcatcaactgagaagccatgtggtggcgagcctctatagtcctagctactcaggaggttgaggtgggaggattgctggagtccaggaatttgaatttggcctaggcaacataatgagacccctgtctcttaaaaaaaaaaattttgaaaaggtcattaactcagcgtccaaacactagtctgtgatcttgtctcaaatctagtagtaagatgacataacaacattttagatgtgacttttcttccaagcagaaagaaagcagttgttggtggccaggtatggtggctcatgcctgcaatcccattactttgggaggtgggttgatcgcctgaggtcaggagtttgagaccagcctggccaagatggccaaagcttgtctctactaaaaatagaaaaagttggtcaggcgtggtggcgggttcctgtaatcccagctactcgggaggctgagacaggagaatcgcttgaacccaggaggcagaggttgcagtgagccgagatcgcgccactgccctccagcctgggcaacaagagccaaactccctgtcaaaaaaaaaaaaaaagaaagcagttgttggacagtgggttggccattcttagaacgacttggaggcttattttattctgggttgttctaaaaaggacaggacatttactggtcatatgtgataaaataaatagtctattaaatgaaatctaattattgttaatcattgatgccctatggataatgtcaaaagtcatcagactggggatggtggctcatgcctgtaaccccagcactttggtaggatgaggccggcggatcacttgaggtcaggagttcgagaccagcctggccaacatggtgaaacttcttacctactaaaaatacaaaaattagccaggtgtggtggtgtgcgcctatagtcctggctacttgagaggctaaagcagaagaatcgctcgaacctgggagatggaggttgcagtgaaccgagatcacaccactgcactccagcctgggtgacagagtgagactctgtctcaaaaaaagaaaaaacaaagccatcagtcttgtaattaaacgtgatttgtctttatccacatgcagttttgtgcgttactatctctgtactaactcctgtccgtgttctctgcccgtaatgttgaagccacagctgccacaggtcactaccagcctccgccttgtggcattggaatgagtggtgagagagaggctggactgggccgggcaaccccttactccgaaataaaaagagggttgagtacaagttcaataataagtcaggtctagtgttttctcaagtctgactgaagaaacacaaagtggtctcctgacccctactacttccagtgtgctttttgtatcccgaggatattgggtgtgccaaacacacggatttatttcctatttctaattttaagtatcctgaccattcctatccattctcctgtctgatcatcctttacctggcctcctacttggatgtgctcaaccaacctctggttgtgttttgtgctgattaacttcgagtagtctcccaggcttcctagagttgtttctcttttttttttttcaggtggagtcttgctctgtcgcccaggctggagtgcaatggcgcgatcttggctcactgcaacctcagcctcccaggttcaaacaattctcatgcctcagcctcccaagtagctgggattacaggcgtgcaccaccatgaccggctaatttttgtatttttagtagagacaagatttcaccatgttggccagcttggtctcgaactcctgacctcaagtgatccacccgcctcggcctcccaaagtgctgggattacaataggcgtgagccaccttgcctggcctagagttgtttctcatgcaaacctaatgggttctttgtttaacatttgcagtggctccctattgctcttaggataaaatccagactccttagcatagctctaaggcccttcctattcctaggccccattaatcgttatcatctctaaccaccactaccaccactgccatctagtttagttataggtataaatctgtatggattcaaagtcctctttagcctatttctgtctctctctcttttttttccatgtcataagtttatttacaaacatctagtatgtcatataagttcaagtctttgatccatttatttatttatttttaatagagacagggtctctgtgttgcccaggctggtttcgaactcctgggctcaagcgatcctcacgcctcaggttcccaaagtgctgggattacaggcgagagccactgtgcccaggcttatttttctttctttttttttttcttttttttttctgtgatggagtttcactcctgttgcccaggctggagtgcaatggcgcgatcttggctcactgcaacctctgccccccaggttcaagcgattctcttgcttcagcctccttactagctgggattacaggcatgtaccaccacatccggctaattttgtatttttagtagagatggggtttctccatgttggtcaggctggtctctaactcctgacctcaggtgatccgcccgccttggcctcccaaagtgctgggattacaggcaggagccaccatacccggcccggcttattcactttttaaacagatttcatctattaaaacacctccagtctgggcgtggtggcacacgcctgtagtcccagttacttgggaggctgaggcaggagagtcgcttgaacccagcaggcggaggttgcagtgagccaaaatcgcaccactgcacgccagtctgggcaagaagagcgaaactccgtctcaaaaaacaaagaaacaaaaagcctgccgggcacggtggctcacgccggtaatcccagcactttgggaggtcgaggcaggcggatcatgaggtcaggagatcgagaccatcctggctaacacggcgaaaccccgtctctactaaaaatatgaaaaaattagccgagtgtggtggcaggcgcccgtagtcccagctacttgggaggctgaggcaggagaatggcgtgaacccgggaagtggagcttgcagtgagccaggatggcgccactgcactccagcctgggcgacagagcgagactccatctcaaaaaacaaaaaacctgctcttcctatctgttaagtggatgaactaaaacatccttgtttcttaagcagttggtgtcttgctattaaaaaaggtgctgtgaatccagatccaaagtacaaagtcatcctagttagtaaccgccatttgttttccactgaaagtggcaaatgctttcctgggcagcttagccagtttctgcagcttaacagctgatgcctagaagttcttccccgaccttcttagattgatttgtcattggttctcagcaggggacacttttacttcccaggggacatttggcaatgcctggagacggggagttctctactggcatctagtgggtggagacctcctgagtttctggtgaatgtctggagtagggcttgaacatctgtgttttcatcagtctaatgatgctgttggtccagggagcgcagtcttgagaactgctccttaagtagatacccaaggctgcaagatagagggaaaagaatgtggggagttgttaagcattaaatgtgacagaaaaatatgaaaatatgaaaatacctagcaaatggtaagtgctcatgtggcataagaggggggagctgaatccctttttaatcatctcccagtcaggagtattattcctttagtggtttactgagaccactccagtagtataagcgaggagaatcagcctcatccaatactctgacatagtttaatattaattgaatactgtggcttccttagccattattgaagtgcattagggaacagccctaaagctgtagcctgtgtattagtctgttctcatgcagctaataaagacatacctaagactgggtaaattttaaaggaaagaggtttatttaactcacagttcagcacggctggggaggcctcagcgatcgtggcggaaggggaagcaaacacatccttcttaacatggcagcaggaagaatgagcaaaagggtgagcccctcataaaactatcagatctcatgagaacttactatcgcgagaccagcatggaggtaaccgctcctgtgattcagttacctcccatcaggtccctcccatgacacgtggggattatgggaactaaaattctagttgagatctgggtggggacacagccaaaccttatcagtttgtttgttccttcacagatatagcctggtgggtcatgtactcacagttttcttttgttgagaacattcccagagtgattttctttgttttttcctttttaggaacaaaacataaccctttcatttgtactgcctccttccacacgagtgcccctttggccaaagaagattattatcagatattaggagtgcctcgaaatgccagccagaaagagatcaagaaagcctattatcaggtctgtatggaagtcaggttttggtgaccaaattgtagtaggaatgttgttgatcccatgtgatcctgatcagtacagcgtatgtgcccatatgaataggtctcatgagctgatagtatagaagggtgtgataaagctggactttgctagactgtttttcgatgcacaatgctgtagaggttggtgcttcagaaaaaagaggtgagtccaaaccagagattttaagaagtttttttttctagagctgttttcataattaaatttaatctgtattttctgaatcagtagatatgctagtctaagttttaggtagttattttttgcatccagataaaagtttagaggtttagaattacttcctttcctttcttttttttttttttttttttttttttttgagatggagtctcactccattgctgaggctggagtgcagtggcgcaatcttggctcactgcaacctctgcctcctgggttcaagcagttctcctgtgtccgcctcccaagtagctgggactataggcacctgccaccacacccggctaattttttttgtatttttagtagagacgcggtttcactttgttggtcaggctggtcttaaactcctgacctcaggtgatccacctgcctcagcctcccaaagtgctgggattacaggcgtgagccaccgcgcctggccctttcttaacctggaaaatgtgaaattcccattgtatcccagggtctattagggtagttagggtagctgagtaaagttgtatacgagatgtctacaccactggttcctagacccttggtttgctctgaccaacaaaataaaatcaatattggaggcaccattgtaggattgacagctttttataagtgcacagttcactggagttgtgcacctgtcaccacagtcaactttaggacattttcattacctcgaaaagaaactctgtattcattagcactccccttccattgtcctctctccccggtccctagcagctgctaatctgcgtcctgcctctttggatttgcctattctcaatattcatatacagggaatcatacaatatgtatccttttgtgtgtcttggcttctttcattcacataatgttttcagggttcatctgtgttatagtttgtgtcaatacttcatccctttttatggtcaaataatctgttgcatggattaatcacattttgtttattcatcgtttgatggacatttggatattttccactttttgctatcatgaacagtgctgctatatagacattcatatgtaagtttttgtgtagacatgttttcagttctcttggatatttaggagtatagttgctgagtcatatggtaactggatgtttaaccttttgagaagctgccagcctttttcaaagcagctgcaccattttacattcccaccagcagcatatgagggccatgatttctccacatcccagtgaacacttaactattatcgtctgtctttttaattacgaccctagtgaataagaaatgctatctcgttagagtttcgatttgctttttccctgatgactaatgatggtgagcatctttcttgtgcatgttggctattagtatgtctttggagaaacgtgtgtttggatccattgcccacttttaactgggttgtcttttttttttaattgggttgtaatggaatgaacagaggcatggggacaggaagcagagatcctggcctgtgaagagcgaatggcctgtctcttcctgagctcaagagtcaggtgcctgatccaagagtgggaaaagattgaaaagatggaggctgggttggactcacatgacagttgatttgaggcccttagtaagtcccagagacataatttaagagaaagacttaatttagagaaccattcagatttttaggcacggaagtaaaaagatcaggtaaagctgtagcaattactgtattttatttacctacaaaaataattgaaacagcagagacgtctatttattcagtcattttcttccctttttaaaaattttttcttttttcagacagagtctcgccgtgtggctcaggctggagtgcagtggtgcagtcttggctcactgcaacctctgtctcctgggctcaagcaattctcctgcctcagcctcccgagtacctgtgtttataggcgcgtgtgaccatacctggctaatttttgtatttttagtagagatggggtttcgccatgttggccaggctgttctcaaactcctgacctctggtgatccacccagctcagcatctcaaagtgctgggataacaggcatgagccactgcgcccggccccctttttaaaaatttgtttttcttttttgttcatttacctattctaagccatgctgggtgctaagggcaaagatacatcagaatcagttcctgccctcaagttaagagatggatacattaaaacagatcattattattattattttgtggggcggacagaatctcactccgtcacctaggctggagtgcagtgcctcgatctctgctcactgcaacctccacctcccaggttcaagtgattctcgtgcttcagcctcctgagtagctgggaccacaggcatgtgccaccacgcctgactaattttttctatttttggtggagaggggtttcgctgtgttgcccaggctggtgttgaactcctgagcttaagtgatctgcctgccttcacttcccaaagtgttgggattacaggcgtgagccactgcacccagccgagagacaacttttataaagggaacataattatgactggtatttggggttctgttgtatcgggggttttgttgtttctggtatttggggttcacattgtatctggagtaatttatcatgtttttcccttagcttgccaagaagtatcaccctgacacaaataaggatgatcccaaagccaaggagaagttctcccagctggcagaagcctatgaggtaatatgacttcggtgcatgcggtcactgctgttcagctatgtgtatgaatcaaaggttgcattgctacctgggacagcctggtgtgtcatacagtccagtgtgaaggccatgtccctgcgccaagtaatcttgttaagaaaaataaaaaaaaagagattccaggccaagcatggtggctcactcctgtagtcctagcactttgggaagctgaggcaggaggatcacttgacctcaggagttggcttgaccctaggagtttgagaccagcttgggcaatgtagtaagaccacgtctctacaaaaaaaaaaaaaaaaatcaccaggcgtggtggtggcgcacctgtaaacccagctacttgggaggctgagtcaggttcatcacttgaggggctcaaagctgcagtgacccatgatgccatgattgtgccatagaactatggtctgggcaacagaaaaagaccttctctcaaaaaataaaaaattaaaaaaaaaacaaaacaacaacattctaagactaacttggaatctcaatgaagaacaggatccaggccaggcgtggtggctcatgcctgtaatcccaacactttgggaggccgaggcaggtggatcaccaggtcaggagatcgagaccatcccggctaacacggtgaaaccccgtctctactaaaaataaaaaaaaattagccgggcatggcggcatgcgcctgtagtcccaggtgctggggaggctgaggcaggagaatggcgtgaacccgggaggcggagcttgcagtgagctgagattgcgccactgcactccagcctgggcgacagagcaagaccccgtctcaaaaaaaaaaaaaagaacaggatccaataatctgtactaataaagttccccaggtaatttacacttgtagctggatttgggaattcacagttggattaattaattcagcccttattcaatgacatccccttcctccacctcagggcatcactgctttttggggatagaggttattgtaaaagtagaagcccattattgtcctataagaatgtcaatgtaatcagaggacaaagcatacatctctgaaaacagctattgaccccacttccatagttttctgaaagtagacctttttcccagattttttgacaatcttttctttttttttttttttttttgcttaagagacagggtccctctatgttgcccaggctggtcttgaactcctgagctgaagagatcctcctgcctcagcctctcaaattgctaggattataggtgcaaggcaccagacctgcccgactttggccatcctaaaggggttcagtatatataggagctcatatatctataagagtagacagccacgtagaagaacaggctcaactcagtaaatcttttttgagtaaatatctgtcaactagatctaatgaaaagtttatttactagtgtaattttaaaataatatgttcttattaggtaactcaaactaattgataacataactaaacagtcttggaacctgcttctatggaagataagattaatttttttttttttttcaagagttgaggtctcagccaggtgcagtggcttacgtctataatccctataatcccagcactttgggaggccaagacaggcagatcaggaggtcaggagtttgagaccagcctggccaagagaccagcctgagcaatatggtgaaaccccatctctactaaaaatacaaaaattagccaggtgtggtggtgggtgcctgtaatcccagctattcaggaggctgaggcaggagaattgcttgaacccgggaggcatcagtgagccgaagattgcgccattgtactccagcctgggcaacagagcgagactcccaatcaaaaaaaaaaaaaaaagagttgaggtctcactctgttacctaggctggagtgtagtggcgagatcacagctcactgcagtctcaaactcttgggctcaagcagttttcctgcctcaacctcaacttcctgagtagctgggactacaggttccccactgcacccagaagattcaatttttaatggggcgggggggtgttattcttgtgaatgtgtttttccacatggttagttgatctgatgtttctgccaggggcatgagttttggagagtcctaatccaccgtgttgctgacttctgtcttcaagggggatgttattaaacggaccgagcctcagaacctaagagcagcaattccttgggaagggctggaaccaggagataaaacccaccaggaagtcatgaactcccacctgactcctcctctgccagccttcctcctttgcatcttaactgggtgccctaaaagttaccctaggcaccaagctgtcctccacctgctttcttagtccccctccattctaggtggaagtgtcttttcctttggaggaagcgtactcttttctgtttggccttaaggatagtgcctatttttttgagatagtgtctcactttgttgcccaggctggagtgcaatggtgcaatcacggttcactgcagcctcaacctcaacctccgtgctcaagcaatcctcccacctcagcctcccaagtagctggaactataggcgtgcaccaccattcttggttaatttttttgtatttttcttgtgatggggtttcaccatgttgcccaggctggtcttgaactcatgaactcaagcagtccacctgccttggcctcccaaagtcctgggattacaggtgtgagccaccatactcagcctagggcagtgtctttttaattaaagaaaaaaaaagtaagacaaacacataaaaaaaagatacaaagtgagggccaggcacggtggctcacgcttgtaatcccagcactttgggaggctgaggcagacggatcacgaggtcaagagatcgagaccatcctggcaaacgtggtgaaaccctgtctctactaaaaatacaaaaaaattagctgggcgtggtggtgcatgtctttagtcccaactactcgggaggctgaggcaggagaatcacttgaacccgagaggcagaggttgcagtgagccgagatcgcgccactgcactccagcctggcgacagagcaagactcccgtctcaaaaaaaaaaaaaaagatacaaagtgaatactacatttttccttgtccctccctaatccccctttttgaggtagttagtccttattaacagttttgtgggccaggcccagtggctcatgcctgtaatcccagtattttgggaggtcgaagtgggaggatcgcttgaggccaggagtttgaaagcagcctgggcaacatagcaagaccctgtctctacaaaaacttaaaacaatttgccaggactggtggtgtgcacctgtagacccagctactgtggaggctgaggcaggaggattgcttcaacctgggaggttgaggctgcagtgagctaggattgcaccactgctattgtcgttgctgttacttctgttactccggttgttctggcttgcagaaaacctttcgatgaaggtaagggtaggaagcataaattctctacgaggtaatgtcccctgaggagagaggtgaagtgtgaatctgtgaagaatccagggtgcctgtgaggtcaagcgaggatcaacacaaacattttcccagcatgcgcgacggcgggagagttcgtgagacttttggaagcacttcacgccctacacttagcattcagtttggtcatctcatccctcttctaggtgctagtcacaggcccaccccaacctcataggatgtgtttgcacacagggccacttaataaatgttatggctgccttatttgctgtgaactcttgtctgtattcctgggccttggtagacctgggatgcccagtggctctgcctttcactgtaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaagtaagttcctcacttggaagaattattcaaattttagactaagtatgggtcaaacaaatttttttatcagtttctgtttctcagaaaggcaaggcagcttaaatggagtgatctggaggcagccattttagtagaaaataatttcagtatttgaaaaatcgcataggtagtaatgagtatgtccattctgatggtattcttaacagttgcataatgaggtagcacctaaggctttcagagcccatgagggtgtgagtgttgtctctcatctgctacagtattccaggagagttctgtccggtgggaaggcactgctgatcctctctcatttatgtccttataagacactgtcagagtggaagagagaggggatatatttatgatctaaattatgattgtggatcattcaggctgtttttaagtgccatgtacgagtatttatctgtgaacattttcagtctgttgaaagtacgttttcatttaagtcatacattatctcttaaaaatcccaaagagtagggcagaattcgttcagtgagtcctacctatgcttacttggcagagtgcaagtaagtacagtggtgaaagagtgactgaaaatgtgggccagtaccctcctttccctttagagccgagcgtcagttttggtcgttgcaaacaaaagttgacaggctgtcccttggtttctttagtacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggtaaggctctgcccgagactccacctcccacggcttgcaccactgactgagaagagctggttgtggcactgctcccagagaacgtatgctgggaattgggggagttggtgaactcagcctggctgtctttcccccgtgaccctgaggagacgagcctgtgctcctctttccctgataccacaggctcagcaaccagagcacagcagctccgggggcggggcgggggattgcatccagttgtcactttcttctttatttttctaacaattgctttggtaattcaaggggaaataatcttttttaaatgtactgttcagctcccaggagtcttcaggtacttctgtagacaggcggtatcatatttttcagtgtcgtgtggtcaagttgatgatctggagtgcagaagtttgtgtgttctagaaaatcagatgaacagattgaggccctgcacctgggttcctaggcagtgtgtttgagtgcacatgcacataaaaaacaagccttaaagagacatttttcttacgcacattgtggtcccagaaccacccatcagtttacctgcgtacttaggttaccatttttcttgtttttatcaggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggtgggtgcttgggcccgccatgtccaggagcttggagagggcagacagggttgaggctaccacaccgtgtggagagggtggacagggccgaggccactgcactgagtgtgagtgggctcttggtagaagttatggttgaggccctggagccccaggctggaggaggaactggagtctccttgaatctttctgtttctgccagttatccttaaaatttacactttgcatgtcacaatggggagaagagacctgacgtgcctactctgcttcttcctggtgagggagcagcttccaacccccgggctcctctcctctctcccctgtcttagtcaccgaagccatcattgtccctgctgccaccctatctacatcagccccacggatcccacccctcactccatgtctactgttcccttgcccaaaactcactttctgctttcttttttcggttaactttattcatcttggagatcccagcttgagtatcccttccctagctagcctcacaccctcctccctgttcttttttttttcttttttgagacggagtctcgctctgtcacccaggctggagcgcagtggcccgatctcggcccactgcaagctctgcctcccaggctcatgccattctcctgcctcagcctcccaaggagctgggactacaggcacctgccaccacacccagctaattttttgtatttttagtagagacggggtttcatcgtgttagccaggatggtctcgatctcctgacctcgtgatccacccgcctcggcttcccaaagtgctgagattatagtcatgagccaccgcgcgtggcctgctttactgttgtttagatgtctgtttctctagagttgtgagcatttccattgaagagcatgtctctgtttgtagttatgcattagtgctatcgtttggttaacacccatcaccccagtgagaccatgaactccctgaggtactgcctagaccaagcctgaggcaggtgctcagtcatcaggtgtctgtgttgcatctctggaaggttacccatgtgcctcttagataatgacattgttcctcgttaataagaaacaggagtggggaagaagctgtgggttacaagtggatcttgggtggaaagtgctgtgggaggtctcacaataactgctccctttcttttttttctttttcttttctttttttttttttttttaagacggagtctcgctctgttgccaggctggcgtgtagtggagtgatctcggctcactgcaacctccgcctcctgggttcaagcgattctctttcctcagcctcctgagtagctgggactacaggcgtgtgccaccacgcccagttaatttttagtagagaccaggtttcaccatgttggccaggatggtctcgatctcttgacgtcatgatctgcccgcctcggcctcccaaagtgctgggattacaggcgtgagccaccgcgtcctgcctaacttctccctttctaatgtcccttgtaggagtcgaggatggccagaccgtgaggatgcctgtgggaaaaagggaaattttcattacgttcagggtaggtgccctgccccgcacagcttctgttgggcctttcctctcttcgggtgggtgtggctgaggctgctcccatgtaatcaaagcttcacaggaacatgtctcgccattcatgtttctgaggggcacagtggccacctagatgtggtttttagctgtttgttaccttcaagattctgtgccttgtgtggagagaagacaacttcttcaacatgctaacaagttagaaatacaggtcacataaaaatacaggaaacatcttgtgtttttatgataagattgttgatgaggcagtgagtgtgaaagttacaattttacatactgtatacaggggcaaaccttggttttctgagatggtggaaacattaatgaagacaatgccttctactggcaattgccctcctatgtgtacacctgagaaaaacccacacaagcctagcaggcgataggtacaaaggggtgcacaagagtcctgtccatggtagcaagacactgccttcctccaacaagagaatggctcagtgagccgtggtggtcagaggctgctgcagggcagtcggaaggaaagaatgagagctgaactcaagggatgctccaggcgttgcaggtacagacagcagggatggaaggcagcttgccagtggctgtagggcctcagagaccatctgtgtaaagttttaaaacctgtgagatggcattatgtattatttagggacacggaaatacatagtaagtagaagcttgtaggaatgataaatgttaaagtcagggttgtggttagctgaggagggcaagactcaccggtgtttatgatgttttattttattttactttattttttgaggtggggtattgctttgttgcctaggatgaaatgcagtggggcagtcttggctcactgtagcctcagactccctgggctcaggtgatcctcccacctcagcctcctgagtagctgggactacaggcacacgccaccaggcccggctgacttttgtatctttagtaaagatgaggtttcaccatgttgcccagggtggtctcaaaccccagggctcaaatgatccacccaccttggcctcccaaagtgctgggattacaggtatgagccactgcgcccggcctgtgatattttgttacctccactgggttgtgggtatgacatgcttgttatattatttactcttcccttttttttcttttttttttctggaaagagagtcttgctctgttgcccagtctggagtgcagtggcatgatctcagctcactgcaacctccacctcccaggttcaagcgattctcttgcctcagcctcctgagtagctgggactacaggcatgcgccactacacccaggtaatttttgtatttttagtagagatggggtttcaccatgttggcaggctggtctcgaattcctgacctcaggtgatccacccaccttagccttccaaagtgctgggattacaagcgtgagccaccacggctggcctatactttctaataaagtaagatttttttttttttttttttgaggtggagtctcgctctgttgctcaggctggagtgcagtggtgtgatctctgttcagtgcaaacttcatctcccaggttcaagtggatcttctgcctcagcctcctgagtagctgggattacaggggcccgccaccacacctggttaatttttgtatttttagtagagacaaggtttcaccatgttggtcagtctggtctcaaactcctgacctcaggtgatccactcaccttggcctcccaaagtgctgggattacaggtgtgtgccactgtgcctggctaaagtaagattaaaaaaaaaaaatcaaaagccagttttacatttttgtttcccttcacgattgaatggcttgatctgagactgaggaaatccaggcacgcttccatttcggcatttcaagtgtgtagaacattgcagtgttgaaatatgtagaacatgtcattcctgggcctgggatggtgtctccttgttggaaggacagttctttccctcaacactgcactttatgtatggaaggggtgtgtagtttgtcaggtctgagcttgggcctggccaggcatgcagctggtgtttagtctgcagtggacttatcttcacatgcatctgtcatgtttggccttaggtgcagaaaagccctgtgttccggagggacggcgcagacatccactccgacctctttatttctatagctcaggctcttcttgggggtacagccagagcccagggcctgtacgagacgatcaacgtgacggtaagagggtgtgagaacacctttgtcacccctgtactttattgctctttttctgaaatggaaaagaactgaccagtggcctggaacccatgagtgaccagcatgtgggggggcactcacaggggaggacatgaggaattttaggctgctccttgagtgtggaccacaagccacaggccttgagtctataatcgcatgggaagcagttcctggctggcatcactcccacactggttagcggggcctgggaactgggcgcattcaggacacagaagggttcaccctgggttgtgctctctgcacttgcttctgtccagtgtctggctccaagagcagaagactcgggcggtgcatatcccttttgccacagtgatggctgcctgtgtgctgccagcacctgtcccccacctctctcttgacctgcccctccagctcttcccacctccaggccacatcattctctgtattcgcctcagaaccttctccagcttctttgtggggaaccttggggtaacctccatgaaggaggtgggcattttgggccaaggctttctcctccatctgggggctattccctggcttctccagggtcctgtggttccaagggccagggagcgacctcagccacgcaccctgtattggcttttcctgctttgctccctcactcctgcttcctgggctcacttgcccaaactcttgccccctcatcctagtcacaggctctgctctgggcagacccaacttagctcatttccatgtgcttgtgggcgggcttggcccagaaacccaagtggtggttctttttttttttttgagatggagtctcgctttgtcgtcaggtgcacgccaccacacctggctaattttttgtattttagtagagacagggtttcaccgtatttcccaggctggtcttcaactcctgatctcaggcagttcacccgcctcggcctcccaaagtgctgggattaaaaggcgtgagccactgcgcccagcccagtggcagttcttttttttttttttttttttttttgagacagagtcttgctctgtcgccaggctggagtgcagtagcgcgatcttggctcgtggcaatctccgcctcccaggttcaagcgattcccacctcagcctcctgagtacctgggcctacaagcacgcgccaccatgcctggctaattttttgtattttagtagcgatggggtttcaccatgttggccaggaaggtctcaatcacctgacctcgtgatctgcctgcctcagccccccaaagtgctgggattacaggcatgagccactgcgcccggcctttttttttacccaccccctccaccaccgctctgccgagacagagtcttgctctgtcagccagagctggagtgcaatggcacaatcttggctcactgcaacctccgcctcccgggttcaagcaattctcctacctcagcctcctgagtagctgagattacaggtgcacgttaccatgccctgctgatttttgtatttttagtagagacggggtttcatcatgttggccaggcaggtcttgaactcctgacctcgtgatcagcctgcctcgacctcccaaagtgatgggagcgtgagccagtggtagttcttttcaaggaattcctatcaagattgtcttcatgtagtgaaaactttttatttgagcaactggggaccaggggaaaccacagattttctttctttatagatcccccctgggactcagacagaccagaagattcggatgggtgggaaaggcatcccccggattaacagctacggctacggagaccactacatccacatcaagatacgagttccaaagtaagtgccccctaggctgtggccaagcccgcctggtcctgcggtggcactgcccttggagctctgtggcttgggcaggttactgctccctgtaagtcaggtggttcctgcccgagttatctgtctgtaaagtggacatagtagaatggtcaacttctttttttttgagatggagtctcgctgtgtcccccaggctggagtgcagtggcgccatctcggctcactgcaacctccgcttcccaggttcaagcgattctcctgcctcagcctcccgagtagctgggattacaggtgcctgccaccatgcccggctaattttttgtatttttagtagagatggggtttcaccgtgttagccagagtggcctcaatctcctgacctagtgatccacccaccttggcctcccaaagtgttgggattacaggcgtgagccaccatgcccggccagaatggtcgacttcttggagttgttgggagaattaaatgaacaacacataggaattgctttgctgctgctgctattgttgattttcttcttttttttttgagaaggaatctgtcactgtgttgcccaggctggaatgtggtggtgccatttcagctcactgcaacctcctcctccccagttcaaatgattctcctgcctcagcctcccgagtagctgggactacaggcgcttaccaccacgcccagctaatttttgtatttttagtagagacggagtttcactggccaggctaatctcgaactcctgacctcaggtgatctgcccaccttgacttcccaaagtggtgggattacaggtgtgagccagcacgcctggcccgttgcttttcttgttgatgttactagcactgttaggagctggagaggtggcctgggcagagtgctgtgggtacctagggcgggacatgcctgactcccctcgggagcactcatgctttttgttaattagataatttctttttttttttttgagatggtgtctagctctgtctctaggtggagttcagtggtgcaatctccacctcccagatttaagcaattctcctgcctcagcctcccaagtagctgggactataggcatgtgccgccacgcccagctaatttttgtattttcagtagagacggggtttcaccttgttggccaggatggtctctatctcctgaccttgtgatccgcccaccttggcctcccaaaatgctgggattacaggcatgagccactgcgcctggcctaattagataatttcttacttgcttcacatacacactggtaaaatctgtttcccctcctgtaaactgtatttagcatagccacagtgacacttgtttaaatgacttagtgtagggtgttttaggagcttttctgtacagaagctttgagggcatggtccttaggttctcaccgctgcactggctcagggtgtccgcccctgccaaggttgggtccctctcttcccatgtgctgcgagggtgctggctgcctgtgagttctttccaaagcttcccggcggaagccttggctgctgactctgctcggtccacaggaggctaacgagccggcagcagagcctgatcctgagctacgccgaggacgagacagatgtggaggggacggtgaacggcgtcaccctcaccagctctggtaaggagtctgaagactacatggtgacacgtgggggcctcagagccccccagggtatggacaattcagggcagcatgttggggtttccacttcgggttcttcatgaagcctttaaaatgtgcagttgaaagaggggggctgtgggcggggacagcgggcagggagccgcagcccccagtccaagcttcgcctcctctctctgtgtgtgtttctgtgctgaggtgagagcaccagggcacttcctgcaggcagctctgcgtgtctcagacccagtgttctgagttctattcttggttctgccacttgccctgtgacctcggacaaatccttccctgagagctcctggcaaaagcgtaaggagagagcatggattggaaggatttgtgcacttcccacctgggacactccgccaggatttcagagtgtcttaaaacaacagcagccacagcagtggagccgcagtcagcagactccgtccgccgctttagagcaggactccctccaagttatctagccgtgaacagatgcaccatttaccctgagctcagacatcgtgctagcgagtggctgtgttagggatctgtcaccagaacacctgctgtgggcgctgagacaatggcaccccagctgcagcccctcttcccatggggtctggggcctctttcctgggactcctggctcagggcagggcaggctgtgcccaggggtccttggttcaggcggcatgtatttcctcctcattgcatcattttgtttttgtttggatcctgggtggagttctcagaacttgagcagccttagattagtgcatggtaattcgtagcaggtgtttggagctgggggccgattttccaataaagtggaggatttggagctccaggggcaggggcaggggctgggatggaagtccctggaatttcactgagctcctgttgctcccaggggactggaattcctctgttaaaaagcagctgccggccgggcgcagtggctcttgcctgtaatcccagcactttgggaggcaggggcaggtggatcacttgaagtcaggagtttgagaccagcctggacagcatggcgaaaccccatccctactaaaaatacaaaaattagctgggtatggtggtgcatgcctgtaatctcagctactcaggacgctgaggcaggagaatcgcttgaacccaggaggcagaggatgcagtgagccaagaccacaccactgcactccagcttgggtgacagtgagactctctgaaaaaaaaaaaaaaaaaaaaaaaaagggcctggcgcggtggctcacgcctgtaatcctagcactttgggacgccgaggagggtggatcacgaggtcaggagtttgagaccagcctgaccaacatggtgaaaccctgtctctactaaaaaaaaaaaaaaaatacaaaaactagcggggcatggtggtgggcatccataatcccagctactctggaggctgaggcaggataattgcttgaatccaggaggcagagggtgcagtgagccaagattgcaccactgcactacagcctgggtgacatagcgagactctgtctcaaaaaaacaacaacaaaaaagcagctgccacaaaactctgtagcccaaccaggttccaaatgtcacttattttaatggtttggtacatatactgtgtatatgtatactatcttttgttcttgttgtatctcttgaactaaaatagaagtggtaatagagtagctattccccggaactctaatcagtgcacctgtggcttctccttcctcaaaccctacaatcacataacatgcgagattggttccatagacagctgtccttccctcctcccgcccatcagggtagcttgaggtgtgctacggccgggccctgggtgggttcgtgggtgttgcttactctgttggaggttgggtattactggtcaccagttgatgttttgaccctctctctgatactgtaagttgaaagttgattccgccacccactgagatcctttgtcacttccatggttacttgtcctgatcactcagcctcactcagctgttccctcactcagccaggatgtcttctcctgtgtgcaagacactgtcagctcttccttttaaagatcttggtgaggccggatgcagcggctcacacctataatcccagcactttgggcggctaatgcaggaagatcacttgaacccaggagttcgagaccagcctgggcaatatagcgagactctgtctctacaaaaaatttcaaaactagccaggtgcaaagtagtatgcacctctatcaccagctacttgggaagctgagatgagaagatcacttgagccttagtactcaaggctgcggtgagtcatgacagcgacactgtactccagcctgggtgccagggcaagactctgtccctaagcatacaccgtcacatgtcagtctgctgcctgtgggtggttaagtctctcattatactgtgaagacagttagttttgcatccacatatgacagtattacaggacatataattctcatgtcctaagaacttaagcaacagtgggatttatttatttatttgaggcagagtcttgctctgtggcccagcctggagtgcagtggtgcagtcatagctcacggcagcctcaaactcctggactcaagtgatcctcccaccttggcctcccagagtgttggaattacagacatgagccactgtgcctgaccagcatagtttttgatgcgtttagtatcttaatgtagctgctgaaaaccttaagagctgaccccggtctcccagaaagaccatggtgtgcttagagactcagcacttgcagggataaacaggtccatcttctggcgaacagagagggaactgggggggcttgcaattactatgtgactttttgagtgagagacacagtatggctccttgttgttctttttttttttttctttttttggagacggagtctcactctgtcacccgggccggagtgcagtggcgtgatctcggctcactgcaacgcactctgcctcttgggttcaaccaattctgcctcagcctcccgagtagctgggactacaggtgcatgccgcccctggctaattttttgtattttagtagagatgggtttcaccatgttcgaggccggtctcgaactcctgagctcaggcaatccgcctgccttggcctcccaaagtgcggggattacaggcgtgagccactgtgcccggccttttcttttttgagactgggtctcactctgttttatgtagcctccctcaccccttcccggggacctgtggccccaaactttggacctttcactagcgaaggcaccttcttacttagactgaggcctttactcttttatgcactgtgcgtggcctaggtctctgagcacattaaaaatgagctctacaattaacatgccaagttcaggtctatattctaactcacaacaaaagtgtgcactccttgtctagtagttggcaaatctgtaacacgtttgtgtgagaaagtacctctagatggtgtcagcctgggccctaaagaaattgcagcacagcttccctaggttgagagcatttaggttaggtgccccaaatggggacaacttgctcagggagatagactgctgatgtgagggatgagatggagtgcctgtgacaaaggattgtgcgtggccgtgactcccacatgggctgttctgcagggtctttgcgcacacagcagcatggaatctggccagttggtctagagtagggtttttcttggcagtcattatttaccttcttatagccaacagcatggtggttgagtctcagctttggagtcagactgcatgggctcgcactcagtcctccctcccgcttgttggctctgtggccttgggtaaaccctgtaacctctctgtgcctcctttttttgttttttcatctgtgaaatttgcctgtaaggaagtgtatggcctggcctgggaggtgcctggcacttgactgtgtttttgtcactgttgctcagatagagacagctgtcatagtccgtctctatttcttgtttccctgctgtgggtccttgattgaaagagcagttgggagaccctcaggctctgagtggcctgttcacctcagtcgtctgcaaggtgaggcatcctgtgccatcttaggagtggcccccactcttcttgaggtggcacttggccgcttcttgaacgtgggcccctgggtggccaggcgggggtaggtgggccctgggatgtgactgtggaagtgcaggcccatgacgccagttctttctgctgtttgtgcccaggtggcagcaccatggatagctccgcaggaagcaaggctaggcgtgaggctggggaggacgaggagggattcctttccaaacttaagaaaatgtttacctcatgatatcccagccgaggtaggaaaaccctggaggttttttttccctttgttttcctctgtgaactaatcctggttttctcccactttaaccaatattgtgcccccacccccaggagttggaacaggtgccagtccaaggtgtggtaaacctagctccactaggagctggcctctcagcctagggaatagatgacgtggcaatcagcctgtagtgcaggactggctgggctgccgcggccagcctctggctgtgtcttcttcctggggaggtggcgatgctggggctgttgtacagcccccctgcagtggtgggtccggcttgcccatggtcacagagggcgagtcaggcagagccaggcctagaactcagatctcctcacgtcctgcctgcttggaagctgccctcctgcgtggacagcgcagggctgtgcaagcctgggggctgctccaggggtagcgcttgctcgccgtgtcatcttgggacccactttggtttattatgctcatctcagcaagtggggttctcgcccctctcttggcacagctgctttccagggattaacagacgctccccacaggggtgtgttcccttgaaatgttgagtataaggtaacagcctatctctttggctcaggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaa

SEQ ID NO: 886 - DNA, 62421 bp, Homo sapiens; identical to SEQ ID NO: 883

SEQ ID NO: 887 - DNA, 30971 bp, Homo sapiens; identical to SEQ ID NO: 885

SEQ ID NO: 888 - DNA, 28141 bp, Homo sapiens
tttaaacaattcattctctaaaagagaaacatgaacttaaataattttattaataggaatctactacctgtaaaagttttatttcaaaaagggttaaaaagtagggaaactctttaaactactgaccaagactgccaccttcataattcagatgagttagtgcagagatggccagggccagaggtcgcccagaacctgcgtgtgcagactgcgctctgttagtcttctgcctgtcagcctcagcccagtctgtgttgcttaagggtgcgcctccccagggctggatgatgctgtgctcaagcctgcgggtaggagggctccagcttgcagatcccatgcgtggatgccatatatagatggttgaaaccagcatcagaggaaggaaggtgaccttacagccactgccgagaccaacgtgtgccctggcccagtcacagctggaaatcccagggctggtctacacccgactctggtttggtttaattaggtccttacgtgttggtgttgtcccaggcagttggcatggcatcagcactgagggtgtgagaccctgaggactcagcctcccgtcctgccagtagactgcctgcagccccaccctctttccctcaaaaaagaaggaagccaggcaagagagcagaggcccagggcgggggagtgaaagggccaatttaatgagaaactacaaactgagactgggccacgattcacagtgacaggaggccatgcagtggcagtgcgagaccaggaaggacagtggcaggatacagtggtccaggtgagcaagttcacaaaccattcaggaaataaagacagggcgaggctggtgtccaccaaggcagttctaccacttgtggctgctccttcctcgtccctagcccagtgtgcctgcaggagcaggtgtgagcaggcacagcaacagcctgtcagctggggtgaggggcccggcacttacagggaagaaaatccatggagaaggctctgcacatccaagcgcacccacaagggggaccctctgccatctcttgcccagttgggatacaccagccaccaggcagaggtcatacccacacgcagtgaggacacagggcagacgggaaggggctaggctcaggggctccttccggccccagcaatacagggttcacagaggcatggcctgaaagggggtctgcacactgactcaaagggacaagttccttcttagctaccagggtctgatcattcacccaggtacagtgtcctctctacctgacaccaggcagctctcgggcactgggacagggtattagacatcctgggcttctatacctgagagttctgagggccagagttggcagttttacttccagccaccatgccccacctctagcaccccagaggcgcaaagtacccagaaacaaacccaggctttgtgaccctgtcctacgtgggcccacctgactccagacaacttacccattctcggcccagcaggtcagaaacgcctgtggccacaggcctggggactaactggctaactgctctggctgctgttggtcccagggggaaagagtctggactgaacctgtaccttgtttggaaacagaggcatcaggaccccagcaggagacccctcccagcttatcttcccgatcacacacaccaagcagaccaacaacacacaagctcattgtcagccccctgccacccactgacccttggccttaaatcccaacagaatttttgccagaagagtcagcggctcaggtagggcagggtgaagaggacaggacttctaggggatggtggcacggctcccagccccaagtgggagcgggaaagtgaccactgagcacagggagcaaagcacagggggccagactgacaggcgggggagtcccgagtcccagctccgttagcacaggcgcttgtacgtgtagatgtaggctttgcagctggggcatgtgtgcgtcacatccttgaagtcattgatgaggcaggggatcaggcagcagcccagatcacatctgaatcagagacagggaagaacaggctgaggcctgctgcggaggaggcagaggcagccagttgaccctggtgcagcccccaccctaccagtgcccacaccacctaccccatgaagcaacagaagaaacccagcacgaaattcatcaagccaatctcgtaggagatcttggtggtgatggcctgctggcagtggggacacaccgtctgcacaggcgctccctcaaagatctctccctgcagcactgtcaccgtggtggcagctcctgaagggaccaggactgtggctgtgtggcccccagggccagggtagggccctggcgtgtagggccctggggggtagtagcccatgggtgggtgggggcctggaggagggtagaaacctggaatggcacagaagatggaggcgagaggtcactggcctgccacctgcaccagacaaagagattggcgcaaagccccacggtccacagcgcccagcgtgcaaggctacgcctcagacctcctaccgccctcctaacgggccagtgggaggccttacagctggggccctaagtcaagtggggccacattctcccagcccttcctggtccccaccccttggggcccatgacagatgtggcagagagccaggcacatggcccggtccctctgctcctctgtctgtctccagcatgcaaggacagggcactcagcctcaagcccatgaccaagagagggaaagccttgcgggtcacccacccctctcctgcacacaaggcgcccctccccacccatgtcaggtcctggtgtgccaaggaccagcccttcctgaccagcctgaataagagcagtcccaccttcccacgtccacagtccctgtccacacacagcctgagccctaggcaagggctggttgggcgtgttggagtccctgccctacagcagatgcccacctgtactgaggacagccagcgcaggccagacagcagccaggagttccccatgctcccctcagatcccttccccactcacccggaggcatgtaggtgccatctgcactcatgtgtggtgggatgaagccaggctggggcattgggtgacccggcggctcatagggtggggggccaatgtccgcagggggcagtggcatgcctggagggggctgcatcacagctggggaggaacggcctggacagagagaggcagaaagaggagactgagctggagcctctgcacgatgagctcgaccagaggccactgttttgggacacagatggggcccaggggtaaccctggagtgggcatcaccacttagagagtcccaaccatgccatggcggcagggggctgcaatatggagcctcaggaacagtgaccccctacctggggtgggcggggctccacttttctcttccagaagtggggctgtggggcccccaggataaggagggggaggctcgctggacatcttcgctgcttctcctggacatggagggaaaacccagacatgaactaagctcccagccaggttccttctccttcagccctgtggggtggccaagatgctgcacaaggcgtgtgaccatcctcagaagggtctgcctccaggcactggggatcccccacctttcccagggccacctagcccagagccaccatcctcacctctcagtagtcacctgctcttccctgtttggaagctgaagggcaaggacagaacccaggaagcagggcccagtgaggtaaagtcccccaaggagcctaactcagcacttgccccacacgagagcagtttggcaccgagctctcccctccccaaacgtttagcgggcactaaggcagtcggaggagacactggaccgatctctgccacaggctgcactgggaatgggggttctgggggatttcttacctcaaatccgtgctactcagagaagggaggcaggtgaggctccttcagctgctggcctggatggacagggaacaggcagggctccgggagctgtttcaggggaaggaaaggcagggccctcagcagggagcaagggctgccaagccagggctgggcccaggggcctgggcataccacacagttcctccccttccacatccggcttctccctagctgtcactctgccatccacacacccgaccacccctccattcctcggtcccgtcgcaggtctgcttcctccctcccccaggactgctggcacccaagggccacggctgggccctctgcctcccctcccaccaggcctgagctcccatgcatgaggactggactgccaggcaagctgtgctctggcctgtgcccttctggtttgtttgttgaggtgggggtcagggggaagaagagtcaagtgaaatcttttccctcatttctgtcaccaaactctctgagcacagctcagaaaggtgggaagcttttgctcttacttagcatcataaaggacttgggaagtggggttcagttaccttagctaaaagtaataaaatgagacaaaaatcagtttcagtggaacaaaaaatacagggaaaggagtgtttcccagacagcccagcacctgcaggggatggagggcacataagtttgaatataaagtttaacaaatcaggggcagggccagaggaaccaagtccaagctcttgggttcaactataaagtaccatggaagtttgaaaactgaaagagatcaaaaagctgttagaagaaaatgcaggcatcaatctttatgaccttcgattaggcagtggtttcttagatatgacaccaaaagcaaagcaacaaaagaaagaaaacttaaagtggatgtcatcagaatgaaaaactcttgtgcttcaaaggataccatcacattttataattcatagatctgataaaggacttgtattaagaaatacaaagaactcaactcaataacagaaagacaacccaatttttaaaaggatttgaacaaagacttctcaaaagacaaatggccaaaagcacatgaaaaactactgagcgtcttttcataagggaaatgaaaaccaaaaccacaaggagaccatttcctatctactaggatggctaaaatttaaaaagacagtaataggcattatgtagaaaaactggaaccctcatacactgctggtaggggacagcccctgcaaaccttttgaagaactgccagcccctgttccccttttgaggaacagtctggcagttcctcaaaaggttaaacctagagttaccagatgacccagcaattccacccctagttatctgcccaaaagaaatgaaaacctgtctacacagaaatttgtacacaaatgttcacagcagcatgaatcataatagccaaaaagtggaaacaacccaaatgtccatcaacaaagtggataaacaaaaccgtaggctgcccagacaatggaagacgattcggctataaaaaggaaggaagcactgacaccctacagcatgaactctgaaaacatgcttggtgagagaagccagacacaaaaggccacatactgtatgatttcacttatatgaaatgtccccaataggcaaacccatagaaacggaaagtacattagtagctgtttaggtctgggggagaggggaaatggggaacatggaatctccttctggggtaacgaagatgctctgaaaccgattgtagcaacagttgaacgattctgtgaataactaaaaaccactgaattgtacactttaaatgggtgaattgaatggtacgtaaattatgtcaataaaacttatttttaaaaaaaatgagggaaaagaaaattagtcctactgcagcccatctccacatgtccctgctggtctgtatgcacaggcacctgtaccttttggttttgttttgtagagacgggggtctcactatgttgcccaggctggtctcgaactcctggcctcaaacaatcctcctgcctcggcctcctaaagtgttgggattacaggcaggagcaactgcgcccagcccataccatataaaaatatagttgctgtcctgacagttttaaatcctttttttttttttttttttttttttgtgagacagagtcttgctctgttgcccaggctggagtgcagtggcgcgatcctggctcactgcaacgtctgcctcccgggtcccagcgattctcctgcctcagcctcccaagtagctgagactacaggcacacggcaccacgactggctgatttttgtatttttttagtagagaagggatttcaccacattgaccaggctggtaaatccttttaatgctgtgtcacacatattccatcttacaagactccgtgaccgttgatattaatattccacaaaatgggcatacttgaccaaaccctattaagacatttaggcaaggccctacttgctgctttcatgaaatacaagagaacacctctgtccaccgctctttcccttttgttagattatctcctcaggctaagcttgtcagagtgagatgactaggtcaaaggacatgagcattttatgcctttttgaaaggatgccaatttatagtgccagttattaattttcatattaaaatgtcacttatttttatatgcatttctttggcaatcaggagacagaacatctttccaagtgttcagaaattacacctcttctgagttgccttattatccacagaagacatggaggcctagaaaaggatggggcggggcataagtctaggaccccagcatgactctcccaccctcctgcctgcacagtgaattccaatggcacagggttaagaaaagggagcagtggccaggtgcagggacttattcctgtaatctaatctcagcactttgggagactgaagctggcagatgaactgaggccaggggttcgaaaccagcatggtcaacatggcaagactcttgtctctacaaaagaaaaatttttaaattaggcatgataatgtatgcctgtagtcccagctactggggaggctgaggcaggaggatcacctgagcccaagactcagaggatacagtgagccatgatcaggccactgcactctagcctgggcaacagtgcgagaccctgtctcaaaaaacaaaaaaaaaaaaaacagaacagggagtagcagcagtgcctcttggggctggtcctggggtcccttgcccaggctgctcctagcctgccaggtgccctcctgcaggggagaagagggcagcctttcatggggctttacctgcgtctggaaaactgctccaatacgttgagttggaataagtgccagcccctgctacaaactcccagactcccagaaaatgctctctggcgcctctgggtggcaccaccgtccaccaagtggcccaacactgtggtctgcagtggtcttgctcatcggggaatggtccaggccctgggatgctctgagcagaccaggaaaataagctgcactgtgcttggtgagtcactgaagcacctgcagatcccagcctgggtcccttgcagggagcacacacacacacacgtgtgcacacacaccccatctctgagaatgcaggtgttgcctttctctggcccatcttttcatcaaagtcaacagatataatcctatgatctcctagagctcaaaaattctatttctggaattccacatacagccttgcccatgatgatagggtgtaagcccacagggcatagccctcctttggtgttcacccaacctgggtacagaaaatgcaggccacagggaagggtctggacctgcacagggctggcttcccctccagctcgatggccacaccagagcccaccttctctttgcccctcaccgggggccgcagggccctgttgctcctccgtgtcttccccacctagggccatgcctgctactcactgctccccctcacccctccatatccacatgcgtcctcctgctgccttcctgaaccccagcagagactgcagggcaggtccttctctaccaaggagaggatctggaaaacagctcatgaagatttcccgaattcaaacacccattctcccagtgccttccaatacaaaatcaaacatgcattcccacaaaaccatgttgtgtagggtgtaataaaaactacaagaataatctttcaatcacacgatcagaagcaaaatagttttccaataaaacgagtactgttcaaattaagctacaaaatggaaaatgtctgatctgaaaatgcagccccagcacctctgctgtgggaaggtgctggtgagggagggggctaggagacctggggatctgcccagttcccaacagaggaggaaggggagacttgcggggtctggggagcccactgaagtcaacttgcagccctgacaaatccaagagaggcttcttggccttcttgctttaaatcttggatttattaattgcaaacaaaataggtgcctgtttgaaaatctttacaagtcaatcacaaacttaatagtaagtcactcctatggaagaccagaggcctctgcaaagtctacccctccacaccctctgggttctgtggcatgtgaaggtgtggagaaaaaacctgtttctcctctgctttcacaccataacaatcaacagaaaagacttctgtggcaaaacatgtgggggtttctccccaataacaagcaagcagtcagttctgcagcggacaccaggtggacgtcttctagtggcattcaagtctgatgctaccgtgtcagatcccacaggttgagggctcagttccatgactgccccccacttctgatcatcgcaattcctagcttgcgacctgcgcttctgacagactggctacaaatcactatcttgggagcggattccttgtaagaggattagctagtcttttgtgggtgcctctccccgcggcccttccaccatgggatgacacagcaagaaggcccttgccagatgctggcagtgccttgatcctggacttcccaagcaccacagttttgatgactgatggtgaggcttaatgggagttgtttgggacatgggaggtggattcctcatgaatagataaatgccctccctggggtggaggagaagcgagtgacttctcactctgttagtccccgcatccttgctggttgtcagaaagagcccagcgcttcccctccccttctcaccccctctctcgccatgtgatctctgcacagagaccccccgtgccttccaccatgaatggaagcagcctgaggccctcaacagaagcagatgttggcaccgtgccatcctataaagcctgcagaaccaggaaccaaatactctcttttctttataaattactcagcctcaggtaatttatagcaacacaaatagactaagacaccagcctccagaactgtaaggagataaattcctcttctttatgaatgacccagtctcaggtattctgttagagaagcacaatggactaatactacatcaagacttgacaagtggtaggttttttttttttttagacagagtctcgctctatcaccaggctggagtgcagtggcgcaatcttggctcactgcagcctccgcctcccgggttcaagcgattctcctgcctcagcctcctgaggagctgggactacaggcatgccacccatctaatttttgtatttttagtagagatggggtttcaccatgttgaccaggatggtctcaatctcttgacctcgtcatctgcccgcctcggcctcccaaagtgctgggattacaggtgtgagccaccgcacttgaccgacaagtggtagtttcttaagggttagttgccacaggaattggaagccttaacaatggtttttttctaatgtgttacattagaagtcattggtgtaccttgcatttggaatgggtcttttacatagacatgatttcttaacatcatgtgtgggtcacctgaaaatacgggttcctgtaatgcagatctaccaatgttgacacatctcattgaacaatatatatttttttaaatcacattgctggtatcactaccaatgtcattaaagtcactaaatattgttaacgctaatcatcatttgaaagcttgaatttcatcactggcaacaaagcactaacaaatatagaaacagcaacatatacaaaaataaaaggtcagttgtttcccttgaagtagcaagttcactttgctcattttcaagaaagtgtatgctaaatatccaaatctgaataaccacggtgtgtgccagttgttctttaagtgaagatggagtccatgaaaaaggcagctagttcggcccacacttcaaatgaatgcacgtgtgcttttcctcacgacagcatcaaactccatttgacatacttcatgtgtgcctcatttcgtcacaaaggatcttaaaaagctgtggactcatgggtcaggacttaataaagttgatttttactgctttttctgatgcaacactggtgtgtgtgtgtgtgtgtgtgtactgtgtgtgtggtggtgaagactcaattacaacaagaccagcacagtgtggtgccagtcttgagtcagtgcaggccccacagcttgtttccgcactgctcctacaccatcaatgtgaaagccatcacaaacaaagaggcatggtaacaaatcatggccgtgttattattaaaacagttctgatcctagccccccgagtggtctcaggaagcccccaggagactgcagatcacatttcaagaactgctgtgctagaggaacccccactagaagttaaggggtgcgtatcagccaagtgcagggctgggacaggacttcacaaccagaaggatcaagagtggcctgcaagtcttggagtcgctcctggggaggccctgagtttgttgttctggcaaggccccaccccagggatgtgcttgccacccggtggaaggctttaaatgaaacaagcagtcaagaacatgggctctgggccaggtgtggtggctcaggcctgtaattccagcactcggggaggccgagacgggaggattacttgagcccaggagttcgaaaccagcctggacaacatggcaagacgtcatcaatattaaaaaaaaaaaaaaaaaaaaaaggcgggggggcccgctctgcatcagcttaattcaaacccagacccccaagacccaccactttccagctgagcgagctgagcctcggtttcttcctctgtaaacagagatgatcatgcctacctctcagggtgggagtgaggttgaagagagactgtgtgtgaaacgcctgcagcagaaacgctgggcctagcacacaatgacgctaaataaatggaaactgctattattatgctttattaggcaacttccaacagggaggaaaacaacaggtattgacgcctctgccatggagtgccttctgattcccaacgaggggtcctggtgcatgttcactaatatgactacaaggggatgcctctaccggattctggagggacttgcaatcaaaaccctccctaagaactcagctcagcagcgttccctcacagcacagctcagctgggccacctgctccacggtaacccgagacaactctttgagaaggcagagacactagcagtcctccaagggccatctctcctggtgggctgtggaaatgccaggggcctgcctgggagtgcccaaggttggcaatgcccctggaaggatgctccaccaatacaccctggtggcaggggctctgcagcagctgctgcccagacacatttctcagagctgggctggcttggtgctgcatccccaggaggtgcttacccacgtggcagccatggcgtcaggacgccagctggcctcagaggggctcctctgtccccaggaggcaggtcccaggcatccagccaggaacagggctttctgctttgctgggaaaactgaaaggccgatttctgccttgcctgcagcttccatgtgctgaataaaggaggtgcccactgctccatgaggggcagagccgaggtaaaagacaaacactctctgtgcttcttgggtctgaaaagagaatggcaaggcccaaaccaggtctggaggaaaaggccaaagcaagaagtgagccagaagcaagcaggagctcacgtgggcctcagggaagatgctctcagtccagatagcagcaccctgcagggacagggcagcgggaaaaggagagcacagaatccccaccaagggtgcaggcctgaaggggacccttccagggaggcttggcccacactaggcctttccatcctgtgacatctccatccaacacacagacggattagttcaaacccaccttggagggcggtgtgagaattaagtaaggcatggatataaaaacttactgaaccactgtaacgggccatgcagcgtgagggtcattaggagggggactgttacttgcaagggatggccgctgaccacgtagctgttccgcctattctcccaagcaccccagggctgggctgaagcacagtctgtgaggtgaccacgtaacagaggccctctaaggggagggcgggggatggtgcttccttctgatagttactcagcacatcctccgtgccagatacaggctggggattaaagacacgtccctggctgggcgcagtggctcacgcctgtaatcccagcactttgggaggctgaggagggcggattacgaggtccagagatcgagaccatcctggccaacacggtgaaaccccgtctctactaaaaatacaaagattagctgggcgtggtggcacgtgcctgtaatcccagctacttaggaggctgaggtaggagaatcacttgaacccaggaggcggaggttgtagtgagccaagatcgcgccactgcactctaacctggcgacagagcgggactccatctcaaagaaagaaaaaaaaagacatgtccctgccttccagaagcttacggtcaagtgaagaggatgagcgttaaataatcacccccctcgccaaaaaaccacaaacacaattacatctgtgaccagtggtatcgagaaagtccagggcacagtagaaggacagcaagatcgccgttctggagctctaacaccatctcttcaagcaaacctgggaggaggtggcggaagagttaatgagaccagcaggcaaagggagggatggggacagcagagggaacagtgagtacacaaggcctaaggaaggagggatgtgcccctgagggtggccagatggcagcctggggccctcacagcgacccagccacagggtttgttccagagctcaaatacctcagatctccaggacaaggatgacaaggccagctggacagtgtcccaggcccttctcctcaggctttaggcttccccaggagacctccggcaccattcagccttgttgcattgtggcacttggaaacaaagacagcggtcttctttgcttgactgtcaatagaatattgggagagcacaggtctccctgggaccctgcctcgccgctgatggcctgcagccctagacaaattcctcaacctctctgagcctcagtttccccacgtgcaaaatgaggttcttggaaggctgaacaaaatcccacatgtagatgtccaggctgtattgctggagacgccttccatgaattactacgcagataccaccacccatacagagctgtgctgtgctcctccacatcacactgcaaaggaagaaggcagaataacaagatctcaaacagcaatgttccgcctaatgaagtacagactggagattgccagctgcacccaaatccactctctcccccattcttgaatacagaactccactttcactcagggcaagtccatcaaccaagagggtccccgagctttcttagagtgacaaagctttggctaatgagctgtaagcagaagtgtccagaccataagaaggcattcagggcaagccgactcagcccggagccaggcccttcatctttcctgccttcctcccatctaccacctggaagatagatgccatggctccagtagctgtgcttcaccatgagggccttgggatggaggccagtgcctaggacagccatgggacaccacaccagcaactaactgaccacctcccacatcttccacatgagtaataaaacttggtttactggttaattattggtaaattattttcaggttaagtattaacaagtgtcattacaaatatacagcacagacaggtgcagtggctcacacctgtaattccagcactttggatgccaaggtgggaggactgcttaaagctaggagttcaagaccagcctgggcaacataacaagatcccatctctacaaaaaaataaaattagccaggtatggtgatagacacctgtggtcccagctacttgggaggctgaggcgggaggattgttctagcccagggattctaggctacaaagagctatgtcacgccaatgcactctagcctgggcaacagagtgagactctatcccccctccaccacaaaaatatatctctacagttccttaggtctgaaggaacacaagttctcttcaagtgatccatgatcaaaaggatcatggctttctttaggtcacatgacacagcctcagccagtacagaggccaaggcatggggaatactccctggcgggaaggctggagcagatgcttccgtagttaaaacaggccccgagagaagtgcagctggttgccttggagcgaggacacattcttctgcaactccagtgctcatttcagcatgagcactggctcaaggaggagctgaggaggacgatggcgtgcagtgaacgttaatagagcatgcactgtttggatgcaggtgcccagcacagggacatgaaggaagtgctccaagtgaggaggtgctcaaaagggagcccctgctgtgagactgctcctgggccccaaaccctctccactcccctctccaccatgccctatccaaacctggggctaatccagccacccaagtccatgtgggaccaggccaggattccctgtggcctttcgcagctgaccagagggaccctattcccaacgctgggtgatgagcaggaaagaggaggccctccacaaaggtccactcagttgcagagcagcctctagtgaggctgagccctcccaagactcagggaggttgccaatgtgtccccttctctgggaccgttgtcctcggctgccaagttctagcacaggcaggcctggaaaatcctgaacatggcccatttcccattgtcctgatggaggcaggacgagacagtccctccctcagataacatcgcgggtggctctgaaccatttatttatttttacacttgaagatgggtgtatctgatgccttgggaattctaaacacttcaaaacaagctcaacttaagtcacagaaaggaccagaaaacagatctggttttcccatctgccagctctcctcccacccaaccctacatgctcctcctcgaccatgatgagtctcagcggaaataagacaccagcctagccaggcacggtggctcatgcctgtaattacggcactttgggaggcagaggtgggcggatcacgagggcagaagttcaagaccaggctggccaacatggtgaaactctgtttgtacaaaaaatacaaaaattagctgggcatgatggcatccgcctgtaatcccagctactcgggaggctgaggcaggagaattacttgaacccaggaggcggaggttgcagtgagccgagatcacaccgtcgcactccagcccgggcaatagtctgagaatctgtctcaaaatataaaaaatagctggtcacggtggctcacacctgtaatcccagcactttgggaggccaaggcaggcggatcacagatcaggagattgaggccatcctggctaacatggtgaaaacctgtctctactaaaaatacaaaaaaattagccaggcatgatggcgggcgcctgcagtcccatctactcaggaggctgaggcaggagaatggtgcaaacccgggaggcggagcttgcagtgagctgagatcgcgccactacactccagcctgggcaacagagtgagactccatctcaaaaaaaaaaagataaataaaaataaaataaaaaataaaataaaaataaaattaaaaataaaataaaaaagacatcagcccaaccccatggccccaaacaccactgcgccctccaacagaagcatgagccctgtgtcgcaggcagagctgcaggggcagaatcttgcaccgagtggggcacaggcatcaggccccacgcccaccaccctgccctgccacctgactctccagtctcagattttttttcatctgtgatatggcggtaggagcagccccttatcaagaattgtgatgagtcacgggagaggccatgggtgaagagcacaccactgaaggcctgccacaggagcctgagagaggaagtacacgagaaaaaagaagacactgttacttttttttttttttttagacggagtctcgcactgtcgcccaggctggagtgcagtggcgggatcttggctcactgcaagctccgcctcctgggttcacaccattctcctgcctcagcctcccgagtagctgggactacaggcgcccgccaacacgcctgggtaattttttgtatttttagtagagacggggtttcaccgtgttagccagggtggtcttgatctcatgatctcgtgatccacctgcctcggcctcccaaagtgctgcgattacaggcaagtgccaccgcacccggtgacactgttgctcttaagcagaagcaaaatcaaaaggcagacaggactcaaagaatggttctaaacctaaaagtactaaggcctctaggaactatgatgatgacaattactgtgcaatttatatcatgctgaattttagtaaaacctcctggcaaaccactctcacttggtgacactccgtccacagcacggggccacagcatagtggatcagtacaactttcctggacagccttgctacctgtacactcttatggactcaattccacttcaatgtattcgttctagaggtaaatggacatgtgaacacagattcacaggcaaagatgtttatatgcaccactgtcttgatgttcaagaaaatggaactggttacatgcatgtgattagctatataatgtaactgtattcagcccctaaaaaatgatatagttttgtttttgttttttgagatggagtctcgctcttgttgcccaggctggaatgcaatggtgcagtctaggctcactgcgacctccgcctcccgggttcaagtaattcttctgcctcagcctcctgaataacaaggattacacgcacccgccactaagcctggctaatttttgtattttagtagagatggggtttcaccatgttggccaggctggtgtcgaactcttgacctcaggtgattttgcccaccttggcctctcaaagtgctggaattacaagcatgagccaccatgcctggccaatgatatagatttttattgacatagaaaaatggttttaatatagcagtgagtgaagaataaaaaagcagtagcacagtgtgattcttctttagatgtatttacatacgtaacacattttttgtctttgttttttcctttttgtggagaacagcgtcctgatatattgcccaggcaggtctcgaactcctgagctcaagctatcctccagcctctgcctcgctaagagctgggattacaggcgtgagccactgcactcttccataacacatattaacagtttttctgggcagtaggagtttaggggatttgtttatatgtaagtacacatacagaaacgttctactgatgtggagtttctagttttttaatggtaggcagcacctttacatgactccttcctcaaaatgctcattataagtcagacacagtggctcacgcctataatcccagttacttggggggctgaagagggaggaacactcaacccaggaggtggaggctgcagtaagccatgattgcaccgctgcactctagcatggacaacagtggggaagaaccctgtctcaaaaaaaaaaaaaaaaaaaaaaaggctggccgcggtggctcacacctataatcccagcactttgggaggctgaggcacgcagatcacctgaggtcaggagttcgagaccagcctggccaacatggtgaaaccccatctctactaaaaatacaaaaattagccaggcgtggtggcgcatgcctgtaattccagctacttgggaggctgaggcaaaagaattacttgaacccaggaggcagaggttgcagtaagctgaggtcgcatcattgtactccaggccgggcaacaagagcgaaactccatctcaaaaaaatatatatatactactcctcatactcctcaatccagaaacacacctcagactataatctaatttcacctacaggagaaaatgctctgcagagcaagccagaggcctggactggttagtggcctcctctccaaagccagccccttatggccataggtctcccatgagtttggtcaaatgagtcagttctgccagatcacctcccggtactccaggcaaatggaaagtttagatctgtaaagttggaatgtaatgacctcacagtcctgctagcctaggagaccccgccaggagacccagcaggaggtcacctgaccaaagagggctggtaagaaagtccccgttggatgcataataaaaacgagtgatagagcccatgctgaggacacagccccggcctcccaactcgcccagtgatctcgccaggactctgaactacctcccaggcagaacgctgctcaagagcttgttcctgcatgctctcctgctagcagagaaaatgaaggaagcacagacaggaggggaaatgcagagcaaaaggaaaaaatcagacacagctcaaccacaagtgaataaacaagtcatctgcacctgtcccacaggcaggccttggtaactacaaggctgactaattttagaaacagcatgaacctaaagaaccatcatttaagtgctcaaaatggagcccttaaaaaaaatccttctgtctgcctgtactgagcagacacaaaatggacagtcttgggttgactctattcaaccagctgtctgttggatgagatcaagacacaccactgcaacctacaaaaaagcaccaggccgttaagtgcagtcaagacacgtggccactcacggccacccaggtggaagagtcttaattcagacacaaatgtctcctggccgtccttagccagggagctgggctctgcccgcggccaggtcttgcctgagtccccctattccgtgggtcggggtgggatgtggaaaagcaaacctctaggctttcttcctccaaatgtgtcagtcaccatacatacctgtacacagaagctccccctccagcaattttccctcagaacagtgaggacagtggctcatccctgcgacatttagatctctcatgttacagggcattctttcaattattttgaagacatttctgatgggtgaagaaagcgctctaggaactgagagtgggaatctaatttgtattttacactacattagatgcaacagtatatagcatatggaaattagttaactgagtttctatcactcttagttggcatctgaccctaagaattcacttacattggttgggtgtgaaacaaactgaattagtagtttacactgcattatatgaaacagtatatagactgggtgcagtggctcacgcctgtaatcccagcactttgggaggctgaggcagtcggatcacttgaggtcgggagttcgaaaccagcccgaccaacatggagaaaccccatctctactagaaatacaaaattagccgggcgtggtggcacatgcctgtaatcccagctactcgggaggctgaggcaggagaatcacttgaacccacgaggtggagcttgcagtgagccgagattgcgccagtacactccagcctgggcgacagagtgagactccatctcaaaaaaaaaaaacaaaaacaaaaaaaacagaaatagtatacagtaggccaggcactgtggctcaggactgtaatctcagcactttgggaagtcaaggcaggaggatcacttgagaccaggagttcaaagctgcagtgaactgagtgcgccactgaactccacctgggcaacaaagcaagactctgcctcaaaaaaaaagaaagaaatagtatatagaagtttattaggttggtacaaaagtaattgcagtttttgcctaagttcctgtaactctaagtcaacatctggccctgagttcactcatgctggctgggacagaagacttattctggaagcttgggaaaacaggagctcacgtcatgattgggactgccatctgcttggccatgtatatatttctctatgactcagacatcagagaccaggctggagtgcagtggcgtgatctcggctcattgcaacctccacctcccaggttcacgcaattctcatgcctcagcctcccaagtagctgggactacaggcgcctgccaccacacccagctagttttttgtatttttagtacagatggggtttcaccgtgttagccaggatggtctcgatctcccgacctcgtgatccgcctacctcggcctcccaaagtgctgggattacaggtgtgaggcactgtgcccggccttttttttttgtatttttagagacggggtttcgccatgtttgccatggtctcaaactcctgacctcaagtgatccttctgcctcagcctcccaaagtgctaagattataggtgtgagtgtctgctcctggccagagaacaccttttggaggttgcaaggccatcagagatgactgggtccaagtctaagctgccattcatttctgtcttaaatgtttactaagcacccatggaagacaggtgccctgtgaagtgctggagatgacggtgggcgagcaagcagtggcacagagtggggagcagtctccgaggagagaagtggctgccccgggcaccccagctgcctggagatgacagagccaagacaggacctcagctgtcctgactctctccttccacatcactgtcagccctgtttcttttctcacacattctccagaaatggttttcaaaatacacttgagtgggatctcacactcccaataaagtgcttcacacagtgtagctcacacagtgcagttccttcacatgcgttccatttacatagatttcatggtacccaggacaaaaagctgaagtggcagtgcccggtcccctgctttccctggggagggaaatgggacacagaacgtgctgtttcctcaggccccgctgggcctctagcagggggagtgcctctgagctaataggcaattcaaggactttagaggacagtttgacttatgaggtctttgctctgctagttgactttagaacctaacccactgaatgtgtactgaagaattcaacacagcatgcaaatcagcacccccaacactcaggcaatgacggagcacatgaagaccacggtccctgcgtcttggctcttaggaagatgagacggctgaaatgcaggcatggtgtatcattttattcaaccaataagtatggaccacacactatgcgtgaggcatttcctaggcactgaagatggcagatcaacgtctgtcttaatggcaggcagcttcagtggggggctgagtagagggcataaaatacagaaataaaacatcgggcctggcacagaacaaagcgtggcatggaagaaggaagaacaaggaagtggttgccacagggctgcagttgtcaccagggatagctccactgagcagggaacactccgtgttggaggatgggtgagccgggtcctctggccacagcaggatgcccacttttaccctgataagccgagaggcttgcagagagcttgggaaatcatttcgccccacgactctccattttccgcactcacctgccatgctaatccagttctccaaagttctgacatcaagtaggtggctcctagagctggggagcctgagagcactcggctaccacctccagcaggtatagttcctttttggccaattttactggggccacagagaaatgcgtcatggtgtggccactgtccctgcaaagcagctaaacacacaccacagaacctgagcttgaccatgctggggacagaaactaaggcctgaggtcaggtgacacaaaatgcctggggaatctgagatctgagaagtgctcacttgaggccttctcccctgaacagggcaggactcttcaggttcaaggatgaggccgtttcactcagcagagccatcaccatccaagttcctctcttttttgtttaagtgactacctgtttgaaaagactcatcagaccctccatggaggtcactcacctcatggtccctgccctcagggagctgcagatctacctggcaagacaagtgacacttgagaagaacttataaaaaatacacaggcaagcccagcaggagctgtcgcctctgtgacagcaggtgctccagcagagaaaaggtgaggcctgtcatgggcttcacagccctgcagggaggtggccagggaattctgggtctagggcaatggagtcactcataacatgcagaattagaaagttgtgatcaaggccatctcccagtcagacccatagctcctgcagggcagggtcagaccttggggccagtttctccagggcaccgggcagcctgtgaaacatgggttagtgggtggatgggctgcagcttggctgctgctctaggcaggaactctgctctccagccagaggacccttctgttcacttcactcccattgccaaactggatggctgagaggcgctccagacctttctcgtctccttaaaccatgaccagtcagcaagtcctactaactccatggttcaaaggccctcagatccactatctcatctaacagtcaagggtgacagggaagagtctggacttggaccatatcccagatctaccaccggatcgtaactcacactcctccaaactatctcatccccccacccttcccaagcccacccccgtactctttccctggcctccaaacacgcccacaccccacttccctgcaaacctgggccttcctgaggattctgctgccaggggattctctgtcccttgtcttatctcccctcaagaatcctgggactctcccacttgtattgttgggccctgcttggtgcctagtccatgtgtgttgaagaaatgagtgcacaggtttggggttgacctaagtggacctcctgtgccattcttttttgtttgttttgaaacagtctcactctgtcacccaggctggagtccattggtgcgatctcggctagctgcaacccccaactcccgagttcaagcaattctcctgcctcagcctcctgagtagctggaattacaggcacctgcccccacacctggttaatttttgtatttttagtagaggcggggtttcaccatgttggccaggctggtctcgaactcctgacctcaaatgatccacccacctcagcctcccaaagtgctgggaatacagccatgagccaccgcacccagccccttctgtgccattcttaacccaaaggccactgcccagggtgagaacacagccgcagccgagagagactccactgcgtcctcaggaaagtacttacgttcacagccaaatatccagacaggaaaaaacaccatttcttgaattccagtcaactccgtgatgcagtgatcacaatggggctgggagagcccacgtctccctcagctgctcttccgccacccctgctgtttcagggccagccatgggcccttctctgccattacttggcaaccatgggcaagtcacttagacactctggctgctgcctcagctggccaagtcccactgtgctgctacctccctggctgacaggtgagaacaacgcatgttcatagggcggtacactgcaaagaaccccatttcctcctgcttccccagcctgtgaggccgctgtttgcatggtttttttttttttttttttttttggtttttgtttgtttgattttttgagatagagtcttgctctgtcacccaggctggagtgcagtggtacaatctcgactcactgcaacctccacctgccaggttcaactgattctcctgtctcagcctccggagtagctgggattacaggcatgcaccaccacacccggctaattttgtatttttagtagagacggggtttctccatgttggtcaggctggtctcaaattcccaacctcaggtgatccgcccccgttggcctcctaaagtgctgggattacaggcatgagccacagcacccggcctgcatgttaatcagaattgtgacaaccaagctcgctttcttcctgaagtaatacgggttgaaattctccctaaaccctcccaaggcagctctcgcactcttctctacctacttccacctttcttggcctcttttccttcttgggggaaaaacccagacactgggactagatctgaattcagacttaattagcattgattgaacaattacatctcaggaagaccctcagtgtttactgaacccccattacacctccttgcagtaagaatcgatggtactgaatcactcaatgtacagaccaagccaggtctcacccacaaatcaggagcactgaaaaggtgacaagaaatgtttcctggaaaaatggtccagtattaccaaaaatgcatcacaactgctttcaaggaaagaatcagaatgctcctggaccccctcaccctgcactgcaggctctgtattggttttgctttgtctgccgtcagggacccttcatctcttcagcgctaacagcagatgcaggccttcctgtggcctgggtgatgctcttcacctatcacagacgcggccagcaaggcctgtctgtcacacagcttcaacatgacagagaggtctccacgtctaggcagccctggtcccaggacaccaccaatgtcatggaccactgcctgatgactcacagagtaggagaagtggtgaccggggccatcaggcccacgggttcaggagccaccagaccagtgtctccaagagtggacagccctctgggcatggggaggttctggcccaggccctaggcgcctccacctctgctgcactgtattgcaaggtagcctttaccacctcccacagagactgtggcttggagactcctgactaggcagagacagaaacagaaactttttgtgggatcctagaaaggggcacatttccattttgagtaatctatttccaagtcccctcgtgggggaaagggaacctcctgtcaccactgccggcctggctctctctctccatcctccccatggagcgccaaggtcctctgcagagctctccctgcctgccaccttctcaccagcacttcctccacctacaggacagtgacatgctataaaatgccacaactttaactaccatatttccctgtgtcttctatgagtaaaaacatgtccttacccttggaaccatgttcctcaaagtggagacaaattttcacagggcctatcttttctctcccactcaggcaactgagtagggtgaagggctggtgtttgtggctaaggaacaaagtacctgggcccaagggtctcaaagccacggcctctagtccatcaacaccatgagctaaattgcactacacaccccagttcccctagaccttagaaaacacacactgaactggtaggttcaacctggacaagcttacagtgtaaagagccgacagggagttgcaagctgatgactagcttcaattattgccaacgtgatctgctggggcaagctggccttcgggacgcattccgttagctccttctcaaaacaattttgttccctgaagtattactttacatcatacagtcaatgttctgctcttatggtgattctagaaccacggctggctgctcttaaatccttgtaagaacttgggcacggtagctcctgcctgtaatcccagcactttgggagggtgaggcaagaggatcacttgagcccaggagttagagaccagctgggcaaaataatgacatgccatctctacaaaaaaaaaaaaaaaaaaaaattagccgggcatggtggggcatgcctgtagttccaggtactcaggaggatcgctggagacaaggagttcaaggctgcagtgaacgtcgtgacggcaccgctgcactccagcctgggccacagagcaagaccctggctctaaataaataaatgaacctttgtaagagaacctgtaaagctcttccctggttctcccatcctgtggaaaacctccgaactccttcaaattctcaagggtgagagacggatttctaaatacccagggcttccattaaggtaaaaaccattaagaagataaaaaagtcaaacccaataaacaacaattctaagactctaattaatgacatgcatgcttatttgggagggaaaggcactgatatctgcaacttactttgacacaaaaaacaagagggactgctggttggacaaatatgtgatgaaatacaataaagtgttaactctacattctaggtggtggtctgtgggtgttcactgtaaaattccttcaacttttgtatgtttcacgtttttcgtaactgaatgtgtagagggggagtcttctgagactggcaagtgactgggcataacctttccgattaagggcagagggcaaggcagagctggcacgcctccctccacccagttctacctagatcggccccaagggaagcagcaaagaacccaggagagcagtaacttgcccgggcaccgccccgcccagcatcaggccccagaatacagaagaaactggcagaaacactatggaacgtccctgcccccgggcccgccaaccccctcactgggacaggttctcagccccagctgcgcccgggaatgatctggggagcctactaaatgcagattcctgggcagcgcgacggaactacagcatcccaacacctggggtgggccccaggaatctgcccgtttcccaagagccccaggtggttctgacgcagaggatcttgagcccacctttggaggaactcacagccactcgccccacctcatctaacacctgttgagaagccccccaaggaactcgctaagccaaggtcctcgaaggcgcgactcctagccccaagctaggccaggccgtcgccatctccgccggggatgcgcggccgagcgccacatcccgactccacacgtcggcgagccgggcgcgggtgcaggacactgctgggctccgggacggccaaggtcacccgcggggctcggcaggggctggctcggccacggggctcctcctcgaccccctttccttgagaaaacaactcccacccctcccctccccgtctcgccctgcaagacggagatggcaatttccacaaccttccctgacggaaaaacgtgcgggcgagcaggctgccattccgggcgcacaaccccgcggcacacagcggggcgcccgcccgggccccgccaccgcagcggcttcgacatccccagggccgcgctaggtctcggcagcgccctgaggggaggacgggccccgccatgccgcgccccaaccgccggccccgctttacctccagaagcccggtgcccgaggccggccgaaagcggagaggggcccgggtccggacaggcgccggcagaacaagaccctcagccccgcgcggctttgcgcgcacaacgaaaccccccaacccaccgcccaccccaccgcccagaggcttctaggacttgtagtccgcccggtcaccccccccaccacaacccgctctgagaggctggggactacggtgcccggcatgcaccgcccaggcgccgcgggcgggggcggggagggggcgccacggtccgaggtcacgccccgacctgaggagagctggcgcccagacccttcccccggggaggagggctcccgcgcgaagccgtctccgaatgcgtccagtcgactcaccgtccccgcagccctggggcagcggccgcaacagcaggaccgaacgcctcggcagctggcagtcgcacttctgtcacaaggaggcgggtagactttggaccagggccgaggccc

SEQ ID NO: 889 - DNA, 35631 bp, Homo sapiens
agtgagtttgtgtaaatccagttagaccaaaatgagcgaggtggagagcctcttaaccggatgctacgggtgatgactgggaggaggagaaaaattacctctttatcttgcatgaacatcttaattttcaggtattgggcgtcaggcaaagataattaaagctatgtccatgagtcttatcccttgaggccttgtccgcttgatattttctttgcctaactcacttttaaaattttattatttttatttttttgagacagtgtcttggtccgtcgcccaggctggtgtgcagtggcgcgatctcggcttactgcaacctccgccccccgggttcaagagattctcctgcctcagcctcccgagtagctgggattacaagcatgtgccaccaagcccggctaatttttgtattttttagtagagacggggtttcaccaggttgaccaggcaggtctcgaactcctgacttaaagtgatccacccacctcagcctcccaaagtgctgggagtacaggtgggagccaccgtgcccagccctaactcacttctgaagttgctgctacttgcactgatttcagtttttttttgtttttgttttttgttttcaaggtggagtcttgctctgtggcccaggctggagtgcagtggtggtgcgatcttggctcactgcaacttccgcctcttgggttcaagtgattctcctgcctcagtttcctgagtagctgggattacaggcaggagccaccatgcccggctaaaatttttttgtatttttggtagagacggggtttcaacatgctggccaggctggtctcgaactgctgacctcaagtgatcttcccgcctcaggctcccaaagtgctgggattacagacatgagccaccacacccggcccacgatttcagtaatttctttgtgttcagtaaaactaaaaaatgactctgggctgggtgcggtggcctgtaattgcagtgatttgggaggccgaggcgggtggatcacctgagctcaggagttcgagaccagcctggccaacatggtgaaacccccgtctctactaaaaatacaaaaattagccgggcgtggtggcaggcgcttgtaatcccagctattcgggaggttaaggcaggagaatcgcttgaacccgggagaagggggttgcagtgagccgagatcacgtcattgcactccagcctgggcgacgagcaaaactcggtctcaaaaaaagaaaaatcattctgtcattctggccgctgtttgaagaatgcgaataatgcaacagggagatcagatacaagactggtaaccgaggtgtcagagttgagactcagtttcgcagattgcattggcaagtgaccaagtgggtggtgccacggttgacaaccctatttcttacatcactgagtggatgtacaaggattaaaccacactggggaagaaaagtgctcaaccctgaggcaccctcacacacctcggctcttgtgaacactagtgttcctgccgaagcacgcctacttaccccgctgagcagagcctgagcctgcaacctccagagacctggggaaagccacatactccgcttcccgcccccggcaagggcgtgtcagctacaaggggcgtgtcatctctaggccccgccccgcgctgcgtgcccacgttgcgccggcctcgcgccagtccgctgggctgcagggactgcggcgcctgagggagtcgctgacgggcacgctgactggaggctggcggacaggcgacagcgacctgcggcaggtgagctgtccgcgccctcccggggccttccttccgcccggcttctcggaccgcgctgcgtccttcgcgggccctgcctcggtccaggccttcggacctgggcttggccgggccacagccctttgggtcccctgcgccggtctgaggggagacccggccgggggcggccggaagctgggtgaggccgggcagaaggacgaagaagggcgtggaggggctgtcaggggagggcgaaaccgcggacgccgctctccagaagtcgtctccccgggggcgcggggaggcctgaatggctctctttggcgtccccgttgggcccaccctctcccagcgtcacggctatgctgggcgaggtgacccccggggtcgtagctgggggcgtcggcggtgcagacaggggatgccggcagagattggagcccggcttggctgtttcccgggctgttggcattgaccggggctctgcccttcctctaatgcccttatctctataggaagtgccccttgagtgggtgtcgtgacttcacgagtgaaccctggtacgccctggagcagagtcggactgggagggatcaagtgtgggggcagccggttagtccggacgcgggtttacctattactttctgagcgcagtgctctgggtggattaattgccctgcaaaagctgccgggacctccttgcagtctttgcacgaggcctgcctgtgtcatgccatttaaatcgcgtctgggccgggtcggtggctcacgcctgtaattccagcactttgggaggccagggcgggcggattgcttgaggtcaggagtccgagaccagcctggccaacatagtgaaaccccgtctctactaaaaatacaaaaatcagccgggcatggtaacgtgagcctgtagctccagctacttaggaggctgaggcaggagaatcgcttgaacccgggaggcagaggttgcagtgagccgagatcacgccattgcactccagcctgggcgacagagcaagactccatctaaaaaaaaaaaaaaaaaaaaaaaaaatcgcttctgatgagccggttgtcgtggcctgtggctgtccatccttacgtactgtgttttgttgatggcgctacaaaccagacaaggtggagtgtgattgaagaaagaaacgctggccggtgcagtggctcactcctgtaatcccagcactttgggaggccgaggcaggcggatcacctgaggtcaggagttcgagatcagcctggccaacatggtgaaaccccgtctctactaaaaatacaaaaaagttaaacgggcggggtggcgcgtgtctgtaatcccagctactggggagtttgaggttggaggatcacttgagcccacgaagtggagattgcagtgagctgagatcgcatcactgcactccagcctgggtgacagagtgagaccctgtctcaaaaaagaaaaaaataaattatcacaagacaaaatttgtgcttatcaggagttcacagttaagacatatataagcttacttggtgaaattagaaaaagttatcagataaaacattcaggtttaaacactggtgagggtgtgggaatttgtggagccttggaaacacactcattgaatgacctcatctacctggggatgtgaagagggaaatcctgtgattcctccattgtctgacttgatttccttttttccttggctgtggcaacatgttgaagtgctgtgagtcaccaaaagggggaacgtgagcaactctagaaatgccagtgccagtgagttacagacaataaagcattgaccgcctttagctcacccctcatcaagtctgttgaaaacttgtaaaattggacagctagagctaccttgattttttggtttccttttaacagctgactctcttcacaggacagttgggctctacatcaggattgcacccaaaactggaatatcactcctccaggaggaagatatatttgaaaattagaattgtgggcccggtgcagtggctcatgcttgtgatcccagcactttgggaggccgagatgggcggatcacctgaggtcgggagatagagaccagcctgaccaacatggaaaaaccccatctctactaagaaaaaaataataataatacaaaaattagctgggcatggtggtgtgtgcctgtaatccgagctacttgggaggccgaggcaggagaatcacttgaacctgggaggcagaggttgcgatgagccaagattgtgccactgcattccagcctgggcaacaggagcaaaactgcatctcaaaaaaaaaaaaaagaaagaaagaaaattagaattgtgtatttcactgtaaaatttgaaattcagctttaactccttggaaaggaaagagatgaaaaacttgacctagactgggtgcggtggctcacgcctgtaatcccagcactttgggagaccaaggcgggtggatcacctgaggtcaggagttcgagaccagcctggctaacattgtgaaaccccgtctctactaaaaatacaaaaattagccttgcaaaaagtagcctgtaatcccagctactcgggaggctgagcaaggagaattgcttgaacctgggaggcagaggtttcagtgagccaagatcatgccattgcactccagcctgggcgacaagagcaaaacttcatctcaaagaaaaaaaaattctatcagagtgaacaataagtaggatgctagcacatacctgtaatctcagctacttgggaggctgaggcaggaagttaatacttgatgagcctaagtttttggtgtctttggatgctgcttgtcgatctaaggggtttccaaacgcttcttttttggtaaaattgggattatgactaggaatctgttttttggagtttcccaggtgatccttgtttggggtccttgtctaaggcacaggctggaaagaggagggagtggactggcagggaagatagagcagtaagcgaatagaatacctggggaaagggacgccagaagagtgattgttgtctggtgaactgtgctgtcagtgtgtatgtcagaagccaacaaagtggatattctcttcactcagcttagggaaaaaattaatttttgtttcacagatagattcgtttccttcccaggagtattataggcctaattactgtcatagttctcagtaactttaaaaaggctgtggggaagaatggcataacagactagtatcttgtacccagcctgcctttttcttattctattttttttttttttttttttttttttttttttgagacagtcttgctctgtcacccaggctggagtgtggtggcacaatctcagctcactgcaacctccgcctcctgggttcaagcgattctccagcctcagtctcctgagtagctgggattacaggcgtatgccaccatgcctggctaatttttgtatttttagtagagatgaggtttcactatgttggccgggctggtctcctactcctgacctcaggtgatccgtccaccttggcctcccaaagtgctggggttataggcatgagtcgctgcgcccggcttttttattttttattttttatttttttgaaacagagtctggctctttcacccaggctggagtacagtgatctgatctgagctcactgcaatctctgcctctggggttcaagcagttctcctgcctcagccttccaagtaactgggactacaggcatgcaccaccatgcctggctaatttttgtacttttggtagagatggggtttcgccatgttggccacgctggtctccagctcctgacctcaagcgaaccaccctccttggcctcccaaagtgctagtattacaggcgtgagccacagcacccggccttttttttttttttttccttagagtcttgctctgtcaccagggctggagtgcagtggcgccgtctcggctcactgcaacctctgcctcctgggttcaagtgattctccttcctcagcctccctagtagctgggattacaggtgtgtgccaccacacccagttaatttttgtatttttagtagagacggggtttcaccatgctggccaggctggtctcaaactcctgacctcaagtggtccacccactttggcctcccaattagaattagaggtggagcgaccgtgcccggctaagggcctactattttttttttttttttttgagacagagtttcactcttgtcacccaggctggagtgcagtggtgtgaccttggttcactgcaacttccacctcccaggtttaagcgattctcctgcctcagcctctggagaagctgggattataggcgtctgccaccacgcctggctaattttttgtatttttagtagagacggggtttcaccatgttagtcaggctggtctcaaacttctgatgtcaggtgatccacctacctcggcctcccaaagcattgggattacaggcgtgagccaccgcgcccggccaggcctcgtatttttgcttttgctcatgttttcatgtctgagatagagggcctactattaaagcactgtgctgaggctgcaagaaggtactagtgtgattaaaacaatctggtccgggcgcggtggctcgcacctgtaatcccagcactttgggaggcggaggcgggcggatcacgaggtcaggagatcgagaccatgctggctaacacggtgaaaccccgtctctactaaaaaatacaaaaaaaattagccgggcatggtggcgggcgcctgtagtcccggctactcgggaggctgaggcaggagaatggcgggaacccgggaggcggagcttgcagtaagcagagatcgcgccactgcgctccagcctgggagacagagcgagactccgtctcaaaaaaaaaaaaaaaaagaaaaaaataaaacaatctggcattataatgccatcctgattttagttaatctagttgactggctggcctcataagtagctgtgatgatcataatttttatgcgaaacacctgtcattgagcatacaggtgtactgaaagaattgggtggaacagggtatttgaaatcagaattgttctggaaagtcgggtacataaagctctatctttagcacagttgtctgtattgcacaattaatatttatagaatggtacaccttatgttatctttttatttttccacctaactctctctctagattgaaaggtacttgacgtgcagagcaagatcttatctttctttgtagtcacagtactcaagagggtgataaatgtttgttgatgataatgtaatgtcacctgtccaagtgtagccatcatcttcagtagttacttgatctgctgttgtgtctggcaagactgctatgtgctgctgcagaggagccattgtcaccttgaactatctctgtggcagtctggaggagggcaggagggagaagggaaggaataaatgagcaaagctgagtgtggatagtagtgtttgacggcagatgaaaaagcaaacttggtgaagtgtggcctgggtggtcatctaacttctacctagaagacattaaacctttactctcttctttttatgtaggaaggcagagggaaagtcaggccttcggttggcttggtaatagcaggtatcccagtaattagaaaataacttaaaaaactccattcctctaccatatacttgagaatttgtcaatctcagcaaaattttcaaatgtctgtgttcagtgtcatatttgtcctgctctgtaagactttttgtgtttataaaaaggcaagtggacccagaaggggaaaaatatgctgttctgagaaactagctgctgtaggttatgcttttctgtctttgcttgtggctcttctggttatttgagaaaggcaaaaaaacccaaagtcttttttctactctgttcccacagtcactcaacacaacacttctgataccagatatatgggagttgtttccccatacaccaagcaattctctagtagacacaccggtgcggtgtcctctaagtcagttaaattctgatactctatctggagatagcgtcagatcccaccaattgagggctcagtcccacaaaactgtcccaacttgaggcactagtcacaagtagtaaattgtcacctatacttctgacctactagctataaatcgaaagttctgacaatccctcctcgagtttgattaatctgctagagtgggtcacagaactcaggaaaacactttacttacatttaccaatttactctaaaggatattaagaaggatacagatggctgggcgtgctggttcatgcctgtaatcccagcactttgggaggccaaggagggcagatcacctgaggtcaggagtttgagaccagcctgaccaatgtggtgaaaccccatttctagtaaaaatacaaaaaaattagccgggtgtggtcgtgcatgcctgtagtcccagccactagggaggctgaggcaggaaaatcgcttggaccctgggggcagatgttgcagtgaaatgagatcacgccaccgcactccatccagcctgggcgacagactggaagaaaaaaaaaggatacagatgaatagccagatggaagagatgtatagggtgaggcatgtaggaagaggcatgaagcttctacgccctctctggaactttcgtgtattcagctatcctgaagctaatgcaaaccctggtgtgtgtgtgtgtgtgtgtgtgtgtgtgtgtgtgtgtgtgtgtgtgtgtgtgtgtgtgtgtgtttatggaggcttcattacaaaggcataattgaatacgttattggccactggtgatcaactcaacctttagaccttctcccgtcccctgaggttaagggggtagggctgaaagttcccaccctctaatcacatggttggttccccaggcaatcagcccccatctaggagcccaccaagagttacttacttacaacaaaagatgctcctattacccaggaaattccaagggatttaggaaattacaaaagttttaggagctctgtgtcaggaactgaggttaaagaccaatatcagaatgaaggattctcctagtgcccccatctacaaaggttttaggagctctgtgccaggaacctagggtgcagatcaaatatatctataaatctttttgtttgtttgtgttttgagacagagtcttgctgcgacacccaggctggagtgcaatggcgctatctcggctcactgcaacctccgcttcccggattcaagcgattctcctgcctcagcctcccgagtaggtgggactacaggtgtgcgccactatacctggttaatttttgtatttttagtagagacggggtttcaccatattaaccaggctggtcttgaactcctgacctcaagtgatctgcccacctcagcctcctgaagtgctgggattacaggcatgagccgctgcatccagcctcaaatttatctctgtatcttcttctaaattacagtatcacacccgtgcatatgcccaaaaatttttttttttttttttttgagacggagtcttgctctgtcgcccaggctggagtgcagtggtgcgatctcggctcactgcaggctccgcctcccaggttcacgccattctcctgcctcagcctcccgagtagctgggactacaggctcccgccaccatgcccggctaattttttgtatttttagtagagacggggtttcaccgtgttagccaagatggtctcaatctcctgacctcatgatccacccaccttggcctcccaaagtgctgggattacaggcgtgagccactgcacccggcctcatatgcccaaattttaaaggaggcaccacattcaagtccaaatgcctaaaggtagaaggatcaagaaacagtagtatgaggccatttgagaagtatatatagttatccctcagtatctgtggagattagttccaggacccctcaagggtaccaagatccaggatgctcaagtttcttttcttttcttttttttttttttttttgagacggagtcttgcactgtcacccaggctggagtgcagtggtacgatttcggctcactgcaatctccacctcccgggttcaaatgattctcctgcctcagcctcccgagtagctgggattacaggtgtgcaccaccacgcctggctgatttttgtatttttagtagaggtgaggtttcaccatattggccaggctggtctcgaactcctgacttcaggtgagccgcctgccgcgggctcccaaagtgctggtattacaggcatgagccactgtgcccagcttaagtttcttatataaaatggtgtatagaatttgcatataacctatgcatatcttctgtattctttaaatcatctgtatttataatacccaatacagtgctatgtaaatagttgttatactgtatcgtttaggtaatcatgacaagaaaaaaaatctgtacatgtgtagtacatatgtagccatctgttgttttttttttccctgaagattgattggttgattgagacggcatctcactctgtcaccgaggctggagtgcagtggcgcagtcttggctcactgcaacctccacctcctgggttcaagcgattctcttgccttagcctcccgagtagctgggattacaggtgcctgccacaacccccggctaatttttatatttttagcagattccgggtttcaccatgttggccaggctgatctcgaactcctgaccttaagtgattcacccacctccacgtcccaaagtgctatgattacaggggtgagccaccatgtcaggcctttttctgaatatttttaatctgaggttggttgaatccactgatgcagagcccatggatatggagggctgactgtactgtattgagcttctaaggtatgcagagtattggcactgaggggatgtgcaaatacaacaacaaaccaagcatagtctttgtttactaggagctggtagtaactgtgggaagacacaaaacagtaaaatcactttgtaaggtttatgagagttttgagaggccagggaagttaaagagtggagaaatggagaaaatgggagaacttgtactgaacccattaggacagaggaggaagggaagagaaggaaggaggccaaagaaagaagaaacccttcttagagcactcagggtcttactgaaaactttacccataaaaagagaatgtcactgatagactccttttagaacagggattgatttttttgtttttgtttttgtttttatttttgtttttgtttttgagagaagtctcgctcttgtcccccaggcttgagtgcaatggcttgatctcggctcactgcaacctctgcctcccgggttcaaacaattctcctacctctgcctcccaggtagctgggattaaggcacctgccaccacgcccggctaatttttgcatttttagtagagacaaggtttcaccatgttggccaggctggtctcgaactcctgacctcaggtgatccacccacctcagcctcccaaagtgctgggattacaggcttgagccaccatgcctggccacaggcaacatttttaaaccatacgattgtcctggagagagaatctgaagccttgctctgattctgaaagggatttgcaaccaaaaaaggataaggattgttctgacaagtaccctttcttcccatcttcaaaagtacacatctcttaatttgtgtcttcaaacacaaattgtgttcaaaaaaggaagtatttgagtagattaaagacagaaaccctaggacattcctttgtaaacaaacagccttttaccaaacaccaactgtcaagggacttgcctgagtacttgtccaaaggacagcgtgtccccatgtgtaggcagtggtctaatctggttcctaggagaggactgctgaggccacagcaacttaactggctagtgtgggtgaggcagaagtgtttgaagctcaaggtctgtcaaggacagctgattagagtatgtctgtccctaatacagggttagagctcagtaccaatgctggggatgaggtgagttgaagacacagaaactacatggttttttggaaggtcacgaacttttcaaggaactagtgggcaactggaaatgatatgtgaaagagtagagggagctctggcctagctgccagaaaactctgggcaggtcaggtctgggaacagtggctaatccaggcccagcttcccactgttgatttggacatacaggcctaagataagagaccgtgcccagagccactggtcacttagcacaggtagtgggaaatggtagccagcaaatgtttaattgaatatcttatgtctcctagaccacagctgagcaaactaggccaagctcaaggtcctgaggggaatgaggagctgagctcagtcccttttggccccctttctctttccctcctcattttaagtatggaagctcacttatttcctttttgtattggccatttgtgtagggttttgtttgaaaaagggcttgaggctgggcgtggtggcccacgcctgtaatcccagtactttgggaggccaaagaaagattgcttgagcccaggagttcgagaccaacctgggcaacatagtgagaccctgtctctacaaaaaaatttttaaaattagctagacatggtagtgaatgcctgtagtctcagctgctcgagaggctaagttggaagtatcacctgagcccaggagttgaggctgcagtgagctctgattgacccagtgcacttcagcttgagcaacacagcaagaccctgtctcaaaaaaaaaaaagaagttgggcacagtggctcaggcctgtaatcccagcactttgggaagcctaggtgggcggatcacctgagatcaggagtttgagaccagcctgacctctaaaactacaaaattagccaggcgtagcccagcggctcatacctgtaatcccggcactttgggaggccgaggcgggcggatcacctgaggttgggagtttgagaccagcctgaccaacatggagaaaccccatgtctactaaaaatataaaattgctgggcgcagtggctcacacctgtaatcccagcacgttgggaggccgaggcgggtggatcacaaggtcaggagatcgagaccatcctgtgaatggcgaaaccccgtctccactaaaaatacaaaaaattagctgggcgtggtggctggcgcctgtagtcccagctccttgggaggctgaggtgggagaatggcgtgaacccgggaggcggaggttgcagtgagctgagaacaccagcctgggagacagagcgagactccgtctcaaaaaaaaaaaaaattagccgggcgcggtggcatatgcctgtaatcccagctactcgggaggcagaggcaggagaactgcttgaacccgggaggcggaggttgcggcgaggggagatcacgccattgcatgccagccttggcaacaagagcgaaactctgtctcaaaaaaaaaaaaaaaaaaaaatgtagccgggtgtggttttgcatgcctgtaatcctagctactcaggaggctgaggcaggagaatcacttgaacccgggaggcagaggttgcagtgagctcagaccgtgccattgcactccattgtttcgctgcaacgagagggaaactccatctcaaaaaaaaaaaaaaaaaaaacaggcttgagtatacctctcacagccctggagaatgcctgagctgttggacagttgccttttccattatgtctgcttttttctaaagctattcattcattgttgcctaatcatgtcctcagtcagtagttgatgttctgggctatttgaatttcctctgaataatgattaatggagataatgatgtttgaccagttctgggaactcttgggaattaaaggaattaaactcttggacattaaacttcactttaatgtgtatagttgtgggtgctgccccattggagaagattgtgacaggaagttacacagttttacagcaaactgctgggattttttatttttttttcagtaaattatgataactgtagcattttcctttgcaataatgataacctaaggccttggtgtttcctctaaaatgtacatagatacaggatgtgggtttgttacaaagttgtataactattgcctttttgtggctgaccccttccctagagaacaacatgaagagaccttgctgctgctatgaaacccagactctaaggacaacttgggggacattggatattttttcacagatgtagacatcaaggagtcagtggtttgtgtatgcgttgagtggagaaggctggcaagcatttgctaccatgactgttaaaaatgtgcctgtacatttctttttttttttttttttgagacaggatctcactctgtcacccaggctggagtgcagtggtgtgtttttggctcagtacaacctccaccattgtgggctcaagcaatcctcctgcctaggactcctgagtagctgggatgacaggcatgtgccaccacgcccagctaatttttgtagtttttttgtagagacagggtttttgccttgttgcccaggctggtatacatttctttatataaggagggggcaagtaacacagtgttatgctaccaatcaggctttcagagaccataaaacaaaatctaaaaggtacgctcttagtagtcatatctgtggaatgtaaggaagccagtttaagaccaatgtaatgcagcattttcccttcacacatgaaacagtgagttactcgagcacaaagcatcaaatgcttattccccccacaaggccattcttatctttcaccaagtgtttagtcactaggcagccatcatcctccctccctctctcccttcctcccttactttcttcctttcttccttttgcagtggcacagtcatgggctcaagtgatccgcctcagcctcgcgagtagctgggaccacaagcactcaccaccacatccagctagttttattttatttttaaaaattttttgaaacagagtcctgctgtgtcacataggctggagtgcagtggcacggtcttggctcactgcagccgccacccccagggtcaagtgatactcctacctcagcctcccaggtagctgggactacaggcatgtgccaccatgcttggctaagttttgtattttttgtagagatggggtttcaccatgttgcccaggctggtctggaactcctgtactcaagctatccacctgccttggcctcccaaggcgctgggattacaggtgtgagccattgcgccgagcctcatccagctaattttataatttttggggggaggtagcaacagagatctccatatgttacccaggctggtctgaaactcctggcctcagtgatcctcctgcctcagcctcccaaagtgttgggattacaggcgtgagccaccgcgcccagcccattattcttatatctgagattcacctttaattgccctctgtcatcagcactttgagaatgcctcaattttgagaataccttgtattctggaaatcattcattcagtcaacaaaccctgactggtgtgtaattgggcagtaggaggccaagataaatgacctgtaatctggaaaacaaacatataaacatacacataccataacgagatatgagtgctaggatggatcacaaaaggcttacttaggtagctctgaatataatatcaggcctacaatattatcacttatgttgttttttggatcttatttttagaaacagcacaagctttttcttggaggaaatatagcaaggaagaggggagctgttctgactgaagcagggtatgggaggcccacagcctttcctgctttgcctcctgttcaaagccatcctccctgcagttcactgagaaatgactccttggagctccaaggaagtcctacagctagctagtagcagacctggtagtagaagttagttcttctgattcttagctttcttagcagtcaggtaccagactgataaacgaaaatcaaatttctcccagttatatgttccatcccacaaagaagtaataaacacatttctgtcaggggcttcagcctgcctggatttgttactgggtttgttttaaatgtttagcttccaggcatccaaatacatacaaaaaaggtctattcccaggaacatactgtaacccttttcattgtcatttgtgggcagtgccaagctgcctctaatagcttcttctgtttttttggtggaaattcagtttcctcagaaatctatataagggatatttgataaaggtgactaacaatctcgtctctgtaaattgatgaagggatgagaggggtattagactcatgtcctcttttgaatgcacactgcttttgtggtccggcagggtttctcagcgttagtgctgttgacattttgggctagattgtttgtggtggtggggtatgtgtgtgtgtgtgtgcgtgcgtgcaagcacatttgtgcgctataggacattgagtagtatccctgacctctacccactattgtcagtagcacactcccgtctttcagttgtgacaactaaatatgtctgcaaacatttccacgtctccaaacatgttccttgggggacaagttggcccccagtggagaaacactggattggagattggttgtcatgtgataaaaatgcaaatcagatttgtcacaggacaaagtaaattttcagttacctaattaaacctttactttttataagtcgctctaaagaaacaaaagtgtgtcctgtcttccatcctgattctcggttactggagggcccttcacctaagtcatgttcaggatctccttgaaggagttaaactaaaacaatacaatatcttcccttaggtcttttgcagaatttattttgctaggccgggcactatggcccactcctgtaatcctggcactttgggaggccaaggcggctggatcacttgagttcaggagttcaacactcgcctgggcaacatggtgaaaccccatctctacaaaaaataccaaaaaattagctgggcatggtgttgcatgcctgtagtcccaggtacttggggggctgaggtgggaggatcacttgagctcaggaggtcaaggctgcagtgggccgagattatgccactgcgctccagcctgggtgacaaagtgagactctgtctcaaaaaatatatatattttgctagaaatcccaagatttttctctcttttctttttgtttattttctttctttttttgagatggaatctcactctgtcactcaggctggagtgctgtggcatgatctcggctcactgcaacctccacctcccaggttctgagaagctaggactataggcgcatgccatcacatctggctagtttttgtatttttagtagacgcagggttttaccatatttgccaggctggtctcgagctcctgaccttgtgattcacctgccttggcctcccaaagtactgagattacaggtgtgagccactgtgcctaacccccatatactttcaaacaaaaaatggaaatatcactgtctccatgaaaagccatacaggcagcatcaaaactacactaggggccaggtgtggtgcctcctgactgtaatcccaacaatgggagggtgataggattccttgaggctaggagttcgagaccagcctgggcaatatagtgagaccctatgtctacaaaatactttttaaaattagcatagtggtgcgcacatgtagtcctagctacttggaaggatgaattgggaggatcgcctgatcccaggaggtagagactgcagtgagctaatatctcaccactgcactccagacacagtaaaaccctgtctctaaaaaaaaaaaattaaataaataaataaatggtttacactgagggtcacagactttgagttgaggttcgtcatgaagaatctccattttcattctaatagcactagatacaggctgggtgtggtggctcacagctataatcccagcactttgggaggccgaggtgggcagatcacgaggtcaagagatcgagaccatcctggcgaacatgctgaaaccccatctctactaaaaatacaaaaaattagctggatgtggtggcacgtgcctgtaatccctactactcgggagtctgaggcaggaaaatcccttgaacccaggaggcagagattgcggtgatccaagatcacgccactgcactccagcctggcgacagagtgagactctgtctcaaaaacaaaacaacaacaacaacaaaaaacacaaaaaaggctgggcacagtggctcaccttgtaattccaacactttgggaggccgaggcgggcggatcacttgaggtcagcagtttgagaccagcctgggcaacatgggaataccctggctctactaaaaatacaaaaattaattgggtgtgttggcacatgcctgtagccccagctactcagaaggctgaggcacaggaattgcttgaacccaggagtggggagaaaaaggaaatattaggggacatttgttaagtttatatttttttcttttctcttctttttcctctttttttgagacagagtctcgctctgtggcccaggctggaagctggaattcagtagttcagtcatagctcactgccgcctttacctcctaggctcaagtgatcttcccacctaagcctcctaagtggatgtgaccacaactgcatgccactccctccacccccgtctgcctaccagctaattcaaaaaaatttttttttgtagagatggggtctccctgtgttgcccaggtcagtctcaaactcctaggctcaagcaatcctcctgccttggcttctcaaagtgctgggattacagacatgagccactgggctcagccattaattttaaattgcaagtgacatattctttagtttattaatcagcaccatatgatgtcacagttttataactcatttatctcatttaattctcatacccaccttgtggaattgttatcactgtcctttacagatgaagaaagaaactccaagaaattaagtagctggcccaagtccacccaactgggatgggcagaaccagggtttgctcttggttgtgcctttctacagcctgtgccttaaccacatctatgtgctgcctcttggcctctgtgtggccagtagattctctcatggctaggctcatcttaattaacatttgttgggtgcctactatggctcaggctctagagatcattgtaaaatccagtccactgccccagctcctcgtgtgtcttttgaacacattagtattgtgctgtgcagaaaggacttctgtgcatatgcctgctattacacttgttgaacccaatttctacaaactttcattcagatggagggattcagtcttcttatcatataatacatacagaaatacaaatatttaaatatttatctaaattaatagtcacatatgccatttatacagttagtgagttacagccaagtgacagttgtgatgggaggctgtgtctggggagttacatactggtgaggaaactagaaaacatggctgtcgggccggcactgtggctcacgcctgtaatcccagcactttgggaggccgaggcgggtggatcacgaggtcaggagatcgagaccatcctggctaacacggtgaaaccccgtatctactaaaaatacaaaaaattagcggggcgtggtggtgggcgcctgtagtctcagctactcaggaggctgaggcaggagaatggcatgaacccgggaggtggagcttgcagtgagccgagatagcaccactgcactccagtctgggcgacagagtgagactctgccacaaaaaaaaaaaaaaagaaaacaaggctatgaaaatttaacacattgactgggcagggtaatgcatggtgatctgttttctcttcgctccaatcctgaaaggtttctttgaagagctggagtgtctagaaagctttcctagaaagctagtgtacattttgctaagtaatcactgtgtcacttagattttctgctctttaagtgtggttatgagatgtgttccaaacaatttgttactaaccatgaagttgatgaatgctttgcctttaaaaaaataagtttgggtggggtgcagtggctcatgcttgtattcccagcattttgggaggctgaggcaggcagatcgcttgagtccaggagtttgagaccagcctggacaacatggtgaaaccctgtctttactaaaaatacaaaaattagccaggtgtggtggcgtgtgcctgtagtcccagctgctttgggggctgaagcaggaggatcacttgagcctgggaaatccaggctgcagtgagctatgatcacaccactgcactccagcctgcgtgaaaaagtgagactgtctaaaaaaaaaaagtttggccaggcatggtggttcatacctgtaatcacagcactttgggaggccaaagtgggaggattgttgaggctaggaggtcaagaccagtctcggtttgattgggttaaacattatccctgtaagttggctctcattctgagaagttgtttagagtagaagagagggctgcatttacagctaattgctagtaatttcacatcatctgcaatatattttctggacactctgcccgactagtcctatgggacgttgtcattcatgtgcaaatcaggccctatatactaagggaggaaaacagttgaggacctcctttttttaggcactcttggtgccttgtgcattaagatagtgagtcagaggataagaaggaagcagattccattccccttaccactctttgggtgtaggcagggcctgctggtagtgctgggaaagccgaccatccttctttgagcaagtccaatagctgctgctgctagttctgtcccaccataggcacagtctatgtaggatgagccaaccatatgtggagttactggttcttggtctgggcttgttcctttccccaatttcagtccccaccagaatctgggcagtcattgtgaagaagcctaggaataataccttactctataggcctgtggaaacgtgtaaagataccttgcaggcccagagtgagaaattggagccaccttgttcgattgaccaaaggcttgtcctatggagttactaattttacaggaagtttatgttaacatactttctatccattgcactaccatttctgaggcacaatatatttcagtaggcagaaagatagaactgcttagattttaaatactcaatacatgcttgacacagtttagtctatttctcttcagttactatggcagtgggtgctatagagatgtgcagaccctattgtgacctccctttggtatagggatgctctggagcccctggcttcattgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggtgagtgttttagggacaagcagcatcaacttcggaatcttcaactgggcctgagcacttatttctcagaaataatagaatcttgctcacttttctttctttttttttttttttttagatggagtctcgctctgttgcccaggctggagtgcagtggatcagtctagctcattgcagcctccacctcctgggttcaagagattctcctgcctcagcctcctgtgtagctgggattacaggtgtgcgccaccacgcctggctaataattctatttttagtagagttggggtctcaccatgttggccaggctgctctcgaactcctgacctcaagtgatctgcccgcctcggcctcccaaagagctgggattataggtgtgagtcaccatgcctggcctcttgctcacttttcatactaaaacaacaaattacaggctgtagtttaacctctctactgcatgcataaatgcagtgtggtacgagtgcctctgtagcccataacttcagtttccttgttgctagcagtctgtggtgacactatactaatctcacatgcaggaaccaatgaggattagccagggacacaggaggagtcaccttgcattcagaatgactcaagtttagtctcaacttgaccattagctctctgagtgatcttgcccatgttaattctcttgatcttagtttcttcagagccagtgagacattgcttgaaagtgacttagcctggtatacccaggtctgtcagacttatagtctggtgctctcttgggtgaacttgagggccttctgccaaggcaggaatggcttcttttaaaaaaaaattattttattattatttttttttttgtagagacggggggtctcactatgtttcctaggctggtctcaaactcctggactcaagtgatccttcagcctcggcctcccaaagtacagagattataggtgtgagctaccagtaccagcctccaggaatggcttctaaggcttcaggctgtttatagagaggaaagcacctgggagctgatggcactctcaggtttcccaaaatgacagttctgcatatgcatcttaatcacctactttttttccctccacccccaaatgctattcacagtccttgtttatgatagaagctgaagcttacaggtgacaatttttgtgcctgtatgaaaggaaacatgactgactccacttatccacacgacacctgctttcaaggttgttcagtgttggaataatttttgcttgatggtaacctagggatgacccaaggtttcattagttaaagccagccctgtgggatgcatgaagtctagcctctgtccctgtaaaaatcccaccagaaccattttagaattcactcaggacttcacccctcccgctcctggtgctgcttatggaactaaagaatcctcatcttctcagccctgggacacattgtcctcatataaagcgaggtggcaatcagggaacaggggcgagtcttgtgcttatttcagttataataggaaggctctaccaggactcatcattgtcccaacaatagtcgattccaggccccttctttgaactcatttcagtgtctcaggttctgtccttggtgtctgtcttcactgcttgctcagttgtatttgaacatggctagagatgagcacacttctcttctccagtaaaaaagcctgcaagaaaagtcttggacttcttgaactgctattcagttgtcttttttattcaatgtattttttgagatggagggggtctcactttgttgcccaggatggtgttgaactcctggccacaagtgatccttctgcctcagagttccaaagtgcagagattacaggcttgagctaccacaaccggtctcttgtcagtttttgaggttacttaagaggttaatgcctttaaattagtttgcagttgttttgcttttgcctgccttcttgcccaaatgcgcaagtgcttatttagtaatctgactcaagtgctttgtgtccccagagtccccacttttccaggattcattgtctttttttttttttttttttttttgagacacagtcttgctctgttgtgcaggctggagcgcagtggcactgtcggctcactgcaacctccacctcctaggttccagaaattctcgtgcctcagcctcccaagtatttgggattagagtcacacaccaccacacctggctaatttttttatatttttagtagagatggggttttgccatgttggccaggctggtcttgaatgcctgacctcaggtgatctacccgctcggcctcccaaagtgctgggattacagacatgagccaccacacccggctggattcagtcttaacttgctctttttttttttttgcatctcactcccttgccaggctggagtgcaacggtgtgatcatagttcactgcatccttgaactcctggggtcaaaagatcctcttgccccagtttcccgagtggttgggactacaggtgtgtgtcaccacgcctggctaattattttatttttcgtagagacaaggtctgactgtgttgcccaggctagtcttgagctcctaggcttaggtgatcctcccaccttggcctcccaaagtgtcaggattataggtgtgagccactgcacccagcctggatttgctcttttatcaagaggttaatatttattcttccgttcagtgaaccgtgggattgaattcccccagcgattgaaatgaaagggcttatgtataacatttcctgaggaatggtagtaccagagttcagaggagacctcaggccatttattctataaactcagaagctgtagttctagatgatgtggcttcttcagggtgttgagaagtctctgttatctcgtgccttgttggattagaactgattgagctctgtctgctgccccaaacatgtggctcagccaatctccagtggcatctgcaatgtgggtattctagcctccagtgctcacgtggctcaccttagaaagggcagatattcctatttcctgacgctgctggagaatgaggtctgagtcagaagtcctcaggtgtgacctgcccagaactatctgaaattgctggatttcttgttcttcctcagtgtttaacaatcacccaattgctcattctcaccagcgacttcctcagtaagagctcaatatttgaggtggtgctgcattttgtcaaacattcatgcgtgttagcccacttagtcttcgcagcacacagtggattaatggatttttaaaagctggtatttatgcacgatggaatactactcaaccataaacaagaaggaaattctgtcatttgtgactacatggatgcatctagaggacattatgctaagtgaagtaagccaaagaaagaaagacaaatggtgcatgatatcacttatatgtgaaatctgaaaaagtcagttatagaaggagagtgtaacatgttggttaccagcggctgggggaagggaagggtgggtgtggaaaggggagatgttgatcaaagggtacaaaatttcagttaggagaaataaggtctgatgatctgccttacagcatggtgactatagttaatatggttaatattataatagtattgtatacttcaaaattggtaaaagagtggattttaaaagttgtcaccacaaagaaatgataagcatgtgagctgatggatatgttaataaccctgatttaattattccccaatgtatacatgtgtccaaacatcacactgtaccccataaatataattgtcagttaaaaacttaggagtcaagtcagatctgaagagaagtcaaaacagatttcatacagttaatttagagacatgggacccaattaaaaatttgtattactttacttggtattttagaatttagctgttattttcttgttacacacacaggcacaggcacacaaatcctctatttaactggctttctcagtaggaactccatctgtgtatttgcaacagctgtaactcaggttggatgctccccagggtgctggcctataagtcatattggaccctgatctgaatctgagggaatctggatctctcttgtaggaagcttttggtttaactgggaagacaggatgacagtcagttgtggaagctgaagcgtaatcacctcatattaatatggtggcaattttatatcggagtgagctctgagctgcaaacagccttctaggaagcaggcaggggacccccatccagggtgatggtaagaatcctgatgcccaactgcaaggtgttcagcagggagggagcactcgtggagtcccagtgcagaagtctctgagcagccacttagcctccctgtgtttgtggggtaacaacccgagttcatgttgtgggcatctcatgcagtgtagtagctggtcactgtcaagtgtcactatttcattgagtcagaagcctgcagaattgttctcattccagggagtgagtcagtctgctgttgcttactctcggtgctggctgagctcagcaacctgctctcttccttcagttcaggtttctccagggcaaagaagtctttattgttcctttctgtatgaccagatgggaaatgaattataatatagtccttagattatattcccacctggtagcaatgcactgagttacctgacctgaaatttgttggacttagtctccatggaggaggatttaccatcttcgttgtctcagaagtcctggtagtgcctcatgccagcaatttagcaggagcaaaagctttgagacagtgttctggatctgctgagctggtctaaaggaacctcttttgcttgaagtaactgtgataggaactttgttactgcttctgttagctcaggtgttggaatgagaatcagcagctgatgaggtgaacagctaggagtactggaattatggagtagtggaggtagattttataaacagagggtcccagttttttggaaatgggaaagagagagggtagactggcctttctagaatttgtaacagaaaagaggacccaggagcttccattgactagttagttaatgcagtgcgggatcttagctggtttgcttggtccaattcctgtctctcggtttcttttttcccttcccttcgctgccttcccctccctcttccctttttctttccaagagaattgagtcactccatataaaagaagcagccagttggctaaaaagtccaacaaaaaacaagtatttatagctctccaaatttcccacttgtcattatcagtatacttttgcacacagttatagtcggtgtttgggatcctttttaaaaaaataaaaagtttctgtaggcttttccatgcatgaacacagcttatcaacttgccccggctgtgccaggattccattgttgactgttgtttgagcagtcatgccctttgttcttaggctgtgtgttgtttttttcctaacatcatagtatggctgggtattattttgatacagattacaattactattactatttcttgaagtgtatttcccagagtggaatattttaggatctttttttctcttttgtgggggtggggaacatgtagcttcttgtggatattagacattgaagtctaaaaaggttctatatttatgatttggccctcaattttctagagattccaatggttcctgcaaagaaaagagcattcaagtatagaaaccagccagactaagtctggacatgtagcttttcagaaagtgaaaaaaaattatgtttctgcagttgcaaggtggcctctgaatgccacactgtgtggccactcccttggacagtggctaggccacagggtcgcctcccctggccccagtctgtgggttgaatatgctaaccgagccttcccaggagcctcctctgcccccagcccccaggtctgtacagatggtagttggtactttcagcccgccttgagaactcagtattcttcctgttagctttccttcaaagtaaaatcggtagaacctattttgagtgtagaaaatttgaagtcgtggacagcagattacaaaaaattgcccaccaccatgcctggctcatttttgtatttctagtagagatgggctttcaccatgttggccaggctggtctcgaactgctgacctcaggtgatctgcccacctcggcctccctaaatgctgggattataggtgcgaaccactgtgcctggctcctttttgtatttttcggagaagcacaaggacttgttgtttaattaagcaagactatactctcccagagcatgcagttattattgagtaaaacacagttaatgagatttaatcacgttccctatcactgttgtgcagcatgataagtaggtgcaaatggcaagaagcacgctgaagttactgcagttggtaacctgggccatggatggcacttgtctttgcctcattttgcctgtaagaagcatggggcctgtggtcctggggtacctggaccctcagcctggtgtgtgtgtgccctcagcctggtcctttacttccatcacccatctagaggctccaggaccctttactgcacccctccctcctctagatagctcagtgttttcatcccagcacctttttctctgctgcctgagaactgagcagccagagacaaattttggctctcagggtcctcaagggtgtacagcaaagctgttcttattatttaaagtattttatttatttatttttgagacagagtcttactttgtcggccaggctggagtgcagtggcatgatctcgactcactgcaacctctgtctcccaggctcaagaaatcctcctacatcagcctcccaagtagctgggattacaggctggagtgcagtggctccatctcggctcactgcaacctccgcctcccaggttcaagcgattctcctgcctcagcctcctgagtagctgggattacaggtgtgtgccaccatgcctggctaatttttgtatttttagtagagacagggttttaccatgttggccaggccggtctcggactcctgacctcctgatctgcccacctcggcctcccaaagtgttgggattacaggcgtgagccaccgcgcccggctagcaaagctgtacttttaccaaaaaaaaaaaagaaaacatttataaatcaaggtctgaaggcccatgtgaggcttattctacagcttgcaatgcctgtttttgccccttggtaagtggacgcacagctgggcagccttatgctatctctgtgaactacccatttctggctttgttcataatattcccttgatctggaggccctcccccagccctgccccaaatcctgtctgtgttgagggtcctgccccaggaagccctctgcatactcttccctgcatgtaatacctgcctgctttcacattcttctagactgtgctgtgcatcgtacagttcatcagcattattgcagagtagagtgtctctgatttggagtcaagagaaggttccatttttctgtacatcccgatgtttattttctgagtgttctcagacatcactaagcctcagtcaaaataaagtatgatcatgatgtaacattcattgagtgcttatcacatggtaggcattgtgctatatgagttattgcttgacttcctaaaataatcccagtagagatgctaaatctaaaggtgagagagatggttcaaaaagacctcagtgagcaaaccatgtactataatatcctaaaagataacaaaaatgtaactaggtatctagagaaaactcaggaaggatatgtgccttgggccttttaaggaccatttcttaacacttctgtgttcttcttgacacctgtttctgggtagagcacatagaaaatgctcagtaaataagttctttttccttggcccagtttggcctgatttggccccagttctgtctttgtgagttactttattagttgtcggtgctactgtgctgctattcatgtggaagattccccaaatgggctgcgccttacattgcctgagcagaagccccgagggatggaggatgagcttgccttgttatgggactgtgtttccctggctgacaaaggctcagcatttgcagcaggcaatgggaattgattggccaacttaatatttccttcagcctagcaaagtcctgagtaggctagggacagtctgcttttttggtaactcctgtaggctgccttctgcacaaggcacccagcctctcacaggtaggatgaactggcctcagcacgcttgcagaggggtggaactgtgcgttgcttgccaagctttttgtttccctaaggtttttgaggttttctttgtttttggtaactttcaattttttttttttttttttttttttggacagagtttcactcttattgcccaggctggagtgcagtggcgcgatcttggctcactgcaacttctgcttcgtaggttcaagtgattctcctgcctcagcctcctgagtagctgggattacaggcacgcgccaccacatccggctaattttgcatttttagtagaaacagggtttctccatgttggtcaggctggtcttaaactcctaacctcaggtgatccacccaccttggcctcccaaagtggtgggattacaggcatgagccaccgtgtctggcctaacttttaattttgatacggtcttttttttttttttttttttttttttaagacagtttcgctcttgttgcccaggctggagtgcaacggcgtgatctcggctcactgcaacctctgcctcctgggctcaagagattctcctgcctgagcctcccgagtagctgggattacaagtgtgcaccaccatgcccggctattttttgtatttttagtagagacagggtttcaccatgttaaccaggctagtctcaaactccagtctgcctcggcctcccaaagtgctgggattacaggcatgagccactgtgccctgccttgatacagttttaagcatacagaaaaatggtaagaatagtacaaagaactctcatacctcttccccagattcactgctaggattttgccttgtttgcttttctgacttgccagtgtcccccaccctgcagcatatgcacatgcacacacactgtcttctgaaccatctgacagggagttgcaggcagtgtacctttacttctgaataccccagtgtgtatttcttaggaacaaagacattctcttatataatcgcagtacaattatttttaaaaaccagcaagcttaatgtcaatacaatgctattacctaatacattgttcatattcagattttttccatattccactatggtcccagtaatggcagagctttattttaaagaaaacaatcctggggtgtgtgggtgtcaccttggttacattcgctctgaggaaagcagaaccgacaggtatttggggaagtgactgccgtgggtgccacatcaccagctccttgtgtctctgcaggaccagaggagcgagagcagcaagaaccacacccagcagcaatgtcagcggaagtggaaacctcagagggggtagacgagtcagaaaaaaagaactctggggccctagaaaaggagaaccaaatgaggtgagcgatgggggctggctgcactgaatcaggtgggcccagcacctgtcgtgctcagcacacctggttttgtctgttggcagcactggggagtggccatgggccatgagctctggacccctgggtgcctgcttggccctgcagggaccgcatacagcttcggctgcttagaactctccccactggtccattgtctcatccaaggaggcagggcaggtgctcctgggagtgctgataggatttgatggtagttatccttttttctttttaaaaacttgtgcgtttcctcatctgggctgagaaagggtaaacgcaggcaaagctggctctgttcagtcttttaccacataaaagactgcagggcagcctttccttactctgtatagggacagctcatgctaaacctgagcttccaggccctgttctgcatcattagcctctcatagccctgtcattggccaagttttttttttatcccttgaaataattgctaataataaattgattctcagcacatggatgataacgagctaatctcctaaagaagacagcagaagccagaccatgataaggccaaatttttctcactcttgtagatggattgtgtggacacatgtaagcccctgcccaagtaccaccatctttaggatcacatgttttctaccttgtccatccatccacacacctttacaactgtgtaatttcgttaagcagcacaaacccagcgtcctggccctagcctctcggttgtctcctttgcatccttccgtgcttggtcctagtcacatatagtctcaaagaagctgtgggtccaaggtgggaggaaggcagtagggccatctgaggagacccatggtcacagccttactgaggtgtgtgaattccagaagacacgttccaaggcaggctgttcttagagaagccagcaaatactgaagggaatacagatgtgtgtctcttcgaccactaggtggccacagaagcaaagcattgctcatttgggtggttcccaacacagacacatggacgtgggtactactctcaaggagcaggccacagttatcccttgtgtcctgagtccttggagcagaatgtcatgtctgcttgtcctgtgttccctgacaagttgctgctatttgtgttggagtgaagtgtctgagaagccccagcctccagtacaacaggtggtcaccttggggtgtggactcaatcttctctctatggtcctttctggaaagctgggaagggctaattgacacacaaacacctcccatctctccacagaatggctgacctctcggagctcctgaaggaagggaccaaggaagcacacgaccgggcagaaaacacccagtttgtcaaggacttcttgaaaggcaacattaagaaggagctgtttaaggtttgtgccccgcattgggttccagactgtcatatggggttggggtgggggccttggtcccatgagaaaagtgcccctggagccactctgagggaaaagctgggcttttctccacactccattccttcttgacgttaagctctggctctcggctgggtacagtggctcatgtctgtaatcccagcactttgggaggccgaggcaggtggatcacttgaggccaggagtttgagaccagcctggccaacatggtgaaaccctgtctctactaagaatacaaaaattagccgggtgtggtggcgcgtgcctgtactcccagctacttgggaggctgaggtgggagagtcacttgaacctgggaggcggaggttacagtgagccgagatcgtcccactgtactccagcctgggtgacagagcgagactctttaccccgccaaaaaaaaaaaaaattggttctcatggcttagatagaataacatagtggtgtgaaggaagcaaaagtatgcgtgttccaaagacttcaccatgccattcctttaagaaacaaaagcttccttgtgtgttaaataattcactacataaaaatggaccataggattgggtctttggggttgggggttgtcacttgagcctctgcatccagctgctcggatgtggtgtgctcaggcatagctggcctcctcctgtcacctccacagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcaggtactattgggggctgccagctgctagggctgaagagggaaactttgacagtggtagcagatccatagtggcccatgaaggcacacatggcattaggacagatgagctgcagggtgccgagaggaaggtggccaccagattggccaccagagcttgtgggcccagtgggtggttcccagcatggaggcctggtgtgatagatgccagtgggtagtgttttgggaagggtgagtcctctcgcacatagaggggtctggaagaatggagctggcttcctccctcattgcaggatgctggtcttgaagaatggttaattttcttttcaagttttgctctgagaagccctgctttataagttaatagagagccagtgccaccaaggagagtaaataagctctgtttacaagtagcctttagatgaggctgaacctggggaagcttactctgtccccaggtcctgtcagcttccactgaggcctcccagggcactcaggatgagtatgccctgccacagtctcattctcccatgttccaggttttctgttgcttcttgataaaaaaataaccagcacctagaaatggggatgtactcatgccctcctgtctgtgctgtggtagtttcagtggcttgagccacctcagagaaggctacatctctggtcagttcccaggggagacccagcatttggcagccttcttggggtaccaatatccacacctccccagagctcttgctagggagggaagaccatcaggcagtgcagctgccgcccaccagtgctgcttgctgtgtagttggcacacctgagcaagctcacctgctccagctcactctctctggagggcgtcctctaaaaggagagtgtagccaggcgcagtagctcatgcctgtaatcccagcactttgggaggctgaggcaggggcattacttgaccccaggagttgaagaccagcctgggcaaccaaggtgagacaccatctccccacaaaatttaaaaattagccaggtatggtggtacacacacgtaggaggataaggtgggaggaccacttgagcctaggagtttgaggctgcagtgagttagccatgttcataacactgcactctagcctgggcaacagagacctcatctcaaaagacatttaaaaaaaaaaaaaaagtatgggcagcccaaagatggctcagtcgatcctctgctcctgcagatattcaatgaactggaccaggccggctccacactggccagagagaccttggaggatgggttccctgtacacgatgggaaaggagacatgcgtaaatgccctttctacgctgctgaacaagacaaaggtaggtctgtgtgtcctgagctcccctcctggggcaggtgtagcaggagactccactgatgccatgtctcctattggtgctgccacacaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagcta

SEQ ID NO: 890 - DNA, 28141 bp, Homo sapiens; identical to SEQ ID NO: 888

SEQ ID NO: 891 - DNA, 28141 bp, Homo sapiens; identical to SEQ ID NO: 888

SEQ ID NO: 892 - DNA, 27796 bp, Homo sapiens
tttaaacaattcattctctaaaagagaaacatgaacttaaataattttattaataggaatctactacctgtaaaagttttatttcaaaaagggttaaaaagtagggaaactctttaaactactgaccaagactgccaccttcataattcagatgagttagtgcagagatggccagggccagaggtcgcccagaacctgcgtgtgcagactgcgctctgttagtcttctgcctgtcagcctcagcccagtctgtgttgcttaagggtgcgcctccccagggctggatgatgctgtgctcaagcctgcgggtaggagggctccagcttgcagatcccatgcgtggatgccatatatagatggttgaaaccagcatcagaggaaggaaggtgaccttacagccactgccgagaccaacgtgtgccctggcccagtcacagctggaaatcccagggctggtctacacccgactctggtttggtttaattaggtccttacgtgttggtgttgtcccaggcagttggcatggcatcagcactgagggtgtgagaccctgaggactcagcctcccgtcctgccagtagactgcctgcagccccaccctctttccctcaaaaaagaaggaagccaggcaagagagcagaggcccagggcgggggagtgaaagggccaatttaatgagaaactacaaactgagactgggccacgattcacagtgacaggaggccatgcagtggcagtgcgagaccaggaaggacagtggcaggatacagtggtccaggtgagcaagttcacaaaccattcaggaaataaagacagggcgaggctggtgtccaccaaggcagttctaccacttgtggctgctccttcctcgtccctagcccagtgtgcctgcaggagcaggtgtgagcaggcacagcaacagcctgtcagctggggtgaggggcccggcacttacagggaagaaaatccatggagaaggctctgcacatccaagcgcacccacaagggggaccctctgccatctcttgcccagttgggatacaccagccaccaggcagaggtcatacccacacgcagtgaggacacagggcagacgggaaggggctaggctcaggggctccttccggccccagcaatacagggttcacagaggcatggcctgaaagggggtctgcacactgactcaaagggacaagttccttcttagctaccagggtctgatcattcacccaggtacagtgtcctctctacctgacaccaggcagctctcgggcactgggacagggtattagacatcctgggcttctatacctgagagttctgagggccagagttggcagttttacttccagccaccatgccccacctctagcaccccagaggcgcaaagtacccagaaacaaacccaggctttgtgaccctgtcctacgtgggcccacctgactccagacaacttacccattctcggcccagcaggtcagaaacgcctgtggccacaggcctggggactaactggctaactgctctggctgctgttggtcccagggggaaagagtctggactgaacctgtaccttgtttggaaacagaggcatcaggaccccagcaggagacccctcccagcttatcttcccgatcacacacaccaagcagaccaacaacacacaagctcattgtcagccccctgccacccactgacccttggccttaaatcccaacagaatttttgccagaagagtcagcggctcaggtagggcagggtgaagaggacaggacttctaggggatggtggcacggctcccagccccaagtgggagcgggaaagtgaccactgagcacagggagcaaagcacagggggccagactgacaggcgggggagtcccgagtcccagctccgttagcacaggcgcttgtacgtgtagatgtaggctttgcagctggggcatgtgtgcgtcacatccttgaagtcattgatgaggcaggggatcaggcagcagcccagatcacatctgaatcagagacagggaagaacaggctgaggcctgctgcggaggaggcagaggcagccagttgaccctggtgcagcccccaccctaccagtgcccacaccacctaccccatgaagcaacagaagaaacccagcacgaaattcatcaagccaatctcgtaggagatcttggtggtgatggcctgctggcagtggggacacaccgtctgcacaggcgctccctcaaagatctctccctgcagcactgtcaccgtggtggcagctcctgaagggaccaggactgtggctgtgtggcccccagggccagggtagggccctggcgtgtagggccctggggggtagtagcccatgggtgggtgggggcctggaggagggtagaaacctggaatggcacagaagatggaggcgagaggtcactggcctgccacctgcaccagacaaagagattggcgcaaagccccacggtccacagcgcccagcgtgcaaggctacgcctcagacctcctaccgccctcctaacgggccagtgggaggccttacagctggggccctaagtcaagtggggccacattctcccagcccttcctggtccccaccccttggggcccatgacagatgtggcagagagccaggcacatggcccggtccctctgctcctctgtctgtctccagcatgcaaggacagggcactcagcctcaagcccatgaccaagagagggaaagccttgcgggtcacccacccctctcctgcacacaaggcgcccctccccacccatgtcaggtcctggtgtgccaaggaccagcccttcctgaccagcctgaataagagcagtcccaccttcccacgtccacagtccctgtccacacacagcctgagccctaggcaagggctggttgggcgtgttggagtccctgccctacagcagatgcccacctgtactgaggacagccagcgcaggccagacagcagccaggagttccccatgctcccctcagatcccttccccactcacccggaggcatgtaggtgccatctgcactcatgtgtggtgggatgaagccaggctggggcattgggtgacccggcggctcatagggtggggggccaatgtccgcagggggcagtggcatgcctggagggggctgcatcacagctggggaggaacggcctggacagagagaggcagaaagaggagactgagctggagcctctgcacgatgagctcgaccagaggccactgttttgggacacagatggggcccaggggtaaccctggagtgggcatcaccacttagagagtcccaaccatgccatggcggcagggggctgcaatatggagcctcaggaacagtgaccccctacctggggtgggcggggctccacttttctcttccagaagtggggctgtggggcccccaggataaggagggggaggctcgctggacatcttcgctgcttctcctggacatggagggaaaacccagacatgaactaagctcccagccaggttccttctccttcagccctgtggggtggccaagatgctgcacaaggcgtgtgaccatcctcagaagggtctgcctccaggcactggggatcccccacctttcccagggccacctagcccagagccaccatcctcacctctcagtagtcacctgctcttccctgtttggaagctgaagggcaaggacagaacccaggaagcagggcccagtgaggtaaagtcccccaaggagcctaactcagcacttgccccacacgagagcagtttggcaccgagctctcccctccccaaacgtttagcgggcactaaggcagtcggaggagacactggaccgatctctgccacaggctgcactgggaatgggggttctgggggatttcttacctcaaatccgtgctactcagagaagggaggcaggtgaggctccttcagctgctggcctggatggacagggaacaggcagggctccgggagctgtttcaggggaaggaaaggcagggccctcagcagggagcaagggctgccaagccagggctgggcccaggggcctgggcataccacacagttcctccccttccacatccggcttctccctagctgtcactctgccatccacacacccgaccacccctccattcctcggtcccgtcgcaggtctgcttcctccctcccccaggactgctggcacccaagggccacggctgggccctctgcctcccctcccaccaggcctgagctcccatgcatgaggactggactgccaggcaagctgtgctctggcctgtgcccttctggtttgtttgttgaggtgggggtcagggggaagaagagtcaagtgaaatcttttccctcatttctgtcaccaaactctctgagcacagctcagaaaggtgggaagcttttgctcttacttagcatcataaaggacttgggaagtggggttcagttaccttagctaaaagtaataaaatgagacaaaaatcagtttcagtggaacaaaaaatacagggaaaggagtgtttcccagacagcccagcacctgcaggggatggagggcacataagtttgaatataaagtttaacaaatcaggggcagggccagaggaaccaagtccaagctcttgggttcaactataaagtaccatggaagtttgaaaactgaaagagatcaaaaagctgttagaagaaaatgcaggcatcaatctttatgaccttcgattaggcagtggtttcttagatatgacaccaaaagcaaagcaacaaaagaaagaaaacttaaagtggatgtcatcagaatgaaaaactcttgtgcttcaaaggataccatcacattttataattcatagatctgataaaggacttgtattaagaaatacaaagaactcaactcaataacagaaagacaacccaatttttaaaaggatttgaacaaagacttctcaaaagacaaatggccaaaagcacatgaaaaactactgagcgtcttttcataagggaaatgaaaaccaaaaccacaaggagaccatttcctatctactaggatggctaaaatttaaaaagacagtaataggcattatgtagaaaaactggaaccctcatacactgctggtaggggacagcccctgcaaaccttttgaagaactgccagcccctgttccccttttgaggaacagtctggcagttcctcaaaaggttaaacctagagttaccagatgacccagcaattccacccctagttatctgcccaaaagaaatgaaaacctgtctacacagaaatttgtacacaaatgttcacagcagcatgaatcataatagccaaaaagtggaaacaacccaaatgtccatcaacaaagtggataaacaaaaccgtaggctgcccagacaatggaagacgattcggctataaaaaggaaggaagcactgacaccctacagcatgaactctgaaaacatgcttggtgagagaagccagacacaaaaggccacatactgtatgatttcacttatatgaaatgtccccaataggcaaacccatagaaacggaaagtacattagtagctgtttaggtctgggggagaggggaaatggggaacatggaatctccttctggggtaacgaagatgctctgaaaccgattgtagcaacagttgaacgattctgtgaataactaaaaaccactgaattgtacactttaaatgggtgaattgaatggtacgtaaattatgtcaataaaacttatttttaaaaaaaatgagggaaaagaaaattagtcctactgcagcccatctccacatgtccctgctggtctgtatgcacaggcacctgtaccttttggttttgttttgtagagacgggggtctcactatgttgcccaggctggtctcgaactcctggcctcaaacaatcctcctgcctcggcctcctaaagtgttgggattacaggcaggagcaactgcgcccagcccataccatataaaaatatagttgctgtcctgacagttttaaatcctttttttttttttttttttttttttgtgagacagagtcttgctctgttgcccaggctggagtgcagtggcgcgatcctggctcactgcaacgtctgcctcccgggtcccagcgattctcctgcctcagcctcccaagtagctgagactacaggcacacggcaccacgactggctgatttttgtatttttttagtagagaagggatttcaccacattgaccaggctggtaaatccttttaatgctgtgtcacacatattccatcttacaagactccgtgaccgttgatattaatattccacaaaatgggcatacttgaccaaaccctattaagacatttaggcaaggccctacttgctgctttcatgaaatacaagagaacacctctgtccaccgctctttcccttttgttagattatctcctcaggctaagcttgtcagagtgagatgactaggtcaaaggacatgagcattttatgcctttttgaaaggatgccaatttatagtgccagttattaattttcatattaaaatgtcacttatttttatatgcatttctttggcaatcaggagacagaacatctttccaagtgttcagaaattacacctcttctgagttgccttattatccacagaagacatggaggcctagaaaaggatggggcggggcataagtctaggaccccagcatgactctcccaccctcctgcctgcacagtgaattccaatggcacagggttaagaaaagggagcagtggccaggtgcagggacttattcctgtaatctaatctcagcactttgggagactgaagctggcagatgaactgaggccaggggttcgaaaccagcatggtcaacatggcaagactcttgtctctacaaaagaaaaatttttaaattaggcatgataatgtatgcctgtagtcccagctactggggaggctgaggcaggaggatcacctgagcccaagactcagaggatacagtgagccatgatcaggccactgcactctagcctgggcaacagtgcgagaccctgtctcaaaaaacaaaaaaaaaaaaaacagaacagggagtagcagcagtgcctcttggggctggtcctggggtcccttgcccaggctgctcctagcctgccaggtgccctcctgcaggggagaagagggcagcctttcatggggctttacctgcgtctggaaaactgctccaatacgttgagttggaataagtgccagcccctgctacaaactcccagactcccagaaaatgctctctggcgcctctgggtggcaccaccgtccaccaagtggcccaacactgtggtctgcagtggtcttgctcatcggggaatggtccaggccctgggatgctctgagcagaccaggaaaataagctgcactgtgcttggtgagtcactgaagcacctgcagatcccagcctgggtcccttgcagggagcacacacacacacacgtgtgcacacacaccccatctctgagaatgcaggtgttgcctttctctggcccatcttttcatcaaagtcaacagatataatcctatgatctcctagagctcaaaaattctatttctggaattccacatacagccttgcccatgatgatagggtgtaagcccacagggcatagccctcctttggtgttcacccaacctgggtacagaaaatgcaggccacagggaagggtctggacctgcacagggctggcttcccctccagctcgatggccacaccagagcccaccttctctttgcccctcaccgggggccgcagggccctgttgctcctccgtgtcttccccacctagggccatgcctgctactcactgctccccctcacccctccatatccacatgcgtcctcctgctgccttcctgaaccccagcagagactgcagggcaggtccttctctaccaaggagaggatctggaaaacagctcatgaagatttcccgaattcaaacacccattctcccagtgccttccaatacaaaatcaaacatgcattcccacaaaaccatgttgtgtagggtgtaataaaaactacaagaataatctttcaatcacacgatcagaagcaaaatagttttccaataaaacgagtactgttcaaattaagctacaaaatggaaaatgtctgatctgaaaatgcagccccagcacctctgctgtgggaaggtgctggtgagggagggggctaggagacctggggatctgcccagttcccaacagaggaggaaggggagacttgcggggtctggggagcccactgaagtcaacttgcagccctgacaaatccaagagaggcttcttggccttcttgctttaaatcttggatttattaattgcaaacaaaataggtgcctgtttgaaaatctttacaagtcaatcacaaacttaatagtaagtcactcctatggaagaccagaggcctctgcaaagtctacccctccacaccctctgggttctgtggcatgtgaaggtgtggagaaaaaacctgtttctcctctgctttcacaccataacaatcaacagaaaagacttctgtggcaaaacatgtgggggtttctccccaataacaagcaagcagtcagttctgcagcggacaccaggtggacgtcttctagtggcattcaagtctgatgctaccgtgtcagatcccacaggttgagggctcagttccatgactgccccccacttctgatcatcgcaattcctagcttgcgacctgcgcttctgacagactggctacaaatcactatcttgggagcggattccttgtaagaggattagctagtcttttgtgggtgcctctccccgcggcccttccaccatgggatgacacagcaagaaggcccttgccagatgctggcagtgccttgatcctggacttcccaagcaccacagttttgatgactgatggtgaggcttaatgggagttgtttgggacatgggaggtggattcctcatgaatagataaatgccctccctggggtggaggagaagcgagtgacttctcactctgttagtccccgcatccttgctggttgtcagaaagagcccagcgcttcccctccccttctcaccccctctctcgccatgtgatctctgcacagagaccccccgtgccttccaccatgaatggaagcagcctgaggccctcaacagaagcagatgttggcaccgtgccatcctataaagcctgcagaaccaggaaccaaatactctcttttctttataaattactcagcctcaggtaatttatagcaacacaaatagactaagacaccagcctccagaactgtaaggagataaattcctcttctttatgaatgacccagtctcaggtattctgttagagaagcacaatggactaatactacatcaagacttgacaagtggtaggttttttttttttttagacagagtctcgctctatcaccaggctggagtgcagtggcgcaatcttggctcactgcagcctccgcctcccgggttcaagcgattctcctgcctcagcctcctgaggagctgggactacaggcatgccacccatctaatttttgtatttttagtagagatggggtttcaccatgttgaccaggatggtctcaatctcttgacctcgtcatctgcccgcctcggcctcccaaagtgctgggattacaggtgtgagccaccgcacttgaccgacaagtggtagtttcttaagggttagttgccacaggaattggaagccttaacaatggtttttttctaatgtgttacattagaagtcattggtgtaccttgcatttggaatgggtcttttacatagacatgatttcttaacatcatgtgtgggtcacctgaaaatacgggttcctgtaatgcagatctaccaatgttgacacatctcattgaacaatatatatttttttaaatcacattgctggtatcactaccaatgtcattaaagtcactaaatattgttaacgctaatcatcatttgaaagcttgaatttcatcactggcaacaaagcactaacaaatatagaaacagcaacatatacaaaaataaaaggtcagttgtttcccttgaagtagcaagttcactttgctcattttcaagaaagtgtatgctaaatatccaaatctgaataaccacggtgtgtgccagttgttctttaagtgaagatggagtccatgaaaaaggcagctagttcggcccacacttcaaatgaatgcacgtgtgcttttcctcacgacagcatcaaactccatttgacatacttcatgtgtgcctcatttcgtcacaaaggatcttaaaaagctgtggactcatgggtcaggacttaataaagttgatttttactgctttttctgatgcaacactggtgtgtgtgtgtgtgtgtgtgtactgtgtgtgtggtggtgaagactcaattacaacaagaccagcacagtgtggtgccagtcttgagtcagtgcaggccccacagcttgtttccgcactgctcctacaccatcaatgtgaaagccatcacaaacaaagaggcatggtaacaaatcatggccgtgttattattaaaacagttctgatcctagccccccgagtggtctcaggaagcccccaggagactgcagatcacatttcaagaactgctgtgctagaggaacccccactagaagttaaggggtgcgtatcagccaagtgcagggctgggacaggacttcacaaccagaaggatcaagagtggcctgcaagtcttggagtcgctcctggggaggccctgagtttgttgttctggcaaggccccaccccagggatgtgcttgccacccggtggaaggctttaaatgaaacaagcagtcaagaacatgggctctgggccaggtgtggtggctcaggcctgtaattccagcactcggggaggccgagacgggaggattacttgagcccaggagttcgaaaccagcctggacaacatggcaagacgtcatcaatattaaaaaaaaaaaaaaaaaaaaaaggcgggggggcccgctctgcatcagcttaattcaaacccagacccccaagacccaccactttccagctgagcgagctgagcctcggtttcttcctctgtaaacagagatgatcatgcctacctctcagggtgggagtgaggttgaagagagactgtgtgtgaaacgcctgcagcagaaacgctgggcctagcacacaatgacgctaaataaatggaaactgctattattatgctttattaggcaacttccaacagggaggaaaacaacaggtattgacgcctctgccatggagtgccttctgattcccaacgaggggtcctggtgcatgttcactaatatgactacaaggggatgcctctaccggattctggagggacttgcaatcaaaaccctccctaagaactcagctcagcagcgttccctcacagcacagctcagctgggccacctgctccacggtaacccgagacaactctttgagaaggcagagacactagcagtcctccaagggccatctctcctggtgggctgtggaaatgccaggggcctgcctgggagtgcccaaggttggcaatgcccctggaaggatgctccaccaatacaccctggtggcaggggctctgcagcagctgctgcccagacacatttctcagagctgggctggcttggtgctgcatccccaggaggtgcttacccacgtggcagccatggcgtcaggacgccagctggcctcagaggggctcctctgtccccaggaggcaggtcccaggcatccagccaggaacagggctttctgctttgctgggaaaactgaaaggccgatttctgccttgcctgcagcttccatgtgctgaataaaggaggtgcccactgctccatgaggggcagagccgaggtaaaagacaaacactctctgtgcttcttgggtctgaaaagagaatggcaaggcccaaaccaggtctggaggaaaaggccaaagcaagaagtgagccagaagcaagcaggagctcacgtgggcctcagggaagatgctctcagtccagatagcagcaccctgcagggacagggcagcgggaaaaggagagcacagaatccccaccaagggtgcaggcctgaaggggacccttccagggaggcttggcccacactaggcctttccatcctgtgacatctccatccaacacacagacggattagttcaaacccaccttggagggcggtgtgagaattaagtaaggcatggatataaaaacttactgaaccactgtaacgggccatgcagcgtgagggtcattaggagggggactgttacttgcaagggatggccgctgaccacgtagctgttccgcctattctcccaagcaccccagggctgggctgaagcacagtctgtgaggtgaccacgtaacagaggccctctaaggggagggcgggggatggtgcttccttctgatagttactcagcacatcctccgtgccagatacaggctggggattaaagacacgtccctggctgggcgcagtggctcacgcctgtaatcccagcactttgggaggctgaggagggcggattacgaggtccagagatcgagaccatcctggccaacacggtgaaaccccgtctctactaaaaatacaaagattagctgggcgtggtggcacgtgcctgtaatcccagctacttaggaggctgaggtaggagaatcacttgaacccaggaggcggaggttgtagtgagccaagatcgcgccactgcactctaacctggcgacagagcgggactccatctcaaagaaagaaaaaaaaagacatgtccctgccttccagaagcttacggtcaagtgaagaggatgagcgttaaataatcacccccctcgccaaaaaaccacaaacacaattacatctgtgaccagtggtatcgagaaagtccagggcacagtagaaggacagcaagatcgccgttctggagctctaacaccatctcttcaagcaaacctgggaggaggtggcggaagagttaatgagaccagcaggcaaagggagggatggggacagcagagggaacagtgagtacacaaggcctaaggaaggagggatgtgcccctgagggtggccagatggcagcctggggccctcacagcgacccagccacagggtttgttccagagctcaaatacctcagatctccaggacaaggatgacaaggccagctggacagtgtcccaggcccttctcctcaggctttaggcttccccaggagacctccggcaccattcagccttgttgcattgtggcacttggaaacaaagacagcggtcttctttgcttgactgtcaatagaatattgggagagcacaggtctccctgggaccctgcctcgccgctgatggcctgcagccctagacaaattcctcaacctctctgagcctcagtttccccacgtgcaaaatgaggttcttggaaggctgaacaaaatcccacatgtagatgtccaggctgtattgctggagacgccttccatgaattactacgcagataccaccacccatacagagctgtgctgtgctcctccacatcacactgcaaaggaagaaggcagaataacaagatctcaaacagcaatgttccgcctaatgaagtacagactggagattgccagctgcacccaaatccactctctcccccattcttgaatacagaactccactttcactcagggcaagtccatcaaccaagagggtccccgagctttcttagagtgacaaagctttggctaatgagctgtaagcagaagtgtccagaccataagaaggcattcagggcaagccgactcagcccggagccaggcccttcatctttcctgccttcctcccatctaccacctggaagatagatgccatggctccagtagctgtgcttcaccatgagggccttgggatggaggccagtgcctaggacagccatgggacaccacaccagcaactaactgaccacctcccacatcttccacatgagtaataaaacttggtttactggttaattattggtaaattattttcaggttaagtattaacaagtgtcattacaaatatacagcacagacaggtgcagtggctcacacctgtaattccagcactttggatgccaaggtgggaggactgcttaaagctaggagttcaagaccagcctgggcaacataacaagatcccatctctacaaaaaaataaaattagccaggtatggtgatagacacctgtggtcccagctacttgggaggctgaggcgggaggattgttctagcccagggattctaggctacaaagagctatgtcacgccaatgcactctagcctgggcaacagagtgagactctatcccccctccaccacaaaaatatatctctacagttccttaggtctgaaggaacacaagttctcttcaagtgatccatgatcaaaaggatcatggctttctttaggtcacatgacacagcctcagccagtacagaggccaaggcatggggaatactccctggcgggaaggctggagcagatgcttccgtagttaaaacaggccccgagagaagtgcagctggttgccttggagcgaggacacattcttctgcaactccagtgctcatttcagcatgagcactggctcaaggaggagctgaggaggacgatggcgtgcagtgaacgttaatagagcatgcactgtttggatgcaggtgcccagcacagggacatgaaggaagtgctccaagtgaggaggtgctcaaaagggagcccctgctgtgagactgctcctgggccccaaaccctctccactcccctctccaccatgccctatccaaacctggggctaatccagccacccaagtccatgtgggaccaggccaggattccctgtggcctttcgcagctgaccagagggaccctattcccaacgctgggtgatgagcaggaaagaggaggccctccacaaaggtccactcagttgcagagcagcctctagtgaggctgagccctcccaagactcagggaggttgccaatgtgtccccttctctgggaccgttgtcctcggctgccaagttctagcacaggcaggcctggaaaatcctgaacatggcccatttcccattgtcctgatggaggcaggacgagacagtccctccctcagataacatcgcgggtggctctgaaccatttatttatttttacacttgaagatgggtgtatctgatgccttgggaattctaaacacttcaaaacaagctcaacttaagtcacagaaaggaccagaaaacagatctggttttcccatctgccagctctcctcccacccaaccctacatgctcctcctcgaccatgatgagtctcagcggaaataagacaccagcctagccaggcacggtggctcatgcctgtaattacggcactttgggaggcagaggtgggcggatcacgagggcagaagttcaagaccaggctggccaacatggtgaaactctgtttgtacaaaaaatacaaaaattagctgggcatgatggcatccgcctgtaatcccagctactcgggaggctgaggcaggagaattacttgaacccaggaggcggaggttgcagtgagccgagatcacaccgtcgcactccagcccgggcaatagtctgagaatctgtctcaaaatataaaaaatagctggtcacggtggctcacacctgtaatcccagcactttgggaggccaaggcaggcggatcacagatcaggagattgaggccatcctggctaacatggtgaaaacctgtctctactaaaaatacaaaaaaattagccaggcatgatggcgggcgcctgcagtcccatctactcaggaggctgaggcaggagaatggtgcaaacccgggaggcggagcttgcagtgagctgagatcgcgccactacactccagcctgggcaacagagtgagactccatctcaaaaaaaaaaagataaataaaaataaaataaaaaataaaataaaaataaaattaaaaataaaataaaaaagacatcagcccaaccccatggccccaaacaccactgcgccctccaacagaagcatgagccctgtgtcgcaggcagagctgcaggggcagaatcttgcaccgagtggggcacaggcatcaggccccacgcccaccaccctgccctgccacctgactctccagtctcagattttttttcatctgtgatatggcggtaggagcagccccttatcaagaattgtgatgagtcacgggagaggccatgggtgaagagcacaccactgaaggcctgccacaggagcctgagagaggaagtacacgagaaaaaagaagacactgttacttttttttttttttttagacggagtctcgcactgtcgcccaggctggagtgcagtggcgggatcttggctcactgcaagctccgcctcctgggttcacaccattctcctgcctcagcctcccgagtagctgggactacaggcgcccgccaacacgcctgggtaattttttgtatttttagtagagacggggtttcaccgtgttagccagggtggtcttgatctcatgatctcgtgatccacctgcctcggcctcccaaagtgctgcgattacaggcaagtgccaccgcacccggtgacactgttgctcttaagcagaagcaaaatcaaaaggcagacaggactcaaagaatggttctaaacctaaaagtactaaggcctctaggaactatgatgatgacaattactgtgcaatttatatcatgctgaattttagtaaaacctcctggcaaaccactctcacttggtgacactccgtccacagcacggggccacagcatagtggatcagtacaactttcctggacagccttgctacctgtacactcttatggactcaattccacttcaatgtattcgttctagaggtaaatggacatgtgaacacagattcacaggcaaagatgtttatatgcaccactgtcttgatgttcaagaaaatggaactggttacatgcatgtgattagctatataatgtaactgtattcagcccctaaaaaatgatatagttttgtttttgttttttgagatggagtctcgctcttgttgcccaggctggaatgcaatggtgcagtctaggctcactgcgacctccgcctcccgggttcaagtaattcttctgcctcagcctcctgaataacaaggattacacgcacccgccactaagcctggctaatttttgtattttagtagagatggggtttcaccatgttggccaggctggtgtcgaactcttgacctcaggtgattttgcccaccttggcctctcaaagtgctggaattacaagcatgagccaccatgcctggccaatgatatagatttttattgacatagaaaaatggttttaatatagcagtgagtgaagaataaaaaagcagtagcacagtgtgattcttctttagatgtatttacatacgtaacacattttttgtctttgttttttcctttttgtggagaacagcgtcctgatatattgcccaggcaggtctcgaactcctgagctcaagctatcctccagcctctgcctcgctaagagctgggattacaggcgtgagccactgcactcttccataacacatattaacagtttttctgggcagtaggagtttaggggatttgtttatatgtaagtacacatacagaaacgttctactgatgtggagtttctagttttttaatggtaggcagcacctttacatgactccttcctcaaaatgctcattataagtcagacacagtggctcacgcctataatcccagttacttggggggctgaagagggaggaacactcaacccaggaggtggaggctgcagtaagccatgattgcaccgctgcactctagcatggacaacagtggggaagaaccctgtctcaaaaaaaaaaaaaaaaaaaaaaaggctggccgcggtggctcacacctataatcccagcactttgggaggctgaggcacgcagatcacctgaggtcaggagttcgagaccagcctggccaacatggtgaaaccccatctctactaaaaatacaaaaattagccaggcgtggtggcgcatgcctgtaattccagctacttgggaggctgaggcaaaagaattacttgaacccaggaggcagaggttgcagtaagctgaggtcgcatcattgtactccaggccgggcaacaagagcgaaactccatctcaaaaaaatatatatatactactcctcatactcctcaatccagaaacacacctcagactataatctaatttcacctacaggagaaaatgctctgcagagcaagccagaggcctggactggttagtggcctcctctccaaagccagccccttatggccataggtctcccatgagtttggtcaaatgagtcagttctgccagatcacctcccggtactccaggcaaatggaaagtttagatctgtaaagttggaatgtaatgacctcacagtcctgctagcctaggagaccccgccaggagacccagcaggaggtcacctgaccaaagagggctggtaagaaagtccccgttggatgcataataaaaacgagtgatagagcccatgctgaggacacagccccggcctcccaactcgcccagtgatctcgccaggactctgaactacctcccaggcagaacgctgctcaagagcttgttcctgcatgctctcctgctagcagagaaaatgaaggaagcacagacaggaggggaaatgcagagcaaaaggaaaaaatcagacacagctcaaccacaagtgaataaacaagtcatctgcacctgtcccacaggcaggccttggtaactacaaggctgactaattttagaaacagcatgaacctaaagaaccatcatttaagtgctcaaaatggagcccttaaaaaaaatccttctgtctgcctgtactgagcagacacaaaatggacagtcttgggttgactctattcaaccagctgtctgttggatgagatcaagacacaccactgcaacctacaaaaaagcaccaggccgttaagtgcagtcaagacacgtggccactcacggccacccaggtggaagagtcttaattcagacacaaatgtctcctggccgtccttagccagggagctgggctctgcccgcggccaggtcttgcctgagtccccctattccgtgggtcggggtgggatgtggaaaagcaaacctctaggctttcttcctccaaatgtgtcagtcaccatacatacctgtacacagaagctccccctccagcaattttccctcagaacagtgaggacagtggctcatccctgcgacatttagatctctcatgttacagggcattctttcaattattttgaagacatttctgatgggtgaagaaagcgctctaggaactgagagtgggaatctaatttgtattttacactacattagatgcaacagtatatagcatatggaaattagttaactgagtttctatcactcttagttggcatctgaccctaagaattcacttacattggttgggtgtgaaacaaactgaattagtagtttacactgcattatatgaaacagtatatagactgggtgcagtggctcacgcctgtaatcccagcactttgggaggctgaggcagtcggatcacttgaggtcgggagttcgaaaccagcccgaccaacatggagaaaccccatctctactagaaatacaaaattagccgggcgtggtggcacatgcctgtaatcccagctactcgggaggctgaggcaggagaatcacttgaacccacgaggtggagcttgcagtgagccgagattgcgccagtacactccagcctgggcgacagagtgagactccatctcaaaaaaaaaaaacaaaaacaaaaaaaacagaaatagtatacagtaggccaggcactgtggctcaggactgtaatctcagcactttgggaagtcaaggcaggaggatcacttgagaccaggagttcaaagctgcagtgaactgagtgcgccactgaactccacctgggcaacaaagcaagactctgcctcaaaaaaaaagaaagaaatagtatatagaagtttattaggttggtacaaaagtaattgcagtttttgcctaagttcctgtaactctaagtcaacatctggccctgagttcactcatgctggctgggacagaagacttattctggaagcttgggaaaacaggagctcacgtcatgattgggactgccatctgcttggccatgtatatatttctctatgactcagacatcagagaccaggctggagtgcagtggcgtgatctcggctcattgcaacctccacctcccaggttcacgcaattctcatgcctcagcctcccaagtagctgggactacaggcgcctgccaccacacccagctagttttttgtatttttagtacagatggggtttcaccgtgttagccaggatggtctcgatctcccgacctcgtgatccgcctacctcggcctcccaaagtgctgggattacaggtgtgaggcactgtgcccggccttttttttttgtatttttagagacggggtttcgccatgtttgccatggtctcaaactcctgacctcaagtgatccttctgcctcagcctcccaaagtgctaagattataggtgtgagtgtctgctcctggccagagaacaccttttggaggttgcaaggccatcagagatgactgggtccaagtctaagctgccattcatttctgtcttaaatgtttactaagcacccatggaagacaggtgccctgtgaagtgctggagatgacggtgggcgagcaagcagtggcacagagtggggagcagtctccgaggagagaagtggctgccccgggcaccccagctgcctggagatgacagagccaagacaggacctcagctgtcctgactctctccttccacatcactgtcagccctgtttcttttctcacacattctccagaaatggttttcaaaatacacttgagtgggatctcacactcccaataaagtgcttcacacagtgtagctcacacagtgcagttccttcacatgcgttccatttacatagatttcatggtacccaggacaaaaagctgaagtggcagtgcccggtcccctgctttccctggggagggaaatgggacacagaacgtgctgtttcctcaggccccgctgggcctctagcagggggagtgcctctgagctaataggcaattcaaggactttagaggacagtttgacttatgaggtctttgctctgctagttgactttagaacctaacccactgaatgtgtactgaagaattcaacacagcatgcaaatcagcacccccaacactcaggcaatgacggagcacatgaagaccacggtccctgcgtcttggctcttaggaagatgagacggctgaaatgcaggcatggtgtatcattttattcaaccaataagtatggaccacacactatgcgtgaggcatttcctaggcactgaagatggcagatcaacgtctgtcttaatggcaggcagcttcagtggggggctgagtagagggcataaaatacagaaataaaacatcgggcctggcacagaacaaagcgtggcatggaagaaggaagaacaaggaagtggttgccacagggctgcagttgtcaccagggatagctccactgagcagggaacactccgtgttggaggatgggtgagccgggtcctctggccacagcaggatgcccacttttaccctgataagccgagaggcttgcagagagcttgggaaatcatttcgccccacgactctccattttccgcactcacctgccatgctaatccagttctccaaagttctgacatcaagtaggtggctcctagagctggggagcctgagagcactcggctaccacctccagcaggtatagttcctttttggccaattttactggggccacagagaaatgcgtcatggtgtggccactgtccctgcaaagcagctaaacacacaccacagaacctgagcttgaccatgctggggacagaaactaaggcctgaggtcaggtgacacaaaatgcctggggaatctgagatctgagaagtgctcacttgaggccttctcccctgaacagggcaggactcttcaggttcaaggatgaggccgtttcactcagcagagccatcaccatccaagttcctctcttttttgtttaagtgactacctgtttgaaaagactcatcagaccctccatggaggtcactcacctcatggtccctgccctcagggagctgcagatctacctggcaagacaagtgacacttgagaagaacttataaaaaatacacaggcaagcccagcaggagctgtcgcctctgtgacagcaggtgctccagcagagaaaaggtgaggcctgtcatgggcttcacagccctgcagggaggtggccagggaattctgggtctagggcaatggagtcactcataacatgcagaattagaaagttgtgatcaaggccatctcccagtcagacccatagctcctgcagggcagggtcagaccttggggccagtttctccagggcaccgggcagcctgtgaaacatgggttagtgggtggatgggctgcagcttggctgctgctctaggcaggaactctgctctccagccagaggacccttctgttcacttcactcccattgccaaactggatggctgagaggcgctccagacctttctcgtctccttaaaccatgaccagtcagcaagtcctactaactccatggttcaaaggccctcagatccactatctcatctaacagtcaagggtgacagggaagagtctggacttggaccatatcccagatctaccaccggatcgtaactcacactcctccaaactatctcatccccccacccttcccaagcccacccccgtactctttccctggcctccaaacacgcccacaccccacttccctgcaaacctgggccttcctgaggattctgctgccaggggattctctgtcccttgtcttatctcccctcaagaatcctgggactctcccacttgtattgttgggccctgcttggtgcctagtccatgtgtgttgaagaaatgagtgcacaggtttggggttgacctaagtggacctcctgtgccattcttttttgtttgttttgaaacagtctcactctgtcacccaggctggagtccattggtgcgatctcggctagctgcaacccccaactcccgagttcaagcaattctcctgcctcagcctcctgagtagctggaattacaggcacctgcccccacacctggttaatttttgtatttttagtagaggcggggtttcaccatgttggccaggctggtctcgaactcctgacctcaaatgatccacccacctcagcctcccaaagtgctgggaatacagccatgagccaccgcacccagccccttctgtgccattcttaacccaaaggccactgcccagggtgagaacacagccgcagccgagagagactccactgcgtcctcaggaaagtacttacgttcacagccaaatatccagacaggaaaaaacaccatttcttgaattccagtcaactccgtgatgcagtgatcacaatggggctgggagagcccacgtctccctcagctgctcttccgccacccctgctgtttcagggccagccatgggcccttctctgccattacttggcaaccatgggcaagtcacttagacactctggctgctgcctcagctggccaagtcccactgtgctgctacctccctggctgacaggtgagaacaacgcatgttcatagggcggtacactgcaaagaaccccatttcctcctgcttccccagcctgtgaggccgctgtttgcatggtttttttttttttttttttttttggtttttgtttgtttgattttttgagatagagtcttgctctgtcacccaggctggagtgcagtggtacaatctcgactcactgcaacctccacctgccaggttcaactgattctcctgtctcagcctccggagtagctgggattacaggcatgcaccaccacacccggctaattttgtatttttagtagagacggggtttctccatgttggtcaggctggtctcaaattcccaacctcaggtgatccgcccccgttggcctcctaaagtgctgggattacaggcatgagccacagcacccggcctgcatgttaatcagaattgtgacaaccaagctcgctttcttcctgaagtaatacgggttgaaattctccctaaaccctcccaaggcagctctcgcactcttctctacctacttccacctttcttggcctcttttccttcttgggggaaaaacccagacactgggactagatctgaattcagacttaattagcattgattgaacaattacatctcaggaagaccctcagtgtttactgaacccccattacacctccttgcagtaagaatcgatggtactgaatcactcaatgtacagaccaagccaggtctcacccacaaatcaggagcactgaaaaggtgacaagaaatgtttcctggaaaaatggtccagtattaccaaaaatgcatcacaactgctttcaaggaaagaatcagaatgctcctggaccccctcaccctgcactgcaggctctgtattggttttgctttgtctgccgtcagggacccttcatctcttcagcgctaacagcagatgcaggccttcctgtggcctgggtgatgctcttcacctatcacagacgcggccagcaaggcctgtctgtcacacagcttcaacatgacagagaggtctccacgtctaggcagccctggtcccaggacaccaccaatgtcatggaccactgcctgatgactcacagagtaggagaagtggtgaccggggccatcaggcccacgggttcaggagccaccagaccagtgtctccaagagtggacagccctctgggcatggggaggttctggcccaggccctaggcgcctccacctctgctgcactgtattgcaaggtagcctttaccacctcccacagagactgtggcttggagactcctgactaggcagagacagaaacagaaactttttgtgggatcctagaaaggggcacatttccattttgagtaatctatttccaagtcccctcgtgggggaaagggaacctcctgtcaccactgccggcctggctctctctctccatcctccccatggagcgccaaggtcctctgcagagctctccctgcctgccaccttctcaccagcacttcctccacctacaggacagtgacatgctataaaatgccacaactttaactaccatatttccctgtgtcttctatgagtaaaaacatgtccttacccttggaaccatgttcctcaaagtggagacaaattttcacagggcctatcttttctctcccactcaggcaactgagtagggtgaagggctggtgtttgtggctaaggaacaaagtacctgggcccaagggtctcaaagccacggcctctagtccatcaacaccatgagctaaattgcactacacaccccagttcccctagaccttagaaaacacacactgaactggtaggttcaacctggacaagcttacagtgtaaagagccgacagggagttgcaagctgatgactagcttcaattattgccaacgtgatctgctggggcaagctggccttcgggacgcattccgttagctccttctcaaaacaattttgttccctgaagtattactttacatcatacagtcaatgttctgctcttatggtgattctagaaccacggctggctgctcttaaatccttgtaagaacttgggcacggtagctcctgcctgtaatcccagcactttgggagggtgaggcaagaggatcacttgagcccaggagttagagaccagctgggcaaaataatgacatgccatctctacaaaaaaaaaaaaaaaaaaaaattagccgggcatggtggggcatgcctgtagttccaggtactcaggaggatcgctggagacaaggagttcaaggctgcagtgaacgtcgtgacggcaccgctgcactccagcctgggccacagagcaagaccctggctctaaataaataaatgaacctttgtaagagaacctgtaaagctcttccctggttctcccatcctgtggaaaacctccgaactccttcaaattctcaagggtgagagacggatttctaaatacccagggcttccattaaggtaaaaaccattaagaagataaaaaagtcaaacccaataaacaacaattctaagactctaattaatgacatgcatgcttatttgggagggaaaggcactgatatctgcaacttactttgacacaaaaaacaagagggactgctggttggacaaatatgtgatgaaatacaataaagtgttaactctacattctaggtggtggtctgtgggtgttcactgtaaaattccttcaacttttgtatgtttcacgtttttcgtaactgaatgtgtagagggggagtcttctgagactggcaagtgactgggcataacctttccgattaagggcagagggcaaggcagagctggcacgcctccctccacccagttctacctagatcggccccaagggaagcagcaaagaacccaggagagcagtaacttgcccgggcaccgccccgcccagcatcaggccccagaatacagaagaaactggcagaaacactatggaacgtccctgcccccgggcccgccaaccccctcactgggacaggttctcagccccagctgcgcccgggaatgatctggggagcctactaaatgcagattcctgggcagcgcgacggaactacagcatcccaacacctggggtgggccccaggaatctgcccgtttcccaagagccccaggtggttctgacgcagaggatcttgagcccacctttggaggaactcacagccactcgccccacctcatctaacacctgttgagaagccccccaaggaactcgctaagccaaggtcctcgaaggcgcgactcctagccccaagctaggccaggccgtcgccatctccgccggggatgcgcggccgagcgccacatcccgactccacacgtcggcgagccgggcgcgggtgcaggacactgctgggctccgggacggccaaggtcacccgcggggctcggcaggggctggctcggccacggggctcctcctcgaccccctttccttgagaaaacaactcccacccctcccctccccgtctcgccctgcaagacggagatggcaatttccacaaccttccctgacggaaaaacgtgcgggcgagcaggctgccattccgggcgcacaaccccgcggcacacagcggggcgcccgcccgggccccgccaccgcagcggcttcgacatccccagggccgcgctaggtctcggcagcgccctgaggggaggacgggccccgccatgccgcgccccaaccgccggccccgctttacctccagaagcccggtgcccgaggccggccgaaagcggagaggggcccgggtccggacaggcgccggcagaacaagaccctcagccccgcgcggctttgcgcgcacaacgaaaccccccaacccaccgcccaccccaccgcccagag

SEQ ID NO: 893 - DNA, 14491 bp, Homo sapiens
cattgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggtgagtgttttagggacaagcagcatcaacttcggaatcttcaactgggcctgagcacttatttctcagaaataatagaatcttgctcacttttctttctttttttttttttttttagatggagtctcgctctgttgcccaggctggagtgcagtggatcagtctagctcattgcagcctccacctcctgggttcaagagattctcctgcctcagcctcctgtgtagctgggattacaggtgtgcgccaccacgcctggctaataattctatttttagtagagttggggtctcaccatgttggccaggctgctctcgaactcctgacctcaagtgatctgcccgcctcggcctcccaaagagctgggattataggtgtgagtcaccatgcctggcctcttgctcacttttcatactaaaacaacaaattacaggctgtagtttaacctctctactgcatgcataaatgcagtgtggtacgagtgcctctgtagcccataacttcagtttccttgttgctagcagtctgtggtgacactatactaatctcacatgcaggaaccaatgaggattagccagggacacaggaggagtcaccttgcattcagaatgactcaagtttagtctcaacttgaccattagctctctgagtgatcttgcccatgttaattctcttgatcttagtttcttcagagccagtgagacattgcttgaaagtgacttagcctggtatacccaggtctgtcagacttatagtctggtgctctcttgggtgaacttgagggccttctgccaaggcaggaatggcttcttttaaaaaaaaattattttattattatttttttttttgtagagacggggggtctcactatgtttcctaggctggtctcaaactcctggactcaagtgatccttcagcctcggcctcccaaagtacagagattataggtgtgagctaccagtaccagcctccaggaatggcttctaaggcttcaggctgtttatagagaggaaagcacctgggagctgatggcactctcaggtttcccaaaatgacagttctgcatatgcatcttaatcacctactttttttccctccacccccaaatgctattcacagtccttgtttatgatagaagctgaagcttacaggtgacaatttttgtgcctgtatgaaaggaaacatgactgactccacttatccacacgacacctgctttcaaggttgttcagtgttggaataatttttgcttgatggtaacctagggatgacccaaggtttcattagttaaagccagccctgtgggatgcatgaagtctagcctctgtccctgtaaaaatcccaccagaaccattttagaattcactcaggacttcacccctcccgctcctggtgctgcttatggaactaaagaatcctcatcttctcagccctgggacacattgtcctcatataaagcgaggtggcaatcagggaacaggggcgagtcttgtgcttatttcagttataataggaaggctctaccaggactcatcattgtcccaacaatagtcgattccaggccccttctttgaactcatttcagtgtctcaggttctgtccttggtgtctgtcttcactgcttgctcagttgtatttgaacatggctagagatgagcacacttctcttctccagtaaaaaagcctgcaagaaaagtcttggacttcttgaactgctattcagttgtcttttttattcaatgtattttttgagatggagggggtctcactttgttgcccaggatggtgttgaactcctggccacaagtgatccttctgcctcagagttccaaagtgcagagattacaggcttgagctaccacaaccggtctcttgtcagtttttgaggttacttaagaggttaatgcctttaaattagtttgcagttgttttgcttttgcctgccttcttgcccaaatgcgcaagtgcttatttagtaatctgactcaagtgctttgtgtccccagagtccccacttttccaggattcattgtctttttttttttttttttttttttgagacacagtcttgctctgttgtgcaggctggagcgcagtggcactgtcggctcactgcaacctccacctcctaggttccagaaattctcgtgcctcagcctcccaagtatttgggattagagtcacacaccaccacacctggctaatttttttatatttttagtagagatggggttttgccatgttggccaggctggtcttgaatgcctgacctcaggtgatctacccgctcggcctcccaaagtgctgggattacagacatgagccaccacacccggctggattcagtcttaacttgctctttttttttttttgcatctcactcccttgccaggctggagtgcaacggtgtgatcatagttcactgcatccttgaactcctggggtcaaaagatcctcttgccccagtttcccgagtggttgggactacaggtgtgtgtcaccacgcctggctaattattttatttttcgtagagacaaggtctgactgtgttgcccaggctagtcttgagctcctaggcttaggtgatcctcccaccttggcctcccaaagtgtcaggattataggtgtgagccactgcacccagcctggatttgctcttttatcaagaggttaatatttattcttccgttcagtgaaccgtgggattgaattcccccagcgattgaaatgaaagggcttatgtataacatttcctgaggaatggtagtaccagagttcagaggagacctcaggccatttattctataaactcagaagctgtagttctagatgatgtggcttcttcagggtgttgagaagtctctgttatctcgtgccttgttggattagaactgattgagctctgtctgctgccccaaacatgtggctcagccaatctccagtggcatctgcaatgtgggtattctagcctccagtgctcacgtggctcaccttagaaagggcagatattcctatttcctgacgctgctggagaatgaggtctgagtcagaagtcctcaggtgtgacctgcccagaactatctgaaattgctggatttcttgttcttcctcagtgtttaacaatcacccaattgctcattctcaccagcgacttcctcagtaagagctcaatatttgaggtggtgctgcattttgtcaaacattcatgcgtgttagcccacttagtcttcgcagcacacagtggattaatggatttttaaaagctggtatttatgcacgatggaatactactcaaccataaacaagaaggaaattctgtcatttgtgactacatggatgcatctagaggacattatgctaagtgaagtaagccaaagaaagaaagacaaatggtgcatgatatcacttatatgtgaaatctgaaaaagtcagttatagaaggagagtgtaacatgttggttaccagcggctgggggaagggaagggtgggtgtggaaaggggagatgttgatcaaagggtacaaaatttcagttaggagaaataaggtctgatgatctgccttacagcatggtgactatagttaatatggttaatattataatagtattgtatacttcaaaattggtaaaagagtggattttaaaagttgtcaccacaaagaaatgataagcatgtgagctgatggatatgttaataaccctgatttaattattccccaatgtatacatgtgtccaaacatcacactgtaccccataaatataattgtcagttaaaaacttaggagtcaagtcagatctgaagagaagtcaaaacagatttcatacagttaatttagagacatgggacccaattaaaaatttgtattactttacttggtattttagaatttagctgttattttcttgttacacacacaggcacaggcacacaaatcctctatttaactggctttctcagtaggaactccatctgtgtatttgcaacagctgtaactcaggttggatgctccccagggtgctggcctataagtcatattggaccctgatctgaatctgagggaatctggatctctcttgtaggaagcttttggtttaactgggaagacaggatgacagtcagttgtggaagctgaagcgtaatcacctcatattaatatggtggcaattttatatcggagtgagctctgagctgcaaacagccttctaggaagcaggcaggggacccccatccagggtgatggtaagaatcctgatgcccaactgcaaggtgttcagcagggagggagcactcgtggagtcccagtgcagaagtctctgagcagccacttagcctccctgtgtttgtggggtaacaacccgagttcatgttgtgggcatctcatgcagtgtagtagctggtcactgtcaagtgtcactatttcattgagtcagaagcctgcagaattgttctcattccagggagtgagtcagtctgctgttgcttactctcggtgctggctgagctcagcaacctgctctcttccttcagttcaggtttctccagggcaaagaagtctttattgttcctttctgtatgaccagatgggaaatgaattataatatagtccttagattatattcccacctggtagcaatgcactgagttacctgacctgaaatttgttggacttagtctccatggaggaggatttaccatcttcgttgtctcagaagtcctggtagtgcctcatgccagcaatttagcaggagcaaaagctttgagacagtgttctggatctgctgagctggtctaaaggaacctcttttgcttgaagtaactgtgataggaactttgttactgcttctgttagctcaggtgttggaatgagaatcagcagctgatgaggtgaacagctaggagtactggaattatggagtagtggaggtagattttataaacagagggtcccagttttttggaaatgggaaagagagagggtagactggcctttctagaatttgtaacagaaaagaggacccaggagcttccattgactagttagttaatgcagtgcgggatcttagctggtttgcttggtccaattcctgtctctcggtttcttttttcccttcccttcgctgccttcccctccctcttccctttttctttccaagagaattgagtcactccatataaaagaagcagccagttggctaaaaagtccaacaaaaaacaagtatttatagctctccaaatttcccacttgtcattatcagtatacttttgcacacagttatagtcggtgtttgggatcctttttaaaaaaataaaaagtttctgtaggcttttccatgcatgaacacagcttatcaacttgccccggctgtgccaggattccattgttgactgttgtttgagcagtcatgccctttgttcttaggctgtgtgttgtttttttcctaacatcatagtatggctgggtattattttgatacagattacaattactattactatttcttgaagtgtatttcccagagtggaatattttaggatctttttttctcttttgtgggggtggggaacatgtagcttcttgtggatattagacattgaagtctaaaaaggttctatatttatgatttggccctcaattttctagagattccaatggttcctgcaaagaaaagagcattcaagtatagaaaccagccagactaagtctggacatgtagcttttcagaaagtgaaaaaaaattatgtttctgcagttgcaaggtggcctctgaatgccacactgtgtggccactcccttggacagtggctaggccacagggtcgcctcccctggccccagtctgtgggttgaatatgctaaccgagccttcccaggagcctcctctgcccccagcccccaggtctgtacagatggtagttggtactttcagcccgccttgagaactcagtattcttcctgttagctttccttcaaagtaaaatcggtagaacctattttgagtgtagaaaatttgaagtcgtggacagcagattacaaaaaattgcccaccaccatgcctggctcatttttgtatttctagtagagatgggctttcaccatgttggccaggctggtctcgaactgctgacctcaggtgatctgcccacctcggcctccctaaatgctgggattataggtgcgaaccactgtgcctggctcctttttgtatttttcggagaagcacaaggacttgttgtttaattaagcaagactatactctcccagagcatgcagttattattgagtaaaacacagttaatgagatttaatcacgttccctatcactgttgtgcagcatgataagtaggtgcaaatggcaagaagcacgctgaagttactgcagttggtaacctgggccatggatggcacttgtctttgcctcattttgcctgtaagaagcatggggcctgtggtcctggggtacctggaccctcagcctggtgtgtgtgtgccctcagcctggtcctttacttccatcacccatctagaggctccaggaccctttactgcacccctccctcctctagatagctcagtgttttcatcccagcacctttttctctgctgcctgagaactgagcagccagagacaaattttggctctcagggtcctcaagggtgtacagcaaagctgttcttattatttaaagtattttatttatttatttttgagacagagtcttactttgtcggccaggctggagtgcagtggcatgatctcgactcactgcaacctctgtctcccaggctcaagaaatcctcctacatcagcctcccaagtagctgggattacaggctggagtgcagtggctccatctcggctcactgcaacctccgcctcccaggttcaagcgattctcctgcctcagcctcctgagtagctgggattacaggtgtgtgccaccatgcctggctaatttttgtatttttagtagagacagggttttaccatgttggccaggccggtctcggactcctgacctcctgatctgcccacctcggcctcccaaagtgttgggattacaggcgtgagccaccgcgcccggctagcaaagctgtacttttaccaaaaaaaaaaaagaaaacatttataaatcaaggtctgaaggcccatgtgaggcttattctacagcttgcaatgcctgtttttgccccttggtaagtggacgcacagctgggcagccttatgctatctctgtgaactacccatttctggctttgttcataatattcccttgatctggaggccctcccccagccctgccccaaatcctgtctgtgttgagggtcctgccccaggaagccctctgcatactcttccctgcatgtaatacctgcctgctttcacattcttctagactgtgctgtgcatcgtacagttcatcagcattattgcagagtagagtgtctctgatttggagtcaagagaaggttccatttttctgtacatcccgatgtttattttctgagtgttctcagacatcactaagcctcagtcaaaataaagtatgatcatgatgtaacattcattgagtgcttatcacatggtaggcattgtgctatatgagttattgcttgacttcctaaaataatcccagtagagatgctaaatctaaaggtgagagagatggttcaaaaagacctcagtgagcaaaccatgtactataatatcctaaaagataacaaaaatgtaactaggtatctagagaaaactcaggaaggatatgtgccttgggccttttaaggaccatttcttaacacttctgtgttcttcttgacacctgtttctgggtagagcacatagaaaatgctcagtaaataagttctttttccttggcccagtttggcctgatttggccccagttctgtctttgtgagttactttattagttgtcggtgctactgtgctgctattcatgtggaagattccccaaatgggctgcgccttacattgcctgagcagaagccccgagggatggaggatgagcttgccttgttatgggactgtgtttccctggctgacaaaggctcagcatttgcagcaggcaatgggaattgattggccaacttaatatttccttcagcctagcaaagtcctgagtaggctagggacagtctgcttttttggtaactcctgtaggctgccttctgcacaaggcacccagcctctcacaggtaggatgaactggcctcagcacgcttgcagaggggtggaactgtgcgttgcttgccaagctttttgtttccctaaggtttttgaggttttctttgtttttggtaactttcaattttttttttttttttttttttttggacagagtttcactcttattgcccaggctggagtgcagtggcgcgatcttggctcactgcaacttctgcttcgtaggttcaagtgattctcctgcctcagcctcctgagtagctgggattacaggcacgcgccaccacatccggctaattttgcatttttagtagaaacagggtttctccatgttggtcaggctggtcttaaactcctaacctcaggtgatccacccaccttggcctcccaaagtggtgggattacaggcatgagccaccgtgtctggcctaacttttaattttgatacggtcttttttttttttttttttttttttttaagacagtttcgctcttgttgcccaggctggagtgcaacggcgtgatctcggctcactgcaacctctgcctcctgggctcaagagattctcctgcctgagcctcccgagtagctgggattacaagtgtgcaccaccatgcccggctattttttgtatttttagtagagacagggtttcaccatgttaaccaggctagtctcaaactccagtctgcctcggcctcccaaagtgctgggattacaggcatgagccactgtgccctgccttgatacagttttaagcatacagaaaaatggtaagaatagtacaaagaactctcatacctcttccccagattcactgctaggattttgccttgtttgcttttctgacttgccagtgtcccccaccctgcagcatatgcacatgcacacacactgtcttctgaaccatctgacagggagttgcaggcagtgtacctttacttctgaataccccagtgtgtatttcttaggaacaaagacattctcttatataatcgcagtacaattatttttaaaaaccagcaagcttaatgtcaatacaatgctattacctaatacattgttcatattcagattttttccatattccactatggtcccagtaatggcagagctttattttaaagaaaacaatcctggggtgtgtgggtgtcaccttggttacattcgctctgaggaaagcagaaccgacaggtatttggggaagtgactgccgtgggtgccacatcaccagctccttgtgtctctgcaggaccagaggagcgagagcagcaagaaccacacccagcagcaatgtcagcggaagtggaaacctcagagggggtagacgagtcagaaaaaaagaactctggggccctagaaaaggagaaccaaatgaggtgagcgatgggggctggctgcactgaatcaggtgggcccagcacctgtcgtgctcagcacacctggttttgtctgttggcagcactggggagtggccatgggccatgagctctggacccctgggtgcctgcttggccctgcagggaccgcatacagcttcggctgcttagaactctccccactggtccattgtctcatccaaggaggcagggcaggtgctcctgggagtgctgataggatttgatggtagttatccttttttctttttaaaaacttgtgcgtttcctcatctgggctgagaaagggtaaacgcaggcaaagctggctctgttcagtcttttaccacataaaagactgcagggcagcctttccttactctgtatagggacagctcatgctaaacctgagcttccaggccctgttctgcatcattagcctctcatagccctgtcattggccaagttttttttttatcccttgaaataattgctaataataaattgattctcagcacatggatgataacgagctaatctcctaaagaagacagcagaagccagaccatgataaggccaaatttttctcactcttgtagatggattgtgtggacacatgtaagcccctgcccaagtaccaccatctttaggatcacatgttttctaccttgtccatccatccacacacctttacaactgtgtaatttcgttaagcagcacaaacccagcgtcctggccctagcctctcggttgtctcctttgcatccttccgtgcttggtcctagtcacatatagtctcaaagaagctgtgggtccaaggtgggaggaaggcagtagggccatctgaggagacccatggtcacagccttactgaggtgtgtgaattccagaagacacgttccaaggcaggctgttcttagagaagccagcaaatactgaagggaatacagatgtgtgtctcttcgaccactaggtggccacagaagcaaagcattgctcatttgggtggttcccaacacagacacatggacgtgggtactactctcaaggagcaggccacagttatcccttgtgtcctgagtccttggagcagaatgtcatgtctgcttgtcctgtgttccctgacaagttgctgctatttgtgttggagtgaagtgtctgagaagccccagcctccagtacaacaggtggtcaccttggggtgtggactcaatcttctctctatggtcctttctggaaagctgggaagggctaattgacacacaaacacctcccatctctccacagaatggctgacctctcggagctcctgaaggaagggaccaaggaagcacacgaccgggcagaaaacacccagtttgtcaaggacttcttgaaaggcaacattaagaaggagctgtttaaggtttgtgccccgcattgggttccagactgtcatatggggttggggtgggggccttggtcccatgagaaaagtgcccctggagccactctgagggaaaagctgggcttttctccacactccattccttcttgacgttaagctctggctctcggctgggtacagtggctcatgtctgtaatcccagcactttgggaggccgaggcaggtggatcacttgaggccaggagtttgagaccagcctggccaacatggtgaaaccctgtctctactaagaatacaaaaattagccgggtgtggtggcgcgtgcctgtactcccagctacttgggaggctgaggtgggagagtcacttgaacctgggaggcggaggttacagtgagccgagatcgtcccactgtactccagcctgggtgacagagcgagactctttaccccgccaaaaaaaaaaaaaattggttctcatggcttagatagaataacatagtggtgtgaaggaagcaaaagtatgcgtgttccaaagacttcaccatgccattcctttaagaaacaaaagcttccttgtgtgttaaataattcactacataaaaatggaccataggattgggtctttggggttgggggttgtcacttgagcctctgcatccagctgctcggatgtggtgtgctcaggcatagctggcctcctcctgtcacctccacagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcaggtactattgggggctgccagctgctagggctgaagagggaaactttgacagtggtagcagatccatagtggcccatgaaggcacacatggcattaggacagatgagctgcagggtgccgagaggaaggtggccaccagattggccaccagagcttgtgggcccagtgggtggttcccagcatggaggcctggtgtgatagatgccagtgggtagtgttttgggaagggtgagtcctctcgcacatagaggggtctggaagaatggagctggcttcctccctcattgcaggatgctggtcttgaagaatggttaattttcttttcaagttttgctctgagaagccctgctttataagttaatagagagccagtgccaccaaggagagtaaataagctctgtttacaagtagcctttagatgaggctgaacctggggaagcttactctgtccccaggtcctgtcagcttccactgaggcctcccagggcactcaggatgagtatgccctgccacagtctcattctcccatgttccaggttttctgttgcttcttgataaaaaaataaccagcacctagaaatggggatgtactcatgccctcctgtctgtgctgtggtagtttcagtggcttgagccacctcagagaaggctacatctctggtcagttcccaggggagacccagcatttggcagccttcttggggtaccaatatccacacctccccagagctcttgctagggagggaagaccatcaggcagtgcagctgccgcccaccagtgctgcttgctgtgtagttggcacacctgagcaagctcacctgctccagctcactctctctggagggcgtcctctaaaaggagagtgtagccaggcgcagtagctcatgcctgtaatcccagcactttgggaggctgaggcaggggcattacttgaccccaggagttgaagaccagcctgggcaaccaaggtgagacaccatctccccacaaaatttaaaaattagccaggtatggtggtacacacacgtaggaggataaggtgggaggaccacttgagcctaggagtttgaggctgcagtgagttagccatgttcataacactgcactctagcctgggcaacagagacctcatctcaaaagacatttaaaaaaaaaaaaaaagtatgggcagcccaaagatggctcagtcgatcctctgctcctgcagatattcaatgaactggaccaggccggctccacactggccagagagaccttggaggatgggttccctgtacacgatgggaaaggagacatgcgtaaatgccctttctacgctgctgaacaagacaaaggtaggtctgtgtgtcctgagctcccctcctggggcaggtgtagcaggagactccactgatgccatgtctcctattggtgctgccacacaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagcta

SEQ ID NO: 894 - DNA, 34009 bp, Homo sapiens
tcatctctaggccccgccccgcgctgcgtgcccacgttgcgccggcctcgcgccagtccgctgggctgcagggactgcggcgcctgagggagtcgctgacgggcacgctgactggaggctggcggacaggcgacagcgacctgcggcaggtgagctgtccgcgccctcccggggccttccttccgcccggcttctcggaccgcgctgcgtccttcgcgggccctgcctcggtccaggccttcggacctgggcttggccgggccacagccctttgggtcccctgcgccggtctgaggggagacccggccgggggcggccggaagctgggtgaggccgggcagaaggacgaagaagggcgtggaggggctgtcaggggagggcgaaaccgcggacgccgctctccagaagtcgtctccccgggggcgcggggaggcctgaatggctctctttggcgtccccgttgggcccaccctctcccagcgtcacggctatgctgggcgaggtgacccccggggtcgtagctgggggcgtcggcggtgcagacaggggatgccggcagagattggagcccggcttggctgtttcccgggctgttggcattgaccggggctctgcccttcctctaatgcccttatctctataggaagtgccccttgagtgggtgtcgtgacttcacgagtgaaccctggtacgccctggagcagagtcggactgggagggatcaagtgtgggggcagccggttagtccggacgcgggtttacctattactttctgagcgcagtgctctgggtggattaattgccctgcaaaagctgccgggacctccttgcagtctttgcacgaggcctgcctgtgtcatgccatttaaatcgcgtctgggccgggtcggtggctcacgcctgtaattccagcactttgggaggccagggcgggcggattgcttgaggtcaggagtccgagaccagcctggccaacatagtgaaaccccgtctctactaaaaatacaaaaatcagccgggcatggtaacgtgagcctgtagctccagctacttaggaggctgaggcaggagaatcgcttgaacccgggaggcagaggttgcagtgagccgagatcacgccattgcactccagcctgggcgacagagcaagactccatctaaaaaaaaaaaaaaaaaaaaaaaaaatcgcttctgatgagccggttgtcgtggcctgtggctgtccatccttacgtactgtgttttgttgatggcgctacaaaccagacaaggtggagtgtgattgaagaaagaaacgctggccggtgcagtggctcactcctgtaatcccagcactttgggaggccgaggcaggcggatcacctgaggtcaggagttcgagatcagcctggccaacatggtgaaaccccgtctctactaaaaatacaaaaaagttaaacgggcggggtggcgcgtgtctgtaatcccagctactggggagtttgaggttggaggatcacttgagcccacgaagtggagattgcagtgagctgagatcgcatcactgcactccagcctgggtgacagagtgagaccctgtctcaaaaaagaaaaaaataaattatcacaagacaaaatttgtgcttatcaggagttcacagttaagacatatataagcttacttggtgaaattagaaaaagttatcagataaaacattcaggtttaaacactggtgagggtgtgggaatttgtggagccttggaaacacactcattgaatgacctcatctacctggggatgtgaagagggaaatcctgtgattcctccattgtctgacttgatttccttttttccttggctgtggcaacatgttgaagtgctgtgagtcaccaaaagggggaacgtgagcaactctagaaatgccagtgccagtgagttacagacaataaagcattgaccgcctttagctcacccctcatcaagtctgttgaaaacttgtaaaattggacagctagagctaccttgattttttggtttccttttaacagctgactctcttcacaggacagttgggctctacatcaggattgcacccaaaactggaatatcactcctccaggaggaagatatatttgaaaattagaattgtgggcccggtgcagtggctcatgcttgtgatcccagcactttgggaggccgagatgggcggatcacctgaggtcgggagatagagaccagcctgaccaacatggaaaaaccccatctctactaagaaaaaaataataataatacaaaaattagctgggcatggtggtgtgtgcctgtaatccgagctacttgggaggccgaggcaggagaatcacttgaacctgggaggcagaggttgcgatgagccaagattgtgccactgcattccagcctgggcaacaggagcaaaactgcatctcaaaaaaaaaaaaaagaaagaaagaaaattagaattgtgtatttcactgtaaaatttgaaattcagctttaactccttggaaaggaaagagatgaaaaacttgacctagactgggtgcggtggctcacgcctgtaatcccagcactttgggagaccaaggcgggtggatcacctgaggtcaggagttcgagaccagcctggctaacattgtgaaaccccgtctctactaaaaatacaaaaattagccttgcaaaaagtagcctgtaatcccagctactcgggaggctgagcaaggagaattgcttgaacctgggaggcagaggtttcagtgagccaagatcatgccattgcactccagcctgggcgacaagagcaaaacttcatctcaaagaaaaaaaaattctatcagagtgaacaataagtaggatgctagcacatacctgtaatctcagctacttgggaggctgaggcaggaagttaatacttgatgagcctaagtttttggtgtctttggatgctgcttgtcgatctaaggggtttccaaacgcttcttttttggtaaaattgggattatgactaggaatctgttttttggagtttcccaggtgatccttgtttggggtccttgtctaaggcacaggctggaaagaggagggagtggactggcagggaagatagagcagtaagcgaatagaatacctggggaaagggacgccagaagagtgattgttgtctggtgaactgtgctgtcagtgtgtatgtcagaagccaacaaagtggatattctcttcactcagcttagggaaaaaattaatttttgtttcacagatagattcgtttccttcccaggagtattataggcctaattactgtcatagttctcagtaactttaaaaaggctgtggggaagaatggcataacagactagtatcttgtacccagcctgcctttttcttattctattttttttttttttttttttttttttttttttgagacagtcttgctctgtcacccaggctggagtgtggtggcacaatctcagctcactgcaacctccgcctcctgggttcaagcgattctccagcctcagtctcctgagtagctgggattacaggcgtatgccaccatgcctggctaatttttgtatttttagtagagatgaggtttcactatgttggccgggctggtctcctactcctgacctcaggtgatccgtccaccttggcctcccaaagtgctggggttataggcatgagtcgctgcgcccggcttttttattttttattttttatttttttgaaacagagtctggctctttcacccaggctggagtacagtgatctgatctgagctcactgcaatctctgcctctggggttcaagcagttctcctgcctcagccttccaagtaactgggactacaggcatgcaccaccatgcctggctaatttttgtacttttggtagagatggggtttcgccatgttggccacgctggtctccagctcctgacctcaagcgaaccaccctccttggcctcccaaagtgctagtattacaggcgtgagccacagcacccggccttttttttttttttttccttagagtcttgctctgtcaccagggctggagtgcagtggcgccgtctcggctcactgcaacctctgcctcctgggttcaagtgattctccttcctcagcctccctagtagctgggattacaggtgtgtgccaccacacccagttaatttttgtatttttagtagagacggggtttcaccatgctggccaggctggtctcaaactcctgacctcaagtggtccacccactttggcctcccaattagaattagaggtggagcgaccgtgcccggctaagggcctactattttttttttttttttttgagacagagtttcactcttgtcacccaggctggagtgcagtggtgtgaccttggttcactgcaacttccacctcccaggtttaagcgattctcctgcctcagcctctggagaagctgggattataggcgtctgccaccacgcctggctaattttttgtatttttagtagagacggggtttcaccatgttagtcaggctggtctcaaacttctgatgtcaggtgatccacctacctcggcctcccaaagcattgggattacaggcgtgagccaccgcgcccggccaggcctcgtatttttgcttttgctcatgttttcatgtctgagatagagggcctactattaaagcactgtgctgaggctgcaagaaggtactagtgtgattaaaacaatctggtccgggcgcggtggctcgcacctgtaatcccagcactttgggaggcggaggcgggcggatcacgaggtcaggagatcgagaccatgctggctaacacggtgaaaccccgtctctactaaaaaatacaaaaaaaattagccgggcatggtggcgggcgcctgtagtcccggctactcgggaggctgaggcaggagaatggcgggaacccgggaggcggagcttgcagtaagcagagatcgcgccactgcgctccagcctgggagacagagcgagactccgtctcaaaaaaaaaaaaaaaaagaaaaaaataaaacaatctggcattataatgccatcctgattttagttaatctagttgactggctggcctcataagtagctgtgatgatcataatttttatgcgaaacacctgtcattgagcatacaggtgtactgaaagaattgggtggaacagggtatttgaaatcagaattgttctggaaagtcgggtacataaagctctatctttagcacagttgtctgtattgcacaattaatatttatagaatggtacaccttatgttatctttttatttttccacctaactctctctctagattgaaaggtacttgacgtgcagagcaagatcttatctttctttgtagtcacagtactcaagagggtgataaatgtttgttgatgataatgtaatgtcacctgtccaagtgtagccatcatcttcagtagttacttgatctgctgttgtgtctggcaagactgctatgtgctgctgcagaggagccattgtcaccttgaactatctctgtggcagtctggaggagggcaggagggagaagggaaggaataaatgagcaaagctgagtgtggatagtagtgtttgacggcagatgaaaaagcaaacttggtgaagtgtggcctgggtggtcatctaacttctacctagaagacattaaacctttactctcttctttttatgtaggaaggcagagggaaagtcaggccttcggttggcttggtaatagcaggtatcccagtaattagaaaataacttaaaaaactccattcctctaccatatacttgagaatttgtcaatctcagcaaaattttcaaatgtctgtgttcagtgtcatatttgtcctgctctgtaagactttttgtgtttataaaaaggcaagtggacccagaaggggaaaaatatgctgttctgagaaactagctgctgtaggttatgcttttctgtctttgcttgtggctcttctggttatttgagaaaggcaaaaaaacccaaagtcttttttctactctgttcccacagtcactcaacacaacacttctgataccagatatatgggagttgtttccccatacaccaagcaattctctagtagacacaccggtgcggtgtcctctaagtcagttaaattctgatactctatctggagatagcgtcagatcccaccaattgagggctcagtcccacaaaactgtcccaacttgaggcactagtcacaagtagtaaattgtcacctatacttctgacctactagctataaatcgaaagttctgacaatccctcctcgagtttgattaatctgctagagtgggtcacagaactcaggaaaacactttacttacatttaccaatttactctaaaggatattaagaaggatacagatggctgggcgtgctggttcatgcctgtaatcccagcactttgggaggccaaggagggcagatcacctgaggtcaggagtttgagaccagcctgaccaatgtggtgaaaccccatttctagtaaaaatacaaaaaaattagccgggtgtggtcgtgcatgcctgtagtcccagccactagggaggctgaggcaggaaaatcgcttggaccctgggggcagatgttgcagtgaaatgagatcacgccaccgcactccatccagcctgggcgacagactggaagaaaaaaaaaggatacagatgaatagccagatggaagagatgtatagggtgaggcatgtaggaagaggcatgaagcttctacgccctctctggaactttcgtgtattcagctatcctgaagctaatgcaaaccctggtgtgtgtgtgtgtgtgtgtgtgtgtgtgtgtgtgtgtgtgtgtgtgtgtgtgtgtgtgtgtgtttatggaggcttcattacaaaggcataattgaatacgttattggccactggtgatcaactcaacctttagaccttctcccgtcccctgaggttaagggggtagggctgaaagttcccaccctctaatcacatggttggttccccaggcaatcagcccccatctaggagcccaccaagagttacttacttacaacaaaagatgctcctattacccaggaaattccaagggatttaggaaattacaaaagttttaggagctctgtgtcaggaactgaggttaaagaccaatatcagaatgaaggattctcctagtgcccccatctacaaaggttttaggagctctgtgccaggaacctagggtgcagatcaaatatatctataaatctttttgtttgtttgtgttttgagacagagtcttgctgcgacacccaggctggagtgcaatggcgctatctcggctcactgcaacctccgcttcccggattcaagcgattctcctgcctcagcctcccgagtaggtgggactacaggtgtgcgccactatacctggttaatttttgtatttttagtagagacggggtttcaccatattaaccaggctggtcttgaactcctgacctcaagtgatctgcccacctcagcctcctgaagtgctgggattacaggcatgagccgctgcatccagcctcaaatttatctctgtatcttcttctaaattacagtatcacacccgtgcatatgcccaaaaatttttttttttttttttttgagacggagtcttgctctgtcgcccaggctggagtgcagtggtgcgatctcggctcactgcaggctccgcctcccaggttcacgccattctcctgcctcagcctcccgagtagctgggactacaggctcccgccaccatgcccggctaattttttgtatttttagtagagacggggtttcaccgtgttagccaagatggtctcaatctcctgacctcatgatccacccaccttggcctcccaaagtgctgggattacaggcgtgagccactgcacccggcctcatatgcccaaattttaaaggaggcaccacattcaagtccaaatgcctaaaggtagaaggatcaagaaacagtagtatgaggccatttgagaagtatatatagttatccctcagtatctgtggagattagttccaggacccctcaagggtaccaagatccaggatgctcaagtttcttttcttttcttttttttttttttttttgagacggagtcttgcactgtcacccaggctggagtgcagtggtacgatttcggctcactgcaatctccacctcccgggttcaaatgattctcctgcctcagcctcccgagtagctgggattacaggtgtgcaccaccacgcctggctgatttttgtatttttagtagaggtgaggtttcaccatattggccaggctggtctcgaactcctgacttcaggtgagccgcctgccgcgggctcccaaagtgctggtattacaggcatgagccactgtgcccagcttaagtttcttatataaaatggtgtatagaatttgcatataacctatgcatatcttctgtattctttaaatcatctgtatttataatacccaatacagtgctatgtaaatagttgttatactgtatcgtttaggtaatcatgacaagaaaaaaaatctgtacatgtgtagtacatatgtagccatctgttgttttttttttccctgaagattgattggttgattgagacggcatctcactctgtcaccgaggctggagtgcagtggcgcagtcttggctcactgcaacctccacctcctgggttcaagcgattctcttgccttagcctcccgagtagctgggattacaggtgcctgccacaacccccggctaatttttatatttttagcagattccgggtttcaccatgttggccaggctgatctcgaactcctgaccttaagtgattcacccacctccacgtcccaaagtgctatgattacaggggtgagccaccatgtcaggcctttttctgaatatttttaatctgaggttggttgaatccactgatgcagagcccatggatatggagggctgactgtactgtattgagcttctaaggtatgcagagtattggcactgaggggatgtgcaaatacaacaacaaaccaagcatagtctttgtttactaggagctggtagtaactgtgggaagacacaaaacagtaaaatcactttgtaaggtttatgagagttttgagaggccagggaagttaaagagtggagaaatggagaaaatgggagaacttgtactgaacccattaggacagaggaggaagggaagagaaggaaggaggccaaagaaagaagaaacccttcttagagcactcagggtcttactgaaaactttacccataaaaagagaatgtcactgatagactccttttagaacagggattgatttttttgtttttgtttttgtttttatttttgtttttgtttttgagagaagtctcgctcttgtcccccaggcttgagtgcaatggcttgatctcggctcactgcaacctctgcctcccgggttcaaacaattctcctacctctgcctcccaggtagctgggattaaggcacctgccaccacgcccggctaatttttgcatttttagtagagacaaggtttcaccatgttggccaggctggtctcgaactcctgacctcaggtgatccacccacctcagcctcccaaagtgctgggattacaggcttgagccaccatgcctggccacaggcaacatttttaaaccatacgattgtcctggagagagaatctgaagccttgctctgattctgaaagggatttgcaaccaaaaaaggataaggattgttctgacaagtaccctttcttcccatcttcaaaagtacacatctcttaatttgtgtcttcaaacacaaattgtgttcaaaaaaggaagtatttgagtagattaaagacagaaaccctaggacattcctttgtaaacaaacagccttttaccaaacaccaactgtcaagggacttgcctgagtacttgtccaaaggacagcgtgtccccatgtgtaggcagtggtctaatctggttcctaggagaggactgctgaggccacagcaacttaactggctagtgtgggtgaggcagaagtgtttgaagctcaaggtctgtcaaggacagctgattagagtatgtctgtccctaatacagggttagagctcagtaccaatgctggggatgaggtgagttgaagacacagaaactacatggttttttggaaggtcacgaacttttcaaggaactagtgggcaactggaaatgatatgtgaaagagtagagggagctctggcctagctgccagaaaactctgggcaggtcaggtctgggaacagtggctaatccaggcccagcttcccactgttgatttggacatacaggcctaagataagagaccgtgcccagagccactggtcacttagcacaggtagtgggaaatggtagccagcaaatgtttaattgaatatcttatgtctcctagaccacagctgagcaaactaggccaagctcaaggtcctgaggggaatgaggagctgagctcagtcccttttggccccctttctctttccctcctcattttaagtatggaagctcacttatttcctttttgtattggccatttgtgtagggttttgtttgaaaaagggcttgaggctgggcgtggtggcccacgcctgtaatcccagtactttgggaggccaaagaaagattgcttgagcccaggagttcgagaccaacctgggcaacatagtgagaccctgtctctacaaaaaaatttttaaaattagctagacatggtagtgaatgcctgtagtctcagctgctcgagaggctaagttggaagtatcacctgagcccaggagttgaggctgcagtgagctctgattgacccagtgcacttcagcttgagcaacacagcaagaccctgtctcaaaaaaaaaaaagaagttgggcacagtggctcaggcctgtaatcccagcactttgggaagcctaggtgggcggatcacctgagatcaggagtttgagaccagcctgacctctaaaactacaaaattagccaggcgtagcccagcggctcatacctgtaatcccggcactttgggaggccgaggcgggcggatcacctgaggttgggagtttgagaccagcctgaccaacatggagaaaccccatgtctactaaaaatataaaattgctgggcgcagtggctcacacctgtaatcccagcacgttgggaggccgaggcgggtggatcacaaggtcaggagatcgagaccatcctgtgaatggcgaaaccccgtctccactaaaaatacaaaaaattagctgggcgtggtggctggcgcctgtagtcccagctccttgggaggctgaggtgggagaatggcgtgaacccgggaggcggaggttgcagtgagctgagaacaccagcctgggagacagagcgagactccgtctcaaaaaaaaaaaaaattagccgggcgcggtggcatatgcctgtaatcccagctactcgggaggcagaggcaggagaactgcttgaacccgggaggcggaggttgcggcgaggggagatcacgccattgcatgccagccttggcaacaagagcgaaactctgtctcaaaaaaaaaaaaaaaaaaaaatgtagccgggtgtggttttgcatgcctgtaatcctagctactcaggaggctgaggcaggagaatcacttgaacccgggaggcagaggttgcagtgagctcagaccgtgccattgcactccattgtttcgctgcaacgagagggaaactccatctcaaaaaaaaaaaaaaaaaaaacaggcttgagtatacctctcacagccctggagaatgcctgagctgttggacagttgccttttccattatgtctgcttttttctaaagctattcattcattgttgcctaatcatgtcctcagtcagtagttgatgttctgggctatttgaatttcctctgaataatgattaatggagataatgatgtttgaccagttctgggaactcttgggaattaaaggaattaaactcttggacattaaacttcactttaatgtgtatagttgtgggtgctgccccattggagaagattgtgacaggaagttacacagttttacagcaaactgctgggattttttatttttttttcagtaaattatgataactgtagcattttcctttgcaataatgataacctaaggccttggtgtttcctctaaaatgtacatagatacaggatgtgggtttgttacaaagttgtataactattgcctttttgtggctgaccccttccctagagaacaacatgaagagaccttgctgctgctatgaaacccagactctaaggacaacttgggggacattggatattttttcacagatgtagacatcaaggagtcagtggtttgtgtatgcgttgagtggagaaggctggcaagcatttgctaccatgactgttaaaaatgtgcctgtacatttctttttttttttttttttgagacaggatctcactctgtcacccaggctggagtgcagtggtgtgtttttggctcagtacaacctccaccattgtgggctcaagcaatcctcctgcctaggactcctgagtagctgggatgacaggcatgtgccaccacgcccagctaatttttgtagtttttttgtagagacagggtttttgccttgttgcccaggctggtatacatttctttatataaggagggggcaagtaacacagtgttatgctaccaatcaggctttcagagaccataaaacaaaatctaaaaggtacgctcttagtagtcatatctgtggaatgtaaggaagccagtttaagaccaatgtaatgcagcattttcccttcacacatgaaacagtgagttactcgagcacaaagcatcaaatgcttattccccccacaaggccattcttatctttcaccaagtgtttagtcactaggcagccatcatcctccctccctctctcccttcctcccttactttcttcctttcttccttttgcagtggcacagtcatgggctcaagtgatccgcctcagcctcgcgagtagctgggaccacaagcactcaccaccacatccagctagttttattttatttttaaaaattttttgaaacagagtcctgctgtgtcacataggctggagtgcagtggcacggtcttggctcactgcagccgccacccccagggtcaagtgatactcctacctcagcctcccaggtagctgggactacaggcatgtgccaccatgcttggctaagttttgtattttttgtagagatggggtttcaccatgttgcccaggctggtctggaactcctgtactcaagctatccacctgccttggcctcccaaggcgctgggattacaggtgtgagccattgcgccgagcctcatccagctaattttataatttttggggggaggtagcaacagagatctccatatgttacccaggctggtctgaaactcctggcctcagtgatcctcctgcctcagcctcccaaagtgttgggattacaggcgtgagccaccgcgcccagcccattattcttatatctgagattcacctttaattgccctctgtcatcagcactttgagaatgcctcaattttgagaataccttgtattctggaaatcattcattcagtcaacaaaccctgactggtgtgtaattgggcagtaggaggccaagataaatgacctgtaatctggaaaacaaacatataaacatacacataccataacgagatatgagtgctaggatggatcacaaaaggcttacttaggtagctctgaatataatatcaggcctacaatattatcacttatgttgttttttggatcttatttttagaaacagcacaagctttttcttggaggaaatatagcaaggaagaggggagctgttctgactgaagcagggtatgggaggcccacagcctttcctgctttgcctcctgttcaaagccatcctccctgcagttcactgagaaatgactccttggagctccaaggaagtcctacagctagctagtagcagacctggtagtagaagttagttcttctgattcttagctttcttagcagtcaggtaccagactgataaacgaaaatcaaatttctcccagttatatgttccatcccacaaagaagtaataaacacatttctgtcaggggcttcagcctgcctggatttgttactgggtttgttttaaatgtttagcttccaggcatccaaatacatacaaaaaaggtctattcccaggaacatactgtaacccttttcattgtcatttgtgggcagtgccaagctgcctctaatagcttcttctgtttttttggtggaaattcagtttcctcagaaatctatataagggatatttgataaaggtgactaacaatctcgtctctgtaaattgatgaagggatgagaggggtattagactcatgtcctcttttgaatgcacactgcttttgtggtccggcagggtttctcagcgttagtgctgttgacattttgggctagattgtttgtggtggtggggtatgtgtgtgtgtgtgtgcgtgcgtgcaagcacatttgtgcgctataggacattgagtagtatccctgacctctacccactattgtcagtagcacactcccgtctttcagttgtgacaactaaatatgtctgcaaacatttccacgtctccaaacatgttccttgggggacaagttggcccccagtggagaaacactggattggagattggttgtcatgtgataaaaatgcaaatcagatttgtcacaggacaaagtaaattttcagttacctaattaaacctttactttttataagtcgctctaaagaaacaaaagtgtgtcctgtcttccatcctgattctcggttactggagggcccttcacctaagtcatgttcaggatctccttgaaggagttaaactaaaacaatacaatatcttcccttaggtcttttgcagaatttattttgctaggccgggcactatggcccactcctgtaatcctggcactttgggaggccaaggcggctggatcacttgagttcaggagttcaacactcgcctgggcaacatggtgaaaccccatctctacaaaaaataccaaaaaattagctgggcatggtgttgcatgcctgtagtcccaggtacttggggggctgaggtgggaggatcacttgagctcaggaggtcaaggctgcagtgggccgagattatgccactgcgctccagcctgggtgacaaagtgagactctgtctcaaaaaatatatatattttgctagaaatcccaagatttttctctcttttctttttgtttattttctttctttttttgagatggaatctcactctgtcactcaggctggagtgctgtggcatgatctcggctcactgcaacctccacctcccaggttctgagaagctaggactataggcgcatgccatcacatctggctagtttttgtatttttagtagacgcagggttttaccatatttgccaggctggtctcgagctcctgaccttgtgattcacctgccttggcctcccaaagtactgagattacaggtgtgagccactgtgcctaacccccatatactttcaaacaaaaaatggaaatatcactgtctccatgaaaagccatacaggcagcatcaaaactacactaggggccaggtgtggtgcctcctgactgtaatcccaacaatgggagggtgataggattccttgaggctaggagttcgagaccagcctgggcaatatagtgagaccctatgtctacaaaatactttttaaaattagcatagtggtgcgcacatgtagtcctagctacttggaaggatgaattgggaggatcgcctgatcccaggaggtagagactgcagtgagctaatatctcaccactgcactccagacacagtaaaaccctgtctctaaaaaaaaaaaattaaataaataaataaatggtttacactgagggtcacagactttgagttgaggttcgtcatgaagaatctccattttcattctaatagcactagatacaggctgggtgtggtggctcacagctataatcccagcactttgggaggccgaggtgggcagatcacgaggtcaagagatcgagaccatcctggcgaacatgctgaaaccccatctctactaaaaatacaaaaaattagctggatgtggtggcacgtgcctgtaatccctactactcgggagtctgaggcaggaaaatcccttgaacccaggaggcagagattgcggtgatccaagatcacgccactgcactccagcctggcgacagagtgagactctgtctcaaaaacaaaacaacaacaacaacaaaaaacacaaaaaaggctgggcacagtggctcaccttgtaattccaacactttgggaggccgaggcgggcggatcacttgaggtcagcagtttgagaccagcctgggcaacatgggaataccctggctctactaaaaatacaaaaattaattgggtgtgttggcacatgcctgtagccccagctactcagaaggctgaggcacaggaattgcttgaacccaggagtggggagaaaaaggaaatattaggggacatttgttaagtttatatttttttcttttctcttctttttcctctttttttgagacagagtctcgctctgtggcccaggctggaagctggaattcagtagttcagtcatagctcactgccgcctttacctcctaggctcaagtgatcttcccacctaagcctcctaagtggatgtgaccacaactgcatgccactccctccacccccgtctgcctaccagctaattcaaaaaaatttttttttgtagagatggggtctccctgtgttgcccaggtcagtctcaaactcctaggctcaagcaatcctcctgccttggcttctcaaagtgctgggattacagacatgagccactgggctcagccattaattttaaattgcaagtgacatattctttagtttattaatcagcaccatatgatgtcacagttttataactcatttatctcatttaattctcatacccaccttgtggaattgttatcactgtcctttacagatgaagaaagaaactccaagaaattaagtagctggcccaagtccacccaactgggatgggcagaaccagggtttgctcttggttgtgcctttctacagcctgtgccttaaccacatctatgtgctgcctcttggcctctgtgtggccagtagattctctcatggctaggctcatcttaattaacatttgttgggtgcctactatggctcaggctctagagatcattgtaaaatccagtccactgccccagctcctcgtgtgtcttttgaacacattagtattgtgctgtgcagaaaggacttctgtgcatatgcctgctattacacttgttgaacccaatttctacaaactttcattcagatggagggattcagtcttcttatcatataatacatacagaaatacaaatatttaaatatttatctaaattaatagtcacatatgccatttatacagttagtgagttacagccaagtgacagttgtgatgggaggctgtgtctggggagttacatactggtgaggaaactagaaaacatggctgtcgggccggcactgtggctcacgcctgtaatcccagcactttgggaggccgaggcgggtggatcacgaggtcaggagatcgagaccatcctggctaacacggtgaaaccccgtatctactaaaaatacaaaaaattagcggggcgtggtggtgggcgcctgtagtctcagctactcaggaggctgaggcaggagaatggcatgaacccgggaggtggagcttgcagtgagccgagatagcaccactgcactccagtctgggcgacagagtgagactctgccacaaaaaaaaaaaaaaagaaaacaaggctatgaaaatttaacacattgactgggcagggtaatgcatggtgatctgttttctcttcgctccaatcctgaaaggtttctttgaagagctggagtgtctagaaagctttcctagaaagctagtgtacattttgctaagtaatcactgtgtcacttagattttctgctctttaagtgtggttatgagatgtgttccaaacaatttgttactaaccatgaagttgatgaatgctttgcctttaaaaaaataagtttgggtggggtgcagtggctcatgcttgtattcccagcattttgggaggctgaggcaggcagatcgcttgagtccaggagtttgagaccagcctggacaacatggtgaaaccctgtctttactaaaaatacaaaaattagccaggtgtggtggcgtgtgcctgtagtcccagctgctttgggggctgaagcaggaggatcacttgagcctgggaaatccaggctgcagtgagctatgatcacaccactgcactccagcctgcgtgaaaaagtgagactgtctaaaaaaaaaaagtttggccaggcatggtggttcatacctgtaatcacagcactttgggaggccaaagtgggaggattgttgaggctaggaggtcaagaccagtctcggtttgattgggttaaacattatccctgtaagttggctctcattctgagaagttgtttagagtagaagagagggctgcatttacagctaattgctagtaatttcacatcatctgcaatatattttctggacactctgcccgactagtcctatgggacgttgtcattcatgtgcaaatcaggccctatatactaagggaggaaaacagttgaggacctcctttttttaggcactcttggtgccttgtgcattaagatagtgagtcagaggataagaaggaagcagattccattccccttaccactctttgggtgtaggcagggcctgctggtagtgctgggaaagccgaccatccttctttgagcaagtccaatagctgctgctgctagttctgtcccaccataggcacagtctatgtaggatgagccaaccatatgtggagttactggttcttggtctgggcttgttcctttccccaatttcagtccccaccagaatctgggcagtcattgtgaagaagcctaggaataataccttactctataggcctgtggaaacgtgtaaagataccttgcaggcccagagtgagaaattggagccaccttgttcgattgaccaaaggcttgtcctatggagttactaattttacaggaagtttatgttaacatactttctatccattgcactaccatttctgaggcacaatatatttcagtaggcagaaagatagaactgcttagattttaaatactcaatacatgcttgacacagtttagtctatttctcttcagttactatggcagtgggtgctatagagatgtgcagaccctattgtgacctccctttggtatagggatgctctggagcccctggcttcattgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggtgagtgttttagggacaagcagcatcaacttcggaatcttcaactgggcctgagcacttatttctcagaaataatagaatcttgctcacttttctttctttttttttttttttttagatggagtctcgctctgttgcccaggctggagtgcagtggatcagtctagctcattgcagcctccacctcctgggttcaagagattctcctgcctcagcctcctgtgtagctgggattacaggtgtgcgccaccacgcctggctaataattctatttttagtagagttggggtctcaccatgttggccaggctgctctcgaactcctgacctcaagtgatctgcccgcctcggcctcccaaagagctgggattataggtgtgagtcaccatgcctggcctcttgctcacttttcatactaaaacaacaaattacaggctgtagtttaacctctctactgcatgcataaatgcagtgtggtacgagtgcctctgtagcccataacttcagtttccttgttgctagcagtctgtggtgacactatactaatctcacatgcaggaaccaatgaggattagccagggacacaggaggagtcaccttgcattcagaatgactcaagtttagtctcaacttgaccattagctctctgagtgatcttgcccatgttaattctcttgatcttagtttcttcagagccagtgagacattgcttgaaagtgacttagcctggtatacccaggtctgtcagacttatagtctggtgctctcttgggtgaacttgagggccttctgccaaggcaggaatggcttcttttaaaaaaaaattattttattattatttttttttttgtagagacggggggtctcactatgtttcctaggctggtctcaaactcctggactcaagtgatccttcagcctcggcctcccaaagtacagagattataggtgtgagctaccagtaccagcctccaggaatggcttctaaggcttcaggctgtttatagagaggaaagcacctgggagctgatggcactctcaggtttcccaaaatgacagttctgcatatgcatcttaatcacctactttttttccctccacccccaaatgctattcacagtccttgtttatgatagaagctgaagcttacaggtgacaatttttgtgcctgtatgaaaggaaacatgactgactccacttatccacacgacacctgctttcaaggttgttcagtgttggaataatttttgcttgatggtaacctagggatgacccaaggtttcattagttaaagccagccctgtgggatgcatgaagtctagcctctgtccctgtaaaaatcccaccagaaccattttagaattcactcaggacttcacccctcccgctcctggtgctgcttatggaactaaagaatcctcatcttctcagccctgggacacattgtcctcatataaagcgaggtggcaatcagggaacaggggcgagtcttgtgcttatttcagttataataggaaggctctaccaggactcatcattgtcccaacaatagtcgattccaggccccttctttgaactcatttcagtgtctcaggttctgtccttggtgtctgtcttcactgcttgctcagttgtatttgaacatggctagagatgagcacacttctcttctccagtaaaaaagcctgcaagaaaagtcttggacttcttgaactgctattcagttgtcttttttattcaatgtattttttgagatggagggggtctcactttgttgcccaggatggtgttgaactcctggccacaagtgatccttctgcctcagagttccaaagtgcagagattacaggcttgagctaccacaaccggtctcttgtcagtttttgaggttacttaagaggttaatgcctttaaattagtttgcagttgttttgcttttgcctgccttcttgcccaaatgcgcaagtgcttatttagtaatctgactcaagtgctttgtgtccccagagtccccacttttccaggattcattgtctttttttttttttttttttttttgagacacagtcttgctctgttgtgcaggctggagcgcagtggcactgtcggctcactgcaacctccacctcctaggttccagaaattctcgtgcctcagcctcccaagtatttgggattagagtcacacaccaccacacctggctaatttttttatatttttagtagagatggggttttgccatgttggccaggctggtcttgaatgcctgacctcaggtgatctacccgctcggcctcccaaagtgctgggattacagacatgagccaccacacccggctggattcagtcttaacttgctctttttttttttttgcatctcactcccttgccaggctggagtgcaacggtgtgatcatagttcactgcatccttgaactcctggggtcaaaagatcctcttgccccagtttcccgagtggttgggactacaggtgtgtgtcaccacgcctggctaattattttatttttcgtagagacaaggtctgactgtgttgcccaggctagtcttgagctcctaggcttaggtgatcctcccaccttggcctcccaaagtgtcaggattataggtgtgagccactgcacccagcctggatttgctcttttatcaagaggttaatatttattcttccgttcagtgaaccgtgggattgaattcccccagcgattgaaatgaaagggcttatgtataacatttcctgaggaatggtagtaccagagttcagaggagacctcaggccatttattctataaactcagaagctgtagttctagatgatgtggcttcttcagggtgttgagaagtctctgttatctcgtgccttgttggattagaactgattgagctctgtctgctgccccaaacatgtggctcagccaatctccagtggcatctgcaatgtgggtattctagcctccagtgctcacgtggctcaccttagaaagggcagatattcctatttcctgacgctgctggagaatgaggtctgagtcagaagtcctcaggtgtgacctgcccagaactatctgaaattgctggatttcttgttcttcctcagtgtttaacaatcacccaattgctcattctcaccagcgacttcctcagtaagagctcaatatttgaggtggtgctgcattttgtcaaacattcatgcgtgttagcccacttagtcttcgcagcacacagtggattaatggatttttaaaagctggtatttatgcacgatggaatactactcaaccataaacaagaaggaaattctgtcatttgtgactacatggatgcatctagaggacattatgctaagtgaagtaagccaaagaaagaaagacaaatggtgcatgatatcacttatatgtgaaatctgaaaaagtcagttatagaaggagagtgtaacatgttggttaccagcggctgggggaagggaagggtgggtgtggaaaggggagatgttgatcaaagggtacaaaatttcagttaggagaaataaggtctgatgatctgccttacagcatggtgactatagttaatatggttaatattataatagtattgtatacttcaaaattggtaaaagagtggattttaaaagttgtcaccacaaagaaatgataagcatgtgagctgatggatatgttaataaccctgatttaattattccccaatgtatacatgtgtccaaacatcacactgtaccccataaatataattgtcagttaaaaacttaggagtcaagtcagatctgaagagaagtcaaaacagatttcatacagttaatttagagacatgggacccaattaaaaatttgtattactttacttggtattttagaatttagctgttattttcttgttacacacacaggcacaggcacacaaatcctctatttaactggctttctcagtaggaactccatctgtgtatttgcaacagctgtaactcaggttggatgctccccagggtgctggcctataagtcatattggaccctgatctgaatctgagggaatctggatctctcttgtaggaagcttttggtttaactgggaagacaggatgacagtcagttgtggaagctgaagcgtaatcacctcatattaatatggtggcaattttatatcggagtgagctctgagctgcaaacagccttctaggaagcaggcaggggacccccatccagggtgatggtaagaatcctgatgcccaactgcaaggtgttcagcagggagggagcactcgtggagtcccagtgcagaagtctctgagcagccacttagcctccctgtgtttgtggggtaacaacccgagttcatgttgtgggcatctcatgcagtgtagtagctggtcactgtcaagtgtcactatttcattgagtcagaagcctgcagaattgttctcattccagggagtgagtcagtctgctgttgcttactctcggtgctggctgagctcagcaacctgctctcttccttcagttcaggtttctccagggcaaagaagtctttattgttcctttctgtatgaccagatgggaaatgaattataatatagtccttagattatattcccacctggtagcaatgcactgagttacctgacctgaaatttgttggacttagtctccatggaggaggatttaccatcttcgttgtctcagaagtcctggtagtgcctcatgccagcaatttagcaggagcaaaagctttgagacagtgttctggatctgctgagctggtctaaaggaacctcttttgcttgaagtaactgtgataggaactttgttactgcttctgttagctcaggtgttggaatgagaatcagcagctgatgaggtgaacagctaggagtactggaattatggagtagtggaggtagattttataaacagagggtcccagttttttggaaatgggaaagagagagggtagactggcctttctagaatttgtaacagaaaagaggacccaggagcttccattgactagttagttaatgcagtgcgggatcttagctggtttgcttggtccaattcctgtctctcggtttcttttttcccttcccttcgctgccttcccctccctcttccctttttctttccaagagaattgagtcactccatataaaagaagcagccagttggctaaaaagtccaacaaaaaacaagtatttatagctctccaaatttcccacttgtcattatcagtatacttttgcacacagttatagtcggtgtttgggatcctttttaaaaaaataaaaagtttctgtaggcttttccatgcatgaacacagcttatcaacttgccccggctgtgccaggattccattgttgactgttgtttgagcagtcatgccctttgttcttaggctgtgtgttgtttttttcctaacatcatagtatggctgggtattattttgatacagattacaattactattactatttcttgaagtgtatttcccagagtggaatattttaggatctttttttctcttttgtgggggtggggaacatgtagcttcttgtggatattagacattgaagtctaaaaaggttctatatttatgatttggccctcaattttctagagattccaatggttcctgcaaagaaaagagcattcaagtatagaaaccagccagactaagtctggacatgtagcttttcagaaagtgaaaaaaaattatgtttctgcagttgcaaggtggcctctgaatgccacactgtgtggccactcccttggacagtggctaggccacagggtcgcctcccctggccccagtctgtgggttgaatatgctaaccgagccttcccaggagcctcctctgcccccagcccccaggtctgtacagatggtagttggtactttcagcccgccttgagaactcagtattcttcctgttagctttccttcaaagtaaaatcggtagaacctattttgagtgtagaaaatttgaagtcgtggacagcagattacaaaaaattgcccaccaccatgcctggctcatttttgtatttctagtagagatgggctttcaccatgttggccaggctggtctcgaactgctgacctcaggtgatctgcccacctcggcctccctaaatgctgggattataggtgcgaaccactgtgcctggctcctttttgtatttttcggagaagcacaaggacttgttgtttaattaagcaagactatactctcccagagcatgcagttattattgagtaaaacacagttaatgagatttaatcacgttccctatcactgttgtgcagcatgataagtaggtgcaaatggcaagaagcacgctgaagttactgcagttggtaacctgggccatggatggcacttgtctttgcctcattttgcctgtaagaagcatggggcctgtggtcctggggtacctggaccctcagcctggtgtgtgtgtgccctcagcctggtcctttacttccatcacccatctagaggctccaggaccctttactgcacccctccctcctctagatagctcagtgttttcatcccagcacctttttctctgctgcctgagaactgagcagccagagacaaattttggctctcagggtcctcaagggtgtacagcaaagctgttcttattatttaaagtattttatttatttatttttgagacagagtcttactttgtcggccaggctggagtgcagtggcatgatctcgactcactgcaacctctgtctcccaggctcaagaaatcctcctacatcagcctcccaagtagctgggattacaggctggagtgcagtggctccatctcggctcactgcaacctccgcctcccaggttcaagcgattctcctgcctcagcctcctgagtagctgggattacaggtgtgtgccaccatgcctggctaatttttgtatttttagtagagacagggttttaccatgttggccaggccggtctcggactcctgacctcctgatctgcccacctcggcctcccaaagtgttgggattacaggcgtgagccaccgcgcccggctagcaaagctgtacttttaccaaaaaaaaaaaagaaaacatttataaatcaaggtctgaaggcccatgtgaggcttattctacagcttgcaatgcctgtttttgccccttggtaagtggacgcacagctgggcagccttatgctatctctgtgaactacccatttctggctttgttcataatattcccttgatctggaggccctcccccagccctgccccaaatcctgtctgtgttgagggtcctgccccaggaagccctctgcatactcttccctgcatgtaatacctgcctgctttcacattcttctagactgtgctgtgcatcgtacagttcatcagcattattgcagagtagagtgtctctgatttggagtcaagagaaggttccatttttctgtacatcccgatgtttattttctgagtgttctcagacatcactaagcctcagtcaaaataaagtatgatcatgatgtaacattcattgagtgcttatcacatggtaggcattgtgctatatgagttattgcttgacttcctaaaataatcccagtagagatgctaaatctaaaggtgagagagatggttcaaaaagacctcagtgagcaaaccatgtactataatatcctaaaagataacaaaaatgtaactaggtatctagagaaaactcaggaaggatatgtgccttgggccttttaaggaccatttcttaacacttctgtgttcttcttgacacctgtttctgggtagagcacatagaaaatgctcagtaaataagttctttttccttggcccagtttggcctgatttggccccagttctgtctttgtgagttactttattagttgtcggtgctactgtgctgctattcatgtggaagattccccaaatgggctgcgccttacattgcctgagcagaagccccgagggatggaggatgagcttgccttgttatgggactgtgtttccctggctgacaaaggctcagcatttgcagcaggcaatgggaattgattggccaacttaatatttccttcagcctagcaaagtcctgagtaggctagggacagtctgcttttttggtaactcctgtaggctgccttctgcacaaggcacccagcctctcacaggtaggatgaactggcctcagcacgcttgcagaggggtggaactgtgcgttgcttgccaagctttttgtttccctaaggtttttgaggttttctttgtttttggtaactttcaattttttttttttttttttttttttggacagagtttcactcttattgcccaggctggagtgcagtggcgcgatcttggctcactgcaacttctgcttcgtaggttcaagtgattctcctgcctcagcctcctgagtagctgggattacaggcacgcgccaccacatccggctaattttgcatttttagtagaaacagggtttctccatgttggtcaggctggtcttaaactcctaacctcaggtgatccacccaccttggcctcccaaagtggtgggattacaggcatgagccaccgtgtctggcctaacttttaattttgatacggtcttttttttttttttttttttttttttaagacagtttcgctcttgttgcccaggctggagtgcaacggcgtgatctcggctcactgcaacctctgcctcctgggctcaagagattctcctgcctgagcctcccgagtagctgggattacaagtgtgcaccaccatgcccggctattttttgtatttttagtagagacagggtttcaccatgttaaccaggctagtctcaaactccagtctgcctcggcctcccaaagtgctgggattacaggcatgagccactgtgccctgccttgatacagttttaagcatacagaaaaatggtaagaatagtacaaagaactctcatacctcttccccagattcactgctaggattttgccttgtttgcttttctgacttgccagtgtcccccaccctgcagcatatgcacatgcacacacactgtcttctgaaccatctgacagggagttgcaggcagtgtacctttacttctgaataccccagtgtgtatttcttaggaacaaagacattctcttatataatcgcagtacaattatttttaaaaaccagcaagcttaatgtcaatacaatgctattacctaatacattgttcatattcagattttttccatattccactatggtcccagtaatggcagagctttattttaaagaaaacaatcctggggtgtgtgggtgtcaccttggttacattcgctctgaggaaagcagaaccgacaggtatttggggaagtgactgccgtgggtgccacatcaccagctccttgtgtctctgcaggaccagaggagcgagagcagcaagaaccacacccagcagcaatgtcagcggaagtggaaacctcagagggggtagacgagtcagaaaaaaagaactctggggccctagaaaaggagaaccaaatgaggtgagcgatgggggctggctgcactgaatcaggtgggcccagcacctgtcgtgctcagcacacctggttttgtctgttggcagcactggggagtggccatgggccatgagctctggacccctgggtgcctgcttggccctgcagggaccgcatacagcttcggctgcttagaactctccccactggtccattgtctcatccaaggaggcagggcaggtgctcctgggagtgctgataggatttgatggtagttatccttttttctttttaaaaacttgtgcgtttcctcatctgggctgagaaagggtaaacgcaggcaaagctggctctgttcagtcttttaccacataaaagactgcagggcagcctttccttactctgtatagggacagctcatgctaaacctgagcttccaggccctgttctgcatcattagcctctcatagccctgtcattggccaagttttttttttatcccttgaaataattgctaataataaattgattctcagcacatggatgataacgagctaatctcctaaagaagacagcagaagccagaccatgataaggccaaatttttctcactcttgtagatggattgtgtggacacatgtaagcccctgcccaagtaccaccatctttaggatcacatgttttctaccttgtccatccatccacacacctttacaactgtgtaatttcgttaagcagcacaaacccagcgtcctggccctagcctctcggttgtctcctttgcatccttccgtgcttggtcctagtcacatatagtctcaaagaagctgtgggtccaaggtgggaggaaggcagtagggccatctgaggagacccatggtcacagccttactgaggtgtgtgaattccagaagacacgttccaaggcaggctgttcttagagaagccagcaaatactgaagggaatacagatgtgtgtctcttcgaccactaggtggccacagaagcaaagcattgctcatttgggtggttcccaacacagacacatggacgtgggtactactctcaaggagcaggccacagttatcccttgtgtcctgagtccttggagcagaatgtcatgtctgcttgtcctgtgttccctgacaagttgctgctatttgtgttggagtgaagtgtctgagaagccccagcctccagtacaacaggtggtcaccttggggtgtggactcaatcttctctctatggtcctttctggaaagctgggaagggctaattgacacacaaacacctcccatctctccacagaatggctgacctctcggagctcctgaaggaagggaccaaggaagcacacgaccgggcagaaaacacccagtttgtcaaggacttcttgaaaggcaacattaagaaggagctgtttaaggtttgtgccccgcattgggttccagactgtcatatggggttggggtgggggccttggtcccatgagaaaagtgcccctggagccactctgagggaaaagctgggcttttctccacactccattccttcttgacgttaagctctggctctcggctgggtacagtggctcatgtctgtaatcccagcactttgggaggccgaggcaggtggatcacttgaggccaggagtttgagaccagcctggccaacatggtgaaaccctgtctctactaagaatacaaaaattagccgggtgtggtggcgcgtgcctgtactcccagctacttgggaggctgaggtgggagagtcacttgaacctgggaggcggaggttacagtgagccgagatcgtcccactgtactccagcctgggtgacagagcgagactctttaccccgccaaaaaaaaaaaaaattggttctcatggcttagatagaataacatagtggtgtgaaggaagcaaaagtatgcgtgttccaaagacttcaccatgccattcctttaagaaacaaaagcttccttgtgtgttaaataattcactacataaaaatggaccataggattgggtctttggggttgggggttgtcacttgagcctctgcatccagctgctcggatgtggtgtgctcaggcatagctggcctcctcctgtcacctccacagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcaggtactattgggggctgccagctgctagggctgaagagggaaactttgacagtggtagcagatccatagtggcccatgaaggcacacatggcattaggacagatgagctgcagggtgccgagaggaaggtggccaccagattggccaccagagcttgtgggcccagtgggtggttcccagcatggaggcctggtgtgatagatgccagtgggtagtgttttgggaagggtgagtcctctcgcacatagaggggtctggaagaatggagctggcttcctccctcattgcaggatgctggtcttgaagaatggttaattttcttttcaagttttgctctgagaagccctgctttataagttaatagagagccagtgccaccaaggagagtaaataagctctgtttacaagtagcctttagatgaggctgaacctggggaagcttactctgtccccaggtcctgtcagcttccactgaggcctcccagggcactcaggatgagtatgccctgccacagtctcattctcccatgttccaggttttctgttgcttcttgataaaaaaataaccagcacctagaaatggggatgtactcatgccctcctgtctgtgctgtggtagtttcagtggcttgagccacctcagagaaggctacatctctggtcagttcccaggggagacccagcatttggcagccttcttggggtaccaatatccacacctccccagagctcttgctagggagggaagaccatcaggcagtgcagctgccgcccaccagtgctgcttgctgtgtagttggcacacctgagcaagctcacctgctccagctcactctctctggagggcgtcctctaaaaggagagtgtagccaggcgcagtagctcatgcctgtaatcccagcactttgggaggctgaggcaggggcattacttgaccccaggagttgaagaccagcctgggcaaccaaggtgagacaccatctccccacaaaatttaaaaattagccaggtatggtggtacacacacgtaggaggataaggtgggaggaccacttgagcctaggagtttgaggctgcagtgagttagccatgttcataacactgcactctagcctgggcaacagagacctcatctcaaaagacatttaaaaaaaaaaaaaaagtatgggcagcccaaagatggctcagtcgatcctctgctcctgcagatattcaatgaactggaccaggccggctccacactggccagagagaccttggaggatgggttccctgtacacgatgggaaaggagacatgcgtaaatgccctttctacgctgctgaacaagacaaaggtaggtctgtgtgtcctgagctcccctcctggggcaggtgtagcaggagactccactgatgccatgtctcctattggtgctgccacacaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagcta

SEQ ID NO: 895 - DNA, 34009 bp, Homo sapiens; identical to SEQ ID NO: 894

SEQ ID NO: 896 - DNA, 2168 bp, Homo sapiens
taagtggcagcggcggggacggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctggtgaggacgggcgagggcgcgggcgagggtgccggcgcgggcgggcccgggcgggggcgtccgtcgaccccgcggctgtgacccgcgctcccttgcagatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtggggccgccgcccgggccccgccccccgccccggggtttggctctggccccgtggaaggcaccgatgggtaacacgtctcctgagggtcccctggccgggctgggtcgggtgtcgctgtctccagcaatggggtggggagaggggtctggggctgggaggccgggaaaggaggggcgggggtgggggccggcgctggggctccctcagggctgtgttacatccgccttgctgcctgccattgccaatcctgggagtgggggagtgggatcggtggggaggaagggatgggggaggagcggggattgcttggggagttgggaaacttgagcacagcgggggttgtaaaacttgggaacctcatgttgggcgtgaaggctcttgggatttgtactttgtggtctggaagggctggactgcgggtgttcaggcttcgttgggtggacggggggagcatggggtgcggaccccggggtggggtggcctgggtacgaggggggggagtgcatggggtcagcctccacacttgcttggggaggagggggctgcactgctccgagggagctggctggcttctgccaggccctgcgtgggtctcccattaagtccttggcaaagctggctgctcataccctggcctcatagcttccaggcccctcctgctggaggtgccattgtgtggcaggcctggccccaacccctacctcctgtctgcgcaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtttctca

SEQ ID NO: 897 - DNA, 2168 bp, Homo sapiens; identical to SEQ ID NO: 896

SEQ ID NO: 898 - DNA, 66152 bp, Homo sapiens
ggtgggggctcgaggcgcctccgcggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggtgagcgcccggccccaggcgcggactgctaggcacgcgctggaacgcggacccggcgggcgcgggggcggggactcggggcggggcgccctgctcggccccctccgggcctcgttgctaccccgagccttcgcgcggccccacggccccgatccctaggcgtggctgggggccccggaggaacctgcccgagccgtacctggcgctgctactgcccggcttgggtgaccttggggcagtcccttcgccccgggcacctcagctccgtccttgcaacaggggggagctcctgggggaaaccccgagggcggggcggggtgctgagcgcgggtcccggcgcatcgcttctgcctagaaaactctcattgtcatcagattgacctcaccgcgggggccggctttcgctttctttagtggcttggtgtgaaggccgagccagtggtttgggcaatttccctcccatcaggacggaggctcttggtgtgtgggttggaggagtggggctgggcccaaggagacgattatagttgatcgggaggggccagggtccttgctgagaggacccagccgatactcgggcctctgtgttatggctgagggacgtaagacaccaaggaggaagtgactgccaagatctcagctggatggaagcatagttgggaccgggaccagctgtggggctcccacgtagctttgttcccagctctctttctgcctctattgatgagttatgtgttgactgggagcatctagctccaagtctcaccctccatctcctcgtggggttctttgtggtggaaaggagagaaggaagaggagagagaacttgggcatcatggggacatctagattgggtcctcagatcctggcgtctcatctgatctgatgtctcagtctcctgggtgtctccggacacccacaggccagatttctctgagtgtgggccaggtccacaagtgggggaggactgctagacatgccagggcctgcctgggaccccttggggcctgggaacctgcattttcaacccattccccatgtgagttttacgtccactcaggtttgaaaaactgctctgcccaggttttgtaaggtgtgactaggtgagggcctggggccactgggatgaagtgaggggaaccagcacagtttgggggcactctgaaggggatggactcagagctaggcagaacgcactgttgcctgcctgctggggagagcacagctgtatcccaggcccagcagcgggtcagcctggcctttgggtggttccaccctggggtttccctagaggttccgagggctgatggccctacatcagatggagcagtttgctgttgtcctctttcatctctgatattcttccagcctgcctctggctgagtgaccttggtcgaggttgcttaaccccctgggtcccagtttcctcatctgtaaaacgggctgatgcttatacagccctcagaaccacacctggctcagaagtccccaaatggtagctgctacaattgctcataaaggaagataagtgactagctaatgaccataatcatagtaagcagtggcatgacacagatatcaaaaagttgagtggcacttcctgtcacctgggacctgagctcacttgatgtccgttcttcacttgggctgaacagaataacatacatgtcatttacagcccgcttcgggatcccactgtggctgaaatgtcattgctaatcactcgtggccctccctcccactgagcatccatcgcagaacactcgcgtcagccactattggttggcactggcacccaggtgcaacccatcagctagctgcctgggtcatgttgccagtgccagcagtgttctgcgcccatccagtccacaggtcctctccagctgtgctttttccctttctcttctccatccttccctggggccttgcagatacttgttcttctctttgttcatctcttctggtccttgcctttgtgccgcactggtttcctagactccccgcctctcctgtctccttaatgagaactccgtcaggtcaagggtgggaggcaggccgggcctcagcagcattttggtgtgtttccccaagggcagaccggggaccgtggagacatttgagatgattttaggggttgcccccatggaccattcaatcacccgatgagaaagctttcttttcacatctctgtcaattttgttgattatgtcaaggagaaagagtcactgggtggtaatatatgcatttttaacacctaacactgtccatttttcttaagggaactttcagcatgttctgcagcagcgctcagcttgaatttaatatttgctttgttttcactatatctgttttactcttcatagctttattgagatgtagttcatgtaccacacaactcatccattgtaaacatgatttgatgatttttagttaaattatagaattgtgcagtcgtctggccaggcgcggtggctcacgcctataatcccatcactttgggaggccaaggcgggcggatcacaaggtcaggagatggagaccatcctggctaacacggggaaaccccgtctctactaaaaatacaaaaaaatttagccgggcgtgatggcaggcgtctatagtcccagctacgcgggaggctgaggcaggctgaattgcttgaagctgagaggtggaggctgcagtgagccgagattgcgccactgcactccagcctgggtgacagagcgagactccgtctcaaaaaaaaaggctgggcgcggtggttcacgcctgtaatcccagcactttgggaggctgaggcaggtggatcacaaggtcaggagatcaagaccatcctggctaacaccgtgaaaccccatctctaccaaaaatacaaaaaattagctgggtgtggtggcgggcacctgtagtcccagctactcaggaagctgaggcaggagaatggtgtgaacccaggaggcggaggttgcagtgagccgagactgcgccactgcactccagcctaggtgtcagagtgagactccgtctcaaaaaaaaaaaaaaaaaagaattgtgggtgggtgcggtggctcacgcctgtaatcccagcactttgggaggccgaggcaggcggatcacgaggtcaggagatcgagaccatcctggctaacacggtgaaaccccatgtctactaaaaatacaaaaaattagccaggtgtggtggcaggcgcttgtagtcccagccactcgggaggctgaggcaggagaatggcatgaacccgggaggtgaagcttgcagtgagccgagatcacgccattgcactccagctgggcgatagagtgtgactctgtctccaaaaaaaaaaaaaaaaaaggaggggacattgaagcaacaacaacaaaaaaaagaattgtgcagtcatcaccacaattgcagacatttcccttgtaaaagtttccttccatctgtttgcagagtccctaccccaacccccaccctcagcccatcagcgatctgctttcttttttctttgagatggagtgttgctctgtcgcccaggttgcaatgcagtggcatgatctcggctcagtgcaacgtccgcctcctgggttcaagcaattctcctgtttcagcctcctgagtagcttggattacaggtgcgcaccaccacgcccggctaatttttaaatttttggtacagatgaggtttcaccatattggccagtctggtctcgagctcctgacctcaggtgatctgcctgccttggcctcccaaagtgctaggattacaggtgtgagccactatgcccagccttttctgtttttttttgagacagtctcgctctgttgccctggagtgcagtggtgcaatcttggcttactgcaacctctgcctcctggtttcaagtgattctcctgcctcagcctcccaagtagctgggattataggcactggccactatgccaggctaatttttgtatttttagtagacacggggtttcactatgttgggaaggctggtttcgaactcccgacctcaggtgatctgcccacctcagcctccaaagtgctgggattacaggggtgagccactgcacctggcctgctttctgttcgtatgtgtgtgtgtgtgtgtgtgtgtgtgtgtgtgtgtgtgtgtgaaaagtgtctatttgagtcttttgtccaattttcaaaaactggattgtttatcttacggagttgtaacaaagagttctttatgtgttctggataggattctcctgtcagccatgtgatttgcaaatattttctcccagtctggcttgtcttttaattttcttaatggtgtttcttttgaagagcaaaagttttgaattttgacgaagtctcatttactgctttttaagtggatactgcttttggagttatgtttaagaaatcttgggcccaggcatggtggctcacgcctgtaatcccagcactttgggaggccaaggtgggcggatcatgaggtaaagagattgagaccatcctggccaacatggtgaaaccccatctctactaaaaatacaaaaattagctgggcgtggtggcacacacctgtagtcccagctgctcaggaggctgaggcaggagaattgtttgaacccgggaggcgggggttgcagtgagcctagatcgcgccactgcactccagcctggtgaaagagcgagacaccgtctcaaaaaaaaaaaaaaaatcatacaggcggctgggtgtggtggttcatgcctgtcatctcagcattttgggaggctgaggtgggcggatcacctgaggtcaggagttcgagaccagcctggccaacaaggtgaaacctcgtctctactaaaaatacaaaaatgagctggacgcaatggcgcacgcccgtaatcccagctactcaggaggctgagtcaggagaattgcttgaacctgggaggtggagttgggttgcagtgagccaagatcatgccactgcactgcagcctgggcaaacagtgagacaccatctcaaaaaaaaaaaaaaaaaaaaagcgcaggtgcagtggctcgcgcctgtaatcctagcactttgggagactgagatgggtggattgcctgagctcaggagtttgagaccagcctgggcaacatggtgaaactccatgtctcctaaaatacaaaaaattagttgggtgtggcagcatgtgcctgtagtcccagctaattgggaggccgaggcagaagaatcgctggaacccggagcgcggcagaggttgcagtgagccgagattatgccactgcactccagcctgagcgacagagtgagacgccgtctcaaaaaaaaaaaaacaaatagaaagaaaagaaatctttgcctaggtcaaggtcacaaagattttctcctatttttttctagcattttgttgttgttgttgttgttggttttttttgagatggagtctccctctgtcacccaggctggagtgtagtggcatgatcttagctcactgcagcctctgcccgggttccagcgattcttctacctcagcctactgagtagctgagattacaggtgcgagccaccacgcccggctaatttttggattttttagtagagacggggttttcaccatattggccaggctgatctcaaactgaccttgtgatctgcctgccttggcctcccagattgctgggattacaggcgtgagccgctgtgcccggccttttctagaagttttatagttttagctcttacatttaggtctttgatccatttagagttaattcttttttttttttttttttttaattttgagatagggtcttactctgtcattcaggctagagtatagcggcatgatgtcactctagccttgacttcctggctcaggtgattctcccacctcagcctcccaagtagctgggttttcccagctatgtatgtgtaccactatgcccagcaaagtttttgtattttttttgtagagacagggtttcaccgtgttgtccaggctggcctcaaagtcctggactcaagcaatctgcccaccttggccttccagagtgctgggattacaggtgtgagccgctgtagctgaccaaattaatttgtttcacttatggcttgagataaagatctaaaccccccttttttgtggatggaattcaattattttagtatcatttgttgtagagactatcatcttcccatcaaattgcctttgcacctttgtcaaaaattagttgacctaagccaggcattgtggctggataacaaagcaagaccatgtctcttaaaaatcaaaacaacagcgacaagaaccccaccagttaaccatgaatgtgagggtttattttgggactctccattctgttccattgatttatgtgtgtcccagaagttctcaactggggcatttttgccctctcaagggacatttggccatgtctggagacatttgtgattgtcacagctgggggcatctgttgggtagaggccacaggacagtcccccacaattaagaataaatcggcccagaatatccatagtgcttagactgagaaatcctggtctgttcttagaccagcagcacactggcttgtttacagtagtttgatagtaagttgtgaaatcaggtagcataagttctccaactttgttctctttcaaaattgttttggttatgctaagttctttgcatttccatatacattttataattagcctgtcaattatttctacaaaagcagcctgcaattttgataagtattacattggatatataaatctatgtggtgagaattgctgtctttacagtgctgactctgggaatccatgaacatggtatatctctacattaattttgatatttagcttctcagttgtttttttttttcagataactttacctatttaaggcaagtgatatttgccaatctattactgatatattgccttcccaatctagtagtgataaaaaatttccttttttttttttttttttttttttgagatggagtcttgctcttgtcacccaggctggagggcaatggcgcaatcttgactcactccaacctctgcctcgcaggttcaagtgattctctcctgcctcagcctcctgtgttgctgggactacaggtgcatgccaccacgcccagctaatttttgtatttttagtagagatgggtttcaccatgttggcagggatggtcttgatctattgaccttttgacccgcctacctcagcctccggaagagctggtattacaggcatgagccactgcgcccggctattcttaataacagttttgttgagatctaattcacagcatacgagtcacactgagaacatctagtccagtggttttttttgtttgtttgtttgtttttgagacggagtcttgctctgtcgcccaggctggagtgcagtggcgcaatctctgctcactgcaagctctgcctcccgggttcacgccattctcctgtctcagcctcctgagtagctgggactacaggcacccgccactacgtctggctaatttttttgtatttttagtggagatgtggtttcaccgtgttagccaggatggtctcgatctcctgacctcttgatccgcccgtctcggcctcccaaaatgcggggattacaggcatgagccaccgtgccgggaccagtggtttttggtatacttgtgttgtgcagccatcaccactgtctaattccagaacatcttcatcacaccaaaaagaaacccagtggccatgaaacagtcactcacggccaggcgtggtggctcacatttgtaatcccagcactttgggaggccagggcaggcagattacttgagctcagaagtttgagaccaccctgggcaacacggcaaaaccttgtctctacaaaaaataaaaaaattatctgggtgtggtggcgtccacctttagtcctagctacctggtgggctgaggtgggaggattgcttgagctcaggaggtcgaggctgcagtgagctatgattgccccactgtactccagcctgggcagcagagtgagactctgtctctaaagaataaattaataaaatttggccgggtgcagtggctcacacctgtaatcctagtactttgggaggctgaggcgggtggaccatttgaggttaggagtttgagagcagcctggccagcatggtaaaaccccacctctattaaaaatccaaaaaattagctggacgtggtggtgggtgcccataatcccagctactcaggaggctgaggcaggagaactgctttaaaccaggaagcagagcttgcagtgagctgagatcacgccactgcattccagcctgggcaacagtgcccaggctttatttattgaaaaattaataaaaattggctgggtgccgtggctcacacctgtaatctcagcactttgggaggccaaggcgggtggatcacctgaggtcggaggtttgagaccagactgaccaagatggagaagccccatctctactaaaaatacaaaatgagctgggcgtggtggtacgtgcctgtaatcccagctactcgggaggctgaggcaggagaatcacttgaacccaggaggcagaggttgcagtgagccgaggtcgtgccattgcactccagcctgggcaactagagcaaaactctgtctcaaaaaatatatctatcaataaaaaaaattattattattattattgagacggagtctcactctttctcccaggccggactgcagtggtgctatctcggctcactgcaagctctgcctcccgggttcacgccattctcctgcctcagcctcccgagtagctgggactgcaggcgcccgccaccgcgcccggccaattttttgtattattagtagagacggggtttcaccgtgttagccaggatggtctccatctcctgacctcgtgataaaaatttttttaaaaagggcttgggtttcatagtaggatgcatttgaaggtaaaagcaatcctaacaggctgtgaaaattgcagctgccattgggggcaaccctgtaggcgtgtggtgggaggagcactagcttcagagtcctgggctgatggtagcccctcctgtgccagtgacttcctcagtggccttggccagtgttttgctcaatggggccccaggtttccctggctgagccctgggggtcacctctgattccctgggcccctttcaggtctggctgccagtccatgtgagccagcagggagggacaggccctggccctcgcccagcccagcccagcttttgtttttcatgatgcccagaagttttctggaaaatgttctgtatttcctggatgaccctgaagtggtgaccactcctgcctgcccacctcccagacccggtgccgcctgggtccgacattgcctggctttccccgcgcccttccgctgtgtcccgtgaggctctctagctttgcgctttggggtcatcttgtccagtggacgacggcgtggtgtcgtctgcaccatccctgcagtgcctgacttgtgctcgctgaacagctgtagaattacccggagctcagccctttgctgcgccctaggaggggctggaagaggagcggcctgtgtccctctgcttgtttgtggagaagctgacctggagcagtgttggaggggtccctggatcctgagcgagtgttcggtcatttgcctttccatagacctgggcgaagaagcgagaggtttgaggagtgactgaaatcaagacctgaggccgttagaagaaacaccgtttgctcagtcctttcatccagctcgcgggggacttgggtcctctcacgtggtcttgggtatgtggcctcagcggggcctggcatccctgaggtgggcagaaggttgcattggctccccagggctcagcactggcgccactgctcacataactgaagctttcttctaacagggctctcgccccgcggaacagatgctctctgtgatgtctctgagagcccagactcccagggagccttctggggaatcgaaagaaagaaaagattgcttcagtgctttggggaaaaagtgtgtgtgtacatatactgcacatagacattaaaaatcagaggctgggggctggctgcaggggctcacgcctgtaatcccagcactttgggaggctgaggcaggcggatcacttgaggtcaggagtttgaggccagcctggccaacatggcaaaaccctatctctactaaaaatccaaaaaaaaaaatagccaagtgtggtggtgcacacctgtaatcccagctgctcaggtggctgaggtgggagaatctcttgaaaccaggaggtggagttcacagtgagccaagattgcgccactgcactccaccctgggtgacagagtgagaccctgtctctaaataaattaataagtcaaataaaaaataataaattgaggctaacatattcttttttttttctttttttcgagacagagtcttgctctgtcgcccaggctggagtgtagtggcatgatcttagctcactgcaacctctgcctcctgggttcgagcaatcctccttcagcctctggagtagctgggattacaggtgtgggccaccacacccagctaacttttttttctttttttttgagacagagtctcgcactgtcatccaggctggtgtgcagtggcgcaatattggctcactgcaacctccacctcccaggtttaagcgactctcccgccaaagcctcccgagtagctgggattacaggtgcccactaccacgcccagctaatttttttttttttttttttgtatatttagtggagatgtggtttcaccatgttggccaggctggtcttgaactcctgaccttgtgatctgcctgcctcagcctccagaagtgctgggattacagatgtgactaccgtgcccggcctcagctaacttttgtattttctgttttttttttttaagtagagacagggtttcaccatgttggtcaggctggtcttgaactcttgacctcaggtgatccacctgcctcggcctctgcaagtgctgggattacaggcatgagccactgggcctggccaaggctagcatacatttaggaaatgtacagctcattaatgtgcagtttgataaatgatcacaaaatgaacatgttgagaaaaatagagcagtaccggcccccagaggccccctattgtccccttctgaacaacctgcctcccccttcttccctgggaaccacccccctgacttcctccctgggtgacttctgcttgggtttgagcttgaaagaactggaaggaggcgctcttcttgctccacctcaggatgagatgggatgcaatggccgggcggggtttgtgagcagtgagtgatctggcgtctgctgtgggaccttccagcgtcccagtgctgcccgtggacgggctccgggggagctggggacatccttgtgtctggcggtggtgcccttgagcctgatctctttgggtgcgtttttatgcctggagtggacttgttggggctgttgggtgcattcagccttcgtagattttaaacttttaggagtgaacgaatttgcatgtctgcaggcaagaacaagggtgttggtcgctctgcattcatactggcactaggtagggtgaggggtgtgtgctatttttaattttttttcaattccaccttgaatttctcattgtacttttccctgatgaccagtgaggttgagcgcctttctctatgcgaattggccatctgtttcttgtcctgctgttgaagtgccttgtgaagtcttttacacattaaaacaattgagtggccaggctcagtggctcacacctgtaatcccagcactttgggaggccgagacgggcagatcacaaggtcaggagatcgagaccatcctggctaacatggtaaaaccccgtctctactaaaaatacaaacaattagcagggcacggtggcgtgcgcctgtagtcccagctacttgggaggctgaggcaggagaatggcgtgaacctgggaggtggagcttgcagtgagtcaagattgcgccactgcacgccagcccgggcgacagagcaagactccatctcaaaaaaaaaaaaaaaaaaaaaaattgagtggccaggttcagtggctcacacctgtaattctagcactttgggaggctgaggcgggcagatcacctcaggtcaggagttgaagaccagcccggccaacatggtgaaaccccgtctctactaaaaattcaaaaattagctgggcatggtgttgggtgcctgtaatcctagctcctggggaggctgaggcaggagaatcgcttgaacctgggagatggaggttacagtgagccaagatcgcgccattgcactccagcctgagcgacagagtgagactgtctcaaagaaaaaaacaaaaaaaaaattgagttatctttttttcttactggtttataggagctctttcctaagtgctttttattatggttttaattctttggaaattggccgccttagtgccgtttatggaagctagcccaggcaagaaatggagtgtattgaaggctccgagggaagtcccagtaacctcaggggaaacggacaagtggaagctgcgggaacccagagcctctgttcggctccagcctcagcgccatcctgcagtcctgcagagcgccccagctgctccggcgtgtgtgaggccatcgccacccaccaggctggtcaagggccaagtgctgccgtcgtccctggtcccattccacaggagggagaattcggatggcccagtgtgccagtgtccaccttagggccaaccagccctgtctagggggtgggggccaccctgagggtggtggaggctgtttccagaaaaggggaggacacacccccaacaaaaaaggtgactacagcttatgccccctccgtgccccagcgtctttgcttagtcagagttgttctcagctttgtgttccgcactggaagccagagccctgtatttaatatggtatcacgtttacatatgggaggtccgaaagggacttctagccagtgtgttcacacctgccggaggctcctttgtgttaattggcattttttatcctcaggacgtcctgagtttagggtggccctctcatctcaagtttgcagttaaagaaatcaaggttgggtgtggtggctccctgtaatcccagcactttgggaggccgaggcgggtggattacgaggtcaggagtttgagaccagcctgaccaacatggtgaaactccgtctctactaaaaatacagaaaattgctgggcgtggtggcgggtgcctgtaatctcagctatttggaaggctgaggcaggagaatcacctgaacccgggaggcagaggttgcagtgagccgtgatcgtaccactgcactccagcctgggtgacagagcgagagtccgtctcaaaaaaaaaaataaataaatatctcagcccatgttgacttccccagctgggtgggggactggtagtaggcagggaagcatggtaggcccagggggatcaatgcgtgggtgatacagctgggtgggacccccagagcactcgaaggctgtggggctgccaccccctctggcctcccacctggtgggggcatcctgggacctgatcttgtgcaggtctggcccacctggggtttattggcaatgcagcagctgattttgtgagactggtaagcaggaacacctgtcctgttagaacacgaggagaattttcagcaggtggaatcagtgagctgttcggagcccctgcagacacctcgtggccttcccactcccccttcctcgggtgggaacgatggctgaggcagcccagtgaagtccacccctggtgtcccgggtccctgggccgctgtgtttcttaggaggcagacatgctgggtgtcttcattcacatcctggcttacttcccatggctgacagtgcaggctctggagtctgcccaggggtcccagtgagaatgtctctcactggttgtgtgacctgagcaggtcactcagcctcaccgggccagtttccctgactgtcaaacaccagtaacaacagcatctgctttcattcattaggtgagtgttcatccagctcttaggcatggagcggggaggtcatgaggatgcggggccgtggacagttgaggatgatgcctacttttgggctggggaggacagagggaaccaacaggtacacgagataaagcagcagtgacactatgaggagaatggcggcgggagcgttgaccacgagctggcagttggcctgcgtggtggtccaggctggcctcaccgcggcatcccaaggagggaatagcccaggccgggaaggtggggcggggtgggcagggcatgtggaatcactggtctgcagagcggggagcttggccatggccttcaggtcagggtgcagcaaccttcaccattgggcatcattaggctgggggcatctggaaggtcaggaggaagcctgggctacctaggatggaacaggcaggacagttgtctccaaggcctgcctatgacttgggcatcctgtccccagatgcacagcgtctgccccctcggtgcgggaggatgaggaacgcctgcctgtggatccacacatggtccccgtattgggggtgtggaggaaaggcctttctgacatgatctgagcccggcctctttctcttaggggtgtaccagggttggtgggtttggaggcaaatgcatttcaagggtccagatcacgaacctctgacccggtgggccctgaactctggtctgataaacatgggtcagacttctccctgaaaactgtgagcgtggagttcaggcacaggcaggcggggcaggtgctttcaggcttgatagcaagaccctactttactcatctgccctccacgctccgcggctccgacggtgtttgctgcggctcctctgctgcgttgagtccgtctgtgcactcagatggcctgtgcttcgcctttcgcccgcgttcttgggaggccttgccgcgtcccgggcctcccgcccttccaaggttggcttgtttcagtgattcggaatgtccctgttttcctctcgcagatgtctggtggcgttcattgcacactgtgtaccacaagatattgacaaggtgcaagagacacaagacgggcccagaaggcttcttggctcactctgtggcctgtatggaagggacagggctgtccccctcccctggccatccccaagacagcctctgacctgtggccttgtggttttggtttttctcagctgtagagatgacaaacgtatgtatcctcctgcctggaggcatgtgtggagagcattgaggctgttcggggaatgcctcgaggcctcccacggaagggattttgcagttttcatttctgtggctgttgtctccctgtgcaggttgcccggacacctgcaagccacccagagtccgaatccctcgggcagggaggcagtgaactgctgggctccagtccccctgggggtgacagtaaaccaggggagaaggatgcctttgttttagtggtgttcgaggactgccctgaggccctgggtccttgagtgtgttggttccacatagccgggatttccaggacaaccttgggaccctgtggcgtctgtcgggctctgtgagcccacaggaggattttcagccattctgctggggaagccccttgggtgtggttttttgtgtgtgaacagtgcccattgtcactggcgatgacaccactgactcctgtccccgtggtcccccggctgcaggaggggaggtgcccagcacagagactgagaaacaagtgggctctggagtcggggtgtgcgccccagctccaccgctgatgagcttgggggccttagccaagcttcgtttcctgtatgtttgaaagtgtgggccttgtctgcccctctttccttggggccagcgggaaagggggtgaaggcgctgacctcagcaggtgtggagggagagcctggtgggtgtggttccacctgcgttctttcacctccacagctgccttcccacttcccactcacagtctccttttctttttcctccacccccttggcagcgctgcctgctcctcttggtcctgagctggtgcacatacaaatgtacacagctcatgcacgcacacaccacatgtgtgtcattcttcttgaggcaaaggaaagggcggccccgcccctaacacttccccaggcctggtcccttcctcctgccccatcagggacctagggtctccttcccgtgtttcttctccatgtgtggatacccatgtgtgagcaataggattttttttttgttttttggagacagagtcacgctgttgcttgggctggagtgcagtggcccaggggcccaatcatagctcactgcaacctcaaattgctgggctcgcatggtccttctgcctcagcctcttgagtggctggtactacaggcacataccactgtgcctggctactttttttttttttttttttaagacagcgttttgctcttgttgccccaggctggagtgcagtggtgcagtctcggctgaccgcaacctctgcctcccaggttcaagtgattctcctgccttagcctcctgagtagatgggattacaggcacccaccaccatgcccagctaattttgcatttttagtagagacgggagtttctccatgttggtcaggctggtctcgaactcccaacctcaggtgattcgcctgcctcggcctcccaaagtgctgggattacagatgtgagccactgcgcctggccactttttgtattttttgtagagacagggtctcgccatgtcgcccaggctggtctgaaattcgtggcttcaagccatcttgcccaccttggcctcctaaagtgctgggattataggcgtgagccccctcggctggcctggattctctgtgaggtgtttccagttcttcccagttggtctcgtctcctgcaggtgtgagttgttgattgtctgcgccgtgttgatcacgtagaccctgttcttgagtgctgagggtccatccggtaaccctgcactgtcatgcatttccctgtcagcatatgacttggttccttttttttttttttttttaaaaaagaccgtcttgctctttcgcccaggctggagtgcagtggcgcgatttcagctcgctgcaacctctgcctcttgggttcgagagattctcctgtctcagcctcccgagtagtggggattacaggcatgagctaatttttgtatttttatttatttatttatttttgaaacggagtcgtcttctgtcacccaggctggagttcaatggtgtgatctccgctcacggtaaccttcgtctcctgagttcaagcgattctcctgcctcagccttctgagtagctgggattacaggcatgcaccaccacggccagctaatttgtgtgtgtgtgtgtgtgtgtgtgtgtgtgtgtgtttttagtagagatgggggtttcaccttgttgccagactggtcttaaactcctgaccttgtgatccgcccgcctcggcctcccaaagtgctgggattacaggcgtgagccaccgcacccggccctaatttttgtatttttagtagaaacagactttcccatgttggccaggctggtcttcaactcctgacggcagacctcaagtgatttgcctgccctggcctcccaaagtgctgggattacaggggtgagcaccgtgcctggtgggttataatttttaacgcttgaattttttttttttttttgttaaagggtctggctctgttgcctaggctataatgcagtggcttgatcagggttcactgcagccttgacctcccaggctcaagtgatccttccacctcagcctcccgagtaccttggactgcaagtacgcatcaccgtgctagctaattttttttgttttgttttgttttgagacagtcccactctgtcacccaggctagagtgaagtggcacaatctcagctcactgcagcctctgcctcccaagttcaagcgattctcgtgcctcagcctcctaagtagctgggactataggcacacaccaccatgcctggctaatttttgtatttttagtagagatgggatttcgccatgttggccaggctggtctcaatctcgatctcctgaccttgtgatccactcctctcggcctcccagagcactgggattataggcacgagccactgagcctggactaatttttgtatttttggcagagatggggttttgccatgttgtccaggcaggtctcgaactgctgggctcaagtgaacctcccaccttggcctcccaaagtggtaggattacaggcgtgagctactgtacccggccttgcttgatttttttttttttttttttttctgagacagagtctccctcactgcaacctccgcttcctgggttcaaggaattctcctgcctcagcccctcccaagtacctgggactacaggcgcgtgccaccacacctggctaattttttgtattttttagtagagacggggtttcaccgtgttagccaggatggtctccatctcctgacctcgtgatccacctgccttggcctcccaaagtgctgggattacacgcgtgagtcaccgcgcctggcaaaaatcttgtattgatcatattgtgtgtctgcaaccaaaatatgcgcaccaattgaaattagaattttaaataattttacatcataagctgtgagtttttcgtgttttgaatggccattactaatacccaattgatcaaacaaatattccagtttttatcaataacaagaagaaatacgaaaaaacattggaaatatgtctcttgagtagatgggttcctttttctcctggttaattcatgcattcacagttggatacaagctgttgctaaaatgatttcagcctcaatgctagttttttttgtttgtttgttttttttgagatggagtctcgctctgttgcccaggctggagtggagtgaggtggtgcaatctcggctccctgcaacctctgcctcccagatgcaagcaattctgctgtcttggcctcctgagtagttgggattacaggcatgtactaccactcccggctaatttttttttgttttgttttgtatttttagtagagatggggttttaccatgttggccaggctggtctagaactccttacctcaagtgatccacccccctcagcctcccaaagtgctgggtttacaggtgttagccaccgtgcttggacccctcaattaccagtttttttttttttttttttttgatggagtttcactcttgttgtccaggctggagtggacagctggcccaatctcagctcacggcaacctctgcctcccaggttcaagcgattttcctgcctcagcctcccaagtagctgggattacaggcacacaccaccacgcctgggtaattttgtatttttagtagagacagggtttctccattatggtcaggctggtctccaactcctgacctcaggtgatccacccaccttggcctcccaaagtgctggaattacaggtgtgagccactgcacctgggttctgttttttaagttgagaaaccttgataacatcaattagataggaattagcaagatttttatgtaacaatagcatctatttccaagttacttcacaaaaattgacataaaaacctagtacaaaaattaatgattcatcacctcacaacttacgtccttccagttaagtttttttgaggtaaaattcacttaccatggggacacctttttaaagtgtacaagtcagtgatttttggtatattcagtcatgcaaccattaccttgatctaattctagaacatggtcccagttttgtgatattacaaccattgctttaacaaacactcttcttccttgtctctaatcttttaaaaataatttttcttgttttacaaatgatatatgttaattgtagaaaacttaattttaaaaagataaaggaaaaaattaataatcacttattacctatgcaggtgttttagtttgtagcatttgtttctctgaagttatttatatgtatatatgcgtgtgcatatatatatagagtgagagttggcgggggtgggggtggtggtggggggacgggaagagagacagggtcttgctctgttgcccaggctggagtgcagtgtggtgtgatcatggcttactgcagcctcgaactcttggactcaagcgatcttcctgcctcagtgagtgtcctgagtagctaggactacaggcatgcgctgccatgcccagctaatttttaagaattttttgtagagacagcgtctccctatgttgcccaggctggtcttgaactctggggctcgagcgatcctcctgccttgatcttccaaagcgcccaggcatgaaccactggcccagcttaattactttctctgaagttattgaagcttaaaactacatacagtaagatcttagagcctccagcctagaacaccaggctgaaaagtgctgtggagaagaataaggctggaaaggggagtggaaagattggttggcaagctggggtgtgggaggcttggcaagttgtaaaaggggtgtcagaagaggcctcgtggagagagcagcctgaggtagagctggagctccagggaagagctggatgagctgaggactccagggccccgaggtgtgagtgggccggggctggcagagtggccttgtctggggcctcggaggctactgggacctgccccagtgtggctgggacgccagcagagttttgagggcagtgggtccagaaacaacagacctggggacccaggggatgtggggaggctggtgaatgggcacagtcacagggcagatggtgccagaggctctaaccagtgctgtggttgtagaaatgaaatcgaattgggagtcaggagaggagaaatgacagtcacgtagaccacgtctcagaaagactcgacgtctctttctgggtgactccttcagagtgtagtggcttagcacagtgagcacttcctaccttacggtgagggtcgggattgggagcggctccgtcggggggctctggctcaccatcactcgtgagtcctcactcaggctgtgtcacggtggctcacgcctgtaatcccagcactttgggaggcaaaggtgggaggattgcttgtgcccagcagtttgagaccagcctgggtagcatagtgagaccccatgtctacaaaaaataaacaaaaatgagccagacattgtgcacactgtgatcccagctacttgggaggctgaggcaggaggattgtttgagctcaggaggtccaaggctgcagtgatcgtgcccctgcactccaacctcggcgacagagcaagaccctgtctcaaaaaaaaaaaaagctgtgggtgggctgtggtcctctgagggcttgcctgggcatggaggggctgcctccctggctcacaggcccggcatgccggtgctgggtttagcgggaggcctcaggtcctcccctcgggacctctccatggggctgcttgggtgtcctcacagcatggtggcagcttcccccagagccttagaagccacacaccatcattttcatgcagtctctgtggtcatcatttcatgcggtcacctggtcagccctgttcagtgtgggtgcagtctgcccagagacatgtcggccgggaggtgagatgcgctgggggccctcgtggaggctggccacctcgctcatcttctgcctacagcgggggcttcttggacacaaagtggttgtgccttgaaggtgccctgggaggaggttggagcaggaggcttctggaccagggacctgtctcctgcctggggccatggagtgcccagtgcctcggcctggaaggcctggcagggacaagcccgctcctgagtgtccctccagaccaaggctgcccggccttctggaccccacctcagtacgtcagcgctggggagagcctggaagggtgggggctgatcactgctaagggtgcccccgacgatgggtcctgggctggtcagcagggtcactgggcttcccacaccctcttgccgtgctgctgtggcccttgtctgccagcagctagtgcgggggttcccagcagccgagtccttcatgtggttttcatgaacatggtgcacatcttggaggagcaggcaggtggctctgggccgggccctgtctcagccctgctccatgactggggcttgaggttggtctgaggccagcatccggagaccaccgtgccctgaggcacggggtgccttgtggcccctggccccgccccgtaggctgtgtggaaaattcacctttaaagactttgtgtatttcaatgtggtggggctatgttcaaggcccaggtaatcagggaaggcatcctgggctcactgtactgcaggtgttctttctttcttttgatttaaaaccaccacataggctttgctccacccctcgtctgctctgcaccaatttccctggcagccttgtgggcgtgtccttccagaacattctctgtgtattcacaatttgtgttgcgcacatctcagtgcgtgcggtgacccctcagaaaatgatcttgcagtgtgttaacttgttttctttaacctgcaaatactctgtgactcgctccacatcggtatgtctggatcagcttggttccagcagctgtgtggtgggccataaaatcagggcgtcccacttgctgaagcagttgccgctttcttctttgtttttggtcgtcatcagctctcagtggtccctgttctgcatgctgggttaggtggggctgcggctcccaaccactgttcctggcagtcagcagccatgctgggcacctggctctgggccacctccctcaggaggagcaccctggaatcactgttggggcccggctggtcttggtggccgtggctgtgccaactgtaactggggccgtggttctcgggaaggacacagaccatgcagcgcctgaaggtctcagaattcccgctgaaggccccgggaagggcccacctggcctcaggtgggaattctgagaaggaatagggattctggggcccccagtgggaattctgagaattcccagaagtccctgcaatacgtgaggttgaggaccatgtattctgagcatccttgaaatccacaggtccctgcagctacccgggtcctcccctcggagactcttcccgtggtcacccggctcctcctcccggggactcttcccgtggtcacccggctcctcctcccgcgggctcttcccgtggtcacccggctcctcctctcggggactcttcccgtggtcacccggctcctcctcccggggactcttcccgtggtcacccgggtcctcctcccgggggctcttcccgtggtcacccggctcctcctctcggggactcttcccgtggtcacctggctcctcctcccgggggctcttcccgtggtcacccgggggctcctcccggggctcttcccgtggtcacccgggtcctcctcccgggggctcttcccgtggtcacccgggtcctcctcccggggctcttcccgtggtcacccgggtcctcctcccgggactcttcccgtggtcacccggctcctcctcccggggactcttcccgtggtcacccgggtcctcctcccgggggctcttcccgtggtcacccggctcctcctctcggggactcttcccgtggtcacccggctcctcctcccggggctcttcccgtggtcacccgggtcctcctcccggggctcttcccgtggtcacccgggtcctcctcccggggctcttcccgtggtcacccggctcctcctctcggggactcttcccgtggtcacccggctcctcctctcggggactcttcccgtggtcacccgggtcctcctctccggggctgtgtgccaggagaaatggggctggatctgggcgtcaggtcaggaatccaggggagaggccatgctctcagtgttccttggcagggctgtgagcgcaggtctctgaggatgcccagctgtccatcccctcctcataggagaagcgcagatctcatgcctaagtgtgccagggtcctgatgggcgccacctacagcctcccgccctcacgcgggagtcagactgaacgaactagcccagatccacagagacttctaaacccggctgggtgctgccatggaaagtacacagggctcagatttgggggtaaggtgacttagcctggggtcacgaaatgtgtaaggatttcttggggtggctgtgacaaatgacctctaaccgtggcttgaaacagcagaaatgtattctctcaccatcacagaggcacacgtcagaaaccgaggtgccagcagggccacggtccccgaaggcgctgggggaggactcttccttacctctccccactcctggggccccaggcactcattgtcatccctgggcttgtggccgcatcactgcaatctcttgcctccatctcttcccttggccttcccttcaagtctgcgtccaaacctccctctcctttcttctgttaagaaccagtcactggatttagagcccctcaatccagtatgacctcctcttaacttgattacatctgcaaagaccctagatccaaataaggtcacatgcacaggtaggggctgggtgtggagtaggacccgaacttcatcggaaacacagctcaggccactacagaagaaagtggtgttggagctggatgctggctgatgggctgggagcagcgaggagccgtccagggaagggtgttgaggctggcagtgtggagaggccaggaggccaccttggaaggcccgaggccaggtggccgaggcagagggtatgaggggcacccgctggcctgtctgcatcagctcccctcaggtggagcctttctcagggccgagcttcttggccgtcagatgttcccaccaggctgtgttcagcctcagagtcgataactgtttccaggctgggcgccgtggctcatacctgtaatcccagaaccttgggaggctgaggcgggcggattacctgaggccgggcattggagaccatcctggccaatatggtgaaaccccgtctccactaagaatacaaaaatcagctgggcgtggtggtgggtgccggtaatcccagctactcgggaggctgaggcagaagaatcgcttgaacccggtgggcggagcttgcagtgagctgagatagcgccactgcactccagcctgggtggagcgccactgcactctagcctgagactctgtctcaaaaaaaaaaaaaaaaaatctataatcgtgtttccttttttaaacaggaaactactttgcttcgcactttttcatgggaggagagaaattcgacaccccccaccctgaaggttacctctttggagagaacatggatctgaacttcctgggcagccgcccggtccaggtgggtctggacagggctgtctcatggggctgtgggggtgggaggcccctgtccccagcagtccgcatcccagccatgagggcaagcaggcaccaaatcacccctaaagggggcagagctcctggcaggattccagttgagcttgggtgtgggcacgtgccctggaatgggttgtgtcctggtgctgccccctagaggccagatggccaggggcaggtcactgagaaacagagcagccatactgaatgggtgcgtctgggctgcaacggctgcggaacatggtggatttgattccagccttcttggatgactttctttacaaggcaaaaatagtatttacagactgggcattgtggctcacgcctgtaatcccagcacttggggaggctgaggcgggcagatcacctgaggtcaggagtttgagacaagcctggccaaaatggtgaaaccccgtctctactgaaaaaaaagaaaaattagccgggtgtggtggcacgtgcctgtaatcccaactactcgggaggctgaggcaggagaatcacttgaatctgagaggcggaggtggcagtgagccgagattgcaccactacactccagactgggcaacaaagggagactgtctcaaagaaaaaaaaaaaaaagaatatttactttccctagaacagtgggcaagagacatggtccaaaggagagatgcagacagctggctaacatcttcccctcgttgccagagaagggcacattcgagtactgtcatagtactcgagtactgtgagctgtctgttcagcacacatgtggcacctgctgcgtgcctagtgctcttccagggcttggggtgaaagcagaccctgcctctgctacctggtgggggcgtagacaattaatacgggacaaatgggtagaagagagaaggggcagaaagggaggctctactggagaggccatggctgaaccaagccatgataggtgggaagggggcccctccagaagaagctagaaggcagggggcctgggaacagaggaagaggtgagagggtgcaggcctcaggggacaggaggccggaagagccagtaaactttgggggccctggggcgggttgctgagctgtgctcgtaggaagctttggggatggaaagggtggggactgaggaaggggctgagggtgctcggggcagtgatggatatgggaagcctgggagagcaggttggggatgggcagccccagcgtgcaggggtctggcgttgaggctgcctggctggatttgctcagggtgatttggtcctggccgttgcgtgtgctggctgcgtggcctgcagcttctacctgtaaatgagaacagtgcacccagtatagcccctcccatgggactagatcccagggataccctctggggctgtggctgctgcaccctgacccgttttctgttgttggctgctcctgagggagtcacctggggccctgtggtttttctcctagtttccctacgtcactcctgccccccacgagcccgtgaagacgctgcggagcctggtgaacatccgcaaagactccctgcggctggtgaggtaacttcaccctgcccctggggaccctgtggctctgtggggcgcagcctgtggtggaggttctggcttgatgcttgaggaaaagggcaggcgggaggggccccagtttctgcgccctcccgtgtggaatgagaggctgtcctgggctgagcgagggaaagggcatgtggaacaagagccgtttagccagggcttctcagctgtgccgcacagggaccctgggcagtgtctggaggcagccaggtggggtgcttggcatctcaggtgggtgccaggggtgctgcagacttcctgccatgcacaggacggcccccccacagacaggaatgacccagcaccagatttcagcaggttcagaaactgcttaaaccgactagacttgaggcatctggggctgtctctgaaccaaaagcacgtaccccgtcttctgtgggcaggaagaaggagaggcaagccctggaccactgggctttcatgtacaaataggaaacagcccctatgtctactggagaagcgggctgtgtccacatagccacctccacggcccctcagcctggcaggggaggaggcagcctccgcagatggggccgctgacccgctgcctttctctccaccgcctggggtaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtgtgagtcccgcgggcggctggcaccggcctggctgggggccccagactcctgggggaggcttctgtccaccttactaaccagagggagaaaaccaaaccgtgctctttgaccatactcccaggactttaccacgatgtgaggggtttctcccaccccagggactccccacttttctgcgggaaccagctggggtcctttgactggtttcagttccaacgctgcctggaggtcatgcaacccctgcactttgagggcccagtcccacaagactgccccacttcagatgccactcataagcccccgctgtcacctgaacttctcagcaaccagccataaatcaggctcccacagtcccctcctcaggcttgatgagttgctagtgtggctcacagaacccagggaaacacttggctggtgtttgttggtttattgtaaaggattcagatgaagaggttcacagggtgaggtgtgggggaaggggtggggcgcaccaccttcctcgtattcagcaaaccagaagctctcctgaaaaccccatttcagggccttttctggaggcttcatcacgtaggcaggattgatgattaactccatctccagcccctgtcccctccctggaggatggggctgggctgaaattcagttccaggtttttgttttgtttttgttttgttttgttttgagacgaagcctcactctgctgcccaggctggcgtgcagtggcacaatcttggctcactgcaacctccgcctcccgagttgaagcaattctcctgcctcagcctcctgagtagctgggactacaggcacgtgccaccacgcttggctaatttttgtatttttagtagagatgggggtttcgccatgttggccaggatggtctcaatctcttgacctcatgatctgtccatctcagcctcccaaagtggtttttgtttgtttttgagacagagtttcgctcttgttgcccaggctggagtgcaatggtgtgatcttggctcactgcaacctccgcctcctaggttcaagtgcttctcctgcctcagcctcccgagtagctgggattacaggcatatgctaccatgcctggctaattttgtatttttagtagagacggggtttcatcatgttggtcaggctggtctcaatcgctcgacctcaggtgatccacctgcctcggcctcccaaagtgctgagattacagccgtgagcccccatgcccggcccacctggcccaggtttttgtttgtttttcctcgggagctcttagacgacacttccaagtctctaatcatggcttggtctttctggcagccagccacctccaggagccaagagtcacctcactggcacataagacactcctaccacccgggaaattccaagggtttggagttctgtgttgggagcaaaggtcaaggaacaaatattagaacaaaagaggctcctagcacccctgttgctgaggaaatgacaagggttttagaggactctgtgtcaggaactggggctgggaccaaatatttattttttattgtgtcataattagatatttgtactttcagaggttttatttgagataagggtccttctggccctgaaagtttgaaaactgcaacttcagcaggagctggcaggactgcctccaggctacaagggcacatgtgccccaagtggctttagagacaggcaagagcgtgccccctgccttcctgcactggagcacaccgctcagtggtcagctttgcatctggggatagggtgtggttgagagcctaggctttgaatgctgtccccgctgagtggcttgggggcacatgactgcttgtgcctctgtgtcctcagctggaagttcgggtgggtggtgtgaggaggggaccatgtgtcctgtgcacagcccctcgcgtgacaggtgctcttgaaaggagcctgagtgctcgagttgaggggctggtggagacgacttatgtggggaggttcttagggacctgccaccaggtgaggccgcccttgggctctggccttgggctccccggcagccagggctcctcctgtggagcagcactttggggaggaacaggttcctttttctagactttgttctttgaggctctaccttgccccggcacttgattatatttctttaatgacactagtaatgcatgcctgtgtgctatgacaggcgtcgaattcttgggcgtaggagcatttggagtgaccagggcaggcccctctgtcccctccttgcaccccactgcttggggttgagtgtttgacacccacggggcctggtgccctcctcgggcctggccgacatggtggaggagctgggttgtggcgaggtgtccaggggctgccacagagagggtgtgggctgaggacacaggccagtgtaagttgtctatccgctgccccccagtgctccagctgtcaggggctgggtgaccatctcaagtgcacttgaagagagggtcccgctgctaccagaaaggctagagagagcagagagggtgccctgccagccctggctggtgtcaccctctcctagacccctgcgggctagtgatgagagaaatgccacagtccccccctctcaggacctggcacaaggccagcttcccctcccagcaggaatcacagagcaggaacagctccagtgccactgtccccctctgtcaggacctggtacgaggcctgcttcccctcccagcggggatcacagagcaggaacagctccagtgccactgtccccctctctcaggacctggtacgaggcctgcttcccctcccagcaggcatcacagagcaggaacagctccagtgccactgtccccctctctcaggacgcggtgcaaggccagcttcccctcccagcagggatcacagaaaaggacctggaggctccaggacctggaggctgtgcccaggcacccggacaccatccagcctgccagtgctccatccatttgagctgcagggcaagccaccctccctgcctcctgacaaggaaactgaggctcagacagaggggtgtgtccaggcctccgcatctcacaggagaaggctggggtccacctgagggtggcgtcttaactgtgccttttactgaggctgagcccgggcctcccctgtagtgcctccaaccatgctgggctctggcggccatggcaggcctcttctgcctttgtgtgtacagtggtggcccccccacgccccatcccatttctgagcttggtgtgcctttgtccaggagagcctgtggagccctggccacaggcaagcagggcggtggggtggaggggaggggctgtggattgtgaattgggttcctgcatggagttttatcagaaatgaaactgcttgaggcacctgtcttagggatgcactcgtgcctgtggctaagacatgcagaagggcggtccttgaagcagtgttgggaaaagtgagatgttggtgaccatctgctggtgtcccccaggggccctgactgaatcagtaaaaccaaagcgggacctgtgtggtggttcacaggacacagcccctgatgtgtgcagacgcatgaaagagcagtgttgacgcctaccccgtctgaacgttgaggaagagagacccgcgctgcatgtgggcaccattgtgcctccgccttccgggagtgatctgtgggtctctgctggggcggacagcaggcctctgggagcaggcgtgagggttggggaagatgcattttgcactgtgtatacttaagtactgtgttcatttaaaaagtaaactcaagctgggtgcagtgactcaggcctgtaatcccagcactttgggaggctgaggcaggtgcatcacttgaggtcaggagttcgagaccagcttggccaacatggtgaaaccccatctgtactaaaaataaaatattagcctagcatggtggcgcacacctgtaatcctagctacttgggaagctgaggcaggaggatcacttgaactcagaaggcagaggttgcagtgagctgagatcacaacactgcactccagcccaggcgacagagcgagactcttatctcaaaaataaataaataaataaataaataaataaataaataaataaataaacaaaccaacttagcaccgatggaaaggaaaagcacagctacactggggaggtatcaaagggattgggcaggtgtgggctctgggagaattgtagccaggcctgacctggggagagctgcatggtgagcagagaggccgtggaaggccctggaagggtgagggccacgtggccatgtaggctgtttgctgttccccatgagagagggtccccaaaagacaggtgtctgcggcccttccagctgtcggagtgggagggacgggcacggagggccctcttcctgccgcagcctcactgcttgctcctggctccctgcagatacagccccaagagcccctcgctacagtccgagaccgtccactacaagagaggggtgagccagcagttctccctgccctccttcaagattgacttctcggaatggaaggatgacgaggtaatgctggctgggcggctccttgcccttcgctcctcctgaattctctccccttgggggtggggccagcacagtggggtctgtgtgtttggcttcctccagggttcataagacctgggaacggccgccccagtctgtgctcaggtggacgtgtggatgggcgggagcaaggcctgggccatgtgctgatggggccaggggaccagaggccgaccaggcagccgcactcggaggctcagacactggggtttggggagatgtgaagaatggggcaccccctgccaggctgcagcaatgcagggtctgttcacaccaggtggcattccttcaagctttttaaccttacttttgtttaaaatcttggtgcagacatcctttttttttttttttttttttttttttgagacagtctcgctctgtcgcccaggctgcagtgcagtggcgcgatctcggatcactacaacctctgcctcctgggttcacagcattctgcctcagcctcccgagtggctgggactacaggcgcctgccaccacgcccggctaattttttgtatttttagtagagacggggtttcaccgtgttagccaggatggtcttgatctcctgaccttgtgatccgccggcctcggcctcccaaagtgctgggattacaggtgtgagccaccgtgcccggccattgctgcagacctcttttaaccaggtcttttgtaggttgcggcttgagtggctgctttgctagttgctcctcctaggcccctctccagcttttagtcaaagctgtgtcctccctccttccccctttgccttgttttccagcgtccatctggtctgcagcttgcaaagaccctggtccagggggttcctgtgtaacagtacagaccttgtgtggccgggcgcggtggctcatgcctgtaatcccagcactttgggaggccgaggcaggcggatcacgaggtcaggagatcaagaccatcctggctaacacggtgaaaccccgtctctactaaaaatacaaaaaaattacccgggtgtggtggcgggcgcctgtagtcccacctactggggaggctgaggcaggagaatatcatgaatccaggaggtggagcttgcagtgagccgagatcacgccactgcactccagcctgggcgacagagtgagattccgtctcagaaaaaaaaaaaacaatgtagaccttgtgggtcccaggtctgaggccaggaggagacactgaccacatgccctgctagcaggcctcatgagctgacttacgctggggccagtcctgtggctgtgttcctgacgtttagccactctctgtaaaaagcctcccttgtccttgcattaaaaataaaacaagccaggtgtggtggctctcgcctgtaatcccagcacttcgggaggctgaggtggaaggatcatttgaggccaggagtctgagacaagcctgagtaaaaccttgtctctatgaaaaatacaaaaattagctggatgtggtggtatttgcctgtagtcccagctactgaggaggctgaggtgggaagatcgcctgagcctgggagatggaggctgcagtgagccatgatcgtgccagcgcacttcagcctgggtgacagagcgagaccctgtctcaaaagtaagactacctgggagtgggggaccaccaggttgtctaaggaggggtgaaaaccgaacagatcaaaactcccatgctgatcagtagtgggattgtaccttggaatagccactgcagtccagtctgagccacatagcgagactccatttcttaggaaggtaaaaaaaaaataaaaataaaaataaaataaaagtaaaataaacgtctccccagactccctcgggtgggtggagtctctgtcctctcccggcatcactggcgtggaccctgcaccctgctctcacgtgtgactgtgggtgctgtgtggcgtgtgtgctgagctctggggagtgggagtttgggaggtgtctgtgtttcctgtttgtttcatgtttcctggggtccctccccagcccctctggggagccccagtctccgagccctgtgagccatgggtttgcaggtgaggtggccggggtaggggagtggtcattgtggccagcttcctgaggggtacggtgtttagggcccagagagggttggaatcacgatgcccccagttgtccttacctctgtcccggacttggcactggacccgccagggggcctttggtgagggtttgctgaggaagctgaaggagggcccgcgtgcagcatagtgctggctcgtctgtggatggccacgctgagttggcgcacataaggggcagctgctgctgcggggccttcaaggtgctatccttgtcaggacttttgtggatgcaagtgacagaaaaacatttggtctggtttaagaaaagaaaaccagagacttactggtgtagattcagagaaggctgggtggcctgagatttcttccagggcctgtgtcatcagggtggggatctctgtggcttagcctcccatctccctcagctggccctgctccagcgcgtggccatccggctgggtccggagatgcttggaggccgtgtgtcttctctttgtggccccatttggggcgggggcctcccgtcctgcagccaggccgcagagacctggagtaggagggagacgcttccccgaagagaacctgaggggctcagatgctgggccaggcatggcttagcatcaagagcgcagctgcaaggacaggccacaggggtgcccagcatggctgcactggccttgcccaggagcagagaggacatgtgtggaggggctgggggcccactttcgttctgccgctttttctctctagagtgttaggccagttctgcagctctgtgagcctgggtttgcccctctgtagactggggctggaagcagtccctcgcagggtggccacgaggggtccgtgatcagcatgcaaagggctttacctggagccgcccactgtaaacccgtctgccagccggggagtgggagagaaggctatagccaccatcttgcacgcctccccagaccgttggtttttattccacaccagtaaagcactgtcagcacctagtttctgcagtgtgatgagaaaaaaaatcacagctcactcagaggctcctcagagcacagagcggcccacgccagtgctgaggtgctggctgcgcggatgcattccaggcctgggcagaagcgaaggggtgggcaggggcgcgggggtggatgcgctccagaaagctctgcctcccccgtttggctccatcacctaaaggagtggctgccggtgcgcgaactccccatttccgggcttcatgacagcccttgtggcagcagtgtgggagcgttgccaggcaaccctgggacgatgactcctgtgtggactcagtggagtgggcaggaaacaggctcacaaggggcctacagtcccagcatgatcagccctgacaggccccccagaccggggaagggagtgtccctcactctggcaagcccaggtgtctgtggtatccctcagacggctgggagctggaggcctagctgggtcccagtgggtgtgaacatgtgccccacgtccctgcagccttttatttttccccctttttttgagacaggggctcactctgtctcccaggctggagtgcagtggcacaatcacagcttgccgcagcctcgaactcctgggttaagcgatcctctcacctcaactttcacagtagctgggactacaggtgccacaactactggctgatttttttttttttttggtagagacagagtttctctatgttgcgtaggctggtctcaaactcccgggctccagcaatcctcgtacctcggcctcccagagtgttgggattataggcgtgagccaccacgtcaggcccaccagtctgcagctttctgatgtgtgtggacgttttcacaaagccgtggcccaggattggccgccttggccacctttcgcacccttttctcctgcaccctccagccctctcccggaggaggctgggtcggctcctgttgcctggacacacagggcttcagggtgctggtgttgactgtgtgttctgccagccacagcacttggagctttgtgttaggcacggcttccgttccattttgccaaatggggaaactgaggctcaggtggggttctaattgtagtgaatgggtgaggagctagacttgatgccggcagccttgactctggccctgggccagtgccctgccagctcctggctccacccttcctcactaacagagaccacggcacttctcagccttcacagcatagcccccagcatcagtgtctctgtccacctctgtccatgtgtgcgttgttgtccatcccatgggacttgtggctggaacccctgacccttcctcgtgagatgcggggcctaggtccgtgtggacttggtctccaggcttgtggtttgttcagcagatggctgcctgcccagggcttcttgtgtggatgggttacgtgtgccattcattctggtctgaatggaactcttagctccagatggcaggaagctgcggtagccgtgtgccaggtgcctgtgggtatggagtccctgctgggtggggacatgcctgggaacgccagggtgctgccagcctttgccgtgtgtccatgtccacatagcctccctggttcgcagtcgggtactttcttgacactgatgtttgtccccgtccccttctcctgactgctgtctgtggtccgctgtaactcctttcttctcgtctgtatttttggtaggaaattcgctgtgttgacaaatgttaggaagaaacatttccctcggttccttaaataatagtaatatttggccgggcgcggtggctgacacctgtaatcccagcatttttggaggctgagttagtcggatcactggcggtcaggagttcgagaccagcttggccaacatggtgaaaccccgtctctactaaaaatacaaaaatttagctgggcgtggtggcgggcgcctataatcccagttacttgggaggctgaggcaggagaattgcttgaacccagggggtggaggttgcagcgagccgacatcctgccactgcactccatcctgggtaacagatcaagactctgtctcaaaaaaaaaaaaaaatcataatagtaatactcacaacaactgtagcagccaccacaggcagtgtctctgtgctgggtctgtcgagaggacttcatttgcgctttatccttgaaacccatgcggtagcgtggtattgaccccattttacaaggaaagaagccgaggctcggagggaggagggcctgagatgaaagccaccctggtcactggggtggggacgtgtgcccctgccctgcttccgctgcccacttcacggggggacagcaggggagaggagacatcctatgtgtctgttggttctgagcattgctgttcaggggcgggtgcttggctgcgggctcagggttcccttgtgctgggccaggagtagtcccacctggacatccgtgggggtggttgctgcagacatggaggggcttgtcccttcctcatgggtcttagtcagtgaggcctgtggtcggtcttgggaggcaggaggctctcccctcacccaactgcccttgcctgggctgggcctgccaggcctttcctatttgatgtttcatccatattttgtttttgtttttgagacggagtctcactgtgtcgcccaggctggagtgcagtggtgtgatctcggctcactgcaatctccgcctcccgatttcaagtgattctcctacctcagcctcccgagtagctgggattacaggcatgcgtcaccatgcttggctaatttttgtatttttagtagagacagggtttcaccatattggccaggctggtctcaaactgctgacctcaggtgatccgccacctaggcctcccaaagtgctgggattacaggcgggagccacggcacctggccttgttttttttttttttttttttttttttacacctttattgtgttataattaccatctcctgcagctcactcgtgttaagcgaatgattcgctggcttttagaatgctcacagtggcacagccagcatctgttctttcagtaaatcttcattgagaaataaatgattctttttcttcccagaataaacagatgcatgtgtccattgctgttctgtgccagacaccgaggatgtcatggtgactggagaggcagggtccctgccctctatggagggagtcagggagcctgatggtggccggtggctttcctggttgccagggtatgagcaatagaagcccaggggcgaagtgcttcctgaggcccagagaaggacgtggcctgtagagagtagggcgagacccacagagcagtgctggggagcaggggtctgagaggatggcactgtgctgggctgactgctggggccctgggggccgtggggaagagggtggccttcagcctgtgcacagcagggggtgggatgaacgcaagaggaagcttctctttggactcaagccagcctcgtggtctcccttgcttgccttttgtgtttgctggggccaagtccggtgccttcttcagaaagttacagggagttgcccagtgaccagcacttcccctcagaggcacgcacccgggagaactgaaaacgcggttcaggcagacacttgcgcaccggtgtccagtgcagcgctgctcaccgtagccaggacacaggcccagcccggtgtccgtcgcaaaggaacgcgtgcacagcgtgtggatatccacacagtgcctgttatttggccagaaaaaggaaagcagcaccgatgcgtgctgcaccgtgggtgaactttggaaacatacctagacacagaaggtcacctgttgtgcaattccatgtaaatgacaggtccaaaaatggcaaatccctggagacaggaagcacatggtggctgccgggggctggaggaggggatggggagtgtgtgggtgctgatggctacgtgtggggtttccgtttggggtgatgaaaagttctggaaatggatggtggcggttgcatgacattatagatgtactttactcaacgctgttgaaacgtagttaaaatggcagattttgtgttgtatctgttttaacacacacataaaaaaggtgccaagcctggcatccgccttccctgccatctcgaggcgtgtcctctgagctctgctgctgcctcctgctcctgcctgctttgtccagctcatttgttgaccgactccaggcttccaggcttggctgtgtgggtcctgaccattcttggcaactctctcctcagctgaactttgacctggaccggggcgtgtttccagtagtcatccaggctgtggtggacgaaggagatggtgagtgcgtcctcttccgtcctcctgggcgtgcaggccgtgcagggaggaagcacgtcttgagggaggagtgcttgcagcagtgatgaagcaggccaggcatagggccttgggcttcccacagggcagggtgtgagcagcttggagtcccgggcaggtgaggaggtggaaagtgcaggagggcaggtcccagaacaggctcaggactctatggactctgtgcaggctgagccctcggtgccgcaggcctaccagggtcggggaggtgagatgcctgggtggggcaggccccgactctgactactctgcccctctctccccagcagtggtggaagtgactggccacgcccacgtgctcttggctgcctttgaaaaggtaagtgccatctggccatcactttcccggggacctgggagctgggcagggggtggccttttgagacgagaagcctgagcaggggctggggcttggtggggtggctgagtgtcaagggccccggggcaggttggggcgtgtctgtggcttcctgctttctagcattctggtcctgaggccgagtgccgctgtcaggaggcttagcatttcctttttttttttttttctttcctgagccgggctcactctgtcacccaggctggagttcagtggcgtgatctctctcggctcactgcaacctctgcctcctgggttcaagcgattctcccacctcaacctcccgagtacctgggagtacaggtgtgcactaccacgcctggctaatttttgtatgtttagtagaaacagcgtttcatcatgttggccagactggtctcaaactcctgacctcaagtgatccacctgccacggcctcccagagtgttgggagtacaggcgtgagccacgtgcccggccttttttttttttttttttttgaggcggagtctcaccctgtcatccaggctggagtgcagtggtgggatctgtgttcactgcaacctctgcctcccaggttcaagcgattctcctgcctcagcctccaagtacctgggattacaggcccatgccaccatgcctggccaattttttttttttgagacagagtctcgctcttttgcccaggctggagtgcagtggcatgatcttgtctcactgcagcctacgcctcccgggttcatgccattctcctccctcagcctcccaagcagctggtactacagatgcccgccaccatgcccagctaatttttttgtattttcagtagagacagggtttcactgtgctagccaggatggtctcgatctcctgcctcttgatccacctgcctcggcctcccaaagtgcttggattacaggtgtgagccaccacacctggccatctcttttcttttttttaaacagggtctcgctctgttgcccaggctagagggctgtggtgtgatctcagctcgctgcagccttgacctcctgggcttaaggagatcctcccacttcagcctcccgagtagctgggactataggcatgcaccaccacgtctgtctaacttaaaaaaatttttttgtagagaagaggtctcgctatgttgcccaggctggtctcaaactcctggcctcaagtgatcctcccaccttggccttccaaagtgctgggattacaagcgtgagccaccgtacctggccaagaggcttttcaaagggtacttggagtgtgttgagggagaacattgtagactgaggccagccctgtagaattctgtagagcctgctgccatgccacgggctggggctcccacaaggagggctgtctgcggtagactgccttcgccctggggtgtgcagagatcagcaatgttgttacctcctcgggctgtagctttttcctaccaggctcagtgtccttgggtgtcacctggcacatgtcacagacccccagtcctgctgctccttccgccacctgcctgcggcactctgaccctgcaggctgggcaggccctgcttcctacaggagccttttcctgacaccactcaggacaaacatctgttgttcccacttgatgttcacgagggcagcactgtcctcttgggtgtcttggcatccccagagctgagtttgatgtctggcacagagcagacactcagaacactggcaggatggacgaggggttgctgcccacctggcatgggtttctgctgagaacctggcggaggtggtgggacgcacgcttgtttgatagtgccttggtgcctcggtggccccgcccccagtgtgcactgacgttcatcagcaccctgccgttgcaggtctgcgtggcaccatcctgctgcctaggagtcggagggggaaaggatcccgtgtgacaaggcccagcctgcctgctgcgggcttcacgctgcctctgggtcctgcctagcccaggctctccacccacctccagccccatgtgcagccgcagcccctgagagctctaagtgcagagtccagctcttacctgtgatctgggtctttctagagcaccccagggtcgggggttctgttagctgggtagaggaccctctcctctgtgtgtcctgtggcgaggctgggtctgttctctcccgggtccaggaccacagactgtggtgacacaagtgccctgggcagagggcagccttctgcctttttagtactgggctccccagctgctctccccggcccggactcgtcagaagccacggtgactattgacacatctgcatcctctggcagaggcagatgggacatctctggcaaaatggtctattctgtgcttgaagtacagaacccagtgggaaactgctttatttttggagtccaacattctggaaatttctgttagaacccaccagcctcactggaaaattctgagtgctgatggtggttgactgagaagggataatgagtgttgttgcgaggtctccgatctcaagccgtaattaaccttgttgaactctgagcggtggtgtgtttccctggataccgccgggtgtgcttgttctatttcgttcctgcgtttttagagctttgcggttccctgtgtgtgcaccactgtgcgtgctcccgctctgtctttctaactcagccgggcctgggagagcaggaagctgttttgtctgtcttgattcttgctgccaggtgatacttctcggtgtgcaggaggcccttgtccatcatctgaacttggctgattggcattcagcttgagtgtgcttgagaccaaccgaggagagttgggttctgtgggtcagcagagggtccccgggctgtgtgttctggaggcctcagatagttgcacagccaggcctgaggccgtgttttcagaaatcccggctctttcgctgtcaagtggccccacccttttttttttttttcttttttctttttccagctgtgggcatggattggctggggcagggtggccaacccaggcggccacgcaggggtgctcagaggcgccagcttgaccaccttaacctctttgtctttctcccctgcagcacatggacggcagcttctctgtgaagcctttaaagcagaagcaaattgtaagtcatcagaggaaatatgacgtgcttgaattaaaagacacacatatacaatcactcacacgcatactcatacatagacacacactcatacacacgcacatatactcatacacgctcatacacactcatacacattcacttgcacatatatacggacacacatacataccatcagacactcacattcacacatatatagacacataaacacacagacacacacatacacacataaacacactcctactcgcacacactcatacagacacgacactcatacacacatacactcacactcacatgcagtcattcagatgcacacactcagacacactcatatactcagtcacacacatatacatagacacactcgtacacatacacacatacactcacactcactcacatatacatagacacatactgatacacacacatatacccattcacacacacatagacattcatacacatatacacatacacacacgtatacagacacacactcatacacatacccacacatatactcacacacataaactcacatgtatactcatacacatatacatagacacacattcactcgcacacatatacagacatacatacacacaatcacttgcacacatatacatagacacactcatacaatcactcacgcacatatacaaagacgcatacactcacatagacacacacacatacacatatgtacagacacacatatactcacacacacttatatatagacacacacacacactcttcagtagtcttcatgcactggtcttcctaggctacccttgctgctgcctttgaaataactgtgcaggggctgggcgcagtggctaacgcctgtaatcccagcacttcgggaggccgaggtgggcagatcacttgagcccaggagtttgatatcagcttggccaacatggtgagaccccgtctctactaaaaataaaaaaattaaccgggtataataacacatgcctgtaatctcagcaactcaggaggatgaggtaggagaatggcttgaacccaggaggtggaggttgcagtgagccgagatcatgccactgcactccagcctgggtgacagaggaagactgtgtcaaaaaaaaaaaaaaaaagctgtgcaacagcctgttgacttccctgtagagctctaagctctgggacgacgggtccctgtcttgggtgagcatatatgttttgcgtgcccgccatgtacagggacgcctgcaggccctgagttctgtccagtttgagccattgtgtctggaacatagtgttaagtaaatatttgccgaatggatggatggaaaaggaaggaaagagaccagaaacaaagtctgcaactccttctcctcttccttacaaattgtccaatatgtcagtattggacagagacttagcttgacttcatcaatacttgaaaagaaggattaaatagttgagaataaatggagctatagagcagtacatctgttctctggggtcagcgatcctgggatgctgcattgggaagtgttattcctggtggcctcacaagtaggcaccgagaatttagaggatggggtgccctaaacagcagtgttagatcttgctaatgagatgtcctaggccacagctaacagttactccgtgtgtactgttggggcgcataagacctgtttcaagccaccacttgggaatgatttttgttagtttttaattttttaaatatttaatttaattttaattttaattttattttattgagacaagacagagtctcgctctgttgcccaggctggaatgcagtggcgcgatctcagctcacttcaacctctgtctcccaggttcaagtgatttctcgttcaggctcccaagtagctgggactgcaggtgtgcgccaccacagttggttaatttgttttgttttattttgttttgtatttttgagatggagtctcactctgtcgccgaggctggagtgcagtggcatgatcccagcttactgtagcctccacctcctgggttcaagtgattcttctgcctcagcatcccgagtagctgggactacaggcacgcgccaccatgcctggctaatttttgtattttttgtagagatgaggttttgccatgttggccaagctggtctcaaacttttgggctcaagtgatccaccagcctcggcctcctactaaagtgctgggatgataggtgtaagccactgcacccggccatctgttagctttttagaagagagtttgtccaggtgcagtggcttatgcctatgatcccagcactatgggaggtggaggcaggaggattgcttgagcctggggattccagaccagcctgggcaatgtagcgagatcctgtctatttaaaatgtaaatcacaataaacaaaagagaggtgcagcaaactctagcaggtccaggtccctgcaggtaccaggggaacaggagaccccagtgatggtcagggccttgtgttgagagagctgaccagcaggccctgggctccctggagtggtgctcctggcccatggtctctgggaaacccagcagcacaaaccgctttgcaatgtggtcagcgtgaggctttttggttgcaagtgggtggcaggacagaatcagcttggagacattgctttggcgtctttgaaaccagagaggcttcatgccttttggaaggaggatctggaaagcagtgggaacttaggctgctgtctggtgccttcaggcgtcagctcctgctttcctcgtggggctggtggtggtggagccaagtggtgttgggggtggtgaggcggtcagggggtggtggttgggcctgtgggttggcttcaggcccccagtagtggggagagccaccggctccagccctgttccaggtgctgctggttgggtgggggcaagcagcaggttttccctgcccttctcctggcccccaggggttgagctggactgacccctggtatggaagcctggtaagttggaggcagggctaggccaggtgggtatggaggagccctcatatggcagttggcgagggcccagtgagcccctctctgctctccaggtggaccgggtcagctacctcctgcaggagatctatggcattgagaacaagaacaaccaggagaccaaggtgtgtatctgggtgaggtttccctctgccattacagaagcccacaccaggagcagccgcggacagcaatgcttgccggttcccttccatgccttcccctggagtcctagacccgctagacaacatcatttttccttaattttttttaaagctaacagtttagggaacattttatcctttctccagcaaattcactagcttctgatgtaaattgccatccaggttccccagggcagcccaggaatgggggccagtgtctcaccctctaggctcaggtgtgtggcaccctgctgcccggctcctgcccgcctccccagagacagcacgtccctgcagctcctgggggagggatgcttattctgtatgtccatagaaccagtcctggtgcctgacaaataagccgtggtgtaccccagtcagggaatgtagcaggggatgaaattagttttttttgtttttgttttttgagtcagtctcactctgctgctcaggctgtaatgcagcagggagatcttggctcactgtggcctccgcctcccgggttcaagcgattctcctgcctcagcctcctgagtagctgggaccacaggcacgcgccaccacacccggctaattttttgtattttagtagcgacggggtttcaccatgttggccaggatggtcttgatctcctgaccttgtgatccaccctcctcggcctcccaaagtgctgggattacaggcgtgaaccaccgcgcccagcctaatttttaatttttgtatttttagtagagatggggtttcactatgttggccaggctggtctcaaacttctgatctcaagtgatctgcctgcctcagcctcccaaagtgctgggatttcaggcctgagaccaccacgcctggtcgatgaacttgttaaaaggcacactgacatgagtgaaactcctgcctcttaagatctcttggaaagtctcacaggcccgcttcattatggcatctgggcccaggacaactggagcagctccacgtggcgggagcggagcacctggccgggcctcgcctcaacccagggaagtcagtgcattcatgtttcataccagggggcggcccactttgagaaaaggttcagagagggaatgttttcagccgcccgggcatatggtctctgttgcactgactccacgctgccattacaacaggagcagcggggactgtataaaaatgagtgggtgtggcggtgttccagtaagattttatttatagaaacaggccacaggcctagtttgtggacacctgttttagatttttggctttctttttgtccagttgctaatgtggtttctggtagctgccattaatgaaaatacttctaacatattaacttgttttttgttttttttgtttgtttgttttgagatggagtcttgctctgttgcccaggctggagtgcagtggcagccatcttggcccactgcaagctccgcctcctgggttcacgccattctcctgcctcagcctcctgagtagctggaactacaagcacgtgccaccatgcccggctaattttttgtatttttagtagagacggggtttcactatgttagccaggatggtctcgatctcctgacctcgtgatctgcccgcctcagcctcccaaagtgctgggattacaggcgtgagccaccgcgcctgaccattaacttggttttttttaaaccaaagataacgggtaccctgaccctcaggaagatgtgtttcttaggtgcatctgttcctcattttttctttaggtctgaagaacagaaagagaccatgttctcatgatttgggtgggtgaggggcacagaccctccccctctgccaggtgctgagtttgcactggatttgagcctggtgattctgctctggggcaacctccccctcccctctggacttctctttgtcatgacagcccccagggtagggtggagtggggtgggacagctggggacaggaagcaggagccgtactctggcctttgggaggctgctgacccacaagcccttgtcccggcagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcgtgagttccccggccggctgttctgtggaaggttctggaaattagggactggccacaccacggtggtcctgggatagggggccacaggtccgttgatggctaagaaagaagagttgtcattcatctagtctgtgctgaacgtgggcgtgttggctgtcggagtcagtcaccgtgagagagctggcagggacgctagcacggggcattcagatcttcacgtctgcctccagccaggcaaggcttgcagaacaaagggctacagaggcgctccagggcagatgaactgaacgaaaattgatgagtgaatgaaatctttattcttattttatttttattattttttgtttgagacagtttcgtgctgtcgcccaggctggagttcagtagcgagttctcagcttactgtaacctctgcctcctgagttcaagcaattctcctgtctcagcctccctagtagctgggattgcaggcaactgccaccatggccagctaatattttacttttattagagatggggttttgccatgttggccaggctggtcttgaactcctggcctcaagtaatctgcctgcctcagcctctcaaagtgctggtgttacaggcatgagccaccatgcctggctattttattttattttatttttttgagatagagtctcgctctgtcacccaggctggagtgcagtgttgcagtctcggctcactgcaaactccgcctcccgggtttaagtgattctcctgcctcagcctcctgagtagatgggattacagccctgcaccaccatgcctggctaatttttgtgttttaagtggagatggggtttcaccatgttggtcaggctggtctggaactcctgacctcgtgatctgccctcctgggcctcccaaagtgctggaattacaagcgtgagccaccgcttttttttttttcttttcttttctttttttttcttttcttttcttttctttttttttttttttttttttttttgagacggagtctcgctctgtcgcccaggctggactgcggactgcagtggcgcaatctcggctcactgcaagctccgcttcccgggttcacgccattctcctgcctcagcctcccgagtagctgggattacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggccgagccaccgctttttaattaattacttacttttatttatttatttattttgagacagagtcttaactctgttgcctaggctggagtacagtggcaggatcttggctcactgtaacctctgcctcccaggttcaaatgattcttgtgactcagcctcctgagttgctgggattacaggcatgtgccaccatgcccggctattttgtgtatttttagtagagatggggttttacattgttgcccagtctggtctgaagctcctgacctcaagtgatctgcctgccttggcctcccaaagtgctgggattacaggcagagccacagggccctgccttgtttttaaaattttttttgtagagacagggtcttgctatgttgcccagcctggtctcgaactcttggggttaagtggtcctcgtgcctcctaaagtgttgggattatgggcatgagccaccatggccagctcagatctttattttaaaggtaaaatagaaaatatttcaataaatttttagcataacgctggttgcagatcacacctataatcccagcactttgggaggtcaaggcaggaggatcgcttgagcccaagagttcgagactagcctgggcaacatggcgaaaccccatctgtacaaaaagttaaaagttagccagatgtgttggctatagtaccagtgacttggaaggctgaggcgggaggatcggctgagcctgggaggttgagggtgcagtgagctgtgattgtgccaccactgcacccccgcctgagagacaggggaagaccctgtttcaaaaaaaaaaaaaaaaattatagcgaagtgaaaacaaagtatgctgggtagaaaattgaccaaggaattaaattgggttttctagagcattccagacatttcctcagtgaaaagccgctcgtagggccccgttctgagtgtcttccagtagagggaacaacctgaatgttctcagggtgaaaaaacgaccaggtcaaagtgcacatcccactggtaggcccttgccctggatcctgggatccctggcctgggtcctggcggtggggccggagcatagttggggatttgcctgcgcagctgcaggacacatgcgcttagtaggccagcagacctccaagccgggcgtggggctgtgcgaggatgctggtctgtgcagtcaggccatggggtcactggatgtgtccagatcccaggagtaagtgaagaggctgctggggcctggagggagaggccggccgcccagcctgtggcagatcctgtagcagggagggccggcccaggctgtctgtcggcctctcctgtctgaaagccacagagttgcgggggcagggaccaggaagtgggggcaggggtgggctgtctaggaaggttctctgtgcctgcccaggaggcaggcagtgttgaggactgagcctcagggtggctgtgtggctggagatacagcagggctgctttccagggagggtgccctgaaccgagtccaattctggaatcttcaggtgtgtggggtcagtgggtcggggccatcagactggagttcagagctcccgtgtggctttgagcctcaaggacgtggcggtagaggggcccctcacaggcgcccgagggcagagactgctgttctcagtagaaattgacacagaggaggcctgaggccctgtccctgggctgacggcagatgcattggtttgttggaggtggctggtttggtggtttggtggttcggtttcctggcctgcacacgtcactaaaggtgtctcaggaacattctacagcagcctgtggggcccttgtgtgagcaggactggcactgtgggatgacagggcatcctaggtcctggtttatcttctctgctcccagtggctgctgtctgtgcccctcagcttccccagcgtgatgtttttgcctcagtttccccagcgtgactccccacttcagcttcctcagcatgatgtccttgtctcagtttccacagcatgacatccccacctcagcttccccagtgtgatgtccccgcctgccatcctgtcctgcagccaagagctcctctgggctcagccaggactgctgatttgcagtcacgtcctgtctcgggtgcagcctggagcttcaggggtgtgacgctttgggggtcatggccaccagcctcttggaaacaccctctggagccccgccttgggcagcactgcatggccttgctgtgtttcctgcccggggccatttcattaatactgtgtttgcgggagttctgtctctcgtctttggagcgccccctccctctatttctgtacaggggagctgcttctttctttcttcccccatctttcctgcctattaaattcctgctccttaaaactaaaagaaaaaaaaaagaccgttgtgatctggaagcggggtcaccccaggacccctatggtgtggggggggtgttgatccctggggctgggagggtcccctcggggctgggtgtgtcgcctgggcctgatctgagccctccttctgccgcagctttccgggccctcctgcagatccgggcggtgcggaagaagccaggagccctgtcccccgtgtccttcagccccgtcctggcccagagcctggagcatgatgagcactctgtaagtgccgcctcctgcctgcgggatgggcgggagaggggcatgagtgcctgggccaggcgcaaggcccagacggtccagccagcagccccgtgttctcttctgtccagtgggcaggcatggcccccatggatggctgtgaggcatgaagggggtggccaggctgggccctggggtgccgctgctgggaacagcgctgctgccatcagtaccagagcctgcgacaaggctgagcgcggtcgaggtctcggtggagccaggtgcttttttttttttttttttctttttgaggcagggtctcggtctgtcaccgaggctggtgtgcacccaaagtggtgcaatgtcagctcactgcagcctcgacctcccgcctcaagcaattcccccatttcagcctcccaagacgctgtgaccacgggcgtgtaccaccacgccgagctaatgttttgtatttttagtaaggtggggtttcccatgttgcccaggctggtctcgaactcttgggctcaagtgctagtcctgcctcagcctcccacagtgctgggattacaggcctgagccaccgcctccaccccgtggttcttagtgaatgagccatgctgtttcccccatgcgctgctgtgcaaggggcactggtgaccctcctcccacgctccaggcccaccaggcgccctcagtggggaccttaagggcaggccctgcttcagcaacacaagggaggtggaaccctggcttcaaggacccaaagacagacagagacatggagagagatgcacagagaaacacagagacagggcgagagagaggtggagagacacagggagaggcagagacaaatgtggagagacacagagacaggatgagagagatgtggagagacaaagggagagacagagaaagatgtggagagacatagggagagactgatggagagataggaagagacagacagatgtggagagacggagagacagatgtggagagacagggtgagagagatgtggagagacacagggagagacagagatggggatgggtggcaggggctgtggtgggcagggagcagaatgggggagttggacagtgactggttgggcccgggtcttaggccccctgctccccactggccacgcgcattgtcagattgagtgcctttcttggctcttagctgtggctgttatgagccgttggttcttccaggctctgctgcctctctaaacagaaaagaggagcagagccctgaggactggcgttcacagacagcgcctttgctctagaaggctcctcccaagcccccttgatcagggccttgacctgggccctatgggcctccctggcagcaggtgcaatgtttctgaaatggggtcaatgtttaaaagtctggaatttcccttaaaacccagattttgggtttgtcttttaaaatctgacatggtcttgatgctagaggagaaacatggcttgggggtccctgtcaacccaggccctctaggcccctaccatcgtggggctcctggcaccacgctctccagcacttttgatgttggctttgattcggaaacgctgcgtgtgctcaggtttttggtggagagagaagcagcccctgagggatttgcctctgagagggtttcacctagggagtgatcgatgctcaggcgtggctaggtttattgtcccttgtttttgcccctccctgtttgtgttctggtggctgaggatccagtaggtccctccatgtttgtccctcttatgctgagtgagctgggcggccggggtccgaggtgtgaccaggcagctctgacctccacatgccccagaagggctggcacccagccagggagccgccgtcctctctgcatggagcaaaagcaaacgctcctcctcacctgccaggttcctgttggagccccttccacgtagtgacagaaagagccaccgtgggtgttctctccagcgagtgcctaaagatgatggtggggtgggtgggtctggggctgactcttctccccagccctcttgaggggttcatggttggtgataagtgagcggcggtgcctgggcaccggctggctgggggactttgaccagtgtggcttcaggatctccaccctgcacccagcctgcattaggcagcgttcagctgccctcacgtccaccttggccaaatctgttgccccaggtgacccagactgcggggggacaggcaatggggatgagattgggctccacagcctccccactgcagcagcacagctcccgggagctgccgagacgcacacatggcccacccagacccgagtcaaccctcacttaggacagtcccgagattcacgtcccccggaagcttgtgaagttctgcgccacggtgtggcaagaggacagccagtcagacctgtccagcccactccagggccgcgtgggggtggtagttgtaaaacatatgatttttatcttgacagtgtccctttaaaaaatcaaagccgcaccccgcctccctggccagcaagaaacctaaaagggaaacagtaagtgtctggtcctccggctacgtttttttgcccccgccctcatttttaaacccacgacaagtaggggagatcgtttccgccccaggctagtgtctgattcatataacccgtcagctccacttgcccagtcccggcctccctgcccagggagtttgtggaaccggaaaagctctcggtccgtgggcgaaacgccaggtgcgctggccccgccgccctcccctcagctttgcctccgccccgcgtggcccccgtgccgtttcccttttttttcttgctggcagtggaatggacgttgcaggcggaactaacgtcgctgctgcgttttgcaatcgcgccccgcgcatgcttcttggccccgtgtcccgctcctttaccctgcgggttcgagctccttgggctgagctttttggtttccttgggcttcccttgtgccccagggagcaggcagggggaccagcacacaaccacctggagcctccgtggcccaggcagacccagccgaaaccctgtgtgcgttggtgtagaaggtggaggccactccggagccacccggaccgtgttttcctttctagaggggtgaggggattctgtgtggttatttacccttaacttggaggcaggtatgggagcaaatgtggggtacacagaggtccagaaaagcatcccgggctcattgcccgggccgtgcccgctcccccatttctcccccacctccccgtggtctccaggcatcccgcacccatctcactttccccttccttccaggagctcggtcaggcaggccggggtctcccgaaaggagcactgacgagcgttgtgcccctcaacctggttttgtggggacagagcaggggcccccgcagtctgacttccgttccccagaacctgggcattttccttcttcctcagccttgttgattctgtctgctcccagtgagggaagaacagtggctcttagccagggtgcccgttagaaccacctggagcaggtcagcccccagaggcccgggcagggcacagctcccaacagctcagctctccctggtccaggacgcccctgaccgtgtctctcgcctctggcatggctttgctctgcccccgctcccagctcctgtctgtcactaacccttcactctccacctggggccaggcgggactgaaagccagggaggggctggttgaggccagggctggggcggttcttggcagatgccctcgtgcccgtcatcccaggcaccagcgtgggcatttgggcatccagccccgtgctggagctgatggctgaggcagggagggcatcggtgctgccagggagctcttggccaccctctgagggtgggggagtctcaatcccccaaagaacagagtggacaggaggtcatcaggaggagcgtctggggagcaggtggtccctgggcatgagccccctcacgcaccctgtccctacagaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacaggtgagcagcagccaggccaggtgcatggcagggtgtgtggtggcgcgcgtgcggagcgggtgtctttgtggtttcaaatcagtttgtgatgtgttctgtgtggcgattccccagaaggactcggagaccccgtatcaggttagactcatgggtaaagtttattacggcaaagaacgcagcagacgaggcaggaagagcgtccgggcagctggaggctttgatcccccgaccagggccacaccggcgtgcaggcgcatacgtgctctcgagcaggaaactgcaggggtcggtgctgtgtctctgctgaggggagcccctttgagcctctgggttcccagacttcattggggggctggccacgtaggcccactctgccggtgaccagccagggcagccgaaactcaggacctgacagtgacccaggcacactcactgctcttgccgttcgcccgtgacgagccacggggcacggtccctctccaggcgatgagtgcatcatccatcactcatacgacagccttcggagggcctggctcctggggttggccacgggtcattcgtggttcccctggagccttgcggtgtatagagcggcggctgccagggggactctgtgcctcaggcctgtcggttctcgtagaagagtgtcaggaaggcgcgggttctgcaggcccgccctgggcaccctccatgcccacgaggaggcagcgccaaagctcagagaaacgggggcctctgtctcctgctgcttctcctccccaggaaccaccagcggtttctcttctccttctagaaagaaaaggaaggctaggcccgtgccagtgtgtcgggagcccctctgtcgggcgggtctgtggtggccgctgttgcctgttggccgtttgggttggtcccggtggctggtgatgcccttctccagggagtgtccttgcgtgggtcctggcaggcgtgtgcaggggcccccaggtgccctgcatggctttggcagggttagccttccttgtcgttatcctctcacccctgcccaccctctcctctgtccccagcaccctacggtccccgtcttcccccatccacgaagaggatgaggagaagctctccgaggacgtggacgcccctcccccactgggtggcgcagagctggccctgcgggaaagcagctcccctgaggtgaggcccccccggggaagctttgcgcacccgcccgggccagccctcctccagcttctgtcgctggaatcagaccccatcccactgcccgcctgggcgcccccgtgcttgttggctcttgctgagctgcgcggctccttagcctcggtctgtggaggcagcaccccctggtggagcggctgtgcggtcccgggagggccgtgcctgatggcggcttgtcctggagcggtggccgcggctctctgagctctaggctactttcccctttgtttcctagagtttcataacagaagaggttgatgagtcgtcgtcaccacagcaaggtgagcgcctccttccatgggcacaaaccgcatgcagggaccaggcagccctggcttactggggccttagggctccaggtggtgttgggccagcacctcttctgccccaggaaccctcggccaagaggcccccctcggcggcactgggatcccggctgggagggactgaacgggtgactgggtcaggctgcgctgttgaccctgcagggctgtctgcctgggatggggaacacctgccagcattcagtcctggttttgaaacatgagcgtgtaatgtttctatgaccaaaaaaaaaaaagccctatgctctgaacatccaggacacagtgtaaaaaaggggaaaaaaaagccccatgctgggggatgggaaggagggaaatagaagggaaacacccagctttggggtccctggagagcaggtggggtcacggtggagtcctgctggagcacaagcctggggtccccacagtggctacagagcccttgggtaagagagacggcctcctgcccagagggacctgccgggacctggcccctgcctgtaggtccctaacctcaccctctgcctgcagggacccgagcagcttccattgagaatgtcctgcaggacagcagccccgagcactgtggccgaggcccacctgctgacatctacctgccaggtaaggggctgggggtctgggggtgaggggctgggtgcctgtcttagtccccagggagggggccctgctctgatggtcggtgcatagcagcagaggctgtccattggagcctggttctctccctggctctcagccatgcccctgctattgaccgtgaagcaggatgcgggccagggccatggccacaaagcagcctcaggcagggcctggctcttgggagcggaacctgcaccaaagccccttccctccctggggccacattggccacaggaggtgagagacgcgagagaggctgcctgtgagaggatggggtccttttccctctgcctgctgctcacgccaggagggcagatccggccccactgggatcaccacatgttcccccactcctggtcctatcgtgggcccacaggccccatgctgggtgccacgtgcgctcctggcagtgcctgagagctgcagacagagcaggagcaggtaccacacgctgtgctgggtagcgggggccctgggccacagagcgcaggggcagtgtcttctgggtcaccctgccccgggcctgacagaggccacctgatgcagcagcacatcccaggccaggcacagaggacggcgggggcgccaggcgccagcggggaacagcaaggcagcaaggctgggacagagggttgctcttctcacctttcccggaggctcgggccccagaccccatcagccaagcaccttcgtgctctgctctgctgggataagatcctcagtttcgaatcctaagctctaaagaccgggagggaatgggggctctcagactagtgtctcagcacctgccacgaggctgtctgcggctctggaactgcgataaacagccacggtgctttcagacatgaccccagagccactgcttagggagtgtggctcttccctcgcggctgccaggcttcacccgcttcctggccccagggcccaccattgctcaatcctcctgagtcacctggtgacctgggcctgacattgggtggttgtgacgtgctttagttggaaaggggctcttgtgcccccggactctggctgagcagtggcctgtgctcatgggctgggcgtgacaggtcgcaggtgcaggagcaggcactgcctctggtgccctgatgaccacagcggcctgccccgaacaactcacagcagaaggtgtgtttaggaccagcttaccttaaagtgacacagaattcgagtaaggtctttcagaggatctcaaatatttcattctgattaaaaacttggggggtgatcggggaagaggccagaaggacctcagcttctgggagccacgaacatgatatctgatcctgcagggtggccctgtgggggagcatctcagaggctgcgcctcccctctgtggccaggcctgggaaggattgggacagctacagaggaggcccacacagaggaggccaggactccgagtctcatgccccacccacaggggagggtctcgggccttcttcaggcccacagacgggggcaggcagtcgtcatctgtggaggcggtagaggagaggccgagtctacatcggggcagcctgaggtgaactcctgggccctgggccccgctcttggagttggctgctgctgaatgccagcaggtcagcctgcacggcctcagttctgagccacggagagcacatgtgcctttgggggctgtttggcgccatctccgtggctgtcagccttgtcagcacaggtttctgtgtgtttttaaatccatgtggtggcccctctgttccactgactttttcacatcacagagcccttgactgtctatccgtgtctgtgcgtaaggcatgaacacacgccagagcctttggtttctcataggggtgcagccgctgcctggcggggtgggcggcatcactgaaccctgctgtccctgtagatgggagggcccatgagatggtgaacactgggggccctggtgtcttggacttggccctgagctcggtcctgtctagcctcagccccccacccagggccttcactcctgaaaccagaggtggactgcgcccgttaggtccttcatgcgcccttccctaggctgcggcagcgggaggtatgggagggaggggcagggccagtgcgctcctccgcgttgaattctggctgcgctctgcctcccagctgtggttctccttgtggttctctgtggttgcagcagagtgtttgtttctagacggcctcgaccgtgtccccaagctggtgcccttgctgtggctgtgctggctgctgcgcgcttgctaaccgagcttccgtctgtctctccccctctccgcgcagccctggggcccgactcctgctctgttggtatagacgagtaagccggtacgtgacctcccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcgtggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatcccccccaagaggcgccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctatgaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccgtgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatctggggacagcgcccggcggcgtcgtgcaggccacagtctgggcattggggctctgtgggaggctcctctctttgccttgcagtagccatccgggggctactctgagcacgggcttgttctcacccagggccgctccccacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggtgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctctttttttttttttttgagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttttttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgaggtccgcctcctgggcgagacccagcagtggacagcatggtcctcacacccagctccctgcacacccaggccagccacccctcccgctcgtgcacaggcacgcagatgcgctcacacgtacacacacacaaatgcacgcccacttgcacatgctcacgcacatgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaata

SEQ ID NO: 899 - DNA, 66152 bp, Homo sapiens; identical to SEQ ID NO: 898

SEQ ID NO: 900 - DNA, 66152 bp, Homo sapiens; identical to SEQ ID NO: 898

SEQ ID NO: 901 - DNA, 66152 bp, Homo sapiens; identical to SEQ ID NO: 898

SEQ ID NO: 902 - DNA, 6045 bp, Homo sapiens
agtggtttggaattcgttcttctcttttgttaaaagggggaaaggaagtggatgcgggtacccccaggtgcaggggaggcatgcaggcagccccagcaggcaggcgctgggaggcggtgggaagagtcctggagtttcccacaatccttttctctgcaaggaacagcaacgctggctgacgagggggtggggaggaggcagggccctggggagggggcggcgggcagggggctgggggctcacactaacatgcaaagtccagctgccccaggaactaggttgcttctgaagagcgacacacgtagaaatacacagacacggccacgcgcacacatgcggagaggctctgcattccctagggtgggggtcgaggcctgccggcccccaaggagctccaagccagggatcagcaatgtctctgccagggtggtcctccacggcacccctgggctgggctgggcaggtgcgtcttcgaaggaaggctgcgtggtctctgaagttctgtccgccaggcacccaggccgcgctgaaccactccatgtgccggggccgctggggccatgaccttgcgtgtgggcagctgcgtgttctggcaccagacgtgtccctgcctggctagagtccgcgctctcccctccagggctccggggaacaaggggtgcagacagaaaaggggtgaagggggcccgcagagacgtcctctcccccgccccacggggtcctggcctccgggaggggggaggggcctcccttatctctctgcctccatggcagggtgggccctgggttctgaggtggcctgttggggggccaggggtggccagtctgaagccggagaagggggtgttggagtccacaggggcggctgtggctggtggtgctgtgggccccccgggggcgaggccgccgtgggccagctggaggccgcagagctgctggtggcggcatgggggaagtgtggcgggggtgacgtggctgtcgcggccatcgggctgccgctgccaccgctgtggaagctctcggaggccttgagacgggagaacatggtgagagcgtcagggaagttggggggtgtagcaggggtattggcgggggtgcacatctgtgaggggaagagaggagagatggggtgagcaccccttcctggaggggcccccactgcctcccaaggggagatgcgtggctggcccattctcggaaggctctgtgttccttccccagatccccaagcctgtccgccgcccaggggttcccagaggagaagccttgagatgaaccgacccagcctcactctcaggagcccacggtgcctggggccacgaggctttcccagcccacccctttccatcagccacagcatccccgggggctgtagggtaaggagcttcattgccccagaggccagcgccccccaggtctcagggggagctggcacaggcaagattaagtgcaggacccacggagccgggactcctgctgacccatctccaaagaggtcgagccccgcctgcaccagcgccctcgtacaccggggccaggggctgcttatacacagaactagctcggcctccttccgcccaatccagaactggggactccggggacacttaccatctggtggtgatggtggctgtaggggatgttggtctcctggaaaaaggcgctgagggctgtctgcaggaagaaaggcccctgctcaccctccaggcccccgccggccctgccgctgcccttgttcccaggctcctctgaggctggggatgaccctggctggactgctgagtgggaggggtgagtcgcggtgctgaggctcagtggcttgcctgtcacccccaaccctcactgctgtctaaggaggagccacggaaccttgggcagttggggtgggtggagaagacccttcccctgctgctcgccacctgcctcagtgcctaaggcctgcagagccctccccctgcaccagctggcaccagcaccatgactgggggagggcgggcagtacaccccatcctgggggaaaggcgcccggccccaggtagcccaaccagacctccccaccctgccccgtttcaggagattctagcctggctgttaccacctcaacgggtagcaagtctctactcttctctaagcctcggtctcctcatctgcgaagcaaaagcatcctgaaggagtctgagcctggtggtggggatcccctgctgccccacccagctctgcttctggctgatcaagggggccactgtttgggccttggtttctccatctgtaccacaaagaggttcgactaggtggctcctgggtcccctcccttgcaacagtgacctcctaagatcaccagattccagcaagcagggcctggcaccaaggagacaagcctgggctttaggctcactcgcttccccacctgagcctccctcggaacagtgcccgggaagtggagcagaaagacggccctaggatcaaagccaccacgggtttacgacagctcccagcacagctccccagccacccgcccttggctggcaccacgctaggcacgggatgctccaccgtctccctccacacccgggccgcatgccacactgagcacggtgcgggcacccagcagggctccatcccagcggggccgtggactgtcatcattaaccccacaggcagggactgctgtcttacaggcagggaaatgaaggtaggaagtgacttgctcagggtcagctggtcggcagaagacagagatgggggcgctcagaaaggccaggacaggtgggggagacagagcgagcctggagccctttcctgtgtgtgtcagctcagcaggctccagaggtccttggtgactgggaactgaggagccccagagggaggcgctgggatttgctatgtcctggctgaggccctgcaggggtggggaggcctgtcccaggaaacggaggctgctcttgcgcaagggccagtgagggagccccacaagtatttgaggggttctcggggccctgccaagtcccaggcccagacttggagcttcaagccgccgaggtgcccctaccgccacccctcaggcccactcccctaatgccagcttgacttcctggccctcccaggcccagcacacccagaaatccagcctggctcctggggcctgccctcgatcagggggtatgggtgggaggctatttagattttttttttttttttttttgagacggagtctcgctctgtcaccaggctggagtgcagtggcgttatctgggctcactgcaacctttgccttctagttcaagtgattctcctgcctcagcctcccgagtagctgggactacaggcacgtgccaccacacctggctaacttttgtatttttagtagagatggggtttcaccatgttggccaggatggtcttgatctcttgacctcatgatccgcccaccttggcctcccaaagtgctgggattacaggcatgaaccaccgtgcccggcaaaaaatattttttaaataaatgaattatgtggggaatttcctgcaggagacaccctatctgggtgtccctaaacaggggtgtgggagctcaggcatgggggccgggctttaagcaccttcccagaccccaagaccctctgtcagcagcagctgtgccccaaagcccaggctcactgtgtaaatcccaaccccaggagccccaggccacaccagaccccctctgcaggccgctgtgagcattctccattgagaaacatctgccccactagacaccggcccctccccctgcagcctcctgcccccattagcacctgaattgcagcaaatgtgacccagaaacaccgcctggtggatgcagccagcgggtggagcgtggagagggatggggtggccatgtgaacccctcactcagccccattccaaggcctgaagtcccgtcaccttcctccagcctccctggcggcccccactttacagatggcacaactgagacttgggagtggagggcacagggctcctcccatggggaccctgggagccaccagaggccccagatgctcctgcccctctgggaacagtctttccccagacattgcactcctcaaagctgcattttcaattaactgtgccgctgagggatgtggcctgggtgccagctgggtgccaggttttgagggctgggctgagtcctgcaggcagggcccgcttcccaccggacacctacctgcccagccccaggcagcgagggaaccctgcgtgcagatgtgtaactgccatgaatgcggttttgcaagttttgccacatccagcccctgacacaaacagggctgatgagggctgtggagaccaggagggaagcagggagcttcctccgggtggggctgccttggggcacagggggcagtaagctggccaacagaagctgactcatgccccccaaccccaccatacagatgtggaaactaaggccagagggacagagcagcctcccacgtcctggggtgaacaccacacaggatcagtggcctccgcgacggctggtaggagggaagtaggcaaggagagagggatgtactcatctggatgggatggccactgccttcccagactgtcccaagcttgggacattctgatccccctgcagtccccaggaagcggagcctcagagtcctctggcttctagtccctcctgcaggccctgggatggctcctcatggagaaaccaggttcccagtccccggctgggcacagatggtaccgggatggctgaggccatgaccctacccctgtgaggggcacagctcaaagggctctggcctcatcccctgataccaaccaccatggggttaatcctggggtcggtgaattagggaaagccaggtagcctctgggcagcacaagccaggagcactactgtcctatgggttaggagaggcccgggggagtgggtgccagaccggggcagcatcacctcctacccagctagcccgaaagctggtgaaccgtgtgcaccctccccattgcaccggtaaagggacagatgcccctgccagccccaggagagcacctagtcgcgcacacggagtccccaggcacacctctgaaggggatacacgctcatccctgtggtgtagtgtggggctccgacacgccacccctacactccaggccgtgtacacacatcacaccgtgccgggcacgggcggcatctgcacacccgccacatgtgtacgcgttgatcacacaccaaacgcaccagggggctgcgcgttcacacgcgcgccaacgtgcccgcaggtccgccacctccccggtgcccggccgacgccgtggcgcggtgcgtgcgtaaacacaaatgcacatggacgtgtgcgcacgccgccgaccgcccaccaggcacgcggaccctcggaccactcgcccggagcggctccgccctccggcccagctctgccgaggcctggggcgtcctccttccggccgcccgcccgactgtccgtctgcaccgcggggccgcccggccctcggccgttacccggacaaaaggggtggggggggtccccgtctcgatcccgggggactcgcggccccgcgggggcggcgtatccccgaccggtggcccggttcccacctccgcccgccgcgagcccttgggatccggacgccgggcaccgccgtcgggaaagcgggtcgggtctgcggcccggagggggcgcacagccggcacgcgtccacgccgtccgcccccgcccggcggccacgcgggacacactccgcccgtggccccggccctcgcccggctccggcgccgcgcacctcgaactgccagtgggccgcctgcagcagttgcttcgcctggtcggccgcgcagcccgccgtcagcacgaactggttgatcatgacctggtgcttgagctcgtccatgttcacggacatggcgccgccgcgctgcccgctccggcctccctcctccgcccgcgcctccgcctcacgcgtccaccattagcgagccggctccggctaatacaaatatttactgtgcggctctgactcaccgcgcctcgc

SEQ ID NO: 903 - DNA, 15110 bp, Homo sapiens
cggagcacgccgggaagctcgcgggtcggcaccgggacagctcccgggcgccgtggaatgcacacgtcccgcacccggaccttccggtcagcttcccggctcgctgtctgatgcccgcggtagccaatgagctagtggtgtttgtcctgctccgtccccgccctccaggggaaccaatcccattgcaggagaggcaggacgcgcaaaggcccgaaagaggagctgggcggggtggggggaaggcggaggcagtctagtaatgtaaagctccgctgagagggagagtgctgaagaaggggacagcctctgtacctgcggcgcggcccgaggggcggacgcgagcggagtgacgcgctggaggctgtttatagcgctgtcaggacagcgcggggagtggaggcagaggcctgaggtgaggggcctcgggcctgctgcgcctgcagggagttgaacaaaacgcggggaaatacgggctgggggtgggtgagaggaggagcgatgggctttccacttccacagctttaaaatttaaaagctcgacccgggaggctgttggcgtctggttgccataacaaccggcagcctcgtggcaggccggctgggggcggggctctgagaaccggggcggggctgtggcggggctaacaggctgcagctgagaaacccaccccgagacggagccggaaggccgttattcagaggcggctccgagcctccccttcgccttctggatgctctgagctcctcaacttggcgttcagggccctgcattgtctggtccgttttcaccggagagtccagcaactgacactttcttcccttaaacctgttgggcggttcattcctttgagctactgtacatgctcttccttctgccggtaatgccgttccctcccctattgtcttgtccgcctgaagggtttatcagagtctctggaggccctcttcatcccgacgattctgttgccctaagaaatactgtgccctgaattgcggaacagagctctagttacaaaaaacacccgctggctgtgtgcaccagatgcgtccccaacccgctgctcccagttcagagtgcaccaagcacctgccctattcccagaagtacagaggaagcaagcagcccccaattcacatctcctgccgctgccctgattggggatgaacgggcactgactgcagggccaaagccacagcggcctctcgagctgcagagttctcctgacactggctctagaggaccctcaccccccagctctcaagctcaagctccccagccccctgaataacaggaccatctcctttaagactctaagatataaatgcaggggctggtcagagtagtgactccaaaaaaaaaaaaaaatcacttagtgactccaaactgtcagccaggcgcgatggcacatgcctgtaatcccagcactttgggaggctgaggcaagaggatcacttgaggccaggagtttgagaccagcctgggcaacagggagactccatctctacaaaaaataaaaatgttagccagatgtggtggtacacacctgtagtcccagttattcaggaggctgaggtgggaggatcacttgagctcaggaggccgaggcttcagtgagctatcattgtaccactgcactctagcctgggcgacaaagccagaccctgtctccaaaacaaaaaagcaaggtgtcttctgttccttggtaaagggcagtaaagggtagtaggacttgaaattccccctgattcagagtccactgttgctatttactaaacaccctgagcctatgaaatgaagagaatagttatgctatatggggtatatataaaatatacctatatatcattatatatcgtacatatggcattctatataacatgtacatatatctacataggtatatttatatcaatacatatatttgtatattattatgtatatatcactatatacattatatacctgcaggctccacatgtgtgcatgagtgggaacacacacacacacgtacacacacagtgcctggcactaacaggagcttgcataactagaaggaaactgaggcaggtggtgaggcctgccagcctgtttggtctcctacagctggtagagcagcccctgctctcctgaccttcagtggcccggaccctcttccatcaccctgtgtaccccacagagctccccggattatggtgcactgagaaggcatctggaagcctgggccctcatggcatccaacgataaaggcatggcaccctcgctgggctctccctgggcctcccagatggggccctgggatgccatcctcaaggctgtcaaagaccagctcccgtctctggactcagactcccctttggtaagcaagaactctctccctggatgccttgtccttcctaccagagcaggcatgacgctggccaggacagctttggagcacttctctgaagacttttcctgctgacctgtgcagtttgttgtcattttactttaaatcgcatggccagactcaaagttgtgttttctgggtgcctatttccttctttactctttcttctgccttgattgtcatctctgagcatgggtattggtgctcagcatcttgggagaccctttcagtggagtttttggtgctgacttggaacccaggtcaatttgatgcagaagctctgtcctttccattctgctattctccactctctcgtgccaggacagggccagaacacccactgagaatgcacaattccagtgcattgtgataagccttcgagggattctgcatttgtggtttggggtccctgaaatggctctcaaagacgctcagaccaatagccctaggtgcaggcataagaccctgctaaagatgctcctggcgggggctgctcagtgcacaggttggcactgggcgttaagagacagtatgagggttttaaaaggaacgggcagggtttgggtcctacctgggcaccagcaacagagcttcagggacctcagacgtcatccagtgcatgacgaggctaaggagaacctaaggggaccccacgcctcagtgctcagggtgttttcacaccttcagtctcatttgagagtatgagccccaaccccttcaagaagacaaactaagctgtgtaagtgatggctcagggtcacaggggatggggagggctggaccctgctctttcagctaccacctcactgccctgttcatgtcacgaggcattaatgaagcacctgctgtatgcgaggtacttgcagaaccaggagccccagtctcacctccacgaggttgtgctgccaagcccatttctaaacggtggcaagaagccgcgcacagcaaggctgactgggagagaaccggatctcccccaggctcctgagcagcagggctggacgggctggatgggctgggcgggctgggctggaagtgagagtggagagtggagagcgggggtggctaggccctcagggctctgcctgctgccttgtcctccaaaagccctctcatttgtccacagtcggactatggggaagaggagctgttcatcttccagcgaaaccaaacctccctgattccagacctgtcggaggagctggctgaagatcctgccgatggcgacaagtccagggcctgggtcgctgcagctgaagagtcccttcccgaggtctgtgggacacagaagagtatacgcctgtgtgtgtgcgatgttagtctaaactgactggtctaaaccactgttctagcatttccacgatatgctagaacatggtccttttttttttcccccatgtacaacccaaggtattcagatgcccaacatctaacctccacgcacctccctctcctggggagcccggcaccttagggctggcatgcacgcttgattttccatccgattttgacccttctcttcttcttgatcgctcctatcctgttctctaccatggcatcctgaatagcttctggccattgtcacaactgcttgtcctaattgtctctcccttaacccagctggcttcatggctacctggctcatcccagcacctggcgagtacacaggaactctggtttactaaactgctaaactacactgctacaggctacagtggggagtgggagggaggaagatggcccatcagtgcctgagcaagcacacaagctggacctcgtgggagggacaacccaggagacaatgagcaaatgtggactaagcgtgccaacgcaggcctgtgttgccagtgctggaggctgagacagaggttcccatgaggccaggagtttgagaccagcctgggcaatacagcaagaccccatttctggctgagcacagtggctcacgcctgtaatcccagcattttaggaggccagtatgggtggatcacttgaagtcaggagtttgagaccagcctggccaacatggtgaaaccctatctctactaaaaataaaaaaattagctgggcatggtggcaggtgcctgtaatcgcagctactccagaggctgagacaggagaatcgcttggacccgggggagcagagatggcagtgagccaagatcacaccactgcacactccagcctgggcaacagagtgagactccatctaaaaaaaaaataataataaagaaaagaaaacagtgtagaggcactaacccacttccaaaatggagacggggcctagctccagcgtaacttctctcaggtgttctgctgagaacaattaacctactgaatgggagggcatgggcaccgaaccagatcatctcccagaaccaggacatgcacccacccatcaccttgaaggaaatctcccatcagcccagccattcctagacctaggtttgaaataaccccacacaagagagatccccagggcagctaagaactctggtgggttcaggtggaacaatttgcatgtgattttattttgctgcttcatttttacaatcaattacttcagaaactcttctggatgattttttcttgtttttttttttttttttttttgtaatgtgggatctctactaaaaaattagctgggtgtgatggtgtgcctgtggtcccagctactcaggatgctgaggtggaaggatgacttgtactctagcttggggtatgaatttctgagccccaacattatcatgattgataatttaaatattgtttcattgctgtaacagtgcattccactctagccttgtatttaaatagcaggatgcctcagtggtgctgtctttagccagcccatattcaacagtagctttccaacttttttttttttttttttgggacaggatcttgctgtgtcacccaggctggaatacaatggtgccctcactgctcactgcagcctccacctcccgggctgaagcgatcctcccacttcagcctcccaagtagctgggattacacgcacgccactgtgctggctcatttttgtatttttagtagaatgaagtgtgcagttaaaaatggttaaaagaggtcaggcacagtggcttgtgcctgtaatcccaccactttgggaggctgaggcaggaaagatagcttgaggccaggaacttgagacaagcctggaagaccaactatgttgtagagactctgtcactacaaaataatattaaaaaaaattaactgggcctagtagtatgtgcctgtcatcctagctacttgggaggctgaagtgggaggatcgcctgggccagggaagtcgaggctgcagtgagctatgatcgcaccactgcactgcagcctgggcaacaaagcgagacttcacctcaaaaaaaaaaaaaaagtacatatttttctatgaaaaacattccctgaagcatgtttttgaggatgctaactgaacatacctgttttcttgacagccagttctggtgcctgcagaattggccacagaacctgggtgcagacagaacacaaggacaaaggatgcatcctctcaggaaggaagagaccctggcaggccttttgaaagctctggtgaggtcagcgctcttcttgggatggccgaggagccccccaggtggctggaaggcgaccttggaagcctgtctttcaacaccaaaggatcccagggtcctccctgggacccacaggccgaagccactctctcctgccatgaaggagacccaaaggcagagcccctcagcactgcctcacaagaatctgtgaaccgccgggccctccgacaggagagaaggaagatgatagagacggacatcctccagaaagtcacccgggatgcctgcggcccgaccagcagtgacaaaggtggggtgaaggaggcgccctgccacgctgcggagtcagctcccagatccaaaatgcccctcgtggagcctccggagggaccaccagtgctctcgctccaggtaggcgcctccccgtgcctggctgtttctcaggcctgttacctgtggcatggctgctgttcccatgcactggagctagaagcagcttgagggctggcccactaggaccttaggcccattatccaccattctgtgtacctgtctcagtagaggggtggagggtcccagcagagcacatcctgggggagggttaacaagaacaaagaacaagcagggcctgccttccttaaagagagaaaaggaggccaggcacagcggctcgcacctgtaatcccagcactttgggaggccgaggcgggagccccggagttcaagaccatcctggtcaacacagtgagaccctcatctctaaaaaaaaaagaaatcatcctggctaacacggtgaaaccccatctctactaaaaatacaaaaaaaaaaaaaataattagctgggtgtggtggcgggcgcctgtagtcccagctactcaggaggctgaggcaggagaatggcgtgaacctgggaggcggagcttgcagtgagccgatatcgcaccactacactccagcctgggtgacagagcgagactccatctcaaaaaaaaaaaaaaagaaagaaagaaagaaacaaagaaagaaagaatgtataaatttaaaaagagagagaaaaaaggaattccactcccgaggatgttcataaatacatatagccatatctaaaatatagaacctggttctgtcaaagcctgatctcaaaatatgaaagccctcattctcataaactagtgagcacctgttaaaaagttgtatttagtgcattaatgagggaaccagcaggatgacagtgccggtttaatgagatcataagaaactgggattttggccaggtgtgatggctcacgcttgtaatcccagcactttgggaagccaaggcaggaggaaaatctgaggtcaggagttcgagagcagcctggccaacatggtgaaaccgtgactctattaacaatacaaaaattagccaagtgtggtggtgcgcgcctgtagtcccactatttgggaggctgaggcaggagaatcgcttgaacccaggagatggggatcacgcccctgcactccagtttgggtgacagagcgagactccatctcaaaaaaaaagaaattgggattttgtaaaacactggggaaaaagagaggaatgcagagatacgcttgtcacattcatgtcctagaggagttatcttgtctactggacagaaaagtaaccatcacaccgtctcggttttacacattttggataatttttcttaacaggttagagaaaactggcaccaggtatacacagaagtcatctttactactgtttaaatcaaccgttctttctgctcacctaaaaacttatttttctccacttagagggctgcaaagagttgaaaggtcatatgataaacatgaattcttgattaatttcctccctcctcctcagactcactctgcccctaagcactcactgccaagccttccagttttagctcctgcctggaacagcttgattcttaaaagaacaaaattttttaacctccaaacattgtgaacctgtatgaacctaaatagtgtttctgaaaacaacacagggtttggctgggctcggtggcttatgcctgtaatcacaacattttgggagacccaggcagatggattgcttgaggtcaggcattcaagaccagcctcgccaacatggtgaaaccccatctctactaaaaacacaaaaattaggctgggcgtggtggctcacacctgtagtctcagcactttgggaggtgaaggcggaggtggaggcaggtggatcacctgaggtcaggtgtttgttcgagaccagcctggccaacatggtgaaaccccatctctactaaaaatacaaaaaaaaaaaaaaaaaaaatgaagggtgtggtggcgcatgcctgtaattccagctacttgggaggctgaggcaggagaatcacttgaacctgggaggtggaggttgcagtgagctgagctcgcaccactacactccagcctgagcgacagagtgagactcggtctcaaaaacaaaacaaaatgaaacaacaatacagggtttccttcgggtcagacaacgtctttgtgccaaaaacaaaagtgaagtactgatccccaagaaagcataggaaggaggtggcaaagtgcaggcccaccttaacggaggcgttcaatctgtaatggaaaggcggggtcagcctatttgcaaactctgtcatgcactgaattcctgatttctacccccaacatcctgtgaccatctccatgggtcacagcagctgtgaagcaggtacttgtgcctctgggacccctcagcatcctcataatcactggttttaatgatttcagcaacttgaagcgtgggatttggatgacatccttcagagtctggcgggacaagaagacaaccagggaaatcgtgcacctggaactgtgtggtgggcagctgaccaccgccaagttcaaggtctgaccttgaacactggagcccacgtgaatccccacaagcagcaccttcctgggcccctcagacacagagggctgcaggctggtcacagacagtcctgcagcccacacaagtcttccctgctggccccgccctaaacactcatgctgccagtccccaaaagacttcattcattcaacatatatgtgaccgcctgctacgtgccaggcgtgggccaggtcctagggacaaaggagaggcctccgcaccccaccccatgacccatacctcctcttccccacctccctgggccagcctgccttccttctccctcctcctccttcctgggggaaggaagccccaccttctgtgcgcagtcagctcctaagcacgctcccgcttcccctggcctccccatttaaaaagggaggcaaaggatgtcaccactgtcactacactcatggctttgctctgggaagtcctgcaaataaaatgaaagttctccaacccctccctatccactcgggccacaaaggcgaggggaggcaggtctgaggcagaggagccagggcaggtgcggcgcttccgcctctggtcccaaagcaaagactcccctgtgactgacagcccgtgttatgttaaatacattttgttggtttgtaattcaaatcccataaagcaggaggtagagagccaaccattctggaggacatgtgtgtgcatgtgtatgtgtgtgtgtaactggcactccctttgtggaggggagtagggcagaatgtattcttttttttttttttttttttttttgagacagagtttcactcttgttgcccaaactggagtgcaatggcacgatctcggttcactgcaacctccacctcccgggttcaagcgattctcctgcctcagcctcctgagttgctgggattacaggcacgtgccaccacgcctggctaattttttttgtatttttagtagaaacgggatttcaccatgttagccaggctggtctcgaactcctgacctcaggatccgcctgcctcagcctcccaaagtgctgggattacaggcgtgagccaccgcgcttggccgaatgtattctctgttttaaaggcacataaccctttaatcaagctattgcaattagaaaatctgtcttacactctgactctagtaggtaaagatgtgtgttcagagctgtttgctgcagtgttgtttaaaaatctgaaaagctggaaacaacccatattcaggaggagtccagctagatcgttttagcacagaatacactgcggctcgatgaggggatctccgtaggttaacgtggaagcatgtaatatacaaagtgaaaaaagtgaagttgaaaaaaaacctatagaggatgaccctattttttttttaagtcaacacacagaactgttcattatgatcacctgtgacaagtgggaccggggtgtgaggaagtgggataaacttaaaaatacgtcactcctacttcaccaagcccttgtgccacaggccctgctcataaagattctgcccccctcagccctgctgagctagaggtggagtcctcagagggctgagtagggagagggctgggcgggggcagtggaggagcctgaggtccattcacatgtggagaccccaggggtcctgaggctccagctgctgtaagtcacaagtgggccaagtccccactaatcagcctctcctttggccatcctcagaccgcatggtgccgagcgcccacaacaggctcatggaacagctggccctcctgtgcaccacgcagtccaaggcctctgcttgtgcccggaaggtgcctgccgacactccccaggacaccaaagaggcagattcaggaagcaggtgggacttgtagccaggcccggctcctgtggtcctttagaatggccccatggttttgtagcactgactgggcctaccaagggcggggcactccatgtgcattttctcagtcactctcaagcatctgatcaggcagtcgctccagtcatccccattttagagatggggaaaccaaggctcagagaggttgactctctctggccataaatggcagggctgggactcaagccctcaagtacctgctctttccccaaacccaacgggaaccctcctttcaatgggaggccatgaggcctccctgagagtaggaaggttatcatgtgaccctgcccctctggccacagctgattggtccagctctgggcatgtgaccccagctgcgggatttttcaatctctgtgtctctgtgtaggggtggaagggcaacagccacctgtcctgccacagggagaaaggcaagctgcagtgaagctgggagaggcagaggtggaggcagggccccagggtcccgtaaggcccctctatatgcctgccctccccacactttggttgctccgcacttgaggaatctgagaaccagtgaatcccttttcacctgaccagcagtgggtttctgtgtctggaaaccaaaagtacctaacagaagtggctacacctggctgggcgcggtggctcatgcctataatcccggcactttggaaggccgaggcaggcagatcacctgatgtcaggagttcgagaccagcctggccaacatggtgaaaccccatctctactaaaaacacaaaaaaattttccaggcatgttggtgcatgcctgtaatcccagctacttgggaggctgaggcaggagaaatctcttgaacccaggaggcggaggttgcagtgaccaagatcatgccactgcagtccagcctgggcgacagagcaagactctgtctcaaaaaaaaaaaaaaaaagaaaaagaaaaagaaatggagagaactgcagtgttaaccatggcagccattagccgtgtgtggctactaaacacctaacgtggtgaatgtgactgaggaactgaatgttttatgcattggatttaaactggcttaaatgtaaacttagccacttgtgccaagtggctacacttaccacagatagagagcatgtccatcatgagggacgttctgttggccagtggtggcctaaatctcgcatgctgttctgaagagtaaaagagcaaatgtgtttaatgtgcccgtctgtagagagtgggcactcactgggtggcagccacgagcactgtgactggacaaacccagcgcaggtcacagagttatcacagagaactgactccacaacacctgcttttctcatttcagatgtgcctcaaggaagcagggctcccaggctgggccaggcccgcagctggcccagggcatgaggcttaacgcagagtcccccaccatctttattgacctgcggcagatggagctaccagaccacctgtccccagaaaggtccggagggcagtgactaccccataccagcctctactttgcagagttgcctgttgaccgcacagagcctctggtggatcctgatggggaggaacagggacttcaaaaggcttggatcaattctcaattgaaaagtgctggcctacagtccccctgggtccctgcagggagggaagaggggcatgaggcacacctcctcgggctgggctctatgcaatagagcccaacacgtctaggctggagggcatcacccacacctgtcctcacctcctggcaggacgtccaccggcctccagtgtggctgctgacctcttgcattgggtcaccagcaaagcccgagtgcttcaagccccaacaagagttggaacaccaggtggagtgggcacatccagaaacccatttctctccctgcagctccagccacagctcctctgacagtgaggaggaggaggaggaagagatggcagctctgggagacgcagagggggcatctccttcctccctggggctacggtaaccacccaggggcctctcgccacctgcagatgtcccacctctgctttctgcagcaagccctccacctggcacatttaccgcctgtggtgaggtcttgctgcacccaccgcacagggtgagggggacggcacagctttcatcatcctgcccacgtccactgggtcccagcagtggcagcagtgatgggctgcctgaattgcattcttgctctgaaatgggagctgggctcatctgcttttctcctgtttcagtaaggagggctgggaggggcggcccccacggggttgagtgaatttggtctcattgtgtcacaggacctgtaccgggaaaagccagcttctccagcagctcagggcctttcagaaggggacagcccagcccgagctgcctgccagcaaggggcccgcgggtgggagggctcaggcccctgaagacacagctggatcacgaactgggaggaagcaacacatgaagctctgtgccaaggggcagagcgcccaggctcgactcccaagaggcaggcccagagccctgggggatgttcctgagccaggggcagccagggaggccctgatgcctcctctggagcaactatagctgcctcaggtagtgggatcccaggagtgggcaggggcgggctgacttgccatggaccctgggccccggtgtccccttgttgttcctgcatttccactagcaggggcattccagaggcagggaccctcagactttggactgttgcccaccctgttagagctcagtcacaggtgcatgaacttagaggaaggatgcagatacaaatctgtatgtaacctgtgacaacagctttgggataaaggggcctggtcctctgagggagatgggcagggacagcaggaggacggggtgctgctctctgcgggactctgaggctcttcatctttctccagttctgcatttttttaaacaggcatctattatttccatcaataaggtctttttaaaaaccaagtaaaacgtatttagaggattttagggttgaaagagacctaagccttattttctggcttcctgcatacttgctattttgggcacctaaattaacacacgacacacacatgcctacccacacagatctaatacacgtggttttttctcttttcgagacgcagcagctgggactacaggtgcacaccaccatgtccagctaattttttttttttttttttttgtagagatggggtctcacggtgttgcccaggttggtctggaactcctctcaatcctcctgcctaggccttccacagtgctgggattatagcactgtgagctgccagcctggcttttaatgaactttttgaaagaggagtaacgagaatttgctttctctttctcttctttacctaagatagaaaggcacacatagattctcaaggcctttgacctttatgaatctagacagaatactggaaacccctggaaatgctgtcctgtgtagaatggagcagcggcctcacttgttgatcaccagcaaaaactggggacatctgcttgccccctgccaagacccggcccctccacaggacaagcctggtcttcctgggtcctgttcctttgccagcaccgtcttgcagccccgtcttcacgggatgcttttgtaactgctgtgatcagccctgacctgggcacctgtttgtctccccaaccttgtctccaggatgtgtcctgctgtctgccccgtgggaagagcagagaaatcatcaccaccttgggccccacggtgccacgggctcaggcagcacagtagggcgccgggcctttgggacagtgtcccagcttcccctggggttcacccctggctgccaggccactgaggatgggcaggggtctcttctcatcaagccttgtaccaggcaaaagacaggccctgcttggccgtggtcactggccgccaagatcagggctacagatgtctgctctctggaccccacgtgatctggccactggggacccccacccgaccccactcccaatgatgaggggcattttcattgcaagtcaaaggcaagacaggcttccataaagtcccaggaggtccctcctgtagggcacaaggccaggctgcctcccagcccccaggccctctcccacctacagagaccctcccctgccccctccactccggggcctgtgccgccagaaccgggctctgcccccatacgctgccctcgcagcctggcggcctccgctgtggctgcctagctgtcaagagcaaaggctttttttttcttcaaccccattttcttccatttctcccacctttttaatgccagtaacctcactgagaatgttttacagtgatggaaaataaactctgttccaagttcaa

SEQ ID NO: 904 - DNA, 5990 bp, Homo sapiens
ctccaggtggagtctgatgatctttatttcttagacagccctggactggggctatgaaacacagtcaccagcactatactcactcctagggtggctctgtctgtggcgttcctcaccatccccgggactcatagctcagtgccaccccccgacaccatgccctccagggggaggggacagcgaaggggagaggagggagagccctgcgcctggccctgtcctgagtccaaagattcccatggtgatcagagggcggtgttgggaatgtgggacacccttggccccgcctccctgacctccccactaccccaccaaaccagccttccttcctcctggcacttccagtgtccattcccggcagtgcaaatgtgttaggtggggtagggggtgggatagggagataaatagcagcctggcgttggcactggctggtgctctgtggtgggtatgagtaggggacggggccgccttcctggagacaagctcctgggtgctgtgatcagaagggtctgtagctccagtagctggagaacacggagatctgcaaggggagagggtgctgtaggttgctgaagggggatggggtagcccaggggagatgtcaaggtcacccaaggacaatatgtcaggacagggcattgctgcctcgcagtgctgtggggtacaccagaccccaaggttggggcgctctgagggtgtggcaaggacccttagaagtccttcccctaatgaaggcgctcggcccgggcccaccttgtccttgagctgctggcagagctgcagggagacggtgaagtagaccagggcgtcgttgagccaggggatcacgcactccactttgtgcacgtggctcacctccaggcgctgagagccccactcgctgtgggcagtgagagggtccctgaggagggtcccggccctccaggtgtggagggatggggtgggcgtgcctggaccccccgcccctgcctacttacaacatggccccagggctatgcagcaccgcgcccccagctgggcggaagttctagggagaacagcaccagacccgtcaggccttgcagggcgtgtgcatggcgggcagtgggccgggcaggggtccctcctcaccttggtggagttgggctgcagggcatgcagctggtacaccgtgaggcagagcttgttgaggttgatgtagacgttgaccagcaggtcggacggcagggcaggggcgaacatccgctgcgggaggcaggtgggatgaggccctcgcaagcccccagcccaggctggatggagcggggctctgcagtcactcatggagtctgcaggggatcccagtccccaccccagagatgctcttctcatcaatgggggcttccagacttttcccaggtgccccaagtatctcctgtgctgtcaggtttgggaaccactaacccgaaacagggttaacgtattttaggggcacaggacggaagccaaggaccccatcccagaaacctgcctagacagaatattccacctataatctgggagtggcacccctccgcgtccatcctgagggcaagctgggacccactgtgggacccctctcctgcagcaggggctggcaggggcactgaccgtgaggccgctggcggcgatctcggggagggtgagggtggcgggggtggtgagccggtttcgggctctggtcagctgcagcatcactgcgtccatcagctgcagggagaggcggggttggctctgcgtcctcccgtgtccccatgcattaaggaacaacagacatggtagctcccactcccacccagcccagtggctactgttcccaggtcccgaaacccggcagcagggacctgttaaagacaggtagttgggctccagctgggtatggaggagggcaggatgtctgcactaatgtcagtcgggatggggctgattcactgcacggggatcctgggtgctggatcaatggggaatggaaggtcctgggaggtcagtcccaggggcacaggctttgtggacaggggtacaggcaacaaaggttggttgtaaagggccagagagggcttcctggaagaggcgatggatgactgggttgaggttttcaggggggtaagccagggtcacggctgatggatggtgggaccacctggagcccattccttccctttgccgtggagcagagccctggcagactcctcagagccccagctttcgtgccattcagccgtggccatgagtaccagggtgatgtggctcccaggaaacacgtaagagctgactgggggtatagggcctgtagcaccctagggtggttacagttctcgaagggatcttagtctatctggttctaagtgtgaggaaacagaggtccagagagggcaggtgaaccaccggaggacacacagcaagtcaggggcagaactcaagcatgaggtcaggtgcccaggtcagctcttcacatgtgccacgcggttaatgtgaaggctttcactgctgctaccggcagtggtgtgtgccgagtgcttactgggggccccgtgacctgaattattatggtgaacagtcactccagcttgcccctgaccccacaggtagaaatggagacacagagtcggcaggtaagtgcttacaggttgcacagctcaacgtggaggccctgggattggaacccaggtgtgattccggatcaagaacgtgggactaggcccaggagtcaggcccgggggcagctcaccttgaggacctcagcgcccgtcttgaactggtagctctggtcccggctggtaagcaggtaaatggcttggctcacatggtttctggcatcctggatctggaagcaggggtcatccagaggggtcacgccagcttccatgcggccaggaggggagagtgggtgctgcctgcctgccccacgtcattccactctccacactgtcatccctgtgccccagagggccaggtccacgccaggtgatgggcatctggcatcacctggggcaggcctggtctctgcccaagctgactgccccctcctttctaagggatggacacacagtaatgcccaagacaagagtctgtgcgagttgcggagggaagcaaacagggcgacaaggcaggggcaagggtgctgagatggagacagtcggggtggagggggcaggggaggaggctggggcccattggtacaggagctgccagggagcatgggcctcatccccagagccatggcaagtccctggaggctctgggcaagggagtgacttttcagagggcttctgaaccatctcatccagccagctgctgtggggactccacagtcccgatgtggccctcggggctctcaggccaggttctctacctccccacatggcgcagcctccagggcttcaggaaacgcctgcccccagctttgctgttaggaaacaccctcccaggcttgctgtggccacagatccccagggctagtccctctccagggaggccccgcggcaggcctgctgccgcctgtccttgtggctgagcactagccaggaggggcggggtcacctgctgcagcttccactgcttgtcctcccggaaggcgaagtgcagcagctggttgttccggggcatcttcaggttcacatcctgacaggcaagagtggggtgagctgggcagtgggggggcacctcctgccacagccactctgagcccttaagcccagggcagaaatggggtgtgtggtggttcaggccttggccgctgtatagggcagagggtctcccaatgccttggccgtttgggggttgaacagggaggtcaggaaacaggaaaccaggcccaagaagagccacaaagaagtgaaatggaaagaggtgaagaaaggggaaggggaagaggaaaggcagcctctgtgaggctctgtgcgaacggggtgcatctagtgtctacaaagggcaacagatggagcccaggaggggggcctccccccacgccttggtgcctggcacagagtcgggtgcagactggagttcaggcattggctgattcaactgtgatgtgtggccagcctaatccaccaatgcccatgtttcactggtccggacgccaggccaggccgtgtgcaaagaacccctctcctgcacctcttactgaatctgcacaccgatcccgggagaaggtgtgagggttgctgtcattttccaaaggagaaaactgaggccagagagatcaagggtcccgcccagagtcgcagggcttgtacagagagaaagtgggagctcccatgctcttccccattggcaggatgggaggggacagggccgggggactcaccgcctggctgagggcatccccctgcagagtcagcacacccttcacctggtctgtgctgtaacatgtggcgtcagagcggtgcctgtggtcacccccccaccacccagccctccctcccggcgggctgcccctcctgtcccatcgcacaaccagctggtctgcaggacagggctatggccatgcctcctaccccccaaggtacccatttccccggtttccgcctagcccaggctcacccacagctgcctaggatgaagttctcttgcttggcgggcccctcagtgccggagcccggcagagtgaagcgcagagaggcctcctgtggaacagagggaaggaggggagctggtagcgcccactcaggcccggcccagtgctccttccagaagcccccctccctccaagtcagcggggggaaggaacaacgtggcctggcctcacctgggttcagctggggtgggaagaccctgcccaagcccccagggcacctaaccgtgagcccgatctctgcttataccacattccctgaacacctcctgtgtgcccgcctcggggaatacaaaacagacaggggcagcctcccagcttggttgagggggaaaggggcaaggggcagagtcagggaacaaggcagtagttatggtaacccgcggtcctgggccacagcaagcactacgccggttacttctgtgagctgcctggctcatttatctacaccccagcctcgcgaagcgggtactgttatctcccttttgccaatgagaaaagggaggcccagggaggttcagtgacttggctgaagtcacactgccaggcagaggcagaattcttcggctcccagattggatgccgctgctcccaaggcggccttccccgacccgaggccgggcgggactcaggcccttgctagcaccctcgtcgggacccgcccctgcccgcacacaggtacttatataatgaggtcggctcgagttcgcggaggcggggccctgcctgaaagccgcggcagccgcacactgtaggcgctcaggacgcagccgcgcggccccaggtggagccagggaaatgaggagggagggccgccacgcccggcggggcagggcgcgggtcgttaccttgaggatgtcctgcagctgcttcaacacagcgtgcacctcgtcgtgcagcagccagcggaactcctcctcctgcgggacagacccggcggtcgcgcccggccccgccgccccgccggcccgcccgctggcccgcgcgccttaccagcaccgcccgctccgccgccgtcgctgccatcacggtggccatggccgcaggccgccgccgagcgccctccccaccggccgctgctcctgtccaccaatctttctgtcctcggtcctccggtcctcccgtccgcccccggcgtctggctccgcccccacccgattggcggagcgggtaccaccccgcccccaggccggctccgtgctcgcgattggctggcgcctgtcggtccgcctcggcccccgaaacctgcgggagccctggaaccagactggcggctgcgggagtgaggctcgctccgcctggccagggacgcggccggcggctgcacgagtcaggcttgctccggctggccagggacgcggccggcaccagcctggggcgcccgcttgggggcggagctcccggggcgcccccagga

SEQ ID NO: 905 - DNA, 1115 bp, Homo sapiens
tggagccggaagcaggaagcagcctgtgctccccaggacctgcctggttgggggaattggaggcttctaggaggtaggtgggggcctgggggctgggctgccagggggagagagaggggagatgacagtggctggggagaaggttgtcagggtaaggaccacagggctgggcaaggagagaagctgggcctggggccgagggagaagtggagtgggagggggtggggaagctggcgctgggccaggagcgggcagtggctgggctgtgggaagcctggatgtggtccccgctgagctgagcccaggatcctgatgcagcctctgggggaccggggcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggtaagtgtggctgtggcctctgggtcctcccagccccctgccctgggctccaggttggggccacacctggacgcctgtcctgtccccaggcaccgtgctgctcctgctgctgctggtcgtcgcccactgctgctgctgcagctcccccgggccccgcagggaaagccccaggaaggtgagcccctggaaggtgagccctgccggcctctgggacctgcacggaactgtactgggggtggaggcggaaggtgaggggagtggcgggaagggtgctcatccccctagggaacaacgagcgaacctgcttggtcccgctgtgcttctcgtgcaggaaagacccaagggagtggataacttggccctggaaccctgaccctgtgtctcctgcccggtggcagtaacaaagccttctgtctgcccagagcctgagtctgcagtgtcttccagtccccgtctgggtgggtgacgcgggactcgccgccccactcaggtggccacctggcctctccaagccttcagtcagcacgactgtgccaggtcatcctcagtcacctagctgggaggggagctggtctcaggccgggcgcggtggctcacacctataatcccagcactttgggaggccgaggtggg

SEQ ID NO: 906 - DNA, 10909 bp, Homo sapiens
gtgacacccagcctttttatttgtggatagctcaaagaagtcatttacaaaatgccttttgttttcaaagcacagcttttcataaaaagcaaggctcacatttaatagatgctctggtacataggtgtgtgttgagagccgctggggactcaggaagcccagcagccccgggatccgccggtggtcagaactcatcatcagaatcgtcatgggcccccctgcagaccttgaaggtccggggggtggtcagctgtcctggggaggccggggccaggttcacccagccgggcccgcggggcagcaggtggctttcattgagtctgatgacgcggtagttctcatagtggatgttgtgggttatgtccttcaggtcttggaggtgggagctgggggaccggagacggtcagccccgatggtggtgtccccagggcccctcgccagccccctagccccaggctccccacaccctcaccggataagcaggtctctcaggagaggaaattcacagtgcgccatgttctccactgcaagacatgggactcagtatgggcgctgcttagtgagcactgagtaagtgcctactgtatgcaccacctgacaccatttcccttagcccttttcccacatttctctttaccctatcctgccttccctttgttggttcattcattcattcacccactgttgtgttcccagtgcctggtacaggcggctcctacaaatagctgtagaatgaatgaatccaccaatcattattgtattatatgtacactcggcctctgtatccatgggtgcccactgtaggacttgagcatctgccgattttggtatccctgggggtcctggaaccaccctctgcggatagcatgggtgctatatcataggcaatagtatagtatatttctggctgggcgcggtggctcacgcctataatcccagcagtttgggaggctgagttgggtggatcacctgaggtcaggagtttgagaccagcctggacgacatagtgaagccccgtctctactaaaaatacaaaaattagccgggtgtggtggtataatctgtagtcccagctatttgggaggctgaggcaggagaatcgcttgaacctgagaggcggaagttgcagtgagccaagatcgctccactgcactccagcctgagtgacaaagcaagactctgtctcaaaaaaatatatatatatagtatagaatatttctaataattataataatacatcacctgaccgggcgcggtggcacacgcctgtaatcccagcactttgggaggccgaggcgggcagatcacgaggtcaggagtttgagaccagcctggcaacatagtgaaaccccgtctctcataaacatacaaaaaattagctgggcgtggtggcaggtgcctgtaatcccagctctttgggaggctgagacaggagaatcacttgaacccaggaggcggaggttgcagtgagccgagatcacgccaccgcactccagctcgggtgacactgcgagactccatctcaaaaaaataaaaataaaaaataataataatacatcaggggctacatcctcgctgcccctcctgtgtcactttccctagctccctaaggcagtctcctctccctcccgccacaatcgccttcactgtgcctccccgacctgtccttgtcctgtcagctctatggggacagggaccctgtcagtcctccctttaccgtgcactgcagtaactgcacatagcggtgcctgatacacagtaggcccatcgtaatttccggccagccactagggcagccttgggtattgggcattgtgcaaaatggtggttctccccgctccaacaccctaggaagttgatgcactgtgatgcccactttactgtgaggaaactgaggcccagagggtccggaaacttgccacagcctcccagctggaaagagggaccattccccagggctctttgtctagtgggcttcacctttctgtgccctgtgatgggtgcgaaggttgcccaaggctgctctggtttccaaactgaccccacctgcatcctacccaggggccccgcactgaccttcaatgatgccccacttggtcttccggcccaggacacacctcccgttcaccaggtgctcttggtcagcccctaccacggcaaaagggattcggtcctgggaaaggagaagacacagagatgggaggattgacttcgctggggagaagagaagaaaagtcaaggcacccaggcaggagaggggagtcctatccttttcgaggagggaacatggtagaaagtgcacagaattcccaagttcaaagacataaagtctaattggtgcctctggctgagtgaggtagctcttgcctgtaatttcagcactttaggaggccgaggtgggaggatcacttgagccctaggagtttgagaccagcctgggcaacatggtgaaaggccatctctgcaaaaactaaaaaattagctgagcttataatcccattatattatatagcgtattatatagctcacacctataatcccatagctcactgcagccttgacctcctgggctcaagtgatatccccgcctcagtcccctgaggagtgaggaccataggtgtgcaccaccatgcctggctactttttaaacatttttagtagagatgagttctctgtgttgcccaggctggtctctaactcctgggctcaagtgatcctcccgcctctgccttccaaagtggtgggattataggagtgagctaccacacccagcctgcctgtcttcctatatataaagttttattggcacatagttgagcctatgagtcatttttgtctatggctgctcttgaaccatgacatcagagttgaatcatcacaacagagaccctacggcccagaaagtctaaaacatttactacctggccctttgcagaaaaggttgttgaaccctaccgtaaactccagttgtttacttgctcatggccagaagcagaaattcaaacttgcaaactccgaagtgacatatatgggtttttacttctgaattcatctgtgatggggagtaatgtggatgttgataatattgggcgtggtggctcacacctgtaatcctagcattttgggaggtgaaggcaggcagatcacctgaggtcaggacttcaagaccagcctggtcaacatggtgaaaccctgtctctaggaaaaataaaaaattagctgggtgtggtggcgcatgcctgtaatcccagctactcaggaggctgaggtgggagaatcacctgaacccaggaggttggaggttgctgtgaacggagatcctgccactgcaccccagcctgggccacagaacaagaccctgtctctgctgggcacggtggctcacgcctataatcccagcactttgggaggctgagatgggtggatcacaaggtcaggagatcgagatcaccctggctgaaatagtgaaaccccatctctaccaaaaagacaataattagccaggcgtggtattgtgcacctatagtcccagctactcaggaggctgaggcaggagaatcgcttgaacccaggaggcaggggttgcagtgagcggagatcacgccactatactccagcttgggtgacagagggagactccatctaaaaaaaaaaaaaagaccctatctcataaaaaaaacaacattaaaaacaaaacaaacaaaacattgtacggtacgggggtttttagtatttgaccagggttatgcaaccatcatcgcaatctaatttcacaacgttttcatcacgtccccccaaaaaaaccccataccttttagcaatcactccccatttctcccttccccacagcccctgactaccaccaatctactttctgtctctatagatttgcctatgcctatttgggacatttcatataaatggaatcccataatacgtgaccttttgtgtctgactgatttttgtctgagaaacatgtttacaaggttcccccacgctgtagcaggcaggtgacagggtgacagtgcttcatttttttttttttttttgagacagggtctcactcccttgcccaggctggggtgcaacggtgtgatctcagctcactgcaatctccatctcctgggttcaagtgattctcctgcctcagcctcctaagtagctgggattacaggcatgcaccaccacacccggctaattttgtatttttaggagagacgggatttctccatgtcggtcaggctggtctcgaactcccgacctcaggtaatctgcccacctcagccgcccaaagtgctgggattacaggtgtgagccaccgtgcccggcctttttttttttttttttttttttttgagacagggtctcactcccttgcccaggctggagtgcagtgtcacaatctctgctcactgcaaccttcaccttccaggttcaagcaattctcctgcctcagtctccccagtagctgggattacaggtgcgtgccaccacacgcagctaattttgtatttttagtagagacagagtttcaccatgttagccaggctggtctcgaacccctggccgcaagtgatctgcccacctcagcttcccaaagtgctgggattacaggcatgagccactgagcccagccttgaactgtacacttttaaagggtgaacttcattgcttttcatggttaagggatagtccatggtagggaataggccgcactgtgtttccccactcatctgttgatgcatatttgggttgcttccactttcggggctaaaataaataatgctgctgtgaacattcacgtacacatttttctgtgaatgtacatttttgtttcttttgggtatacacgtaggagttcagttgctgggtcatagagtaactgcatgtttaagcatttgaggaaccaccagactgttttccaaagtggctgagccattttactttccctccagcagtaggtgagggtttcagttcctccacatcttccacagcacttttttttttaagctggagttttgctcttgttgcccaggctggggtgcagtggcgcaatctcggctcaccgtaacctccacctccaagattcaaccgattctcctgcctcagcctcctgagtagctgggcttacaggcacccaccaccacgcccagctgatttcttgtatttttagtagagacggggtttcgtcatgttggccaggctggtctcgaactcctgacctcaggtgatccacccacctcggcctcccaaagtgcagggattacagggctgagccactgcgcccggccaacacattttttttttctgagatggagtttcactcttcttgcccaggctggagtgcaatggcgccatctcagctcactcactgcaacctctgcctcccagtttcaaaattctcccgcttcagcctcctgagtagctgggactaaaggcgtgcaccaccacacccagccaattttttgcatttttggcagagacaaggtttcaccatgttggccaggctggtctccaactcctgacctcaagcgatctgcctgcctcggcctcccaaactgctgggattacaggcgtgagccactgtgcccggcccaatgttctctatatattcaggatacaagccccttattgggtatgtgattcgcagacattttctccgattctgtgggttgttagtgtgagctgttatttcttgctcaccttgagcttgtggatgagtagagaatcatatctgctaggaatatgtgcacatttccctgagatgtagagaaagatgagtctttggatggaaaggatgtgtgggaaggaaatcacctcgcccgcctcccgccccacagcctctcacccgtaacttgctgttgaggattttgtcattgatgtcctcgtcaaagcacatctgggggtagacgtcgatgcagtgggtcctcaggttctgctggatctggagatcccacacaggtgacctcagcccaccctgcccactctgccctctgcccccgctgaccccagccctgcccgggcatccagatcaccctgcgcctgaaggcctctcgctcctccatggtcaggctgtcggccctggcaatcacgggcaccacattcacagtccggcacagccgctgcaggaactcaatgtccaggggccgcaggctgccggaggcagggcagtgatgggggtggcggtggtggtgagtgtataaacgacagcagcagggcacgggggtgggggcagccggcagcccatggtggggaccccttctcctcctccctgccccgtgcaggtggtcctcgccttgcaggtgcagccccctcaccagtgcccagtgggtggtacaaagtacacgcagcagtgcacccgggtgtctgggatgtggcgctggcgggtgatgaggatctcctcctgcaggtactgctcgtattgctcgttgatgtagcccaggatggggtcccagctgaggcgggaggtggaccctcccctcagaactgtgctgtgcccagagagccccacccctctcctctgtgtcctctgggcggtcctcccttgggacgacgaatcgtcccggttggcccgggacctgtgggtcaccccggtactttcccccacttccctgcatcatcagagacacacagggagacctcctgccattctcggcttcactgtctgtaaaatggagacaatagtagcacctacgttgcaagtaagggaggggtgagcattaactgtattaaagggccacagctgggcccaaaccaccaaggaatcgcgcctgatggttgcaggggtctccctcctcctcttcgagtcccttcccctcttgggtattgtcaacactgtaagtagccaaacagatccttttaaaaacaggtgtcaggccaggcccgatggctcatgcctgtaatcccagcactttgggaggcggaggcaggaggatcgctcgagcccaggaattcgaggctagcctgggcaacatggggaaacgccaactctacaaaaaatacacaaattagctcggtggggtggcacgtgcctgtggtcacagctactcaggaggctgaggcaggagggtccttgagcttggggaggtcaaggctgcagtgagccatgatctcgccactgcactccagcctgggaaacagactgagacactgtctctaaataaataaataaataaataaataaataaataaataaataaataaaatgaaaccagggccaggtgcggtggcttatgcgtgtaatcccagtgctttgggaggctgaagcaagtggatcacctgaggtcagtagttcgagaccagcctggccaacatggggaaatccccgtctctactaaaaatacaaaaattgggccgggtgcagtggctcacacctgtaatcccagcactttgggagactgaggtgggcggaccacccgaggtcaggagtttgagaccagcctggccaacgtggtgaaaccccgtctctactaaataaattcaaaaaagtagccgagcgtgttggcggatgtctgtaatcccagctacttgggaggctgaggcaggagaattgcttgaaccccgggaggcggaggttgcagtgagcagagattgtgccactgcactctggcctgggtgacaagagcgagtctgtcttaaaaaaaaaaaaaattagccggaaattgcttgaacccaggaggcagaggttgcagtgagccgagattgtgtcactgcactctggcctgggcgacaagagctagattctgtctcaaaaaaaaaaaagatcacacagcctggctgttccaggtctggggtgtttcccaaaggttgaagggggaggggcacggacaggaggggacagccatggcttggcccccacctttgagaacccaccacttgttgcgggcacagtggctcatgcctgtaatcccagcactttgggaggccgaggcgggtggatcatctgaggtcaggagttcaagaccagcctggccaacatggtgaaaccccatctcaactaaaaatacaaaaaaaattagctgggcgtggtggcgggcgcctgtaatcccagctacttcgggaggctgaggcaggagaatcacttgaacctgggaggtggaggttgcagtgagccgagatcatgccattgcactccagcctgggtgacaagagtgaaactctgcctaaaaaaaaaaaaaaagagagagaacctaccagttgtcattgttgatctggtccccgaagccgggcgtgtccgtcaccgtcagcttcagcttcacacccttctcctctatgactgtggagggagagcagagtcgggagagactggacccaggtgggatggggtggggcagggtggggtgaggtgtgggcaggggctcactcaccatgggtcagtgaatgcagctgcagcgtctggggtgtgggcacccccaagcccggtgggtttgacttccacactttggacttgaacagcgtgttcaccatcgtggacttgcccagcccgctttgccctgggagtggcaaccggatgacagcagttagggtgggcgttttaggcagtttttctctaactctttacttttctattttatttttggagacaggttctcactctgtcacccaggctggagtgcaatgatgcaatccccgttcactgcagcctcgaccttcccagactctagtgattctcgcacctcggcctccctagtagctgggactgtaggcacacgccaccatacccagctgatttttgcactgctttttttttttttttttttgagacgcagtctcgctctgtcacccaggctggagcgcgatggtgggatctcggttcactgcaagctccgcctcccagattcacgccattcccctgtctcagcctcccaagtagctgggactacaggcgcccgccaccacgcctggctaatttttttgtatttttagtagagacggggtttcaccatgttagccaggatggtcttgatttcctgacctcatgatccgcctgcctcagcctcccaaagtgctgggattacaggcgtgagccaccacacccggccttgcactgttttttaatttttaagacagggtctcaatctgtcacccagactcaagtgatcgcagctcactgcaacctccaccctcaggttcaaacgatcctcccacctcagccccccaagtagctgggattcaggtgcatgtcaccatgcctggctaatttttaaattttttttgtagagatggggtcttgctgtgttgcctaggctggtcatgaactcctggcctccagggatccttctgcttcagtcttgctctgtcacccaggctggagtacagtggcgcaatctcggctcactacaacatctgcctcccaggttcaagcaattctcctgccttagcctcctaagtagctcctaagtacaggcgcccaccaccacgcctggcaaatttttgtatttttagtagagacggagtttccccatgttggccaggctgttttcgaactcctgacctcaagtgaccctcctgccttggcctttcaaagtgctggaattacaggcttgagccaccatgcccggcctcatttttgtactttttgtagacattaggttttgctagtctcaaactcctgagctcaagtgatccacccacctcagtctcccaaaaccctggattataggtgtgagccaccgctccaggcacatttttgtcttttaatgactcagcatttctcaaattttcaatgacaacatccctgtgaggtgctattatcaggcccacctaagagatggggaggggcgacaggctgccaaaggtgaggccacacgcccaggcacgcgtagcactgtgggtctgtcctgccgtgggccctacctctcactcacccaccaccatgatgttgaactcaaaccccatcttcatagccttgatcttcagctggtccagcacagcctcaatgcccacaggaccaagcatctcgcagggtggggtgctggggctggagggctgcgaggacaggcagggagagggggagcgcctcagggggtccatgggggccaagggttcgagatgcctgtcaccaggtgggtggggagaagggggtcactggggctcagaggagcccacattgacctctcctatctgaacccctatttgagcttggccgttggccaaccccctccacacttcatgcctctggtgtaccctaagtgcctgtagtcccaggggtgtggcaagggtgcctgtggggagctgtttctgcagggtgcctcaacacccatccagagaggctccgctgcccaagggtctgccctgtccccacctacagcccaggcaggggcctctcaggtcgcttcccccagcagagcctggagggccaggcaaagtccaggatgggtgtttgcagccaggctggagtcctggaggggcttcagggagtgtgtatggggtgaagtggctcccgtcccagcaggaaacttgggcagggggctcaggaggaggtgcccccactttccccagggggacacacagcagagttgatagagagcgagaaagacggcacaggcatgaaggtgacggagacagagagagagagaccaaggtcaggcagggaagatggctgggagggagcggtgcgaagagcccacggggggcagagagagagagaagcagcctgctgtgacacctggtggacgtgggtcctggtggagcttccaggagctgccttgtcctggcagggcctggtgtgtgtgatgggggaggggagagggtgacagttaaccgaagaatctgagctccatctgcacttgctgtgacccccacctggaggcttctctgcagcaggagcaggagctgttacccttctaatccccacaatgaccccagcctaataatacaataatccccaagtagaaccaggggcccaag

SEQ ID NO: 907 - DNA, 5990 bp, Homo sapiens; identical to SEQ ID NO: 904

SEQ ID NO: 908 - DNA, 10909 bp, Homo sapiens; identical to SEQ ID NO: 906

SEQ ID NO: 909 - DNA, 44101 bp, Homo sapiens
ctgtgttaccaagaagtgttttatttttcttgcagtagctttgttaattgcacaaaatcatgttttgtttttgccatttaaacattatcacacaatcctattctgaaagacaaatgttcattaaaaacaaagcaaaaataaaaattcacaaccttaattacctagatttgtcatttaaaggtttaaagaaaaaagggaggggctttcttacaagctttttcacaagtgtcacattttctccttaaaagggaaggatttcaaaagaaaggtgaaatagcttaaacagaaatattcataaaaaggaactttacagaattgtcaacaatattaagacaaaattgactaaccggtttcattaccgcatcttcccccgcccccacccccagtgtgttccgccaggactagaacaggctttgtgttcagacagaaatgcttcaaaatcccagtgaaatgaactgtgctaaaaacccgacaggcatcttccctgccctccccccactcgtcttctgcaatcctctaacccagtttctaatctctgaaaggggccaaagctgtgaggggggaaggaccccgccctagtgtggccaccctatatataattacatattgcatcgtaaatgctggccttccttctgcaaattatgattttggaaaatccaacccatgcagagggataaaaaactgacatcccttgggtaacttttttttttgcaacattccaagccccccccggtcccctatccaaggacaaatgtagggcctctaggatgtcccagacccacctcggagggccagtcagttcaggtaggtcaggcccagttctcttccctcccgacagaccccgggcccgggaagcaccgaagaccatgatgctggctggagtgaagacactcgtttccgtatcaagagctgagcctaagaaatgctcatcgttggtcaggctgggtctgggccaaagggacagacagaaagaaatactgtctccacgggaggaagagggagaggagggaggatggagagcggtgggcatgcaggggacttggcagggcagggtggagaaggtgggaccactgggaggggaccgaggtaagagtggctcttcagagccaggtgaagagtctgtggcctaacggaaacagaaaggagcgcccccaacccccactcctcttggctcatcactagtggccctgaggactccctcccaagggatggaatgcaaatccaaatactaaaacagcctagggaggagcgagcgcccgctgtggcagtggcatctggggcatggcttcgaggcggtgagggccgggcctccatgctcacctgcaggccggctgcttgctgcactccctggaaagccagggccccatcttctcgggactctgccagtctcttttcagttcacaaaggcgtctatggagcgctgggtgcacactggacgcttagacgtgaacatctttctcagctcatcacctgaggttggagggccccaagggcccctctgtctggagtctgtactggctcatctgggcccaaggcctctccttgtagggaatccagtgggggatggggacatgactacagcctcttcgctctgggggaagctgtgggaaggcttccaactctcgttgctgattctagttccttgactggaaggggtttgagataagacaagctcggaagaaaaaaagccaggcagcagtttctgggcagcttctatcctggggcgagagcctgtgtgtgtgtgtgtgtgtgtgtgtgtgtgtgtgtgtgaacacacagccacctcgtccggggggccagtgcccagctcaagagctttcccacacgccaatcctgctgacacttgtcccctccccaccggcctcaggggaagggtgctgctgtgtgctgtgctgatggcaagtctcaaagtctgtataaaaggaaatggagataggtgggctggtccagaatgaactcccaggcccccgaccccatgtgaggaagagggggtcagaggggggattggaggggtgagggcggggtgtcgacagcttagtgtatgtaggctcggtacacggcggacatatcgttgtcagactggtccagcgccttggctcttttgtacacctggaaaaaaaagagatggctcagtctctggccccagagctgccttcaagacctagacctgattcctggaggcagtggtggatgtggccagcaggcagtgctggagcccaggctgtccggttaggaatcctgtgttgaccttgcatgaagcacctccgtttctctggacctcagccactgtgcttcttgctctgggagaaggaacagtacccgggggatcttgtgagaatgaaatacactatgggatataaaacattcagcattggccgggcactgcggctcatgcctgtaaggccgaggtgggtggatcacctgaagtcaggagttcgagaccagccaggccaaaaaggtgaaacctcatctctactaaaaatacaaaaattagggccaggcgcagtggctcatgcctgtaatcccagcactttaggaggccaaggtgggtgaatcacgaggtcaggagatcaagaccagcctggtgaccgtcgtgaaaccccttctttaaaaaaaaaaaatacaaaaaattagccgggcatggtggcaggtgcctgtaatcccagctactcaggaggttgaggcaggagaatagcttgaacctgggaggcggaggttgcagtgagctgagatcacaccactgcactccagtctgggtgacagagcgagactctgtctcaaaaacaaaaaaagagcaaaactgtctcaaataaataaataaatgaataaaaaataaaacaagggcagatgaaacacccaggacacctatacctcagagtgagagttctcacacctgtggtgcttctgcccccaggggacatctggtaatatctggagacattttctgtcacctgaggaggagctatgtcactggcgtctggtgggtgggctacccaacatcctgcagtgcttggatagcccccccacacagaatggcagcagtgccgaggttgagaaaccctgccttaaaggatgagggagaggaagggggaaagaaatgcttctgtgtggttgcaaagtttttacatttaatgggaaatggtacaagattaactgtcttttttttttttcttgagacagggtcttgctctgttgcccaggctggagtgcagtggtaggatcatggctcattgcagcctcgaactcctgggctcaagcaatcctcctgcctcacctgcctcagcctcccaagtagctaggaatagggtgctcgccaccacgcccagctagttttttatttttttttgtacagatgggggtcttgctatgttgcccaggctggtctcaaactcctgggcttgcttaagcctcgaccctgcctcgaccctgcctcgacctcccaaagtgctaggattacaaggatcacaagtataagccactgtgcctggcaagattaactctatcttaaggatttataccgcaatctgtagagtaaccactaaaaaaagaatgcagaggcaaagtaaaaaagaaaatagataaatgaaactggaattcttttttcttttttttttttttgagatggagtcttgctctgtcgcccagactggagtgcagtggtgtgatctcggctcactgccagctctgctctgcctcccgggttcacgccattctcctgcttcagcctcccgagtagctgggactacaggcgcccgccaccacgcctggctaattttttgtatttttagtagagacagggtttcaccctgttagccaggatggtcttgatctcctgacctcgtgatccacccgcctcggcctcccaaagtgctgggattacaggcgtgagccactgcgcctggccccttttttttttttttttttttttgagacggagtcttggtctgtcgcccaggctggagtgcaatggcacgatctcggctcactgcaacctccgcctcctgggttcaagtgattctcctgtcccagcctccggagtagctggcattaatagtgcccgccactatgcccggctaatttttggtatttttagtagagactgggcttcactatattggccaggctgatctcgaactcctgacctcaggtgatctgcccgcctcagcctcccaaagtgttgagattataggtgtcagccaccgtgcccagctgaaactggaattctaaaaagaaagtaagaaaggaggaacaaacaaaagacaaagacaacgaacagaaatcaaatgataaaatggcagccccaaattgaaccacatatcaatacaactactaaaggtcaatgcaccagttaaccttcagaacctaacctctgaactcctaacagtatagagtctaagctcataccatccaaacgacctgaaagcagcgagctgcattgagaaattaacctaaaaactctgcttccaagccaatgaatcctgtagtcagggtggaggcaacttggaagtcacttcaaagagaagctttcccagcccaagccacatgaaacccttgggaaataactatagtcagaaatgagctttcatcaaaaaagacttataaaatacacaacgaattctactatccagagagaatccactggtagaatgaacaggggggacttgaaatagtaatgtaatctgaaagagtcatgaaataagtactctgaaatgttgaaacagacaagagacagaagacagaatttaggaacaaggctgcatgcggtggctcatgcctgtaatcccagcactttgggaggccaaggcaggcggattacttgaggccaggagttcgagtccagcctggtcaaaatggtaaaaccctgtctctactacaaatacaaaaattagccaagtgtggcggtgcatgcctgcggttccagctacttgggaggctgaggcaggagaatcactttaacccaagaggtgggggctgcagtgaactgagatcatgtcactgcactccagcctgggcaacagagtgagactctgtctcaaaaaaaaaaaaaaaaaaaaatacaattcaggaacagagaattatactatgaaaagccaggtgtcaaaagaacagtactggctgggtgccatggctcacgcctgtaatcccagcacttaggtaggctgaggtgggtggatcacctgaggtcaggagtttgagaccaacctggccaacatggtgaaaccgtatctctactaaaaatacaaaaagttagccaggagtactggcaggcacctgtaatcccagctactgtggaggctgaggcaggagaatcacttgaacccaggaggcagaggttgcagtgagccgagattacaccattgcactccagcttgggcaacaagggtgaaactcggtctctaaaataaaataaaataaaataaaataacataaaataaaagtgtatcagctgatagtactttaaaaatacagctgctgtttcacaaagtgtcatttttattataataatatggtaaagacaaatgtttttcagttgttttttttttagattcaaattctatgaagatgagctaagaaagcggaacttctaccctaaaaagcttttcgaaagtgtatgtgaagttggatacagttgtgcacgcctatagtcccagctactcgggaggctgaggtgggaggattgcttgagcctaggaagtcaaggctgcagtgagctataattgtgccactgcactttacctgggcaagagagtgagactgtgtctcaaatataaaaaaagtgcacgtgttaagtgcttaaaacatcatttgaaaaatgctaatagacatgctaattaaaaggcagatactgtcaaaatggataaaaatccaaaccccaattacatactgtctatcaaagccataatttagacataaataagagaggaaatggatggaaaaatatacataccatgaaaacaataagcctgagaaggctgtagcagctttcgtttttttttttttttttttgcgatggagtctcactctgttgcccaggctggagtgcagtggtgcgatctaggctcactgcaacctcccgcctcccaggttcaagcaattctctgcctcagcctcctgagtagctgagattaaaggtgcctgccaccatgcccagctaattttttgtatttttagtagagataggggtttcaacatcttggtcaggagaatgagaccatcctggctaacacagtggaaccccgtctttactaaaaatacaaaaaattagccaggcatggtggcaggcgcctgcagtcccagctactcaggagggtgaggcaggagaatggagtgaacccgggagacgaagcttgcagtgagccgagatcgtgccactgtactccagcttgggtgacagagcgaaactccgtctcaaaaaaaaaaaaaaaaaaaatcatacaggcagctggttgtggtggttcatgcctgtcatcccagcactttgggaggctgaggtggacggatcacctgaggtcagcagttcaagcccagcctggccaacatggtgaaacctcatctctactaaaaatacaaaaatcagttgtgtatggtggtgtgtgcctgtaatcccagctactcaagaggctgaggcatgagaatcgcttgaacttgggaggcagaggttgcggtgagccgagatcgcgacactgcactccagcctgggcgaaagagcaaaactctgtctccaaaaaaaacaaaaaaacaaaaaacaaaaaaacaaaaaaaacccaatacagggcagggcatgttctttgatcatagagcagtaagttaaaaatcaataatcattagatatctaggaaaacccaaacactagataaacttttaagtaattcatggatcaaagaagaaatcagaaaacaaattaacacggattagtggacatttaaagatttatatactcatgttataaagaaagcaggattaaaataaatgatttaagattccactttaaagggtttgaaaaagaacaaagaggccagacacagtggctcacacctgtaatcccagcactttgagaggctgaggcaggtggctctcctgaggtcaggagttggagaacagcctagccaacatggcaaaaccccatctctactaaaaatacaaaaattagcagggcgggttggggcacgcctgtaatcccaggctacttgggaggctacttgggaggcagaggcacaaaaatctattgaacccaggaggcagaggctgcagtgagctgagatcacaccactgcactccagcctgggcgacagagtgagactctgtctcaaaaaaaagaaaaagaacaaagaaaagctaaactaagtagagggaaggaaacgataaaagaaaaagaaacttggccaggtgtagtggctcacacctgtaatcccagcactttgggaggccgaggcgggcagatcacgaggtcaggagatcgagaccatcctggctaacatggtgaaaccctgtctctactaaaaaaaaaaaaaaaaaaaaaaaaaaaaaaaaaattagccgggcgtggtggcaagagcctgaggcgacagagcaagactctgtctcaaaataaaagaaaaagaaaaagaaaaagaaactgaatggctgggcgtggtagctcatgcctgtaatcccagcactctgggaggcagaggcgggtggatcacctgaggtcaggagttcgagaccagcctgaacaacaaggagaaaccccatctctgctaaaaatacaaaaattagctaggcatggtggtgggcacctataatcccaactactcaggaggctgaggcaggagaattgcttgaaaccaggaggcggaggttgcattgagctgagatcgcaccagtgcactctagcctgggtgacagagtgagactccgttaaaaaaaaaaaaaaaagaaagaaaaagaaactgaagggccttggggcttgggccacatctaccctacctcatttgctgcagctgccatgggagtcggatggttgaccgcatcacccagcgcaatggctaagcggagatccttctgaatgtatttcaggtagaaatcaggcttaaagtttccttgcaggatatctgaggagaaaaagccagtatcagacaaaagccaaggacctgaaactaaaaactacttacggtccaccaggtgtcagtacctaaaacatactcagggctcagttccacatagcctaggcctcttggctcctcactcacccttagacacctgagggctgcagctcccagcctatatccccaaatcccgcccactgtgtttctgaacctcctctggccagggtcagggactgactggggaggggcatctttcacgctcactaaatccctgacctagtaccctgctctaatcaaacaccaaatgcaagaagaggggccaaaaacaactcactttggcacttctggtccaggaagatgctggccaactgtccctgattgaggatgtccaagagtgtctgctgggactggcctgtcacgtgggccagggtcagcccctcggcaatagtggccatgaagctcccttggaccatgttcacgatcagcatcatcttggctgcattgcccacttcacctgcccagggtaaagactcacggtcacagcccaagaatgccacagacagggcttctctgtccaccctcacctctgctcagacccacctctctccaggggaggcccccttcacctgcccccgacagactggctcttcctccttccacgcactgactatgcaggtgaaaggaaaccttccccagggtccccggcagaaaggccgtgtgggactgacgctgtcatcagtgtgaaacagaggagatgtggccccaggctccaggcctgacaggtgcaggcgtgttacctaggaagaaggaggtcttccccatcgcctggaagcagctgctgcagtcctcatataagcccctgtctccagccgctaagatcaccaacatcccgtcattagacagctgctgattccctgagacgggggcttccagaaagcgcccccccctggacacaatcacctggaaagaaaagtcacagcttctggaggcctcccctctcccagcgctctctgggcaggactcaaggagtgttgctgagtggccacggctgctcatcaccttccagagctggaggggacggccacccataccaaggtcctttagctgacacctaaactcaggagctaaccatgtgcaggtcacacaggccgaatcacagcagtgatgagacgctggggtctccacacaggaacccaactgacttggaattttttttttttttttgaggtggagtctcgctgtcgcccaggctggagtgcagtggagcgatctcggatcactgcaagctccgcctcgcgggttcatgccattctcctgcctcagcctcccgagtaactgggactacaggcgtccaccaccacgcctggctaattttttgtatttttagtagagacaggtttcaccatattagccaggattgtcttgatctcctgaccttgtgatccgcccgcctcggcctcccaaagtgcttggattacaggagtgagccaccacgcctggccggaatttttttgttttgtttttttgagacagagtcttgctctgttgcccaggctggagtgcagtggcgcaatctcagctcactgcaaactctgcctcccgggttcatgccattctcctgcatcagcctcctcagtagctgggactacaggcaaccgccaccatgcctggctaatttttttttttttttttgagacggagtcttgctctgttgcccaggctggagtgcagtggcacgatcacagctcactgcaagctccgcctcctgggttcatgccgctctcctgcctcagcctcccaagtagctgggactacaggtgcccgccaccgcgtccggctaatttttttgtatttttagtagagatggggtttcaccgtgttagccaggatggtctcgatctcctgacctcgtgatccgcccacctcggcctcccaaagtgctgggattacaggcgtgagccaccgcgcccggactggaatttcttagagaccaacaactagaaccagatgtgaccatgtcaatggctcggctgaacacacacctcccctgtggatgctgccctcccctcagaacatatgtgggtcccaaagtccccactcccttatttgggccagatgctcggggaggagggatgctttgccagtgtcaaatgcagacagctgctcaaaccccaatgccaggcgggcggcctgggttgcttctcatcataaggctggcagctccaggacttgatgcccatcccagccatgcagcgactgcccatggctgttcagactagctgcggtttgaaggtggagcacgggataggctagtcccaaggctactcgcctctcctcttccctctctggctttggctctagagtaacttaactgcccactcttgtaagcctgggtcttgggctctgatagaaaagatgctggagagccagcccaaggaaggctgctacctgggccagctcagtgacggtgtcagcgtccactgttgacatgtccacgtagcacttcccagggcggatcccttgcagcacaccactggggcccagcaccagctgtggggacacaagggagaagcaatagcccaggctcccgggcagatgctcaggagccctacagacctcagatcagaatcctgctgctgttttggctcatttcctgatttctatcagctgaaaagggaagaacaatgaaataagcaagggatagaaaagtacttcccgcatgctcccatttatctttaaaaagaatctatgtgagtgtgtgcatttctttttatttaaaaaaaaaaaaaaacaaaccccatttaaaagaataaacctcagcatttactttggggacttctttggatttacttggattaggctagtcaccagtttaataagatgactaccacacttgaacttctaaaatatacaaatacagtgacagctaaacatagaagcttggcacctggaccaaaggcacattcagttccaaagcttctagttcaacaagaacacatgaagcctgttcaagacacatttcagcacagacttcaagggccctagtagtgttcattctttgatctgaattaaaggaagtctgtattcaattaatgcaaacacccttcacaatgggagatggcccctgatgggaaattcagccccccacatgtggacactcacttggtgtgcaggggaggaggggaagaggccagccagcaatcctggctgtgacccggagttgctgaggggagggagggggtccttacgtccttggccgccttgggatccgacacgcaggcgaaagtgatgtcgcaggttgagacgacttcagcgggggttcttcccagacgggccccctcctggatgaacaaatcacactgcaaaagtcacagatcctaacgtgagctgcaggcagtgcacaacaaacatgccagccaggccagagaattgctgaccaggcctcctggcggcctaccaaggcaggaggctgaggccgggagcctgggtcatggagataggagcccaacttttggggaagtgcacggggccttttactggccatcttcagtttttgcatgacgagtgcctaggatgatgaactgcttcacaagtgtctgctgaaggtatgctgtttcaagaatggggtatgaacagtagcacctctccccagcccccgctgtgctgtcctggctgtggccctgagctatcaacactctgctgggaatgtggggatgtcgctggaagccttccacctggtggccattcgtttttgggttgtttctcaacactgttgtcaggttaataagacttctggaagtgcctaaaaacactaccattttggctttttttttttgagacaaggttttgctctgtcacccaggctggagcacagtggtgcaatcatggctcactgcagcctcaacctcctggactcaagtgatcctcctgcctcagcctcctgaatagctgggactataggtgcatgccccatgtgtgatttttttttttttctgtagagacagggtttcaccatgttgcccaggctggatgggcctactattttctatcagacttttaatgttgtttatgattcacatttatctatattgttgtctttcataattctggcataattatggtttatagtggttgactatggaaaacttcactgagagatatactgtgatttacctaatggctgacctgtagtttgacacttagcccactttcaattgtaaaatcacatcaccaaacatctttacgtacaaaacttctctatgttttaaattcaggtctccacaaatagaataaaacaggttctaaaagttttaaggctctcaacaaatgtagacagatgacttcccaatgagactatgtcacttcataaagatcaccagcaagctctcctattatgccagtaccaagtatgtaatttaaaaactacaaataagtgcccataaatacatgtaaaattcttcctacctgatcatttaaccagtcaaaaaaggcaactgtttcattttttttttttgagacagagtctcgctgtcgcccaggatggagtgcagtggcacgatctcagctcactgcaagctctgcctcccaggttcacgccattctcctgcctcagcctcccgagtagctgggactacaggcgcccgccactgtgcccggctaatttttcgtatttttagtagagacggggtttcaccgaggtctcgatctcctgacctcgttatcccccagtctctgccttccaaagtgctgggattataggcatgagccaccgcacccggccttgtttgatatattttaattactcctgattaccgaatattttttatgcctttgtttcctcttttgtgagccatttttttgtcctttttcttttctgagacagggtcttgctgctgcctaggtgggaatgcagtggtatgatcacagctcactgcagcctctacctcctgggcccaagagatcttctggcctcagcctcccaagtagctgggactatagtaggcaggtgccacctcactcagctaatattttattttttgtagagatggagtctcatgttgtccaggctggtctcaaattcctggactcaagcaatcctcttccctcagcctcccaaggtgctaggattataggtgtgagcctattcttagatctaaaattattaattagcaccctactaatttttttgtcttaattatcaaactatgtttaataaaagcaacatattacccttcttacgtatttgctacaagtacttctagttggtattcctttgaattttatttttttgttgttggggagtattatcaaaaaaaatcaactgatcttcttgtgtgatttttattagttctagatttacaaagatctatgttagtatttattttcttctggttttcttttaaaaaattacttgtgggccaggcacagtggctcacacccgtaatcccagtattttgggaggccaaggcgggtggatcacctgaggtcagaagttcgagaccagcctggctaacatggtgaaaccccttctctactaaaaatacaaaaaattagccaggtgtggtggcgcgcgcctgtaatcccagctacttgggagtctgaggcaggagaatcacttgaacctgggaggtggaggttgcagtgagccgagattgtgccatttttttttttttttgagacggagtcttgttctgttgccaggctggagtgcagtgacacgatctcagctcactgcaacctctgcctcccacattcaagttattctcctgcctcagcctcctgagtaactgagactacaggtgaacgccaccatacccagctaatttttgtattttctattttttttttttgagacggagtcttgctctgtcgcccaggctggagtgcagtggcgcgatctcggctcactgcaagctctgcctcccgggttcatgccattctcctgcctcagcctctggagcagctgggactacaggtgcccgccaccacgcccggctaattttttgtattttaagtagagacggggtttcaccgtgttagccaggatggtctcgatctcctgacctcatgatccgcccgcctcagcctcccaaagtgctgggattacaggagtgagccaccgcgccaggcaaatgtttaggttttataataacatcctaagtttaggcatctacatctctacctgcctggactaaaagcttggcttctattctattgcacgcagaacgctgagacaacagggggagatgtccactcttagggttaccccagactccaccgatccaacaggcaccacccctgaatgcttactttctctgcagtgcggttccagacagtcactgtgtgacccatttttagcaagttggagacgattccacttcccatgagaccaaggcccaaaaatcctatcctgaaacagagagagactgatgagttcagggtggaaagggagggtcacggtgatgatgattccatgcagcacaaggctcgctcccttatacagcttggggtaggggaattcagactgccagaaacagcagtggccaatctacctgcagagccaggggcgtcatgcacatgggtcttctcttatgccatggtctaaagctgtcccaggatgtaaacaggcattttgaaacccctgactgtcacagaaaaaagtatgatgtgtatggttcagggccagtctcccagggcaaagtccccttgctgcccttttttttttttttgagacagtcttgctctgttccaggctggagtgcaatggcgcgagctcagctcactgcaacctctgcatcctgggttcaagcgattctcctgcctcagctttctgagtagctgggattacaggcgcacgccaccatgcccagctaatttttgtatttttagtagagacagggtttcaccatgttggccaggctggtctcaaactcctgacctcgtgatctgcccacctcggcctcccaaagtgctcggattacaggcgtgagccaccatgcccggcctcacactttacttattttttgagatagtgtcttgttctgttgcccaggctgcagtgtagtggtgcaatcatggctcactgcagcctcgacctcctgggctcaagtaatccttccccctcagcctcctgggtagctgagactacaggcatctgtcagcacacctaattttttgtggagatgggcttttgccatgttacccaggctggtcttggactcctgggcttaagggatccgcccacctcagcctcccaaagtgctggggttgcaggtgtgaaccactgcacccggctctggatactactttaaagcccaacagaatccaccacaagtcactgaagcactgtgtttagagccaggcaacttccttgactgcatgaaccaggacggcaattttcacctctctttcccaacttcaattctctacccacaccctacctttcccgtcttcccgttatcaacagaatgggccttgcctctcctctccaaagctaagtccttcacctgagcttggaacccaatctttcccagtccacaaatccttctccccatgcctgccttcccccaaacctctcactgttcccccagcccttccttccacaggtccttcccaatccttgtgacagaagcactcattggccagtctcctccacacacattcacatactccgcctgctccttcctgcaaccctgagagctgggggctggatgccactgctgctatttcaacatgcttttacggatgacttttagcttgccaaagtgtcttttcttgattcttgtacttcttcacctctctttgcaagtgacaatggtgcaaaagaatgcctttcctcatttctgatcatatcatgttcttgtttttatagtttttaatttttatttatttatttatttaaaaagagagatgggggggtcttgctatgttggctaggctggtctcgaacttttggtatcaggcaatcctctcacctcagcctcccaaagtgttaggattatgggcgtgagccactgcacccagccttttttctttttttagtgacagcattatgctgtctcccaggctggagtgcaggggggtgatcatagctcaccgcagcctcaaactcctgggctcaagtgatccttccacctcagtccacctgagcagctaggactataggtgcatgccaccatgtctggctaagttttaaaatttttttgtagagacggggtcttgctgtatttcctaggctggtcatgaactcctggcctcaagggatccttctgctttggtctcccaaagtgtggggattacaaggatgagctactgcgcttggccatgttttcaattcagaaattctctgactgctggatgtccccggcagctcctccactttgaccctgtcattctttccatagttttggtcttctggaaccatctctacaaatggacccctaatctcagctggaatatcagctgctcacattctccctgtcccagcctgtattaagtaatttgaatcacatgttgaaaatggaacccaccaactttctcaccaaaatagacctccttgctaactgcttcaagttgtggcttaaaaacaaggaggtacctttttgtcactcattatttgggtagtacaatattcccccatgattctaaatcatgacaggcgaattccctttcctttcttggtgttctaggaagtccagtagacctgggataaagcttctggatttttttgagacacagtctcgttctgttgcccaggctggagtgcagtggtgcgatcttggctcactgcaacctccacctcccgggttcaagcgattctcccacctcagcctcccaagtagctgggattaaaggcacccaccatcatgcctggctaatttttgtagagacagggtttcaccatgttggccaggctggtcttgaactcctgacctcaggtaatccgcccaccttggcctcccaaagtgctgggataacagccatgagccaccatgcccaggtcaaggttctggatttttaatatggcaactgagagtccttcacactgtgtctcagacaaaatggaaatgtggattaaggtgggttgggcaacaacaaaactggttggttttgatgctggcttcatactcttttattaaaagtttgactaatgggccaataaatgtgttgggtaaaaacatcaggactctgtcctcaccctatcctgatcatttttttatttttatttttttaacacaatcctcctcccctttgtttgcacctaatatgcccttatctcctccactctacagagacaagttcaccaaaaataactggtagcattagtgatttaaacagtacaaaaatatcatgtaaaagatgcactgtttttagtctggggaagaccatgtgaaaggtacaaactggaaactgactttagctaacttgctccagagaacgtgttttcctagaaaaggtatctttttgccaacaagactctgcggaggagacatgcctacagagcaggcacagaggcaaggctgggcgcaagttgggtctgggagcatgtccaggatcgccccacccacaccgggcagggtgcaggacagccagcaagtgctcagtgaggatccccaagcactttcatctcccttcccccacctgccccaccatggccaattttggggcctcatcatgattctactcagccagtggttctcacagcgtagctctgaccagcagcagcagtatacctgggaactggttaaaaatacaaattcttgggccccacccggacatattgactgagaagccaccttccaggtgactgtcaggcacaggaaagtctgagaaccactgagccaagtgctccttgctcttgagttctggagccaaaaaaatccctcagcttatgcccaagggagacccgaccacagatttacacagcttttgactcctgtctttatcgataagagttacaacatccccccaccttttccattcaatgccagcaatggctgggacacaacccttaaagaacccccctggggtcaccttctccccaccctcagcagaaccagagccactggaggccttttcatcaaaggtcctactttttgtctgtgggtgtgatgctgccattcacggctgtgctgtcagctgcctggatggaggtggagccagtttcctacggacaggaagcacacatcatcaagtcagtctgcctgcagtttaaggccccaggtgaaaattaaaatggggaggcatggagcctacatacctcttcacatattttcaacttcttcgtgattgcctggtaacagacagctggctaatgaaggaggaggaaagagactacttgtgctactgcaggcttaaccagtcttcataataatcccctcaaaggttagacccaaagtgggaagttaacatcaactatttgttttatactttagtgaactccaaattttacactagaaagttcatacacattacctcattcaagtccccatgcaattctaccaggtctttttgctgaccatggtgttgagaataagagtcataagcttggaacccacatctatccaactccaaagccacaaactctcatgagatcctagcacggctcaggccaccccataaccttgcagaccttgggaggacctccctctgcatccgcaggacttggagactacctcttggagtgagcttgaagatgtgtctgccatgcaatttcatggggtgctgacagcttacgatgtttggtttctgccctaaactctaaaggtcactgtgacagtctcaactacacagctggctgagttttaaatgctcttctgagatagagtctcgctctgtcgcccaggctggagtgcagtggcaccatctcggcttgctgcaacctttacctcctgggttcaagcgattctactgcctcagactcccaagtagctgggattacaggaatgcaccaccatgcccagctaatttttgtattttcagtagagatggggtttcaccatgttggccaggctggtcttgaactcctgacctcaggtgatccacccgccttggcctcccaaagtgctgggattataggcatgagccaccatgcccggcctttgggtttatttatcttttttgagacagagtcttacgctgttgcccagtctggagtgcagcgacgcaatcttggctcactgcaacctctgcctcccgggttcaagcaattctcctgcctcagcctcctgagtagctgggattacaggcacgcgccaccatgcccagctaatttttctatttttagtagagatgaggtttcaccatgttggtcagactggtcttgaatccctaacctcatgatccacctgcctcagcctcccaaagtactgggatgacaggtgtgagccaccgcgcccggcctggatttacttttaatcttaacaatgcttggctcattagcgggcccatatgggggcttctgggctagttgctctgggcaatacaccggcagagcctaacttttcagatggccaggccaggacccagtggaggagcactccttggccagcccctgaccaagggccaagagcctcaaaggcaactcaccttctctgtttggcttagcaggaaatgatggaaatgaggatctgcatctttaacaggctgaaaccagaaaacagtgaaataaaaccagttatctgccaccaaaggtcacttccttctccctggtaactggactctcctctggctgcaacacctctggattctggtctctttttcacaattgtctggaaactcttttcccattttggcctaagcctttttataaaaacaagccccattccagctagaggaaaactggctttaaagtgtaaaagaatagatgattctgctaggttggtacacaaattattccaatgagcctgtgggaaaatattaacaagcatacctgtgctttataaattcggtactcatcaggcacagcagataacccagcaaactaagtcacatctattctggaatttcagggttttggcctacttgtgtctggtaccaagcccttggcgatctcatcttactgagcatattaacagaaacagagtagccacgacagtggaccttcatgggctttccataattatgcccagcaacaggtgtagccgcaccaaggataataaaactaaacataaaagttgtatttatggacaataagagggtgtttataaaatattaggggaaaaaaacttgtggaatcatcccacttttgtgaaaaagaaccctgcccaaaataaaaaaaactagacataggtctataatcatgtaaatgaatgctaagtgggcatcccaaaggactgaaatccgtcacctcgagcctcacagtgctcaccctagagggaaatttttaattttttatttcatagacttctgtactgttttgtaataataaattaagcctcacacacaagaaagggacaaaaaaaaaaaaaaaaaggatcacacaggaacctcgccctaagccacagcttgtcctgcctgcaggagagctccttacctcgcttgcggttggctgccatttaaacgcggccatcggtccggccatcatccccttcacggtactagactccgggatggtgagatcctatagagggaggggcagggcattttaaaatcacattcaaaccccaacaaaaccccttgcaagctccacagtctaagggaaagttcaagccaatccccaaccactgttctgatgaccgtccctcgggagaaacaagccagttcttcccattaacacaaagtgagtctttcttctcaattctggaaataataaaatgtgtacttatgtctaaatttcacaaagatggaggtaattagaaagcccaagtacgatctgcagtactgtctgcaaagtttcagagtaaatgccttatggtgaataccaaacattaagaaacagttgtggtggctgggcgtggtggctcatgtctgtaatcccagcactttgggaggccgaggcaggcagatcatgaggtcaagagatcgagaccagcctggccaacacggtgaaaccccgtctctactaaaaaatacaaaaattagctgcacctgtactcccagctactccagaggttgaggcagaagaatcgcttgaaccggggaggtggaagttgcagtgagccgagattgcaccaccgcactccagcctggagacagagcaagactccatctcaaaaaaaaaaaaaaaaagaaaaaaaagaaacagtagtggcttcagaaggaatccgccatatttcaaagaaacgaataaaaccacatggggctgatgagatctgcccacattttacagctatcatgacaaaggcagaattaaactccagggtggccagagcccaagagcctgagttctcctgagacggacacaggaggacatggtgagatgagaagctcctcttcatcgatggcccggctcaccttcttcctgggcaaagggtcctctttccagttttaacactggtctggtccctctcgactgctctgatgttaccttgcactccctttccccagtcactcccttccagccacagtggccctcttgacaccccctgcctaaactactcctgaggttttctcagtcttagaaaacgcctgctccattctactaggccgatatctttagagcccttcttgacccctctcttctctaatccactgacaatgaatggggctttacagttggcgatctgcccaaccccttcttctcaccatccctgctactaatacctaagctcaggccacctggacaattgcaaaaataaatctccctgcttccactcacagtctagtctctacacagcagccagagtcagctaccaaaagggccaatcagattatgatgcttctttgccttaaactgccttccagtctcacatagtaaagctacgggcttcatgagcatggtctacagggagggtcttgcaagttctgccgtctcccacccatcccacgccaatctccaacctcaagtcctatttcttcccccgtcactgctctctagctcgttagcaccctgctggctttcccccccgcaccaaacacaccaagcatgtgcctgccctggcacccttgtgctacttggaacgttcttctgacagttatctccttggctcaggctcgctttgggactctgctgaaatgtcaccttatcagagtggcttcacctgacctctttttatgtttgcccatagaacatgatgctgatgtggattataatgagaacaaatgccttcatagggcttactatgtgctagacatcacaataagtcctattttatacatacattctcatgtaattcttgccccttcatgaaacagaattattatcatcttctttttttttttttgagacggagtcttgctctgtagcccaggctgcagtgcagtggcacaatcttggctcactgcaacctctgtctcctgggttccagcgattctcctgcctcagcctcctgagtagctgggaccacaggcgcgcggccaccatgcccagctaattttttgtatttttagtagagacggggtttcaccatgttagccaggatggtctcgatctcctgacctcgtgatccgcccgcctcggcctcccaaagtgctgggattacaggcgtgagccactgcacccagccctattataatcttcttttacagaatagaaaactaaggcacacagagcttaagtaaccttgcttaaggtcaccgagtcagtcactggtgtggtagacacaacttatttatttatttggaggcatagtctagctgtcacccaggctggagtgcagtgactcaattatggctcactgcagcctcaaccacttgagctcaagtgatcttcccacctcagcctcctgggtagctgggactacaggtgtgtgccactacgcccagctaattttttatttttattttttgtagatgtattatttatttgcaattatttgttttctgtaatttctaattttttgtttttatagggtcttgctatgttggccagactggtctctaacttctggcctcaagtggtcctcctacctcggccttccaaagtgctgggattatgggagtgagccactgtgcctagcagactgacagaatttggctccagggtctgtcatattagaagcacatcctagaaaagcaagaactctgccagtctggcctactctacaacccatgctgccatacagtccaggttcaattcttactgaaggagcctcgtctgacttttatgctgctttctctccaggcatttggcctataggagaattactcaataaacatttgttgaatgcagaggtttttgggggaaaagaaaaggcccagcccagagctgcccaaaagaatattctgcaatgatgggcgtgtactccatctgcactgtgtgatagagcaggcgccagtcaagcgtcactgtggagcatctcacacaatagggtgatggagaagctgcattttaatgtgcatttaatttcaatttaaatggccaattgtggctggggcagcacagctgtcttgggtggtgcagccctaggactcacctaaggccacaatgacccaatggaaacaaggaggaggcagcttgtaactctcagtttggcactaaggaagggccccaactcctaaacttctgctcctcgtgtgagtatgggattttgggagagtcacagaactaacagcgctactttgatctgggtgggctgtgcccagagttcatccccagaaagagggtaggtgggcgctgctggggtgcagctcttacatgcaggtccagacgcaaacccagcctttccctgcctgcctccgccatcaaggtcagctttttccattaatcctcacggggcaggagattatgtcccggaatggcactcagctgggctttgcccagttatcagcctatgtgactgctcagtgtttctgagaggagctcgccagccaaatgacaattactatagcaacacacacacaaacaccctcctctgagactacgggatgtatcgcatttaaaacacaccaaaattccaaagcccaggcaccgattccctacctgtctgaaggtgctgaactgaaacggctatctgtcctgtaccacatgccagctctgtcctctcctgctcatacgtcctttcactatgggccaggtgaagcacaaagaacaggcaggaaggacacctcgaagggtcaatagcagctagagctcctggaccacagacacacctcgttttattatgcgttgttttattgtgctttgtaggtgttgcacttaaaaaaacaaacaaacaaacaaacaaaaaaaacgggccaggcacggtggctcacgcctgtcatcccagcactttgggaggccgaggcaggtggatcatgaggtcaggagatcgacaccatcctggctaacatgatgaaaccccgtctctactaaaaacacaaaaaattagccgggcgtggtggcgggcacctgtagtcccagctgctccagaggctgaggcaggagaatggcattaacccaggaggcggagcttgcagtgagccgagattgcgccactgcaccgcagcctgggcgacagcacgagactccgtctcaaaaaaaacaaaccaaaaaaccaaaaaaccaaaaaacgaattgaaggtttgtggcaacccagtatcaatcaaatctatgggggacattttcccaacagcatgtgttcactttgtgtctctgtcagcatttttttttttaagcaatgaagtatttttaacttaaggcatgtatatatatatatttttttgagatggagtctcgctctgtcacccaggctggggtgcagtggcgtgatctcggctcacttcaagctccgcctcccgggttcacgccattctcctacctcagcctcctgagtagctgggactataggcgcccaccaccatgcccggctaatttttcgtatttttagtagagacggggtttcaccgtgttagccaggatggtctccatctcctgacctcatgatccgcccgcctcggcctcccaaagcgctgggattacaggcgtgagccaccgcgcccggcaaaggtatgtacattttaaaaagacatattgctattgtaccacttaatagactacagtataaacctaactttaacatgcaatgggaaaccaagacgtttgtgtgacctgcaatgatctggaatcgaacctgcagtatctccaacgtatgctacactactccccagattaataattcagacccaagggctgtctgcagtttattgggagctcgtgagacgagttcctgtaagcctgggcagtggcctctggggttctcactgtacaaacggccagtgtctgcgaaacaaacctaaagaactgatcaaatgccttgtacacaggcactgttctaagtgctgtgtccatgtcactcatttaactaacacagtgaacctaggaggcacgtactgttgtaattcctaacgatgagacaaggaaactggggcaaaggtgctttgctaaggtcctatatacgtgattcaaactccaggccctcgtcataacctctcctttgtacttccctttatccaacgagaaggtatttctttccagggtggcacaggcaccggtgagatgcatggcttcacataccagacaatatcaatttgggaaatagcataaaatctgacagcccagattccttttggattccaggaaataaactcagaagtcacattacattttttgtgggtcaatttagatcatgttccctataaagttctctctgcactgcagctggcagcttttccaaaccttgggctgacggtatgcagggacagcactgccacccttgctctcaccactccctcagcctgaggtcatctaacagtgagaagggctgtctctcaccagaggcctcacactggcagcccacagagatgtttctatggccccaagacatatttttgaactaagcacatttaaaattgggatatttcacataaaaacctgtatttccagcttctctctttttttggagatagggtctcacactgttgcccaggctggagtgcagtggtggaattgtaggtcactacagccttgacctcctgggctcaagtgatcctcccaccccagcttcccaagtaggtgggactacaggtgtgtaccactatgcccaactagtactttttgtttctttttttgttgttttttttgagacagggtctcgctgtgtcacccagactaaagtgcagtggcataatcttggctcactgtaacctccacctcctgggttcaagtgatcttctcatctcagctttctgagtaggggggactacaggcacacaccaccaaccccagctaatttttaattcatttatattaaatttttttttttctttgagacggagtctcactctgtcgcccaggctggagtgcagtggcgcaatctcggctcactgcaacctctgcctcctgggttcacgtgattctcctgcctcatcctcccgagtagttggaattacaggagcgtgccaccacactcgggtaatttttgtatttttagtagagacggggtttctccatgttggtcaggctggtctcgaactcccgacctgaggtgaaccacctgcctcggcctcccaaagtgctgggattacaggtgtgagccactgcacccagcaaaaaaaattttaatagagatggggtttccctatgttgcccaggctggtctagaactcctgggctcaggggatcctcctgcactggcctcccaaagtgctaggattacaggtgtgagctaccatgcctggccaattttttagtttttgtagagctagtcttcaactcctaagctcaagcaatctgctcacctcagcctccgaaaatgctgggattacaggcataagccactgcacctggccaactttgtcttttttttttttttttttttaagggaaaggctcttactatgcttctcagcctggtcttgaactcctgggctcatgtgatcttcctgcctcagcctcccaaagtgctatgattgcaggtatgagacaccacaactggccttcccagcttctcttgagaaaaaacagacaatttggcagaagctggctagaaccctgtggacagagcatgacctccccagactccctgaccatggccagccctgctgctctgagcaccaaggcaggtcagctggggtgcctggcacccgtgccactgcttcttaggtccagtcagctacagttgcttccattacctgcctgggctcgctggtgtctgaatttttgagccttgatccaaggtctaatgttccatcatggcctcgtcacccaactgttgctgccagccatctggcttctgttctctttatcctgctgttgacaatcctaccgcgttcctgacacagtccccttcactttgaaattcttctctgtggccttgtaagaccggccccaaatcttgtcagcaagaaggcgagagaggcactctcactgctttatctcatcttgctagctcctcctgctccttcctgccccaagcacggcattcttgtggcaatgcaggcctccgcgcttccctcttctccctctcttcctgaaacaaacccattccactgcccggactcaactacccttttacaaattcacctcccaaatctacatttctagtcctgaggtcacaccaagctcccaggctgtctaggccttgcctcaagttcttgacattccaaacagaactggtactctttctccacaagccacctctacatccccagtcctctacttttaagaaagtgatgaccactttcccaggaatgaagatggaaatcctcttttcctttttctcattcatcctctatataaccaattatggaatcttaagaactcttcctctgaagtgcctctcacctctttgcttgcaacatttgcaattacccccttatgaatgcacgcctagacttacctcctaattggctctgagactttcccctctgcactcggtgactactggtgcacacacgggaggcacacactgccactggctcagtcaccttcccgggcccccactgactccaagacgctttagtaccacgctgcttcagtagaccttcaggccctccacgatccagggacaagcttcctttttctcggctttcctcactatcctctccctgttcgagagtatctccaccagcaccgagcctcacacgggctgtgccctccatctttggaatgcctacccttctttcttgctaagcccctcccagggccagcccttgtgcaccggctcaagtggactgctctcctgcctcgcgctcctactttacacctgcatccaggccgtgtctctcacctggtctatgggattctttattttttaattttttaaataagattcggggtctcactccatcacccaggctagaatgcagtggtgcaatcggctcaatgcaactttgagctccaaggctcaagccatcttcctgactcagcctcctgagttgctgggataaagcatgagccaccgcacctgccctgcaggattcttgagcacagaattctgctcccactccatgagcagagtatagataagcatactacataagcatactgtagagcttaactctaccttgtactaaaaggacatcactaatcccggaagctgcagagagaaaacaaaccttctcatcctttgggggccgaccccgcttccggggactttgctcttgggctcttttcagaggggatttggagcctctctctgaagagcctgaagacaccctcttctttccttctcccatgttcttcttcaccttcccttcagacaggctaagtttgcgcttctcatcacctgagtttggcctacttctctcctcactggaattacgtcgattcttgtcatcagaagaattgtgggatgacgtctgaaagtttaataataataatgataactaccaccacagctgctgccgccatcgccaccatcatttacaggtgccatgtgctgctacaggcactctgtgtggtctcctcacaatgaccctagaaatagattctgctgtcgtcccagacattgggagaagcagatttaaaaaatatatatatcaaaagtcactttccctatgtcccaaaactagaagaaaggatttaaatctaggcagtatatgtatttcagaggctatgctcctaatctgtgtgctatgaaaggaagaaatggcctgtgctagactcaaatgctgagatatttctcctgggtccaagcaattttcctaaaagcaacaacctactccagaaaggttagctgcatggagtttcaaactgataagcaaaacgctgacaccttagaactgaagtagctttctccagtagcatttcagaagaacaaaggtttgcgtttgggtgacatttaatctgttagttgctatgcaaaaatcaccagtctggcattggtagaaagtgaacattgtgtctctcacctggtctttccctttggctctcctgaggaactcttcgacagcatctaccgcttgctggaatcgtttacccttgttaatttttatcatttcctctttatgagcatgatatggcttcagctgttccactttgatccaggcactagcagaaaacaaacacaaaaagggtgtgaaccatatagcatatgccctaaagtatcaacaacctcactatggcacggtgtaaatatccatttggtttaactggactttgcaataggccttgccatttctttcaaaacatgctatcaaccatctcagagtcttatgtctaaagtatattttcttgaaacaagtcaagcagaacaaccatcaccaccactgcagcaaccacaaatcaagttcctccagtgaaagcactgtgttgcagattatttatttccacaatcgtctatcagcctccaatgcccaaccacatatacgctgccacttgctcagggcagaaagaaatctggagaccctttcccattctcaccaggcagcacaaatggccacacacagatccctgggaatcagggtacctggaaatgtgatagatgatagcagcattactatgcaggaaaatgcctgctgcctgtcaacaatgggaaccagatttatgatctgttgatccacagagagtcagggatgttacagagctgaagaaatgcaacatcttctaaaatttgtggttcctatggatattcacagccactgagcctatatttgttcataaatgatggtaaccatggctactaaaccacacaaaacacggaacacatggtttggaataagggcagcagttacaaaaggaggcatttaaaaacaagatggcatgctgttttatgatgtctcaaaaaaaaaaaaaaatagaaacaagatgcttgagattaaaggtagaagaacatacacctccgatatgtaatttttaatttcaaccatcaatgtgtaacacatgaaagtgaaagtagtcagctgtcaattctggggtttctgatctgtcacactaacctgaacaaatctgctgcagctggctttctatggcttccctgaatggcatgcagcttatagaatccaagcacaaaataattttataggctttacaaggtatcagttagtttacatgttttagcctgtgatacaggtttcacagcataaccttcagaaaaagtaggtcaggttaaggatacagaaacccagctatctcacaagcttcaggttgttttcttcatagaaagctagagaatattcactaacagcaagtgttaacctttgcacataaaaataatgttactaaccctccaccagctacctggactttgagtgtgctgctggtagttgtgataatggggtctgtgcaaaaacacagacctgggatcatcggcctgcagatgtcaggcagcgaaccactatcaggcatgccaccatggctaagtgagatgatgaatggagatacagaagctggtctccctggcacagctccaactagaggagttaggcaaattccttttttttttttttttttttttgagacggagtttcactcttgttgcccaggctggagtgcaatggggcgatgttggctcacggcaacctcgcctcctaggttcaagtgattctcctgcctcagcctcccaagtgctgggattacaggcgtgagccaccacacctggccttttttttttcctttttgagacagagtctcattttgtcacctaggatgaagtgcagtggcacgatcttagctaactgcgacctccgcctccacctcccaggttcaagcaattctgcctctatctcccgagttgctgggactacaggtatgcaccaccacacccagctaatttttatgtttctagtagagacggggtttccctgtgttggccaggctggtcttgaacttctggcctccagtgatccacctgccttggcctcccaaagtgctgggattacaggtgtgagccagcaaactcctttccagtgaccaactcatcttaaagtttgaaattcaacatgagagcgccaatgagtccaatctgctgggaggaaaagtggaaggagatttcgaccccagattttctggcaagaatatccctgaactgactccgttccctctccttacagggatgctaatgacaggccagagcaatcagatgcaaagtcagacccagccccaaaagccagtgaagctaccatactaacccgtgggtctgagatgacacaaccagtatcaaggatgaagcttaaggagtcgtgaccagccagttcttcctaggagcttctggtcagaagctgagaaccacacaagttcccaatataggaccaaaaaggtgatttttatggaaccccttgagatgggacaacagactccgagacttgctaatcccacccacgccatcctgctacctccatccctgcctcccactacccagcctcacaggaacccgattctgagggaacagaaaggtgaggatgtctgtgaagtgccaaggaatcaaccccattttttgttgaagcatcttacaaggtttactgatttctgctagaaggaactgtacagtcaaaattccactcactttaaagcatttgagatactaaaattttcctctttacaaccatcttcgaaacattaaaatggctaaatgaactgacagtatgaataggatggtaaatccaagaaatgttaatctatttaaggaatcaacttattgctggagaagcatcctgttacatcaaaaaacagccataaaaaaccagcttggctgggcacggtggctcacacctgtaatcctagcactttgggaggccgaggcaggcagatcacctgaggttaggagtttgagaccagcctggccaacatggtgaaatctcgtctctactgaaaatataaaaattagctgggtgtagtggcacgcagctgtaatcccagctactcggaaggctgagacaggagaaacacttgaacccaggaggcggaggttgcagtgagccagtattgtgccactgcactccagcctgggcaacagagtgagactccacctcaaaaacagtaacaacaaaaaaacccagcttaccagagctctatggggattacctcttgaaagcaaaccaaacttaaatcactttggctatctgaatacaattttttctctaaaggttacacttctttcatcttttttaaatttattttttatagagatggggttcaccatgttgcccaggttggtctcgaactcctgaactcaagtaatctgcccacttcagccacccaaagtgctgggattacaggtatgagccactgcaactggcctacctctgtctttttaatgagaatatgcttttcagttggcgcctcaacaatgcaccactgtctaattcacggaggcacatcagccgggcctggcacaccactggtcctcaataaataatcactgggtaaatgattccttcccagatgttcaggaggatgtactgctcaccagtgagttaaaaggtgctacaatgctccagtgcgtaaggctttagtgtttttgttgttgctactgttggttttttaagtgactgtttctttccttgatagaagctgtaacttttgattttcctatcatcctcccaagacttagatggagctatatctttcagcccaattgtggctgggaagtcagaaaaatcaagcttattcaagctgtatttaaagtaggagactttgctttttatgtacagtagaatgaatgacacattgtgatagtaaatagctgaaaacaggcaaggtcattacagagaaggaaagcggatgtctcgtaagatatctggctacgtggagatgagcaagataaaaagcaatgcatgttatgtgctaccactcgtgcaaagacaaggaaaatggactgaccacgcactgatatctctggagggacacatcatcagaaactggtctaactgggtggctgtgggatggggatgaatgcaactgtttcaatgttgacaagtttttgtttttgaatggtgaacacatattatattggaaaaaaaaaaaaaaaacaaaacaaatcaatactaaaggcctctgccctagaacacaggctatgccgactgcccagagggtttcctccatgacttcctggtttgcaggtttgctctggtgggttgctgctgcctggctgctggcataactgcacctgtaacacagccaatttaccctggtgacctgacactcttcctataaaaagtctcttcatctatgaatacagaaccgccactaaggcactctcagattactccaatcaaaatgaattaaaatctggtattttcaaaaacttgcacacttctgatttgctttcctcttaaatgaaaatcatacatgtagggcccggtgcggtggctcatgcctgaatcccagcaccttgggagaccgaggcaggtggattgaggccaggaattcgacaccagcctggccaacatggcgaaaccccatctctaccagaaaacacaaaaattagccagttgtggtagcacacgtctgtaatcccagctacttaggaggctgcggcaggaactgcttgaacccgggaggtggaggttgtagtgagtgcagatcgtgctactgcactccagcatgggcgacagagcaagacttggtctttaaaaaaaaaaaaagaaaatcatacatgtagatactgtatattaaagatgtcagcctatgactaatcttgaacgctgtcacatgtgtttcagccttcacatagacaggtgacccggggtgaagccgtgaagctaagagaaagagaaaaggagaaaggacggggagaagatggcagggggagggagacagacagagaaaaagcacacacacacaagcatagagtataaaggtgagaacaagccggcacggtagctcacgcctataatcctagcactttgggaggccgaggtcaagagattgagaccaccctggccaacacggtgaaaccctgtctctactaaaaatacaaaattagctaggtgcggtggcatgcgcctgtaatcccagctactccggaggctgaggcaggataatcgcttgaacccaggaggcggaggttgcagtgagccaagatcgtgccactgcattccagcctggcgacagagcgagactccatctcaaaaaataaataaataaataaataaataaataaataaataaataaagataagaataaaaatacaggtgagaacaaagatggggccagaaggtgtgggtttgcttctccatttggatttggtgaatacttagtaaacaatttctatgggtgcctttttaaaaaaaatccatccaaaggggctgaagattactgaggtgttacaggccaagttcttcagaaataaaggcaccagaaaaaaacacacacaaatcaggtgccaggtgaaacgaaaaagggatgcttccaagctgctatgcttctaattattaaccacatattcttctagagcagctactttcagtactgactcagacacctcacatccagcgagaccggtccaccttagatgtggcttggtggaaaaggaccactggtctctcagtttcctcatctgtgaaaaaataagaaccagaaagatgaccctgtgcacttcctgaaagggctgctgtgaggactggaggggaagactgctatggaaactcgcaggtaggcacttgcagcttctccactgtttgtccacaatctgttgaaccggttggtttctggtggcttctaagcacctgtaatttaaatgaacactccctccattccatcatcatccacagccactgatgaaacttttctttttttttttttgagacagagtctcactctgttgcccaggctggagtgcagtggcgcgatctcgacttacggcaagctctgcctctggggttcacgccattctcctgcctcagccacccgagtagctgggactacaggtgcccgccaccacgcccagctaatttttttgtatttttaggagagacggggtttcaccatgttagccagcatggtcttgatctcctgacctcgtgatccgcctgacttgccctttgaaagttctgggattacagatgtgagccaccgtgcctggccaaaactcttcttttttaaaagacagggtcctgctctgtcacccaggctggaatacagtgcctcaatcacagttcactgtagccttgacctcccaggctcaagcgatccttctgcttcagtctcccaagtagctgagactacaggtacatgctactacgcatgaaccctctcacctgtgtttcagccttcggatagacaggtgacctgggctgaagccgtgaagctaagagaaagagaaaaggagaaagggcggggagaagatggcagggggagggagacagacagagaaaaagcacacacacacacacaaacacacacacaagcatagagtataaaggtgagaacaagccggcatggtagctttaaattttttatttttaaattttttgtagagatgggtcttgccatgttacccaggctggccttgaactcttaggcttgagtgatgcttctgcctctgcctcttgaagtgttgggattacgggtgtgagccatcacgcctggccccgatgaaacttttaaaccgtgagctctgtctctactctgatgggggggtcaccactaatcagacctgtcagagagggaccctcgtgcacttgacacataatctttggttgtagtcaccaagtgaagctggcagggttttgctgaaattatatccccttcgtatttccatgaaaatacaaaaattacgtgggcagttttgtcttggccatctcgctcagggagccgaatccgtataaagaagtcctcctctcaccaggacacctgattaggaaggtctggccctctcctaacagtgggatgtcaacacaatttgttagatattttggcagagatgtggagagagaaaaatcaggtttctaaaagattgtaatcactgattatcttgtcataaggagccgttctttctgctctttaataaaagaccttgcaaatattaaaaaagtataactacacttttttttgcctaagtagtgtgtcaattttgaaactgaacatctttgaccaaatcctgtatttctcaggaacggaggacactccactgggtcagaccctatccacctgggccagggtccagtaaccaatggtgcccccacccaggatgtgcctggaccacatgccccctccctgatgtcaagtgttaaaggcgaggtgcagtccagcttctacaggagccacttatggctttgtcttcacaagttagttctcatccctaaaaaatccccttgcaatacctgtttacaccacctcttaaacgccccttttatgcagtgctcctcaccctggtcctaacacagtcataccacaatccacttgcagtgcccatcgccaaactcctctaggccattcgctgtttcctacctcctgatcccgtgattccttcagtctttgcttttccacattgaagagtcctgctcttttgtctgactcagttcccttttctggatcttggccaattctaagagatccctttgaaagcatgatctgaagtccatagagtattcctgatgaggcgcatacagttttacataaaggtggaatgatgcatggttttgtactcaaagcctttttggtaaaaagagcaaacctggctgacatcctttaggaacttccaactctcatattcctttcttttcaaacaaacacacacacacacactctctctctctcccatagggagagtctccatctctctcagttttccatacttaaaggcatcctggaccaatgtgtgctaatacctgctgtatggcaagccacactctacacaagagatactacttttccttcctaactatgaggtagggggtatcatccccttatgtagaggacacagaggctcagaaaggtgaaatagcttgcccaaatcagggagcaaggtggaaccggtacctgaatgcacattaggctggtaaccaatccagagctctttccccaaagtaatctgctgccaccagccaatctggagatcttaccttcatagaaaaacacaaaataaaatctgccccagcactgatcactaaggaagtgttccttctttagagaagtactgtacatctttaccctttatttcctttctctaagttaactgcctacccacaaaaagataacacattagtaccacagtgacttcatttttatagtttaaaatgtagaactctagcaaaggagtttaaaaagttaaaaatattgcatttagcagttgctttgtatcccacttgtttacaaccctccaaagaaccttcgtcagttagaaattatatcatcaccaccaccatccaggctatttttgtcttgagcaagcacatcaccactggcttcacctgtttgcctggttaagctctgaaattaactcaactccaattttctgtgtcctatttctagcacttgttataaacaaggatcacagtttattaatctagtcttttagcattaaaaaaaaaatcggggctcggcgctgtggctcatgcccataatgccagtacttcgggaggccgaggtgggaggatcacttgagcccaggagtttgcgaccagcctgggaaacatggcgagaacttgtctctacaaaaaaaaaaaaaaaaaaaaaaaaaaaaagtaaaaaatttagcagggcatggtggcacacaactgtggtcccagctactcggactgctgaggtgggaggattacctgagcctgggaagtcaaggatgcagtaagccatgtccgtgatactgcactccaaccctttctcaaaaaaaaatcaagaaaccaaacaagaacaacaacaacaacaacaacaacaaaaaacataaggaaacaatggctttcaggctccttatgagactgagttcccatttttgtttcagacttgtgtaattattcatttagctaatgaagtttgggccaaccatattgcctctgttattcctaagcacaagttacctcaggcagggagcctcttcctttccataacacccagcttaatgccaattgttcatggtatccccactgtctgaaatgcccctatagtccccatccatccagattctatgtatcttccagagctggattcaaatcccatctctggctgagtgcgatggctcacgcctgtaatcccagcactttgggaggccgaggcgggcagatcacgaggtcaggagatcaagaccatcttggctaacatggtgaaaccctgcctctactgaaaaatacaacaaaaattagctgggcatggtggtgtgcgcctgtagtcccagctactcgggaggctgaggcaggagaatggcatgaacccgggaggtggagcttgtagtgagccaagatcgcgccactgcactccagcctgggcgacagagcgagactccgtttcaaaaaaaaaaaaacaacaacaaaaaaaaacaaacagaaaaacaaatcccatctcttcagtcagtcttcttggttctcatggctctccactgagctctccctcttctagaattctttttctttttaagacagggtctagctctgtcacccagactggagtgcaatattgtgatcatggctcactgcagttttgacctcctgggctcaagcaatcctcctgccttagccttctgcatacctgggactacacttgtgtgccaccatgcctggctattgaaaaaaaaaatttatttttttaagtagagacaaggtcttgctatgttgtccaggctggtctccggctcctgggctcaagcaatcctcctgtcttggcctcccaaagtgctgggattacaggcatgagccactgtgcccagcctagaattaacaattatctgccatcattcattctgcacataatctttatttattttttgagacagagtctcgctctgtcacccagactggagtgcagtggcgcgatctcagctcactgcaacctccgcatcccaggttcaaccaattctactgcctcagcttcctgagtagctgggattataggtgtgcaccaccacacccgactaatttttgtatttttagtagagacagggtttcaccatgttggccaggctgttctcaaattcctggcgttaagcaatctgcctgccccggcctcccaaagtgctggggttacaggcatgagccaccatgcccgaccatcattgtgcacatcatcttatctgaaatgtttacaacttgtcacttgactgagcatctggaaggtgggaactataatacttgctttcttataaattccctcagtgtcaagcaattcagaaagtggacacataacactgatgttatgcatgaggacaatctttcctgtttttctttttcttttctgagacatagtctcagtctgtcacccatgctggagtgcagggtctcgaacaatctctgcctcctgggttcaggcaattctcgagcctcagcctcccaagtagctgggattacaggtagacgccaacactcctggctaatttttgtattttttgtagagacggggttttgccatgttggccaggatggtctcgaactcatgacctccagtgatccacccaccttggcctcccaaagtactgggattgcaggcctgaggcaccatgcccggccaaatcttctttttaaatccatggagttctaagaacattccctcttccagaagctctggctccacagctccaggccagcgatctccttgaaatactgccaccacaggctgctaagctggcttgtgatagagaaatggggctgggtctatctgtaaacatgaaaccaggaagagcatctgacatataaactcctggatgagtgaagaatactgtttataatatatcgctttctaagtagaaatactttaaccgtcagaattagatttaccagagaagccacagacatttttttcaaatctaaggctgtattttcctataagaataataaatagaaatacaactacttaaagaaatcaaaccggctgggcatggtggctcttgcctgtaatcccagcactttgggaggctgagggggttgggggggggaggggcagatgacttgaggtcaggagtttgagaccagcctggccaacatggtgaaaccccgtctctactaaaaaatataaaacaattagccgggtgtggtggtgtgcgcctgtagtcccagctactcgggaggctcaggcaccagaatcacttgtacccgagaggtggaggttgcagtgagctgagatcatgccactgcactccagcctgggtgacagagtgaaactccatctcaaaaaaaaaaaaaaaaaaaaatcaaaccatctagctagacccaggtaagccacttgacatagtgataaaaagctaaacaaatcactagcaactcaagttaatacaggttcttcacgttcttcccgtcactgtaacatgttatatggtcagagtctcagattaatggtcctggtttccccaacttaggacagatctggtaaaaagacttactataacaatgtcaaagcaaatcacttagttttacacatgagaacatgattgaacaattacttttattaacataaataaaagtttccactgtataccccaagcatgaaccataatgatatatggcattaaaagagaactgaacatggcttttataaaaataattgccagctgggcgcagtggctcacgcctataatccagcactttgggaggccaaggcaggtggattgcttgagtccaggagttcaagaacatcctgggcaacatggtaaaaccccctctacaaaaaattagctgggcatggtggtgcacacctgtggtcccagctactcgggaggctgaggtgagagaaccgcttgagtcagtgaggcagaggttgcggtgaactgagactgcctctgcactccaggctgggtgacagactaagtctctgtctcaaaaacaaacaaaaaggaactgcctttggagttgggtaaagaaacatgtgagaaactgtttcaatgtgattgttatagttagaaggtaaatgaacctagttcttgcctgacttagttatagacctaggacagttgtctagggcaatttctgcaagaaattgcacctttatttaggtatgaaggcagaatgagatgccagtattacacattataagaagactgaactaaggatccttagaatattttcaaagcagctcagactccaggtaacacagaaagaaaggcgaagggagactcctggtgagtactactcactgatcttctgttccaaaaaatttcacaaagaagcatttctttccgcgaggtttcttcaagtcctttggtggattaacaatctggaggataaaaggggggaaaaaggttggctggcaacacagcagcccactttctagtggctccacattgctctacagttctacgttgctaagaaaaaagtaaattaaaaggacttacttacaaataaatttatttatatacaaaacagaacccaaggcctagtacttgtctaaatctcccatttttctattgaggtgtatggaaatgtgtagatattctagaagttcccaatatttaacatgtagcacagtgctcagtagacacaatatcccttttactgcagtggccctgttttacaagcagttaaaactaagatcaacagcatcccctgccccccaccaccccacccctgctccaatgtgaccccattattactgaaaaaatgcagacgacactctttgaaatacttcctgtgcaggaagggttgacacaggacatagtgaaaacaaaggacaaccgaggcacagaaaacaccatattgcaaagagaccatctaaagacacctcccgggctccaagcaagaatataaaaacacaacatttggaaagcaatgatggatcacctcatgcaaaatctggaatgccaacttctgcaaagaggcactggagtagcacatatggtaacatggaaagaagatttaaacttagttgggacaaaaatactttggcttttcactaacctacatttagactttcttcctggataatttatattttcttctccttttgttacatttaagcataaagctaaattcagactagaattatttccggggttaaaaaagaaacttcataaacctcctctaaatccagaaataagggtttagagaagatttaatgatctggtgtatactgcattgccttttaaaaaataaccgatactaggggaaaaaaaattctaagtgccatctgaatgagcccaatttaactcaatactagaaactgagaggaatgcatcttacattctccacctcttcaaacccaacttcagatctcttcctttagtagcaagacactcacctttcctggccaaggaggatatcggccgagtttccccctagagaaaacacaaagagtcaacacttgccctgcaaaagccagtccatctccttcaacccactcaatacgcaatttattttcctaaatctctgctggcatcctcaaatgccgaaacaaaagctttcatagctgggcccaacaccctcagaagtaaaatgcaaaattgtatacttatgtgcacaacgcatatccattcttctgttgacaaggaatacagaacaacacaactgtcaaaagtcacttgtctagagcttcttaatgacgggggtgggaggacagcttcctctgtaaacacagactttccctccctaagtctggtttaattcaacaggagacctgcctggctttgacaaatgctaatggaagccttcctctgggtggagaaacaagctacgcagctcgagggaggcggcgacaaagtcttggttcgggcggttgtctgggacacagaagcagaccgcgggaggcacccaagcgtgcactggtcactgccaagccatcggttgtaaaggagaagtccccccgccgtttcttcgcggggcaacgccagcagtccggtttagacaaccccggctgagccggccgcacaggtcggctgcatcgcaacctgggctttgaccgaatggcaccggccagatctcgcaggtccggtccccggcgcttctgctttctgggaagccccaacaagaccccggggaccggtcgtccggggaagcctcgcggcaccggcggctcccttcacgggggccgccagtatctgggccccgagtgcagaccccacccggccggcctcggggatcaaagccggtgcccgacgtggccaccctcggcctcggtcccccgggactggactgccccttccgcctggcgccgctcgcaagcgccggcaccttctcttcccctctctccgcgacctggagcgcataaaaaggcagctccagggccggcagcgaaccccgcgcccaggcgggtagctccccggcgcgtctcggttggcccggccgctcggactcaccacaccaagtcgccgagccgcagactcacagccgccatcttaccacccaaccaccgccgacgcacgggccgccgg

SEQ ID NO: 910 - DNA, 16353 bp, Homo sapiens
tggtagggaagaggtctttctatattgcccaggctgctcttgaactcctgggctcaagcaatccacccgcgttggcctcccaaagtgctaggattataggtgggagccactgtgctcggcctctgacactaaataatgtcagttaagggaatgagaaaaagggcaggtcacgcacctggaacctgggctgtgccaaaaggtcaaatgtgcacgtatatacagtgactaggtgacaaatgcaatggagcatcccaggctgggatgaaggccaaggccacctacctatgaggaacaaccactgcctggctggaacgttccagaacccagtggtttccatagctgccctacgacttccgagatgactaaacccaccaaggactctatcacactgcttgtcttggccactcacccaccgtggatgtgcacagaccagtggctcccacgcagcacaggccagacaaaagctggaaggtgaaggcttcttaccttagaaagacaaagtggggcaaccgtggaaggccacattccagacactaaggggccaggagcaaacgcagccctgggccccggccctggggagatgtcaggcccgtcacatcccaggcaacatgtcaggaagatggaactcaggggtgctttcccgccccaggtgtcttccgccctgcagagcagctatggatctgcaaaggggactggaatgctgcagagccccgggctccatttggaaactctggcaggatgaagaagctggagaccacgtcctgggaaggctggggtacagcagggctccctgcagcagacgaggggtccctcaaattcatgtgcacccagacctcagaatgtgaccttatttggaaacacgggttttgatgatataattagttaagatgaggtcacagtgtattgggggaccctaaacccagtgagtggtggccctaccaaaaaagagactgggcatggcggcacacacctgtaaccccagctactcaggaggatgaggcaggaggaacacttgagcccagggattcgaggctgcagtgagctatgatcatggcactgtattcccgcctgggggacacagcaaggccccgtctcaaaaaaaaaagggggggggagcaggtggggggtacacacagagacagcgcacagggtcacagacacacaggagaggggttgggacgtggggatgaggctgtatgccagcagccactggatgctggaggcagctgatggaccctcccaggcccttcaggagccagccccacgaacaccttgagtgtcggcttctggcctcctgagtgtgtctctgtggctgaagcccctgctctgtgtcacctgttctggctgccactggacactcagagcctgtccttgcccttgttctgcacccagtgcccagcttcctctgcggcctgggcatcccaaatgtcccctgctggcctcatactgggccatgggaggaaacgggcagctggcaatgctttcggaccaggctgtctagcagtttcctgaattctgtgcccagggatgagagtcctggaaagggagtttcaggcctggtgatcaggctttggcaccggggcctccaggagccaccggctggagcgtcggcaaggagcctgcccccatgtgggtccgctggtgcttgtgcaggtcggtgccccggcggaagccccggccacaggccgggcaggtgtagggcttctcacctgtgtgcgtccggcggtgggcgctgaagtgcgagctgttgttgaagcgcttcccgcactgggtgcaggcatagggccgctccccgctgtgtgtcctgcggtggatgaccaggctggagctctggctgaagcgcttcccacactcggggcacgggtagggcttctcgcctgtgtgcaccctctggtgcgtgctgaagttggagcggtcgctaaagcccttcccacagactaggcacttgtaaggccgctcgcccgtgtgtgtgcgctggtgcttggtcaagtgggacgtcttgctgaagcctttgccacattcggggcaggtgtacggcttgtcagccccatgggaagcccgtcttcctggtggggggccgcctcttggctgatcaggcctgaccaagcccctgactggggctggcctctgacctgggagcgggtggccaggcccctggcatcgtgccgagagcactcggtaccactccattctcaacggggcatcctccctgccatcaccgccgtcctccaactggatcccaggtcctgagacagagaaagcacgatctctaggaactcacagcaagagggcaagggaaatccttctaataggaaaatgaaggcctcacagggctcctaaggttcccctacaaaacatttagcaggggctgggcactgtggctcacgcctataatcccagcactttggaaggctgaagtgggaggattgcttgagcccaggagttcaagaccagcttgggcaacgcagtgagatctcgtctctacagaaaataaacaaaactagctgggcatggtggcgtgtgcctgtagtcctagctactcaggaggctgaggtcggaggatcacttgagtctaggaggtcaaggctgcagtgagctgtgatcgcgccactacattccagcccgggtgacggcatgagaccctgtttcaaaaactaaacaatcaataaaacaaacaaagaggaacgcacttgaccatcacaataacccagtgggtcagtgctgttaccatctccatcctgcagatggggaaaccgaggcacacaagtgttaagaaacttacccagaatcaccgggctgctaagttacagagtgagggccatcaagctctgcactctgctgtatcctctaagccaggggttcccacccagtggcaaggtctggagacatttttgttgtgtctggggagggggttgtaaatggcctctagtgggcaggggccagggctgctggaaaacctcccacccagcacaggcagccccacgtggagagccatctggcccaaatgccagcagcaccaaggtggagaagccctgctctgggctgttctggctgagcagagcagtcgtggctcccagccactggacctcccttgtcgtacttggtgtggcccctgaggcccctctgcagatccaggttctagagccaccaccaacaggacaggagaacagggagaggggcctggaatgatccaggctttgcccctttcaggaaaaagcccttgacttctctgctcttcctttgcagcatgagggtgactgcagctggggacctggtagcacaaagtgcactggggtgcctggggggctgggggagcagccgtcttcatagcagtcccgcaagaggctctgcgcatggtaggcacacgccatgctgacctcacaggggagggacagaaccacccactgcccttggaaatgtccactttaagacactcccagccccagacctcctgggcgaatccttcttgccctcccctcccatctccaggaccaacttccagatagccgaaggtgggtttggcacgtactgagcctcaaattccacatctaaaaaactgagaggaggccgggcatggtggctcatgcctgtaatccaagcactttgggaggccgaggaaggcggatcacttgaggtcaggagtttgagaccagcctggccaacatggtgaaaccccattttattttattaaaaataaaaaaattagttgggggtagtggtgggtgcctgtaatcccagctacttgggaggctgaggcaggagaatcgcttgaactcgggaggcagaagttgcaatgagccaagatcgtgccactgcactccagcctgggcgacagagcgagactctgtctcaaaaaaataaaaaaaaaaaaaatagaaaataaataaaactgagaggaggattggaaccacctcattggcctgctataataatattttatttatttattttaaagacagggtgatatggtttcgatctatgtcctcacccaaatctcatgtcagactgtaatccccaatgtggaggtggggcctggtgggaggtgagtgggtcatggaggcagatttctcatgaatggtttggcaccatcctcttggtactgtcctgacaatggtgagtgagttcccatgagatgtggtcgattaaaagtgagcggcacctcccctcgctcctttgctcctgctccagccatgtgagacatgcctgctccctctctgctttccaccatgactggaagcttcctgaggcctccccaaaagctgagcagacaccagcatcatgctttctgtacagccaattaaaccttttttctttataaattaccaggtctcaggtatttctttacagcaatgcgagaatgacctaatacacagggcctcactatattgcccaggctggcctcaaactcctgacctcaagtgatcctcccacctcagcctcccaaagtgctgagatataggcgtgagccacagcacccagccttgttgtaaaaatatttttacttatttatttatttatttttgagatggagtctcgctctgtcttccaggctggagtgcagtggtgtgatctccgctcactgtaacctctgcctcccaggttcaagcgattctcctacctcaggctcccgagtagctgggattacaggagtgagccaccacacccagccaatttttgtatttttagtagagaaagagtttcaccatgttggccaggctggtctcgaactcctgacctcaggtgacccaaccgccttggcctcccaaagtgctgagatcacaggggtgagccaccatgcctggccgtacaaatatttttaaaagagactgagtctggcagctcatcaaaaggtaaacaagagtcattatatgagccaatgactttactcctaggtacacacccaagaaaactgaaaacatgtcctcaaacagaaatgtgtacataaatgttcacgacagcactcttcacagtagccaaaaaatggaaatcacccaaatgtccatcaacgaaaatggatcaacaaaacgtggtctatccatacagtggaatactattcagccatgaaaaggaagcactgacacatgctataccacggatgacccaggaacacatgacactgagcaaaagaagccagtcaccaagggacagtccctgcacgattccctttacagaagacaaccagaataggcacacccagagacagagcagacaggtggctgccagaggctaggggaggggaaatggggagaaactgcttgttgggtacgaggtttccatttagcatgataaagaatgtttttgagggccaggcctgatagctcacgcctgtaataccagcactctgaaatgccgatgcgggctgatcatttgacgtcaggagttctcgccaacatggcaaaacactgtctctactaaaaatagaaaaaatattgggaggccgaggcgggcagatcacaagatcaggagttcaagaccagcctgaccaacatggtaaaatgctgtctctactaaaaatacaaaaattagccaggtgtggtgatgcacacctgtaatcccagctgcttgggaggctaaggcacgagaattgcttgaacccaggagatggaggttgcagtgagccgagatcatgccactgcaatccaacctgggtgacagagtgaaactccatctcaattaagaaaaaaaaatgtttttgagcccgggtaacacagtgagactccatctctatcaaaaaatttttgtcgcccaggctggtgtgtaatggcgcgatctcagctcactgcaacctctgcctcctgggttcaagcgattctcctgcctcagcctctgagtagctgggactataggtgcatgccaccacacccggctaatttttttgtatttttagtagagatggggtttcaccatgccggccaggatggtctcgatctcttgacctcgtgatccacccgccttggcctcccaaagtgctgggattacagacgtgagacaccgtgcccggcccaaaaattttttcaaaattagctgggcatggtggcattgacctgtggtaccagctactcgggaggctgaggtggtagaatcacctgagcctggggaggttgaagctgcagtgagtcaaaattgtgctactgcactccaacctgggtgacagagtgagatcctgtctcaaaaaaagaaaaaaaaagttttggaactatgtgttactgcacccaacctgggtgacagagtgagaccctgtctcaaaaaagggaagaaaaaagttttggaactagatgaaggtgatgattgtacaacactgtgaagatacgaaacgccactgaaccgtttactgaaatatggctaattttatgttatgtgaatttctttttctttgagcagcagcaagatttattacgaagagtgaaagaacaagtttccacagtgtggaaggggacccgaacgggttgcccgtgaatttcatctcattaaaaaatgtaaaaactttgaggccaggtaccaacctaatttgtttttttgagacagagtctcactctgttgcccaggctggagtgcagtggtatgatcacagcttactgcagccttgaccccccaagctcaagtgttcctcccacctcagcctctcaagcagctgggactacaggcatgcaccacttttgtatttttttgtagagacaaggcttctccatattgctcaggctggtcttgaactcctggactcgagcaatccacccgccttgacctctcaaggtgctgggattacaggcatgagccaccatgcccggcccgtttttgtttttgttttttggaaacggagtcttgctctgttgcccagactggagtgcagtggtgtgatctcggctcactgcaacctccgcctcccgggttcaagcgattctcctgcctcagcctcccgagtacctgggactacagatgagtaccaccacacccagctaatttttgtattttttaggagagacagggtttcatcatgttggccaggatggactcgatctcctgacctcatgatccacccgcctcagcctctggaagtgctgggattacaggtgtgagccaccgcgccagccaattttttttttttttttgacacagagtttcgctcttgttgcccaggctggagtgcaatggcgtgatcttggcttactgcaatctccgcctcctgggttcaagctattctcctgcctcagcctcccaagtagctgggattataggcacccgccatcacgcctaatttttgtatttttaatagagacagggtttcaccatgttggccaggctggactcgaactcctgacctcaggtgataaacactcgcctcggcttcccaaagtgctgggatcacaggtgtgagtcaccgtgcctggccatttttttttttaagcaagatcaaatagatccaattttcctcggccccacagaccttttttaccataggctctggcgccgggtaagtaaaacccaaacacatgcctgtgaccctgagagggaagctgtgtctgggctccaggagctggtggacagagctgggcagaatctcattccttcccttctgaggattccacgtaaccacttgggagccgggagggctggcaaattctttcccttttgacttctgccttttgcacagggaatgaactggaccacaggtaatgtgcgctcagagatcttcagatcagggttcctcaatcacggtgcaggtggtgtccatgggacctggcccgggctgtctctgatgcggccgccctgtgcaccgcaggaggttgggcagcatccccaccttctgctcaacaaataatcactttcatcagtgacaaccccagggtcgtgacaaccaaaaatgtctccaactcatggacagatgtcctctgggggacaagattgccccaggtggagaacccctgctctggatgcctgtcactaaagctactgatgaccaaccagagccccatacaacatcatctaaaactcttcataggcaacaaaagaaaaaaacgatcaactggacactagaaccaaaaacttttgtgcatgaaaggacgctaccaacaaaatgaaaatgcaacacacaaaataggagaaaatatttccaaatcaggccaggtgcggtagctcacgcctgtaatcccagcacttagggaggctgaggcaggcagatcacttgagatcaggaattcgagaccagcttggccaacatggcaaaacccagctctactaaaaatagaaaaattagccgggtatggtggcacacacctgtaatcccagctactttgggaggctgaggcaggagaatcgcttgaacctggaaggcggaggttgcagtgagctgagctgagatcgtgccactccactccagcctgggcaacagagcaagacttcatctcaaaaaaaaaaaaaaaccctgaaaataacaaccattggtatggatgtggagaaactggaacccttgtgcactcttgctgggtgcatgagatggtgcagatgctgtggaaaacagcatggcggctcctcaaaaaattcaacacagaatgaccacatatgctccagccatcccactgctggatacatccacccaggaacggaaagcagagttgatcagagatacacttgtacacccacgttcactgcagcattatttacaatggaatattcttcagccttaaaaaggaaaaaaattctggaggtttcccaaagaaggaagtctgcctcaagaccgtggcacagaaatcctaagcttccagtctgctggcctggcctgcagatttcagacttgtcaacttctgtaagcaaccaagggagctgtctaagtacccattccttaaaataaatctgtgtgtgtgtgtatcttctgttggttctgtttctctggagaagaaccctaatacaaagcgatatctcactgtcattagaaaaggcttcagcatggccacgcacggtggctcacacctgtcatcccagcactttgggaggcctaggccagcggatcacctgaagtcaggacttcgagaccagcctggccaacatggtgatgaaacccatctctactaataaaacaaaaattagccaggcatgatggcgagtacctgtaatcccagctacttgggaggctgaggtgggagcatcgcttgaacccaggaggtggaggttgcagtgagccaaggttgtgccactgcactccagcctgggcaacagagcaaaaatccatctcaaaacaaacaagcaaacaaaaaaccagaaaaggcttcagcagcatcaggaaaggcaggaagagacaaacggacagagaaagagcttaggggacggtgctgggtaacaggcagggcagtgctcagtgtgatggggagaggctggagaaccaggtcctgtgggagcagctctgcccttgagaggagggcacagggaagctgaagtgaagtaggaccagcatgtagggggcagaggcagaagaacaggatggcaaggcagtgctgggcatctgcctgagtcacggccgagtggctgtgcaggccctgcaggtgggactctgcagggatacgggtagccctgtccacggaggatcgccccaggccaactggaccaacagaaccaagccccggagctggtgcctgacagttcctatttttggcaagccccctagaggacacaatcacttgcaagttaccttcattctccagcggcgcgtcccgctgagctgggtccatgcatcttggctcctccccagaaaggtatacagccacgtcctccaagttcacgggcacctgccagaacgcaccccactcagtcctggccccaagcaagctgcctcctccccaactaaggccactggcccagggagctgcaccgccactgcccctcgaggctggcgccaagcctggtggtgcagctggtcttctccactctcgttgcagtggtgagtcctggtgtctccgcccactgctcccatgtgccactgctgcagagctgggacaccaccggagaagggacagattcgccacgaggagtggtggacccactgcacactcagccaccgaggcccatgctccacagggagacaagagcatcccctggctccgtggctagccagccccaggaccccattgcggcagacgggggacttcaggatgcctctgggccagtggctcccagatgtagcaccagattgacccggaagcatgattaaaaaaacaagcaaactctttccagaacaggcaaattcacagagacaagaaggagctttgtggttgccagaggctgagggaaaaacaggtagagactctggtaatgagtctagggggttttcggggagggtctaaaggaaatgttcggccgggcgcggtggctcacacccgtaatcccagcacattgggaggccaaggcaggtggatcatctgaggtcaggagctccagaccagcctggccaacatggtgaaaccccatctgtactaaaaatacaaaaaaaattagccaggcatggtggtgggtgcctgtaatcccagctactcaggaggctgacgcaggaaaatcgcttgaacccgggagccggaggttgcagtgagccgagatcgcaccattgcactccagcctgggcaacaagagcaaaactctgtctcaaaaaaacaaaaacaaaacaaaacaaatacacatacatacacacacacacacacacacacacacacacacacacacacacacacacatataaaaattataaataaataaataaaaataaaacaggccaggcatggtggcttatgcctgtaatcccagtgctttgggagacttaggcaagaggatcacttgagcccaggagttcaagaccagcctaggcagcacagcgagactgtgtcccattaaaaaaaaaacaaaaaaaaaacaactagccgggtgtggtggtgcatgcctgtagtcccaactaactgaggaggctgaggcaggaggatcccttgagcctgggaggtcaaggctgcagtgagctgtaatcacactactgcactccagcgtgagcacagagccagactttggctcaaaacaaacaaacaaacaaacaaacaaacaaaaaccccaaaaaaaccagcaagcaaacaaaggagactcccattccagcccagcggtgtgggaggaagctgtgttttcccccagagtcccaagagattcctgtgcccagcagagtaggagtcaccaccctgtctcactggtggaccgcagaatcttccgggcacagccgagtacttaaatggcctctggagagaagaaaagacttcccaggaggccaggggaagtgactccagggttggggcaaagggagaaaactccagggaagagctcctctgacatccaaaaccttggcccccaggagaggtgtccccttaacaaggaagtgtgacacacaggaggtcgggccagaccccaggatgctgcagaccaggagcatcccactcacctgggaccaggccgaaaggaagggcgaggctgacgccatctcctgatgccggggagctggagggcctgggaaggagcagagtcaccaccagtcacacagctcacccagtactgcccctgccgtcccctgcacaccaaggccccaacagcccggcggctgcccacccaagatccactccttgctggagagcctgtgcaccctgcatccaggcaggcctctgccctggccacagtccacaccccagtcaccttcacctccctcccctgcaccacttctcattcctccaaaggggtgctactcacctctctctggccacaacagcgggcccctctgtggcctgtggctcagctgggctgggggctgctggctggagaatcgagcctcttcctccagggacagatcctctggctgagcctctgcctggtgttttaagaactgtccccctatcccgaggggcacctcgtcatcagaaagcagctctgagccctgcacacagacagtgatctccccaccagctcccagaaggccagaaggaaaaatccccgcagggccccacacccctcatctcaggcaccccagccggctgcccacccccgggctgtctgcagcctccctccctctgcccagccgtgtggcagtgttccctgcagccagctcccagcctgctctactccatggtctctccctgtcaccacaatcgtttccccatcacattcttaccctctattccttggtcctcctgatagaccctgggatagaccctgggccagaagagccctgagtcagcgctggactaatttcagaagttcacagaactgcatttgctagattttttgaaattatctggccagctgcaatggctcacacctgtaattccagcactttgggaggccgaggtgggtggatcacctgaggccaggagttcgagaccagcctaaccaacatggtgaaaccccatctctactaaaaatacaaaaattagccaggcatggtggcagcacgcttgtaatcccaggtacttgggaggctgaggcaggagaatcgcttgaactcgggaagtacaggttgcagtgagccgagatcgtgccactgcactccagcctgggcaaaagagcgagactccatctcagggaagaaaaaaaaaaaaagaaaaaaaaaagaaattatcaacaggtgctctgagatgatctatttcctaattccaggaaaggtgagttgaatgaaattgggtcttagaattgagctctgcaatagcacttggacaagagacatccctaggcaactacaaacccagcgtcagggacccatctcaggcttcctcttattcaacattccacacctctaagggagcgtagtccccttggggagcacagcctgcccctctcagctcagtgatggccatgaggcatgtgtgcagaggtgtcggtgcagtgacagaaggaagccatgccgggaaccccaaacactgaagctgtggtggccaggaaagaggctggccggctgggaagaaaccccgatttcttggccaccccgatggcaggattttctgactgcggtcagctcacgccgtggtcaagcattaggggatgtgcctcctctgttggctgcaaaaggccagcagtgtgcagccagcagcactgccacaggaagaaaggcagctggtcagcactgcccatgtgccccatccacgcaaggccctgaaaaatgaactgaaacagcaggtggcaggacttctttctaatctcaaggagttccacaactgaaactgaagcagcaggaatgagtaagaggcttcctctactccttcaaatggggctggaaggaggtggagaggcactgtctatagagatttcggtgtgtcagaagggtcctgtctgtgccatccagtacagtagccactggccatgtgtgacgactgagcccttgagaggtggtcagtgtgactgaggaactaatttaacattctacacagtggccgggcacagtggctcatgcctgtaatcccagcactttgggaggccaaggcaggcagatcacttgaggccaggagtttgagaccagcctagccaacattgcaaaaccctgtctctactaaaaatacaaaaatcagcctggcgtggtggcagatccctgtaatgccagctacttgggaggctgaggcacgagaatcactccagcctgggcgacagagagagactctgtctcacaaaaataaaagtaaaataaatgggctaggtgcggtggctcacgcctgtaatcccagcactttgggaggccaaggcaggtgaatcacgaggtcaggagatccagaccaccctggctaacacggtgaaaccctgtctctactaaaaatacaaaaaaattagccgggcgtggtggtgggcgcctgtagtcccagctgctgaggaggctgaggcaggagaatggcgtgaatccgggaggcggagcttgcagtgagccgagattgcgccactgctctccagcctgggcgacagggcgagactccatctcaaaaaaaaagaaaaaaaaaaaaaaagtaaaataaatgtacatagctataatttaaaaagctacatgtggctggcagctactgttttgcatggcacagctctagaacctctgggggctctaaccaaagtgccccccatgcccctggtctttcttcccagtgttctcccactttgggggtagtttcaactccctgccttggaaggtgccggacctctctcccaccaaaacctatgtttggggctggcgtagtggctcatgcctgtaatcccagcacttcgggaggccaagatgggaggatcacttgaggccaggagttcaagaccagtctgggcaacataacgaaaccctgtctctacaaaaaatacacaaaattagcaggtgtagtggtgcatgcctgtagtcccagctactcaataggctgaggtgggaggattgcttgaagcctggaggtagaggctgcaatgagcggtgatcacaccaccatagcctgggcaacagagcgagactatgtctcaaaaaaaaaaacatgtttggcctaccctaggacagtgttcacaaaccatctgcactagctaataaagggctattggggtaggatgaggttaatcaaagggtggacacccattagccaaggctgagaaatcttttgcagttgctttcctcaaaagggctcaggggccaggcagccacacttggtcacccaatgaccaaggaatctgcagctgcagaccccagcagcagggccccatttcctcacctgagggtcaaaatgcccccactcacccgctgcctgtgtttcctgggcttccgctgcagcccttccacaaggaccacggcctcctcaccgctctccggctgctgctcgcgtacccgagcctggatctcccccggcagcacagtcaggaactgctccagcaccagcagctccaggatctgctccttggtgcgcagctccggccgcagccagcggcagcacagctcccagaggcggctcagggcctcccggggcccagccacctcctggtagcagaagagccggaagagctggcggaaagtctcagggctggggtcctccgtctccacggagggctcctcttccaagcagaagtcctcctccaccttcacaatcaggatctcttcctgttccaggtcctgctccaaggttggcaggggctggaggccagggacagtggccattgcttccggtgggccttgttccttttcaggccttagagttgaacctgtctctctctatacctctggccagacacaggaagagagtttttttcagggccctgtggagagacgataaaaccatctgaagggcagccctggggctggataagccctttggcctgggaagcccctgccctggttccaaggccagctcaccccaccatggaaaaggaaaaggaagtggatgaatgtcatctttgttattaaccccctgttaattcccgggtaatttactgaagggctctgggctttgcttcctcactgggcaaacagagatgataacaggacctacacacacaggttgctgacagaactaaaagggatggctgggggcagtagctgacgcctgtaatccccgcactttgggaggcagaggagggcagatcacgtgagttcaggagttgaccacctggtcaacgtggtggaaccctgtctctacaaaaaatacaaaaattagcccgacatggtggtagcacatctgtaatcccagcaactcgggaggctgagacaggagaatcgcttgaacccgggagatggaggttgcagtgaactgagatagcgccactgcactccagcctgggcgacagagagagactcaaacaaaaacaatctaaaagggatgtttgcggtcagagctcgagaatcgttattttccatgattagagtgggtcctatatggaaggggttcctttggaaatctgatgaaaagtagggcctttctgcagactctgcctcaacttgatccccggtgtccaggtctggcgaaccctgaagcccctacgcggccccgtcaggcacccccgcgtgggtggtcacgacagccccccaattccagggtcctgggagagctgggacccccaggccgggctgctttcccgtctcatccctcaggtggagggtgagcggtacccgaggccgcggcacagacccgggtgctggcgcgggccgcgaaatcgaagcttcggccgggacccgcgtccccgcgccccccgcactcactggaagcgctgccggccgtgggcagttcggggcaggaccggagcggcgggtctcggcgggagtaggactgcgggcctcaggcttggcagccagggacgccagagccggggccgaagaccctaaaccaggggtgcaaaccaggccgtgcg

SEQ ID NO: 911 - DNA, 8037 bp, Homo sapiens
cttctaatccccacaatgaccccagcctaataatacaataatccccaagtagaaccaggggcccaaggccccctcgtcagctgggctcccacctccaagctgacgccctcaaccactctgctggggtgagcaaacccaggccccacagctggctagcgggatatccgtgtccacgattggcgccatgtgttttaagttgcagcgtcaaaaacatgaagagattgctttagcaaatatttacccagtcctgactctgcacatggcatcgttctaggagcccaaagatgttaacttgtttaataatcaagccctgtgaagtaagtgctgttactaccccaagctgatagataagagagggtcaggtgaggaggtggcagagtctctgccgctctgagtctgtgtgctcaccctctactgcctttttctggtttacagaaacatctagatttccggtgtatcttagaggttatcaccctgacttgagatgccctctttaaataggccatgtgctttccagactgtggtcctcacccctgccttactgtctctctgataagctgtttctttttttgttgtttgtttttgagacagcctcgctctgttgcccttgctggaatgcagtggcgcgatctcggctcactgcaacctccgcctcctgggttcaagcaattctcttgcctcagcctcccaagtagctggattaccggtgtgcaccaccacgctaattttgtatttttagtagagaaggggtttcaccacattggtcaggctagtcacaagcttctgacctcaagtgatccaccaaccctggtctcccaaagtgttgggattagtgagccaccatgcctggcctttttttttcttttttcctttttttctttttttttttgagacggagtctcgctctgtcacccaggctggagtttagtggcatgatctcggctcactgtaagctctgcctcccgggttcacgccgctctcctgcctcagcctcccgagtagctgggactacaggcgcctgccaccacgcccggctaattttttcctatttttagtagagactggttttccctgtgttagccaggatggtctcgatctcctgatctcgtgatctgccctcctcggcctcccaaagtgctgggattacaggcgttagcccctgcgcccagccctttttaaaatttttttgagacacggtctcactatgttgcccatgctggtctcaaactcctgggttctagtgatcctctcacctcagcctccctaaatgctgagattacagacgtgaaccaccatgcccagcctgataagctgtttcttataccaagtccatctcacacagttaattctttcttgtttcctggtacttgacttcacaaggcttaggcattcctgtgtccttgctattggcaaatgttttctctttcttttttctttcttttctcctttcttttctttcttttttttttttcttttttgggacagggtctcactttgtcacccaagttggagtgcagaggcacaatgacagctcactgcagcctcgacttcctgggttcaagtgatcctcctgccccagcctccctagtagctgggacttcaggtacgtagaccatgctgggctaatttttttactttttgtagagatgaggtctccctatgttgcccaagattgtcttgaactcctggggtcaaggggtccagctgcctcagcctcccaaagcgccaccacactcaggctggcaagtgttttctgtaaagggccagatggtccctattttaggctttgctggtcctaagttctctgttgcaactactatgcaacttttcattgcagtgagaaagtcgccacagacaataggtaaacagatgggcgtggctgtgtctaagtaaaaccgtattcacagaagaaaggtggccgtggttccagctttcctgagccccaggccgacttctgccctttgctgtccactaccttctgccagttcttccttctggggaactcccgctccttcctggaggcttaaccttaaaggcttagaggctaggggtcagccaggtgcgttgactcatgcttgtaatcccagcacttcaggaggccaaggtgggcagatcacttgaggtccggtttgagaccagcctggccaacatggcgaaaccccatctctactaaaaatacaagaattagctgggcttggtggcgggcacctgtagtcgcagctacttgggaggctgaggcagggagaatagcttgaaccgaggaggtggaggttgcagtgagccgagatcgtgccattgcactccagcctgggcgacagagtaagaccctagctcagtaaataaataaataaataaataagtaagtaaataaataaaggcttagaggttaagggtgggccaggcagggcccagggtggcagggacgatggggcacagcctgtcctggaccacagtttgttgtccaaggtgaaatcttgaaaaccacaattccacagcccttgagggattcagcacgggggcctctcccataagcagctgaggatgtggttagtggatgaacaaatggctctggtgatggtgacgtgtggactgcgtttgagcagtagacgtacctctggggatgtcccctaaggaaatgcgcctctgtgcagagaaaacactttctccaggaaaatcctcccatgtgagcgatggtctaattctgaaaatcgtggcggtgaggggaggagcctcactgggtgccagtagggactgcaccatgtaagtgccgtcaaaggagtagtttgcagaaagcatgctgtcatctggaaggtgctcccggtggtgttgactggcaaaagccagggaaaaaacgatctatgcagcgtgactatggtggaagaggacaaaagcctggatggaatcacacgtcaacacggcgataatagcacagggcattcagtgcacgtttctgtgagccttccatcatgcttcgacggctctgacatcgatgatcagttcatttcatcctcacgacactgggaggaggtggatactattaacatacccattttacagatgagtatactgaggcagaagggctcagggaacgttactcaagctcacacattggtgggtcttatggcatgcaatcgaacctgggtccagaagtctgactcaccggaaccactccctgccacagcctcctcctcctgttactgtcctgcctgggactgggcggggctctgtgacttttgtcttttttgttttctgagacacagtctcactctgtcacccaggctggagtgcagtggcgagatcttggctccctgcaacctctgcctcccgggttcaagtgattctcctgcctcagcttcccgagtagctgggattactggcaccaaccaccacgcccggctaatttttgtatttttagtagagacgggtttcgccatgttggccaggatggtctcgaatttctaacctcaggtgatctgcccacctcggcctcccaaagtgcttggattactggtgtgagccaccgcgcctggcctgactttgtcttttaacaacttggtggtttccagatcttctttaagagatagatacgactttcataatagtaacaacaaacattagaaacaaggtacccagagagacaggaagactgagggccagaggggagaggaggggacagtgggcctcctgcccacccagccaggccaagagctggagcaggggccacagttgttcccctgcacttttctttttttttgagacagagtctcgctctgtcgcccaggctggagtgcagtggcgtgatctcggctcactgcaagctccgcctcccgggttcatgccattctcctgcctcagcctcccgagtagctgggactacaggtgcccgccaccacgcccggctaattttttgtatttttagtagagacggggtttcaccgtgttagccaggatggtctcgatctcctgacctcgtgatctgcccccctcggcctcccaaagtgctgggattacaggcatgagccaccgcgcctagcctcccctgcactttttaaatagaagtatgtctgctgggcgcggtggatcatgcctgtaatcccagcactttgggaggctgaggggggcggattgctagagctcaggagttcaagaccagcctgaccaacatggtgaaaccccgtctctactgaaaacacaaaaatcagctgggtgtggtggtgcacgcttgaaatcccagtgattcgggaggccgaggcaggagaatctcttgaacccaggaagcggaggttgcagtgagccgacatcgtgccattgcactccagcctgccagcctgggtgacagcaagactccgtctcaaaaaaaaaaaaaaaaaaaaggccaagcatcgtggctcacacctgtaatcctagcactttgggaggccaaggtgggtgaatcacctgaggtcaggagtttgagaccagcctggccaacatggtgaaacccagtctctactaaaatacaaaagttagctgggcgtggtggcaggtgcctgtaatcccagctactcaggaggctgaggcaggagaatcgctcgaacccgggaggcggagattgcagtgagccgagatggcgccactgcactctagcctcagcaaaaagagcgaaactctgtctcaaaaaaaaaaaaaaaaaaaaagggagggaggaggattagagtcagaggaggagacgtgagcctggaagcagagggtggagggatgggagaccacaagcccaggaatgccaccaccctctagaagctggacaaggcaaaagatggactctgccctagaaccttcaggatgaacacagcctggtcgacccattttagactctgaccttcagaaccatagggcaatacatttgtgttgtttgaagccacagagtttgtggtagtgttacggcagcattgggacatggatacattaggtgtgtgacgggctaatggctaaacttctctaggcctccgtttcctcatctgtaaaatggaaaaagcaataatacccactttaggattgctatgaggaataaaccaggtgacacagcacagtgctcgatgcagagccccacattagctgatattttcaagtagtaaaatagagaaaataaggacagtgaagagtcctagtacagctggccttccgtatccacaggttccacatctgtggcttcagccaaccacagacagaaaatatttggaaacaaatcacatctctattggacatgtacagacttttttgcttactgttccctatacaatgtaacaattatttacctagcatacattatattaaataaatatatgtatacaattttttcttgagatggagtcttgctctgtcacccacgctagagtgcagtggtgccatcttggctcactgcagcctctgcctcctgggttcaagcgattctcctgccttggcctcccgattagctgggattacaggagtatgccaccgcacccagccaatttattttttttgagatagtcttgctctgtcacccaggcgggtgtgcggtgacatgatcttggctcactacaggctccgcctcctgggttcaagcgattctcctgcctcagcctcccaagtagctgggattacaggtgcccgccaccacagcggggtaatttttgtattattattattttttgagatggagtcttgctctgtcacccaggctggagtgcagtggcgagatctcggctcactgcaatctctgcctccagggttcaagcaattctcctgcctcagcctcctgagtagttgggactataggcgcgtgccaccatggccggctaattttttgtatttttagtagagatggggttttaccgtgttacccaggatggtcttgatctcctgaccttgtgatccgcctgcctcggcctcccaaagtgctgggattacaggcatgagccaccacacccgaccaatttttgtatttttatctttttttttttttgagatggagttttgctcttgttgcccaggctggagtgcaatggcgtgatctcggctcaccacaacctctgcctcccgggttcaagtgattctcctgcctcagcctccctagtagctgggattacaggaatgtgccaccacgcctggctaattttgtatttttagtagagacatggtttctccacgttggtcagtcaggctggtctcaaacttctggcctcagctgacccgcctctgcctcccaaagtgctgggattacaggcgtgagccactgcgcccggcccaatttttgtatttttagtagaggtggggtttcgccatgttggccaggacggtctcaagctcctgatctaagtaagtgatctgcccaacttggccttccaaagtggtgggattacaggtgtgagccaccaggccaggccaaatatattaagtattataagtaatccagagatgatttaaagtatagagtatatgcacaggttatatgcaaatactgcctcattttatatcagggagtttatagcatctgtggattttggtacccacggaggtgctggaaccaatcgttgaggattccaaggacaactctatgatgcaggcacacctgtcctagctgctcaagggtcgtgggatgcaggtaggttttctcccccttccccctccctcccacccaccttctctcccatctctctctctttcattcacgaagtcagcagtggccaagcacacaggtgttcccagctgcatatctgggatactgaggaaaggtaagaagtctcaggagtgaagaagccacaggccggcgtcttcctccctgggcctccagcagtggggagccagggagcgcacctgctgggcctgggccctctcccctgggctgggcggcctctgctggccctggggagggcggggctggttgccaaggcctcaggtggtgtggagccggaagcaggaagcagcctgtgctccccaggacctgcctggttgggggaattggaggcttctaggaggtaggtgggggcctgggggctgggctgccagggggagagagaggggagatgacagtggctggggagaaggttgtcagggtaaggaccacagggctgggcaaggagagaagctgggcctggggccgagggagaagtggagtgggagggggtggggaagctggcgctgggccaggagcgggcagtggctgggctgtgggaagcctggatgtggtccccgctgagctgagcccaggatcctgatgcagcctctgggggaccggggcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggtaagtgtggctgtggcctctgggtcctcccagccccctgccctgggctccaggttggggccacacctggacgcctgtcctgtccccaggcaccgtgctgctcctgctgctgctggtcgtcgcccactgctgctgctgcagctcccccgggccccgcagggaaagccccaggaaggtgagcccctggaaggtgagccctgccggcctctgggacctgcacggaactgtactgggggtggaggcggaaggtgaggggagtggcgggaagggtgctcatccccctagggaacaacgagcgaacctgcttggtcccgctgtgcttctcgtgcaggaaagacccaagggagtggataacttggccctggaaccctgaccctgtgtctcctgcccggtggcagtaacaaagccttctgtctgcccagagcctgagtctgcagtgtcttccagtccccgtctgggtgggtgacgcgggactcgccgccccactcaggtggccacctggcctctccaagccttcagtcagcacgactgtgccaggtcatcctcagtcacctagctgggaggggagctggtctcaggccgggcgcggtggctcacacctataatcccagcactttgggaggccgaggtggg

SEQ ID NO: 912 - DNA, 8096 bp, Homo sapiens
tgcacttgctgtgacccccacctggaggcttctctgcagcaggagcaggagctgttacccttctaatccccacaatgaccccagcctaataatacaataatccccaagtagaaccaggggcccaaggccccctcgtcagctgggctcccacctccaagctgacgccctcaaccactctgctggggtgagcaaacccaggccccacagctggctagcgggatatccgtgtccacgattggcgccatgtgttttaagttgcagcgtcaaaaacatgaagagattgctttagcaaatatttacccagtcctgactctgcacatggcatcgttctaggagcccaaagatgttaacttgtttaataatcaagccctgtgaagtaagtgctgttactaccccaagctgatagataagagagggtcaggtgaggaggtggcagagtctctgccgctctgagtctgtgtgctcaccctctactgcctttttctggtttacagaaacatctagatttccggtgtatcttagaggttatcaccctgacttgagatgccctctttaaataggccatgtgctttccagactgtggtcctcacccctgccttactgtctctctgataagctgtttctttttttgttgtttgtttttgagacagcctcgctctgttgcccttgctggaatgcagtggcgcgatctcggctcactgcaacctccgcctcctgggttcaagcaattctcttgcctcagcctcccaagtagctggattaccggtgtgcaccaccacgctaattttgtatttttagtagagaaggggtttcaccacattggtcaggctagtcacaagcttctgacctcaagtgatccaccaaccctggtctcccaaagtgttgggattagtgagccaccatgcctggcctttttttttcttttttcctttttttctttttttttttgagacggagtctcgctctgtcacccaggctggagtttagtggcatgatctcggctcactgtaagctctgcctcccgggttcacgccgctctcctgcctcagcctcccgagtagctgggactacaggcgcctgccaccacgcccggctaattttttcctatttttagtagagactggttttccctgtgttagccaggatggtctcgatctcctgatctcgtgatctgccctcctcggcctcccaaagtgctgggattacaggcgttagcccctgcgcccagccctttttaaaatttttttgagacacggtctcactatgttgcccatgctggtctcaaactcctgggttctagtgatcctctcacctcagcctccctaaatgctgagattacagacgtgaaccaccatgcccagcctgataagctgtttcttataccaagtccatctcacacagttaattctttcttgtttcctggtacttgacttcacaaggcttaggcattcctgtgtccttgctattggcaaatgttttctctttcttttttctttcttttctcctttcttttctttcttttttttttttcttttttgggacagggtctcactttgtcacccaagttggagtgcagaggcacaatgacagctcactgcagcctcgacttcctgggttcaagtgatcctcctgccccagcctccctagtagctgggacttcaggtacgtagaccatgctgggctaatttttttactttttgtagagatgaggtctccctatgttgcccaagattgtcttgaactcctggggtcaaggggtccagctgcctcagcctcccaaagcgccaccacactcaggctggcaagtgttttctgtaaagggccagatggtccctattttaggctttgctggtcctaagttctctgttgcaactactatgcaacttttcattgcagtgagaaagtcgccacagacaataggtaaacagatgggcgtggctgtgtctaagtaaaaccgtattcacagaagaaaggtggccgtggttccagctttcctgagccccaggccgacttctgccctttgctgtccactaccttctgccagttcttccttctggggaactcccgctccttcctggaggcttaaccttaaaggcttagaggctaggggtcagccaggtgcgttgactcatgcttgtaatcccagcacttcaggaggccaaggtgggcagatcacttgaggtccggtttgagaccagcctggccaacatggcgaaaccccatctctactaaaaatacaagaattagctgggcttggtggcgggcacctgtagtcgcagctacttgggaggctgaggcagggagaatagcttgaaccgaggaggtggaggttgcagtgagccgagatcgtgccattgcactccagcctgggcgacagagtaagaccctagctcagtaaataaataaataaataaataagtaagtaaataaataaaggcttagaggttaagggtgggccaggcagggcccagggtggcagggacgatggggcacagcctgtcctggaccacagtttgttgtccaaggtgaaatcttgaaaaccacaattccacagcccttgagggattcagcacgggggcctctcccataagcagctgaggatgtggttagtggatgaacaaatggctctggtgatggtgacgtgtggactgcgtttgagcagtagacgtacctctggggatgtcccctaaggaaatgcgcctctgtgcagagaaaacactttctccaggaaaatcctcccatgtgagcgatggtctaattctgaaaatcgtggcggtgaggggaggagcctcactgggtgccagtagggactgcaccatgtaagtgccgtcaaaggagtagtttgcagaaagcatgctgtcatctggaaggtgctcccggtggtgttgactggcaaaagccagggaaaaaacgatctatgcagcgtgactatggtggaagaggacaaaagcctggatggaatcacacgtcaacacggcgataatagcacagggcattcagtgcacgtttctgtgagccttccatcatgcttcgacggctctgacatcgatgatcagttcatttcatcctcacgacactgggaggaggtggatactattaacatacccattttacagatgagtatactgaggcagaagggctcagggaacgttactcaagctcacacattggtgggtcttatggcatgcaatcgaacctgggtccagaagtctgactcaccggaaccactccctgccacagcctcctcctcctgttactgtcctgcctgggactgggcggggctctgtgacttttgtcttttttgttttctgagacacagtctcactctgtcacccaggctggagtgcagtggcgagatcttggctccctgcaacctctgcctcccgggttcaagtgattctcctgcctcagcttcccgagtagctgggattactggcaccaaccaccacgcccggctaatttttgtatttttagtagagacgggtttcgccatgttggccaggatggtctcgaatttctaacctcaggtgatctgcccacctcggcctcccaaagtgcttggattactggtgtgagccaccgcgcctggcctgactttgtcttttaacaacttggtggtttccagatcttctttaagagatagatacgactttcataatagtaacaacaaacattagaaacaaggtacccagagagacaggaagactgagggccagaggggagaggaggggacagtgggcctcctgcccacccagccaggccaagagctggagcaggggccacagttgttcccctgcacttttctttttttttgagacagagtctcgctctgtcgcccaggctggagtgcagtggcgtgatctcggctcactgcaagctccgcctcccgggttcatgccattctcctgcctcagcctcccgagtagctgggactacaggtgcccgccaccacgcccggctaattttttgtatttttagtagagacggggtttcaccgtgttagccaggatggtctcgatctcctgacctcgtgatctgcccccctcggcctcccaaagtgctgggattacaggcatgagccaccgcgcctagcctcccctgcactttttaaatagaagtatgtctgctgggcgcggtggatcatgcctgtaatcccagcactttgggaggctgaggggggcggattgctagagctcaggagttcaagaccagcctgaccaacatggtgaaaccccgtctctactgaaaacacaaaaatcagctgggtgtggtggtgcacgcttgaaatcccagtgattcgggaggccgaggcaggagaatctcttgaacccaggaagcggaggttgcagtgagccgacatcgtgccattgcactccagcctgccagcctgggtgacagcaagactccgtctcaaaaaaaaaaaaaaaaaaaaggccaagcatcgtggctcacacctgtaatcctagcactttgggaggccaaggtgggtgaatcacctgaggtcaggagtttgagaccagcctggccaacatggtgaaacccagtctctactaaaatacaaaagttagctgggcgtggtggcaggtgcctgtaatcccagctactcaggaggctgaggcaggagaatcgctcgaacccgggaggcggagattgcagtgagccgagatggcgccactgcactctagcctcagcaaaaagagcgaaactctgtctcaaaaaaaaaaaaaaaaaaaaagggagggaggaggattagagtcagaggaggagacgtgagcctggaagcagagggtggagggatgggagaccacaagcccaggaatgccaccaccctctagaagctggacaaggcaaaagatggactctgccctagaaccttcaggatgaacacagcctggtcgacccattttagactctgaccttcagaaccatagggcaatacatttgtgttgtttgaagccacagagtttgtggtagtgttacggcagcattgggacatggatacattaggtgtgtgacgggctaatggctaaacttctctaggcctccgtttcctcatctgtaaaatggaaaaagcaataatacccactttaggattgctatgaggaataaaccaggtgacacagcacagtgctcgatgcagagccccacattagctgatattttcaagtagtaaaatagagaaaataaggacagtgaagagtcctagtacagctggccttccgtatccacaggttccacatctgtggcttcagccaaccacagacagaaaatatttggaaacaaatcacatctctattggacatgtacagacttttttgcttactgttccctatacaatgtaacaattatttacctagcatacattatattaaataaatatatgtatacaattttttcttgagatggagtcttgctctgtcacccacgctagagtgcagtggtgccatcttggctcactgcagcctctgcctcctgggttcaagcgattctcctgccttggcctcccgattagctgggattacaggagtatgccaccgcacccagccaatttattttttttgagatagtcttgctctgtcacccaggcgggtgtgcggtgacatgatcttggctcactacaggctccgcctcctgggttcaagcgattctcctgcctcagcctcccaagtagctgggattacaggtgcccgccaccacagcggggtaatttttgtattattattattttttgagatggagtcttgctctgtcacccaggctggagtgcagtggcgagatctcggctcactgcaatctctgcctccagggttcaagcaattctcctgcctcagcctcctgagtagttgggactataggcgcgtgccaccatggccggctaattttttgtatttttagtagagatggggttttaccgtgttacccaggatggtcttgatctcctgaccttgtgatccgcctgcctcggcctcccaaagtgctgggattacaggcatgagccaccacacccgaccaatttttgtatttttatctttttttttttttgagatggagttttgctcttgttgcccaggctggagtgcaatggcgtgatctcggctcaccacaacctctgcctcccgggttcaagtgattctcctgcctcagcctccctagtagctgggattacaggaatgtgccaccacgcctggctaattttgtatttttagtagagacatggtttctccacgttggtcagtcaggctggtctcaaacttctggcctcagctgacccgcctctgcctcccaaagtgctgggattacaggcgtgagccactgcgcccggcccaatttttgtatttttagtagaggtggggtttcgccatgttggccaggacggtctcaagctcctgatctaagtaagtgatctgcccaacttggccttccaaagtggtgggattacaggtgtgagccaccaggccaggccaaatatattaagtattataagtaatccagagatgatttaaagtatagagtatatgcacaggttatatgcaaatactgcctcattttatatcagggagtttatagcatctgtggattttggtacccacggaggtgctggaaccaatcgttgaggattccaaggacaactctatgatgcaggcacacctgtcctagctgctcaagggtcgtgggatgcaggtaggttttctcccccttccccctccctcccacccaccttctctcccatctctctctctttcattcacgaagtcagcagtggccaagcacacaggtgttcccagctgcatatctgggatactgaggaaaggtaagaagtctcaggagtgaagaagccacaggccggcgtcttcctccctgggcctccagcagtggggagccagggagcgcacctgctgggcctgggccctctcccctgggctgggcggcctctgctggccctggggagggcggggctggttgccaaggcctcaggtggtgtggagccggaagcaggaagcagcctgtgctccccaggacctgcctggttgggggaattggaggcttctaggaggtaggtgggggcctgggggctgggctgccagggggagagagaggggagatgacagtggctggggagaaggttgtcagggtaaggaccacagggctgggcaaggagagaagctgggcctggggccgagggagaagtggagtgggagggggtggggaagctggcgctgggccaggagcgggcagtggctgggctgtgggaagcctggatgtggtccccgctgagctgagcccaggatcctgatgcagcctctgggggaccggggcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggtaagtgtggctgtggcctctgggtcctcccagccccctgccctgggctccaggttggggccacacctggacgcctgtcctgtccccaggcaccgtgctgctcctgctgctgctggtcgtcgcccactgctgctgctgcagctcccccgggccccgcagggaaagccccaggaaggtgagcccctggaaggtgagccctgccggcctctgggacctgcacggaactgtactgggggtggaggcggaaggtgaggggagtggcgggaagggtgctcatccccctagggaacaacgagcgaacctgcttggtcccgctgtgcttctcgtgcaggaaagacccaagggagtggataacttggccctggaaccctgaccctgtgtctcctgcccggtggcagtaacaaagccttctgtctgcccagagcctgagtctgcagtgtcttccagtccccgtctgggtgggtgacgcgggactcgccgccccactcaggtggccacctggcctctccaagccttcagtcagcacgactgtgccaggtcatcctcagtcacctagctgggaggggagctggtctcaggccgggcgcggtggctcacacctataatcccagcactttgggaggccgaggtggg

SEQ ID NO: 913 - DNA, 1115 bp, Homo sapiens; identical to SEQ ID NO: 905

SEQ ID NO: 914 - DNA, 54630 bp, Homo sapiens
ggaccgtacaagcagactccagccaccaggtttattttcatgctataaataaatttccctattagttcccattttcttatgttctacatgagatacagagacccagatattggcgtggtgaataatcaactgttttgtatacctaaataccagtgagataataagcgagacttgtaaagcactgaaactaaggctaacagcagcacaatccactatcaaaggatttaaatgccagaactgtgaaacattctctgtaggtgccgggacagtctggtggctgacaattaacgtccactccagcaccgagggctggacacttgtggtttctgttcacctttcctggcttggagcccagatctgtctcatgagcagagtaactactgaggaggcttctcggatggaaagttggttttaagccagaaatctggagagatgtcatgccaggcagcagcccccacgggcccaggcctttgtggggcagtgtcactgtctggtgtgccaccagtacccatgctgcaaggagtgggcttggctgctgtggttggcttgtccttcagtggttttcagattgtgtgcagttatcatgaggagtttgttgctgggagtgtacaggaaaagggaggaaaaggcatcgcagttgtccagtcattggaggatgaagtacgtcactcagggtgaatgatggttgggacgagagttgcctgtcttcagccagtgcctgtctcatatgtgggcgggactctgagcagcctggcagcgagggtatgtataaaatgcttggcctgcaccagggcaagggagaggacgacaccaaggaggtcactgcgtcgtaggagagggccagcgtctgccgttacgaagagttgcaagagctgtgcctacttctgcccagataccaagaccgccagctcctggatggacatatccttgttgacatagcggtcatactgagcaggggtcagcctgccactctgcagggcctcttcgatggagaacttcttgccagacttcctgtcgtgtatcactgaggactccccattgggacccttcactgagatctcctcccagtcgcactcctggcttctgagtttcacgaacatgttccagtcaatgagcccggcacggtgggcttcctccggggacagctcgcggcctgtgtcagggtggatgactacgatggagcgccgcaggtggttctcccgctgctcccgcttgacggccacggagcccaggcgcttctgcagctcgtcgatctcgaggtctttgtccttggagagcctcttgaggtcatccagttccctctccagggaccacagtctggagtcatggttggtcccagagtccgccacggtcatgttccgcaggtctcgtgtttccgtcgctgccatgttgatttccgattggagccttcgggtctccagctgcaggttttgcctctccagctgtaatttgtggttctcttccctcagaaagtctagttccttggatgacttggagttatggaattccagctccgaaagcctggcttccagccggctcacctcgacgtccagctcgcgcttgctgcggctctcctcctccaggctgctcttgagcctctggatctcttgctcggtgtcgcccttctccacctggacactctcggagagcaccaccttctccttgacctccgccttctccagtgcagccagtttcctccggagggtctcgagctccccctccaggagctgccgccggtgctgctcttcttccagctggagtcggagcagggcatgctctcgcgcctgctgcgggtcctgctgcagcaccaccttctgcgtatgggttaccttctcacgggcctcagcttcttcctgctccagcgctgccagccgctgctgcaaccgctgtacctcgcgctcggcctccctgcgggcctgccgctcgcgctctagctcctccagctgccgctcaagctcggtgcgccggcgctgcagccgccgcagctctgcccgcagcttgtcaatctgccgcagctccacatcgatgctctcggcaaaggcgctcgcctcggcccgcaggcctggctcctcctcatacctgaccacctcctgctgcaccaccctttccttcacccgcgagagctcctcctctttccgggcgatctgctcttcctgggaagctctttccctctccagatccacttgtttcttctgctcctctgagagctttgccctcagagacgccacctcctccttggtttgagggtcttcttggaattggaggatctcctggaccacctctttggtctggacctggggtttggtgtctttcagggcctggatttcctttttcagctggtagatctctaaatcacacctttcgatcagtctggtcttgtccacgatctcctccctgagccgctgaagctccttctccatctcagggtcagtcttgtacttaatgacttccttagtcacctctttgacttccacctgggggcctcgcctcctgagggcctccagctcactctggtagctccggagctgctcctcggcaccccggtactttcgctcctgctccacaagctccaggcggaggttcgccacttcactttccgccttggggtctggccgcacgatctcccgcaccttctcctgcaccaccactttggcgttctcctcctccaaggcccatatctttcggagcagctccgtcttctccctctggctagcgcgagccttggcagcctcgtcctcatattggcgggtgagatcgctgacctccctctcggtggccgcgtccttctccaccttgagcacctccttgacggtgatcttgccctcggccatggcccgctccttctctagcctcttgagcttgtcctggaggaagctcagctcctcctcctgcttctccctgagctggtcctggcgctggtggtcctcctgcagctgctggtactctgcctccagctgggggtcattctgcagtttcaccacctctttctctgtgaccttctcctgcgcccggctcttctcttcagccagggcggccacacgctgctgcaggaggagcacctctgcctcccgggcgcccttctgccgcctcagtgcctccagctcctcccgcagctgcaagacctcatccgcctgggccctgtcaggctcgatgcgcaggacctccttgaccacgtactcctgccccccgtctctggtctcctgctccagggcacgcagctgcagctgcagtgcctccagctcctcctgcagcagctggttcttgtgctgctcctctgccagcgtccgctgcagctgctggaagctctcctccagcacgggatccggcaccttcttgagcacctccttcctcaccaccgattcctgaggcccctgattcctcaaggtccagatttcttcctgggtgctcttgacctcgttctccagctgccgcctccgctcagtctcctcatccagttccttcctgatcttccacgcctcctccactccagagtccggcctattcctttgcagggtctcatgggtcacttctacttccggctgctgtgatggagaagacaagacaaggttaaagccaggctctggcagcacatgtagggcctgtccccacctggtcagagtggctgtcctgtggtccccaagggactccctcagtgccagttcatgttagttgtagagttctagggttactttcaaaaaggatcaaacaactagtttggggttttttttaatcaggtaaaacatttttgagctgtggaagagtttaaaatgaaaccacggtctcccacctctggtccccgtcctagggcgtgtctgtcagccttgcagatgctatctgtgctcacacaagaatatctgtctgtagtatgtaccatgtgtttatctctcctgcacaaatggtattcctgctgctcactgcacttacagagctcattccagctcagcacagagagtgctgcttcaggatttaccagcagcattgtttccgctctctggacagaccgcagtttagcccattgctgatgaagagtgaactgcttccagtgtcttgctattaaaaaacaatgctgtcatcaacatcatggacttcagaaaataacattcactttcttttgtttctttctttttttctgagacagagtctcgctctgttgcccaggctggagtgcagtggcacagtctcagctccctgcaacctccacctcctgggttcaagcaattctcctgcctcagtctcctgagtagctgggattacaagcatgcgccacgacgcccagctaatttttgtatttttagtagagacggagttttaccatgttggccaggctggtctcgaactcctgacctcaggtgatccgcctgcctcggcctcccaaagtgctgggattacaagcgtgagccaccatgcccagctgaaaatagcattcactttcagcagatgtttactgagttgaataagttctcatgtcagtagaagcattggctcgggccagtctttgcattggccctgcccagaaacgttagcaaggggacacttccatcaattcacaaaccatttctctaagacagagtctgtatttgtcacctgttagaacagcctgaagtagaatttcttactaagatcagttacctgtctgaggagattcagagcaaactccagattctgcagcctctgtctgttgatggcataaacttcagtgaacttggcggcaagtgctgcttcctgcagagaagaggattaggagagcggtcaacaaacaggtgtcaacagggtaagcaacagagagctagacagcgtggacgtggttcttgagaagtgtggaatttgggggtagaggcatagctcttgcccactcctgcctggagttagactgtagcctcaccggtggagagaaaaatggatctcgaggcagaagatccaggccagggtcttggccacactgactttgagcaagtctttctgcctcttagagcaccagtgttctctcttgtgtgtacaggagactaatatcagccctccactgtacttactgaggtgagcaaaacaggaacttcccagatccatggttctgaccctgacacttctgttcagctgcattttcaaaaatttttatttcttaaagacagaatctctttcactcagactgaagtgccatggtgtgattgtagctcactgcagccttgaactcctgggcccaagtgatcctccctcctcaacctcccaagtagctgggactacaggtttgcaccaccacgcctggctaatatttttgtagatatggggtcctgctttgttgcccaggctggtctccaacccctgggctcaagcagttctcccacctcggcctcccaaagtgctaggattacaggtgtgagccactgcgcccggccttgctgtctttctaggcatattgatgtcactgccctagaacaagttcctcatctcttaccaaacctgtttgcatgcaggagggctctcagtggcttccctgttgtgtgtgcatctctgaggccagcgtgtgacaccatgctccctggggagcagggcagcttggcctccacctcagtcccgaggccgcctggcccatggaactcacctcttccttcactttggtggcaggagattggagcctggctctcttgctcacgtggcttctccttccattctccaagtcgagaagagaccttagtttttctgcttctaactcatagtcctgcatgagggagagacatggcagaggggagattaaaacagctgagaagagacagacatgttcctgtaccccttcaggctgacccagacctgccctgtgccatgtgctggttttataatctgcgtgggtcttcctcacagctgcaccctgcagtgatttccaggaggttttgagaattactgatatctcagcagtacatagctccatcactcagtaacatatgagacaagaagtgccccctgaattcccctcccagcctttctacatgcctagagattttcacattctgctgctgcttttaacatcgtaccataaccctgtctcaccttgccaccacctcttctcatgtttaccagcttgctgactttataatccatcaggtggatgtgtgctgattcacgcagctttccccttccactggacaccagtcctttccagcgtactagttttgctattgtaaatagtgctgttgcaacaatgttgtttatcctgcatttttttttttgtactttttccttaaggataaattcccccaaagtgtttactgcttcagagtataaaacccttttacagcattccatgtctagtaccatgctgttttcccaaaagcctgtgccagtttgcacagcagccggcagtgcctcggatggccagctccacccccatgtgccagggccggtgcttgctgcttctctgaccagggcacggtggaataagacccctgctgtttgtgctttgggcggaagtttcccggctcacctttacagcttgctggtactgctgggaattggcacagatcttctgtacttcctgctccctacttgctatctcatctagcaggttctgtaagacagagtttaaaaatcaaaactaaccagaaaaaaaatttaaaaaagcaaccatggatgcagtagctggaaatctcagaatctgaatttattcttctctagcacaaagtatgatgaatggctcccttgtatacatttttattcattgcaaaaggcagtttttttgttgttgttgtttttttttttttttttttttttttttttttttgagacagtctcactgcatcgcccaggctggagtacagtggcgcgatctcagctcactgcagccttagcctcctgggttcaagcaattctcctgcctcagcctcccaagtagctgggactacaggctcctgccaccatacccagctaatttttttttgtatttttagtagagatttggtttcattatgttggccaggctggtcttgaactcctgaacttgtgatcctcctgcctcagcctcccaaaatgccgggattacaggtgtgagccaccgcgcccagccacaaaaggcagttctaaggctctgtgaagaagggccaagatcattatctctgctaggaaacaaatgtttactgatgatttggaccaccagacactgttctgctgtctgacttagattatctcatttaatcttcaaacgatgccaggaggtaagcatcgtgacctccagcttatgagtgaggaaagcttctgaggtggggatgtggctgatggggtggacccgggatttgcatctcagccattggcttcccgtgttcctccctcaccccaaggcactgcgttgggcatgggggaggcaggagtcccaactttgaaaatgggatttcccccacaaaggcggctcctcattctgtagctgttcactcacatagccaacccacgccaagtgtccattctgcaccaggccctgtgcggggcactgagctgggagaggtgagcgacacactcggttcttgttctcagagggttgggtgttgggagcttgagctgaggcccagggaggacacagctgtggcaggcctctgccctgctccacctcccaaaggcttggctccccagaaaggggcttgttgacctctgaccctcccttgccagtgtgtgcctggggctgcggaaacggccatctcaccttctggttcttcagcttggtctccatctggctgaggctgtctgtctcctggggctcgtaactggggatgctgactaggaactgcagcacgtggtcatggccgcggtggaagtgctcgtaggctgccttggcgctctgtaggctctgcgccctgtcaaggcaaagcgttcaggcctcagccacagcaaacagatgcctcaccgagccctcatttttttttttaaagtgggaaacaaccaaatgtaacaaccagaaataccccaagtatctcccacacagggtgggtggtcattagggaacgtcaggttggactgtggagaaccaggtgggtccatatacattgacttgcagagatgcccattgtggattacaggacccaggtaagcatgactcaaaagagagaccacagggccgtcagagaatctgacgaactcaccaaaaagaaaaacagcaaaatctgtgggacacggctaaagcattgcttagagggaattagatcgcattctcagaaaacaaaaatggccaccacccaccgcaccctcacctgcgttccacctgctggcgcaggttgttgaaacgctggcccagcttgtgcacctcggcctcctggcgctccaggtccggacagtgctcctggaagcggctggccagtgtgctcgagcactgcttggccgcctgcaagttctgctccacctcacccaggagggacttctgggcctgtaactcacaggccatggcctggcggggcagaggaggagacggcggtgctacggccagagctcccagagccaggcgatgacacccactgaagcccctgggccactgactgtaggagggtgggcaaggccacaggtaggaaggaccggagccttgctctgtacatcccaaacctgggtcacttctgccatcttctgttttttaacaatgaacaaagccctgaaaagctaacttctaaaaaccctgcagcaggcagctcgtgccctgcgcgagaacagcctgccactgtctggtcatgaggctgtggcaaaagcaagtcgtgagatgggagtgtgaataaggggcctcaggtcacagacttgaatgtttcctgtgctcaggcagtgtgggaagggggcccgtggcaactgcgaggtaagcaggccgagaaggcagctgctcctctgcccactgacttgccctctgagctgcagcccaggatgccagctctgctcagcaagagatactgggaacatggattgttatgtgctttatgcttttttttttttttttttttttttaagagatagggtcttgcaacgttgtccaggcggctggacttaaactccaaggctcaagcaatcctgccccagcctcctgaatggctggtgttacaggcatgtgccactacactggctattgcagatatttgatcttaaaatgctggcacccgaaatcccgtaagtcacacagatcccgtgaatagcttggatttgtgctgtgggcctccatttgcagttcccaatttgggcattccaaacctggggagactggatgctggtgtcctcatctatccagacgggcgggtggatgtgccagatgctctcacctgctcagagaaggactcccaggacttgggccctagactcaccgccagctcctgccccttgctgtccaggacacggctgctctcaggcactgtgtcatcctgattcagatggttctcgtgtgtggccagcaactcccagctctgctgcaggctcttctccaggcggttggccacatcaaccctgagagcaccaatcaggcgtcgggggatgcccacctggccccctgaccccaccccaacctccatgctgcctgtctgccacccacttctcctgggccaagtccagcagctgcaggaggtgctcgtatttccggttggtgtcctccacccgggtcctcagcaggggtgtggtgccactgcctgggagggcctggatgaaggcttcgccctcagccgtgctccgcgtcttctcaggttcaatccgcagtagctcgttggtgatgttctgtgggaaccagggcccctcagttttggacacagccaggcagccccttcccctgaggatgtgcccagggtgagcacagattcccacatcaggcacagtggaagcagctggagaggcctggcacattctggggctctgacccggcatctggaccccagcctgagggctgtatttttcacgagcatcccagggaaccgctgaggtggaatggactagtgacaccagaagcacccaggcagctgccgggcctgtgctgtcctcagcactgcacgcggacgcttctgtttaatctttgcggcaaccccgggaggtgagtactacgactccacccagtcacgggtgggggtgtgacgactcccagcagcttaggaagggacttgtggggtcaggctacacccgagaccggcatcctctcgccctgacttggctctcactctgaggccccatcaggggctatggcacttctccaatcccagatcctcttctgtaaaattggagtgctactcactgcctcagagggctgccttgaggatgtgggagactttgtataggaaaggaggtggggggaggtggcccctccacgtcccccctggcatcagctcaccctgtcctcgccactgccctgtgagcagggccaacccatcctactgaagacactgaggcctggagtttataaatacaaacgctaacgtgtttgcagtcaagccagccggtgacccagtcctgcggaattccacagcccatgtgccatgccaggcgtcagatcgacaagccgtgcaggaacaatgcaagtcctgccagctctttctcctggggaggtaatgacagcagccctgccacctccatgacttgggacccttttacatgcagcaggctgtccctgacagacagctgcagtgaatatcccaagactccatggggaaaagacctcaaataggggccccagggggccagtgcagggctcccccggccccacctgtgctcctgacccgcaggtaccttgaggtccttggcccgctcggcactgtcctgcacagcccggccttgctccagtggtggccgcaggatccctgtgatggccttctcctgccggtccaggtcgctggccaccttgtccaagccagccagcagctgccgcccctgtaggtcagaggcatctgtggagggagggaggacacaggcaggtgtgacaacgggccaggggtgtgaggcccagggatggacctaggcagccagccccccgccgtctcatccacagcacagaccctggtccagcccctcctccccggtacccccagagcctcaggcgagtggccctggcacccacctccgggattctcggtcttcagcacctcataccgctgctgcagcgtgcgtttgctcccagctgccttctgccgcacgctccggtactggctgcccaggctgtgaggacagaaatgagctgggaacctgggcagcccaccaccccctgcacccacagaggcgggactgcggactctggctgggcagacaccccagaggagcctgacagctccttagatgcggacagcaagtgctcactgtggcactggcctttctgtgctcctgggctcagagctcttctccctccttccctcctctttcgtaggaagtctcactacctaaaattgtctgtccaataatcaccaccaagatgttacttctgagggagcatacacagtaggtgctcaataaatacttaataaatgaaggcattccttgaatgatccactcattcagcaaggagttcctgggcacctactttgtaccaggtacttaactaggccctggagagaggaaattcaaggagcccaggcccaatgagactgacgcatacgctagtcacttaataaaaagcggtgcgtgcagtggaagaaggtgcctgggagcaaagaggaggcagcccttatcccagctgagtcctccagccaaggggctggggtctgcaagtacagggagcagtgcgtgcgggagtcaggggcccttagaaactgcttagaaactcgtgagggggccaggacgaagcccagagctagacattcatgtttagcaagtcagctggcccacaatctgcccctctcctgcatgaacttccaagggggtgcagatggagagtgtcagcgaccccgcgctccccacaggctgagtccaaatccccggggctatgaatggggcctgagaagccctgggggtgggactggtccatgcagactcccgcctttgcccttgtacctgtcagccagagccagggcctcagggtctgtgggggggatcacaaaacacacggccggagcaatcagcttgttcccagcgctgtccatgagctcccagctctccccgttgttcttctgcagggtgtagctgtagccccgcgagatcaggccctggcgggggcaggctggacagtcaggatcccggcagggcctgagggcctgggagcccggttgccatctcagcccccgactcttggacctggggagccccggctcatcacttggaccctccccgtagagtggggaggggcatgcaggagaagcacatgtgttgaggctgccggcccagcaacccacctccatttccctttggggaaccttccctcccaattcccagtccctgtggtctctccttctccattcccaagctccagatggacatgtgacttggacctggccaatgactggcattcgccagccacagtcattggtatagggtggaccctggcattccctggccacagtgattggtgtaggatggacacgtgactcacagtgagccaatgagaacctggcctgggacttctgaggagggactggggttgctaagctggtggaacacaaggccagggcagccgaggtgggggcggcataggggtgccagttggcctgcaccaggggaagggttggcagagtgacaccaaccacggagacaggcacaggctcctgagaacggcgcctgaggcccgggatccaaccatgttaccccaaaaactttgtagtgatgtgaacagaggagctggccccacgcacctgctccccctcaaagtcacagagtgcctccacggggatgggcttgagcggagtctcccggcggtacttgaggggcaccacctgctggcctcgcttctgcagcccctgcaccacgtcctcatacttgtccagcaccttctcctggtcctggagagaacggggtcaggggcccaggtgagaccaacagccttccccctggtgggaggacgcagagcaggggctggattcagcaggtggggtgctgtggaggggcctgtacagggctgagggcaggcatggtgtagaggggtcccccgccccccgggccagcaggggtcctgggccatcgctcacatccagctcccgcagcagcagctcaatctggtaccggtccttgaagtcagggccatacttctggttcaggtccgagtccaccttgcgcagcagctcctgagcgtccttcacgtcttcgtgaaactaggggagaaggtggctctgttacagccaggaaaccactagaagcacctgggcttctgtcggaggcttcaagctcatccctcaggcggggctgggcctccggttcacctggagtccagcatgggaccctgtgctgagcctgaggctcctctgcgtggagacagccccaccctccctgagctggctccttaggggcctcactgggaaaagccaggtcccttcccacccatccatgagatgccacctctgtgacatgttttcttggatgtatcagtaagtcttgaggtgtctttgattcagttcctctctctgtactaggaacatccagacttaatactatagcttctttctaggttttgataatagcctcccctttttgttctcgaaaattctcttgcccattcttcagtctatcaactcttggttcactgtcagctatcccctgggctgagcacctgggctgcagccataaacaggacctgaagcccccactgtgcggctcagacagggaatgaggagtgacacggcgtcgcccacatccagctttccccagacacctcaatcctaagaattacccgcagcttcttaagaactctcattcctctggaaacagacaagtgtccagccacagatgagtggataaacacagtggtctagccatacaataggatatgattcagccataaaaaggggtgaagcactgaaaatgctacaacacggatgaacccggaaaacatgatgctcagtgagagaagccagacacaaaagggcagagattgcatgatcccactgattcttcatattcgttctaggtgtgacacttctggaacaggcaagtccatagagacagcaagaagaccaaaggtgacctggggctgggggagtgggaatggaaaacttactgcctaatgagtacggggttgttttttttttttttttttgaggcggagactcactctgtcgcccaggctggagtgcaatggcgcgatctcagctcactgcaacctctgcctcctgggttcaagcagttctcctgcctcagcctcccatctgggactacagatatgggccaccacacctggctaacttttgtattttagtagagatggggtttcatcatgttggccaggctggtcttgaactcctgacctcaggtgatccagtcgcctcggcttcccagagtgctggaattacagacatgagctaccgtgcccagccagggtatagggtttctgtttggggtgatggaaagttttgcaagtagatggtggtgatggttgcataacattgcgaatgcaatgaatgccactgaattgtacacttaaaaatgcaaactggccgggtgtggtggctcacacctgtaatcccaacactttaggaggccgaggcgggaggatcacctgaggtcaggagttcgagaccagcctgaccaacatggcgaaaccccatctttactgaaaatacaaaaattagctgggtgtggtggtgggcacttgtaatcccagctgttcaggaggctgaggcaggagaatcacttgaacccaggaggtggaggttgtagtgagccgagatggcacgactgcactccagcctgggtgacagggcaagactctctcaaaaaaaaaaaaaaaaaaaaaaaaggcaaattttgttttatgtatctgcatgtatattatagattttaccaaaattaaaaccctacacactcaccctgggccccatgtgacctggggaatcagactctggccctggtccccagggaagttggacaggggccggcaagcttgggacatgtctgcacacgccatcagaagcatgggtgctgggggcctgggatggctgccccgcaaggctcctggaccaaggagcacgaggccacacatgagccaggtaggcactgagcgctctcagagagtagcacccccggtgctggggggactcccaggaaaggtaagtacctggtggtagtcctccatgtacttgaggtggctctcctcgcagatgagcaggttcaggtactccttccagtctgcgtgcacagcctccatgtgcgcctgccaggaagagaaggggccggtcaccactgggcaggtactgcagacaccaagggagggactgctgggatattgggctggggcatggcgggggagggaggcatctggcatctgtctgggtgtggctaccacaggggtagccagcttctgctcaggagtgggaggaggagagaggggtcacgtcaaggagccaaacagggatgccacatacggatgcccaggctgtgcagtgcacaaagggcaagtgggggctgtggtgccttcggcaaatctgtacaaaggcactgtcatggaccgaacagtgtcccaccaaatccatgaccctggccaggcatggtggctcacacctgtaatcgcagcactttgggaggccgaggcgggtggatcacctgaggtcaggagtttgagactagcctggcccacatgatgagaccctgtctctactaaaaatacaaaaattagctgggcatgatggtgtgcgcctgtagtcccagctacttgggaggctgaggcaggagaattgcttgaacccgggaggtggaggttgcagtgagccaagattacaccatcgcactccagcctgggcaacaacagcgaaactccatctcaggcggggttggtggcattgtgggggttgggaagaatgcgaccttatttgggaataagatctttgcagatgtcattagttaaggatcctgaaattagggtgagccctaaatccactgactgatatccttataagaagagaggatacagagagacatggggagagaaggccatgtgaagacggaggaagggactggaatgatgcagccacaagccaagggctgttggcaacccccagaagccggaagagcaaggaaggcacatgtcctggagcttccagagggaatgaggccctaagacaccttgatttcagacttacagcccacagacctctgagagaatgaatttctgttgtttaaagccactaagtttgttttaacttgttgcagcaactctaggaaactaatacagaccccacaggggcttcagaagtccaggggctgagggcagaagtgtcaacggatcaggataaatggaggaggcagagtcagacacagcaagaaagagacagacagacacaagatgcagcttgcaggacccccagctccggggtctgcccgagctccaggcggcccacaggcagcggccaaccagaagccaccctgggggaggtgtctggtctcggggtgcatgaacctcaatggagttcctcccggggtgctcggccgccagcagctggtcgccctcgctgtgcagtttgttgattctctcctctttggcctccaggttccggttgatgaaattctgcagtggggggcagtggaggggcctcagtgcccagcctggcggtcccgtgctccttccagggctgcctcctccctgatgccccaggcccccagaacccacctcatactggcgccggcggctggggtagtcgaggttgcggtcactccagtcgtactgcatgcggcccttggcctgctggtccagccagtacagctcattggtgcagcgctgcatgtagtcctgcagcgaactcaggtgctgctgccgggcctgtgatgctgcctgaaggggccggggcaaggaaagggctgcgtcctcagcccgctgccactgctcgcttccttccctacctcctgcagggcccagctatggctggcctgaggacaagcccagctatgggtggcctgaggacaagcccagcttagccacgtccaggccagtcccccttagacaagtcacctgaacccctgaaactcattcattcattcattcattcattcagtaaatgtttactgagcatctactacatgctggacatggctccagacactggggatacagcaaacgaaacacacaaaacccttacggaactgacatttttgtgaaggcttagttcgcccatctgtaaatggggaagatgacagtcctgacctcacagcgtacagagactggcatatagttggtgctcaacaaatatcagtaactatagcttctacttttatctgtatcatgatcgtcttatagagggctggaaggaaagcaccactgtacgtctgagaagcgggtgtgcaagggaaaggagggatgtttgcattttggtacgtggggccctccacgcctgatgaacttctgcaacattgactcatttcatcctcaaagcgaccctatgagacaggaacatgtaggagctccatttctcagatgaggaaactgaggctcccggaggctaagtaactcgctcaaggtgtcaccactaacactaaggagcagaggaagcatggctccttatagcgacacaatgctgcctctgtattctctgtctgaaacattggcaacaaggaagcgtttgcataacacttatgcaatttttaaaagaatgcattctttaaaggtttgggaaggaaaatggaaagcttttgtatagaaagcaagtggcatcatacttggcacacagcagataataaagaaatgagcaggacaggctgtacccctggggcctgttagggttttccctgaacaaccagggcagaccttgcagccgctcaggaaaaggctggggcacctctcttcccgcctcaacccctctcctgattgaaacgtttactgcacgccttttttttttttttttttttttaaaggcagggttttgctctgtttcccaggctggagtggagtggcacgatcacagctcattgcagcctccacctcctgggctcaagcgatcctcccacttcagcctcccaagtagctgggaccacaggcatgccaccaagcccagctaatttttaaatgttttgtagagctggagtctcactatgttgcccaggttggtctcaaactcgtgggctcaagtgatcctcctgcctctgcctcccaaagtgctaggcgtgagccaccatgcccagctgcctatgtcatttttaaaacaatacatccttgtccccccgactccaagcttcccatcctctcctctccccatgaggcctttcccccagggagctcctcaccagcagtttctggtacttggcccggagttcgctgttctgctcctgaggacagagccgagggcatgggtcagggccaggaagcaggcgcggccccctccatccctgggtccccaccacaccagcacacgccccaccttgtccccgtccttggccaggtggggcccgatggccttgacctcattgtggaagatgttatgctcctccacttggtggtccaccagcggcaggtcagtcccaaagctctggttgttcagcttgtcctggccaggagggcagagaagcaataaggagagggtgggctgagggctggggacgtgtggccaccccaggagcctcgggggtgggcatgatggtgctctctttttcacggggccctgcagagccacaaggagatgctggccacaccttcaaccctgaggttctgtttgctgagcactgacctatatcatctttcatctcacagagcctcaggggtccacatggttactgtcccatctctcagatgaggacacagaggctgaggctgaatgagggccagtcacctgcccagggtcacgccagtaacattgggaaagctggccaggcatggtgactgatgcctgtcatccaggcactttgggaggccaatggggtcggatcgcttgagcccaggagtttgagaccagcctggccaatgtagcaaagccccatctctacaaaaatacaaaaaattagccaggtgtggtggcatgcacctgtaatcccagctacttgagaggctgaggtgggaggatcacctaagcctgggaagttgaggctgcagtgagccgtgatcatgccactgcattccagcctgggagacagagtgagaccttgtgtcaaaaataaataaataaataaataataaaactggggaagctcaggagtttgagaccagcctggccaatgtggcaaagccccgtctctataaaaatacaaaatattagccaggtatgatggcgtgcacctgtaattccagctacttgggaggctgaggtgggaggatcacctaagcctgggaagttgacgctgcagtgagccatgatcatgccactgcactctagtctgcgcgacagagtgagaccttgtctcaaaaataaataaataaataaataaataaataaataaataaaactggggaagctaaggcttgaacccgggacacctagctgcagtggctgtgtgcttctctgtggtgagcacccaggaaagggagcgacaggccagaagcctggccgcttccgccccagcctgcccacaaaatgtcaccaagaccccaacatgccagggttggaaagtgggacccaggagcagcagcgaggtgtggctgacaggggacagagtccgaatctccaccgcttgagctgtgtgaccctgacttcgtgctgcacttctctgagcctcactcttctcatgggcacactggaaaaccatcaggaccacgactgtctccctggtaagacccgggatgcccattacatgggtaggctctccctgcacacgcacagccccctccccagctgaaaccctggagccagcggccccgtccaggccataccagcttctcctccaccagtgccgcccagttgacctgtggatccacttccttcaccgccagcctgtagatctgcttgtgtttcccgcgcaggttggtcacacgctccttcagctggcggatactgatgggagagaggctcccacttagtggggctggttggcactgcctgcaccccaggaggggccccccacccagaccccggcctcagtgtcctggaaggacacagtgaccatatggccttgggttccagacaatcacagcatcctctcacccctcctcccatgcactttttttttttttttgagacagagtcttgctctgtcacccaggctggagtacagtgacgtcatctcagctcatggcagcctccgcctcccaggttcaagcaattctcctgcctcaacctcccgagtagctgggattacaggcatgtgccacctcgcctgggtaattttgtattttcagtagagacggggtttcaccatgttggtcaggctggtctcgaactcctgacctcaggtgatccgtccgcttcggcctcccgaagtgctgggatcacaggcgtgagccaccgtgcctggccccacccactttccctcaaccttccttcccccatcagtttcctgagggcctactatgtgccagaatgatagaaagttctggaataagcaggaaagatcttgttttctggagtctgccatccagcagggcccacagtgtggtgcatgccatgccaaggacaagtgccaagggtcgtggggcaccgagagagccctgcccttgccggggtggagatagggcatgggacaaggcaggagtcaggggggctgattcatccacgataaaatgaactgggagtcgtgagccaaggaagccagggacagggcaccaggcagcggaagagctcgctcaaaagctcacaggtcaggctggtggctccagaacaagggatatcaactccctaagcctccatttccccaactgcaaaatagggtcatcaagaggatcatgtgaggctgggcgcggtggctcacatgtgtaatcccagcactttgtgtaatcccagcactttgggaggtcgaggcaggcggatcacctaaggtctggagtttgagaccagcctggccaacatggagaaaccctgtctctactaaaaatacaaaaattagccgggcatggtggtgcatgcctgtaattccagctacttgggaggctgaggcatgagaatagcttgaactggggaggcagagattgcgctgagccaagatcatgccattgcactccagcctgggcaacaagagcaaaactacgtctcaaaaaaaaaaaaaagaaaggatcatgtgaagcctttggcacgtgcctggcacctaattagcccttgataacccctgactcgggctcccaaatgctgaacaggaccccccgccctggcccatagcccccaatggctcccctggggtaagaagcagaagggacctactcctcggcgatcatgtccccctgtgggtgcttcatgtgcttggcaatggccgcatccgcctctagcacatagagcagcttctcagagtccaacaccttctgcagggtcacgtcccggtgctcaggctgccgaccctcctgcagccgagccaggtcctgtgagggtcacaagagaggggacaatgaacaggagccgagagcgggcacggtggcaatgggaggggtgggaggaaaggggtcagcagggtgctccccttctttccctttgaataacgtcttccaggcttgtccatatggagcgcagtcggtagttccatctctttgctgctacgtggtatttctcaagttcactttgcaaagcaggtatttctcttatgccccctccagcctgtcctccagccactcagcaaacagagctcaagtacctactgtatgcaaggagttgggacacagctgtgaacagaagagacatggcctccctgcctggcactcacaacccagtctgcaaggccaccaggaaggccagtcaaaggatgagcctcatggaggtgactgcaagtccctccaagtcagtgtttatgaaagaaatgctccagaggtggaacgaggggacctacttcagctctggtggtcagggaagcctcttcgtggtggagacacaagctaagaacaaaggatgaaagggacagtgttccagccacaggaacagcctgtgcaaaggtcctgaggcaggagagagcgagctacgactgggccatagtgaaaaggtctctgtggatagggaggaaacagggcaggcggggggcggggagggtgagcagctagaacacacaatggctgcaaggagggatcctgcacagctccatttgtgcttaaaggcgatgcctccaggggctctgcagagaggacagcaagggtgtgggctgggagggcaggcagtggtctgtggcagcagccaggtgacagcgaggtggcaccagcaagaaggaacagagccggggggatatctggaaggggccgtcgatggttgctgatgagtacagggcttctgttcgtttagggaagagcaatgaatggcagccgggacagtaggtttctaatcacagcgggttaattcactgtgtcaatattcaagaagtctggctgtgagtctacaccatgctaggtcctggggatgaatccctgagggatccccagtcccgcaggggaggcagtgacatgtcactgaggggaatgagtgcaggttggctgacgctggggcactcagagccggccgccggtcccttcccctagctgggtctcagcattcccatctctataatgggcataaggaaaatacccgcttatgaagtgaactgagaaataccacttagcaacaaagagcaggaactacggaccgtgctccatctgaacaagcctggaagacgttattcaaaggcaaagaagccagacagagcccacatggtgtgggatccattgatgtgaagtgtcccgaacaggcaagtccagagagatggaaagtcactgtctcttaagtggttgcctggggcagggctgggaagaggcattaacagtaaataggcacaagagatcttgcacgggatgaaaatattctgaaactgattcatgggcgtggttctgccccttgctaaagttactcaaaatcattgacttgtacacttgcagtgggagccttttttaagtgaaatatgtctccatacagttgttttttaaaaagaaaaagcaaaaggaagaaaaacgagaaatacacaggggtgacgtggtgcctggtacgaagtaaagacttggcttcttcttggaggaagaaaatgtgtcaagagtgcctttgcctggctaagtctggaagggctgaagggtgaacaggcctgactccccagggggttggagatgaggctgatgtcccgaaaagccgctggaggccaggcacagtggctcatatctgtaatcttaacactttggggggctgtggcaggaggatggcttgagcccaggagtgcaagaccagcctgggcaatatagtgagaccccatttattaaaaaatatttttaaaaggtagctgggtgtgatggcatgcacctatagtcctagctactcaggacgctggggcaggagaatcatttgagtccaggagttcaaggctgcaatgagctaagattgcaccactgcactccagccttggcgacagagcgagaccctacctcaaaccaaccaatccaaaaagccaatggaaccaggcatcccccaaccctggggtaggctggcccgttaattacaacaaaacatcagcttcttgacttggagtggaatttttaaattttttttgtttttttatttttgagatggagtctcactctgttgcccaggctggagtgcagtggcacgatctcggctcactgcaagctctgcctcccggattcacaccattatcctgcctcagcctcccaagtaactgggactgcaggcgcccaccaccatgcctggataatttttttgtatttttagtagagacggggtttcaccgtgttagccaggatggtctcgatctcctgacctcgtgatccacccgcctcggcctcccaaagttctgggattacaggcgtgagccaccgcgcccggcctgcttggagtagaattttattcactccattatcaccagcttccctgagctgcagatcaaagattaattttgcaaaaggaggaagtccattaatcattgcctaattcgtgaaggtgcccggtgggaatgcaagttctctcaaaacactggctgagagagaaagagaacatctagctgagggaggctagtgttcgaaagttcaaagtcgggcagaactgatcgatggtgagagagatcagcatagggttgacccctgagggatatcaactagggagatggcccgggagctttctagacagttacccatcttgccacagacagtggttatctgggtacctattgatgcaaaaattcacccaggtgaagtctgcgaatgtagacacttctctagagtttatataagttataccttgataaaaaagttttttaaagtcacaggggccaggtgcagtggctcacgcctataatcccagcactctgcgaggcccaggcgggaggattgcttgagctcaggagttggagaccagcccgggcaatatagtgagaccctatctctaaaaaaaaaaaaaaaaaaaaaaaaatacaaaaatgagccaggcatagtagcatgcgcctgtagtcccagctacttgggaggttgaggtgggaggattgcttgagcccaggaggttgaggcttcagtgagtcgtgattgcgccactgcactccagcctgggtgacagagcaagaccctgtctcaataaaaaataaaaataaaaaattatagggactgatatatctaatctcacacacacacacacacacacacacacacacacacacacacacacacggacagatacatgataaagccaattcagcagacgttccttgtaggatcaggtggtgggatatgggtgttcgctgtacggttttctgcatgtttagcatttgaataaatgtgtgatgcagtgtatgattctgtttatgtgaaatatccagaataaataaatccacagagagaaagcagattagttgctgccagggggaaaggggaggtggggagtaactgttaagggtgtggggtttggctctggggtaagggaaatgtttgggaactagatcgaggagatggttgtgtaacattgtgaatgtatgaaatgccactgacttgtacacattacatggttaattttatgttatgtgaatctcccctcaattaaaaaaaatggaaaattcaacagaactgggaaatgaaataaatagtagtatctttagcaaaaagaacataagaaaaagattgtgtgatccatgtagtcttcaaagcctagcttcttttttcaagtgggttcagttgaagttaaaaaaataggccgggtgcagtggctcacacctgtaatcccagcactttgggaggccgaggtgggcagatcacaaggtcaggagtttgagaccagcctggccaatgtgatgaaaccccatctctactgaaaataaataaataaataaattagctgggcgtggtggtgcctgcctgtggtcccagctacttgggaggctgaggcagaagaatcacttgaacccgggaggtggaggttgcagtgagccgagatagcaccactgcactccagcctggacaacagagtgagagactgtctccaaaaaaaaaaaaaaaaaaagaaagaaagaaagaaaaaattgttcaggccaagcacacagtggctcatgcctgtaaatcccagcactttgggaagctgaggcaggaggatggcttgaggccaggagttcaagaccagcctggacaacatagcaaggacctctgtctctgcaaaaaaataaaataaaaatggttcaaaattacctattttgagtcaatacttcagggaaataaaatgagaaggttaaaccctcttccttctttctctctctctctctctctctctcacacacatacacaaaggtcaaacagatatacaccaatatgttaatagtcagtagatacctctggtggtggaattctacatgactgactttattgattgattgattgattgaggcagggtgtccctctgctgcccaggctggagtgcagtggtgtcatctctgctcactgcagcctcaaccttccgggcttaagcgagcctcccacctcagcctcccaaggagctgggattacaggcacacacaccaccacacctggcaaatttttcatattttttgtagagacgaggtttcaccatgttgctcaggcttgtctgaaactcctgggctcaggtgatctgcctgcctaggcctcccaaagtgctgagattacaggcgcgagccaccgcacccggctcatgattttaattcactttgttatgcttgtttatccatcgtgaaatgtgtgtgatgaacacatattatttttgttatgaggaaaaaagagacacacccccaaaagatgttttccatttaagaaggaaagaaatccaccaccacagggggcctcagatggcagaggatgtaactgcaaatgacaaggggagctgatgggagggaacaggtgtggggtggccaggcagaggccagggaggcaggaggtggaggcccaggggggcatggaggcgggggccccaggcaggaggccagggcaaggcccactcctggggcccctgcaggggatagctggtggcagagaacagagtctccacttatctgccccctacacccccgtggactgtgcccaccccagcccacctacccgcttgggtctcttggctgctgtggacaggccttcagagggtgggcaactgggccatcaggagcagccaagggggttggatacctatggctgggcctggggacagcagcttggccgggtagaccttgacctccctcctgacctccccaccctcagcctcccactcctctggtcccaccttttttttttttttttttttttgagacagtcttactctgttgcccaggctggagcgcagtggcacgatcttggctcactgcaacctccgcctcccgggttcaagcgattctcctgcctcagcctcctgagtagctgggattataggtgtgcaccaccacgcccagctaattgttgtatttttagtagagatgaggtttcaccacattggccagtctggtctcaaactcccgacctcaagtgatctacccacctcggcctcccaaagtactgggattacggccgtgtgagccattacgcacctggcctggtcccacttcttagtcgcccctgcatagggatgccagatgaaatacagatcaccacttacacttgattttcagataaacaataaataatgttttagcataagcctttccctaataacacatgggctttcctgctactaaaacatgatttgtgttctgaaattcaaatgtaactgggcatctcatattttatttgctaaatctggtaactccacctgcaggccgatgctggcaccatctctgtcactgactcatcatcccagccccttctaaacctcagttgctccagggtacaaaacaggcatcaacccaatcgcaccgggctggcgctggtggaaggtttaaagagaaggtgaccattccagcggctcgtgagtccctcagggtacagaggcttcatgccgttgagtccactgggcagttgttatccccatgttacagaaagggaaactgaggcacagataggggaaagtgatttgcccagctattttatctctcttctccaaaaaaggtggagaaagacctgcaccctgagtgctggcagcagtaggatgagcagtgagaatgatattgacgataatagccctgtcctatacctgcataatctcatttaatctttacaaccaccccgccaaatgggaaccatcactcctgcctgcttagagagaatctcgttcatggggaggtgggatggctcacttgtccaaggtcacccagcaaggacaaggctgggctgtttccatagagcctgaccccatggcactcctccaggcaggagacgctttccacagggcccaggaagagggaggaacttagtatccgggaggtactagtattaacgacaatggccaggttcctctcacagagcagggcttcctgaccttggcacccctgccctacagtgcacggtagggtgttcagcagcatccctgtctcccctccccaactggacgccaggaggaccttccttccaagcagtgacaaccaaaatgtctctgcatgttccctcggggccacaatcacccctgggtgagaatcaccgattccaaacagatcctggtcctgaacagggctggcagcacggggcacccaggtgggagtgggagtgggggcactcacactctgcatcttggcctctgtgtccacgatgttcttctccacctggtcggcattcttctgcagctgctcgatcagctccgagagctccttgttagagatgctgcgggcagaagccgaggggagatgggcggggtgcctggtgggtgggggctatgtccccaccagcaccccatcctctggctggccccggccccacgctctgagcaggagctgcccacagagcctttgaggtagttgggctgttcccatagggcaacatcactaaagccacagagacaaggcagcgcctggcaggcggtcagcctcctttttttttttttttttttttttgagatggagtcttgctctgtcacccaggctaaagtgcagtggcgtgatctcagcttactgcaacctccacttcctgggttcaaatgattctcatgcctcagcctccccagtagctgagattacaagcatgcaccaccaagcctggctaatttttgtatttttagtggagatggggttccaccatgttggccaggctggtcttgaactcctgacctcaagtgatccacctatcttggcctcccaaagtgctgggattacaggcgtgagccaccgcgcccgcccagcctccactttgatcattctctctaatgcttctattttttatttttattcattcattcgttcattcattcattcattcattcattttattgagacggagtctcacactcttgcccaggctggggtgtagcggcacagtcatggctcactgcagcctctatctcccaggctcaagcaatcctcctagcccagcctcccaagtagctgggactacaggcacatgccaccactcctgcataacttttacatttcttttggtagagaaggggtttcaccatgtcacccaggctggtctcgaactcctgagctcaagcaattcgtccaccttggactcccaaagtgctgggattacagatgtcagccaccaggccccgactacatatttttttgtgagagatagggtctcactctgtcacccagactggagtgcagtggcgtgatcatagttcactatagcctcgaactcctgagctcaagcaatcctcctacctccacctcctgagtagctgggaccactggcaccaccagcacacccagcttctaatgcttctattttgccatgttggcaaaacgcaccatatttgaaaaattgggagataactcacataccgtaaaattcacctgtttaaaatacacagtcactggcttttagtactacacattcagaatcgtgcaaccatcaccactatctcattccagacatttttatcaccccaaagctccacacccacaagctgtcactccctattccccacccgctccagcccctggcaaccaggaatttactttttctctctatggatttgcctattctggacatttcatataaatagaatcacacaacacgtggccttttgcgtctgccttctctcagcataatgttttcaagctttgtgcatattgcagcatctattagaacttcattctttttatggctgaataatattccatcacgtggctacttcacattttgcttattcattcaacagctgacaaccatctgggccgtttccacctttgggccatcgtgagaatcacgctgctatgaacgttcgggaacaagcttttgtgtgagcagtcttatttttaattacctgatatttttctttcaacctactcgttttattttagagttaaatgtgtttacaaaggtaacttctctccccattttaatcagaaatcagaagccctcaccatgagtgaattagctgccaaaataaatttcatgggaacgcagtggcactgggttccgtggtgacactgggctgcccgctgttacaagtcaggaggtgtgacagccgtggtggcgtcaggcccagcctttctcctgatcttctcagagcgcctgaaagagacttgaggcccggtgtggtggctcatacctgtaatcccagcactttgggaggccaaggcgggcgaatcacctgagatcaggagtttgagaccagcctggccaacatggtgaaaccccatctctactaaaaatacaaaaattagctaggtgtggtggcatgcgcctgtagtcccagctactcgggaggctgaggcaggagaactgcttgaacctgggaggtggaggtggcagtgagctgagattgcaccactgcactccagcctgggtaacagagcgagactccatctcgaaaaaaaaaaacaagaaaagaaaaaaaagtcttgaaagcagactggccctctccctcactgtctctgtgtcccctcctgtcacatttgtctactgccccccgtcccccagaaccacagacagaccactctggaaaatgctctaatgggagttagttaagactttggccctggggttagctgtgggttcagatcttggctcccatcagccacttagtggctgtgtgacttggcccagctcccttgcctatctgtgcctctgtctcccaatccgatggactagagtaacagtcctttcccggggccagggtggcaggggttatgaatggaagtgaggttacactaccaaaggactgtgcatagagccgggcacagaataagtctgaacaaaggtttgtgattttagttgtcaaggagccttagagatcacccagctctgcctctgtggttttgagaccgagtctcactctgtcacccaggctggaagtgcagtggtatcatcttggctcgctgcaacctccacttcttggggtcaagtgattcggctgcctcagccttttgagtagctgggattacaggtgtgagccaccatgcccagcctccttctgttgttttctttaaacaaagaaagaaagggaaaccaacttggccattgtcacccagttagccagcgatgatagctcccctgtctccactgaagacccacagtggggcctgagtggctaggcacgcagaagttgccttctactcacactcattaagcacctgctgtgtgcgggccctgcacctcacaaagacaagcctctccctccctgatccaccccacagaccaggaggaaatcagtatttatagaaacagtcacgagactgaggcaggcctggaggctggggatgcccaggggaacctctggactggctgggtggggacagcggtggtcactgaaggcttcctggaggaggtggtgtcggctgggtgctaaagcaaaaggaagaatttggtgttcctgtgcagaaggctccaatgaggacacgccatagagagaggcaggtcctggcacgtcccgtggggtgggccagggcggggttcttgaccgtcaaggcagaggggaccaccagccctttcgagtgatgctccccagatcaaggttctggggcctagcatgaaaaattcagattcccggccactaacccagacctgctgaacccaggtctccagagctgggcccaggaagctgtattattattactatttttgcaggttccccagggtacctggacacctaccggagtcatggaccagcaatgcaggtgctgttgatgttgggggcattgggggcagaaatggcagcagccaacatgctggggatccatccgtctaggttccacaccttgcttaagggccagctttgtggcagacctggatacaccggagctgggggatcttgagggaacaggacccaagccataccttctgcaaggtcaactgggggcagcctgtcccaaagtggggtcccaggaacccaactcttacaagtcttattcttccttggtcaaggcacttaggaaaaccccatccttgatatgttcatgagccagcaaaggcactgacaagtcctgcagtggagaaagccagtgtttggcggggtggccaggaaggcttagcagtggggggctttggatggaggatctcggtaagaagggataaggtgggcttctagaacagccaggtcaggggtccacccgactcctccctcattccctaaccccccacttcctggttgggcaggccacatggagaatgtgagtttctgggcccccacactcccaccccagtcactgaccatctgccaggccagctgcacctagaggcggtgagtctcaccccaaatatttaacccctgactctgcagtgcatcgttagggtctgtactgtggctcaagtgggggcctttgtctctcttgggcccagtcccacctcaggcacagggccagctcccaaaccagccctttcatggattgtggcagatgcaagaaaagccaccttctggactctatcctggctgggcctgttgttccagccgaagccccccagaggacatgggagttgtggggcaatgaccactgcctcagggaccttggactcctgatgggacaaagctgtgagcggtagcaggaagctatgagcagacaggccaggcccaaggcccactgggctgcttgctgcttagacagcctcaggcaagtgccctaccctcgtacagcctccgcttctccatctgtcctctggcgatgaccacaaaggcatcctgggcatttgccacttgctgtgggctttgccagacctcagacatattcacaggcaccagctcaatatcatccttgccctaagtccccggggaggttggtgtgcccctttgaagaaggggatgaagaaaccaagactctgagacatcaaagcacttgctcagggtcacacagctggtgaaccgcgattctccccgcaagcaatctcactccagaggcatgtgatcgactgggctagaagttactcatggggatgctaggaaaatcacaccaataacaatctccaccatcgtaatatgagctaatacttactctctacgtgccaggctcctcactgtttctgactcaatcttcatgacaaccctgagagctgggtgttagcatggtaggtaattgtattattatccccgtttatgggtgtggaaactgaggatcagagaggttaaataactctcccaaagtcacccagcaattagatggcagagccaggactctaggcccttaacaattccatgtgacgatcttacagggctcccagcacacagtaggtacttcacagattaatttaaaatgccaagagcccaaaaccacaccgggatgccacttttcatccactacaatggctataataaaaaagacaataacaagtgttggcaaaaatgtggagaaattggaaccctcgtgccttgctagtggggatgcaaaatggtgtacagttgtggaaaacagtctagaaattccacaaaaagttaagcagtcaccataagacccagcaagtccacccctacgtattttttttatttttattacttatttatttttttgagacagggtctcaccctgttgcccaggctggagtgcactggcatgatctcggctcactcagcctccgcttcccagactcaaatgattctcctacctcagcctcccgagtagctaggattacaggtgtgtgccaccacacccggctaacttttgtacttttagtagagacggggttttgccatgttggccaggctggtctcgaactcctgacctcaggtgatgcacttgccttggcctcccaaagtgctgggattacaggtgtgagccattgcgcccagccttattattttttgagacagggtctcactctgttgcccaggctggactgcagtggtgcaatcttagctcactgcagccttgacctcccagtctcaagcaatctttgtacctcagcctccgagtaactgcgactacaggcgcctggcaccgtgcccagctaattttttttttttttcagagagggaggtttcgccatgttgccccagctggtcttgaacccctgggctcaagcaatctatctgcctcggcctcccaaaatattaggattacaggcgtgagccactgcacccagcccacccctacatatctatccaagagaaatgaaaacctatgtctgggctggatgcggtgactcacgcctgcaatcccagcactttgggaggccgaggcaggtggatcacctgaggtcaggagttcgagaccagcctggccaacatggtgaaaccccatctctactaaaagtacaaaaaaattagctgggcgtggtggtatgtgcctgtaatcccatctattcgggaagctgagacaagagaatcgcttgaacctgggaggcggaggttgcaatgagctgagatggcgccactgcactccagcctgggtgatggagcaagactccatctcagaaaataaaaaacaaaaaaacaaaaacaaaaaaacaaaaaaatctatgcctgcacagaaacttgtacatagatgaatcacagcagcatgattcataatagccttttggcctccactttttagtggaaacaactcaaatattcatcaactgatgaaaatataaaccaaacgtggtctatctctattattcggccaaagaatgaaggcaggactgacagctgctacagcctcaggaacctcgagaatgttatgctcagtgagagaagccagacacaaaagctcacatattattccattgataagaaacgtccagaatgcagaaatctacaggagcagaaagtggatgagtggttgccatggcccaggaggatgtaaaatggacagtgattgctaaggggtatcagatttctttttggggtgataaaaatgttctaaaatcaatcgtggggatggctgtacaactctgtgactatattaatatccactgggctgggcgtggtggctcgcacctataatcccagcactttgggaggccgaggtgggcagatcgcttgagaccaggagtttgagagcagcccgggcaacatggtgaaaccccatgtctactgaaaatacaaaaaattagctgggcatggtgatgcacacctgtagtcctggatactcgggaggctgaggtaggaggattacttgagcccagggggttgaggctgcagtgagccgagatttcgccactgcattccagcctgggcaatgagagtgagaccctgtctcaaaacaaaaacaaaaacactgaactgaacactttaaatgagtgaactggatgatatatgaattacatcacagtaaagctgctacaaaaaaaaaaaacacaaaaaaggcagctgggcatggtggttcaggcctgtaatcccagcactttgggaggctgagtcgggcagatcacctgaggtcaggagttcaagaccagcctggccaacatggtgaaacctcgtctctactaaaaacacaaaaattagccaggcatgatggcaggtacctgtaatcccagctacttgggaggctaaggtggaagaattgcttgaacccgggaggtggaggttgcagtgagccgagattgcaccactacactccagcctgggcgacagagcaagactccatttcaaaaaaaaaaaaaaggcaagtgccatttagaaatgacaggggtttgtttcttctctcctgagtcaggtcctgcctcttgtctcattctccagggaagctggccagctgcaggtaatcccccagcagcctggaagatgctagttaactcctagagagctatttgtcctgcccactgcgaagcaagtcacatatatattagctcatcaatcctaccagcctctaagtaagtaccattattctcaaaagttggaggattacaactttaagtgagtgaattgcatggaattcatataccatgcaattcactcagttacagatggggaaattgaggtacaaagaaattccatcatttggccacagttccactgccagcaagcaaggcagagctgggattcgaatccaggcctccggaagcacagtctcagcgtttttgccctgtagctttgcggtcctgtgttccccccaccatccagctggccgcaggaatcaaccatgtgtgccccttggagagctatggagccccatgctaggaagccagcaggaatgtgggtggggcaggaacctgcaggaaaggggacaggtcccaggagtgctgggaaaccggctaggctggtccagcttttcatctcggtaatgagccgcatcggggcagccagacgtggcacccctgggccatcagccccactgatggaggccgagacacagccctgtcctgcccatgcagacacagacagcagccacctgcctgagccaggaacacaaagatatcccccctccccacacacacaccggaaaagggaaagggcctgagtgacagccgagggtacacgcccagccctcccttttcttactcagagggtaacacggacacacgtgctgagggcagtggccgctggccctcgaaggggcctcagaagccatccagccccacctgctcattacccagatgagcaaaccaaggtcccggacgtgaagtcactacccaggatcacttgggagggcagcctgtgtaggagaaagacttcaggtctggagtcagatagggttcagatcctgactgcaccaaccagcaatgtgaccctgtgacagtgtgacagaggagctacactgtatttcttttttaatctttttatattttcttcaaatttttaaatagagatggtttctcactatgttgaccaggctagtcccgaactcctggcctcaagtgatcctcccatctcggcctcccaaagtgctaggattacaggtatgagccacaatatgcctggccagccactctgtatttctgagtctcagtttcatcatctgtgaaatgtgagcaagaaatcctctctagttatgttcatgtatgggcccaggcacaggagtgcacacctgtaatcccaccactttgggaggctgaggcaggagcatctcttgagcctaggagttcgagaccaaattgggcaaataggaagaccttgtctctacaaaaaatacaaaaattagccagatgtggtagtgtgcacctgtagtcccagttccttgagaagcttaggtgggagaatcgcttgagcccaggaggtcaaggctgcagtgagctgagtgagatcgcaccactgcattccagcctgggagatggagaaagaccctgtctcaaattaaaaccaaaaaaagtgtatttgtggggtgggggtaatcagggtcacttttagaaacacctcagtcaggccaggcacggtggctcacgcctgtaatcctagcactttgggaggccgaggcaggtggatcacgaggtcaggagatcgagatcatcctggccaacctggtgaaactccgtctctactaaaatacaaaaaattagctgggcatggtggcacacacctgtagtcccagctacttgggaggccgaggccggggaattgcttgaacctgggaggtggaggttgcagtgagctgagattgagtcactgcactccagtctggcaacagaacaagactctgtctcaaaaaaagaaagaaagaaagaaggaaagaaggaaagaaaagaaagaaagaaagagagagagagagaaagaaagaaagaaagaaagaaaggacacctcggtcaaatttcaaagacacctttgtggttcaaggactgaactggaggttcagagcagcgtccctgaaacagacttgagatcatttatactctttttaaaattttgaaacagtcttgctctgttgtccaggctgcagtgcagtggcaaaatcttggctcactgcaacctccgtctctggattcaagtgattctactgcctcagcctcccgagtagctgggattacaggcgcacgccaccatgcctggctaatttttgtatttttagtagagacagggtttcgccatgttagccggggtggtcttgaactcctgatcaggtgatctgcctgcttcggcctcccaaagtgctggaattacaggtgtcaaccaccatactcggcctcaactaattttttaatttttttgtagacatggagtctctctctgttgcccaggctggtcttaaactcctgagctcaagggatgctcctgacttggcctcctaaagtacagggattacaggcatgagcccactgtgcctggctcatttacattgtttatacaattcgggccttgctggctgtttcaccagtgggcctgaatgaggacccagaacttggttggcagcagaaacagccccctcagccttgttgacgctgtgggtcaggggctgcctgctagatgggttttgcaagcctctacgagtcacctcgagtcgactgaggctgtttttccctagctttttccttctgggctggggatgccagagtctgggacaatcctgagcagtctcacagagccccattttcttggcctggtctgcatatgaggctcttgatgcaagcaaggaaaaatggaaccagcaggtcaggaggctgcccggttcctcctcggagttccagggctgtgtttgagggtactcccagggaccagacaagggcttcctgggtctgagcccgcaggcttgagcctgaacagccatcttcttgtgtcccaggacatactcagagcagaggaaccactagggagggggcctgggggcctcagatggcatcaggtctcctggctctgtcgccaggagtcagagcctcagtagacacagcccgacctgctttattgattgattgagactgagtctcactctgtcacccaggctggagtgcagtggcatgatcttggctcactgcaacctctgcctcctgggttcaagcaattctcgtgcctcagcctcccgagcagctggaattacagacatgcaccaccacgcccggctaatgtttgtatttttagtagagatggggtttcaccgtgttggccaggctggtctcgaactcctggcctcaagtgatctgcccgcctcggcctcccaaaatgctgggattacaggtgtgtaccactgtgcctggccccagcctgcattagaggtggcaactcgaggctgaggacccagtggctcagtaagcccagctgcaaagtggagagctgggactcgaacctaggactgtgtgctgtcctggccgccaggacagcacacagtcctcagagggccagcagggatgcccgtgagaggagctgggacagaggtagcaccctggccttgacacaccaccgatgctccacgtgggcagagaaagataacacaggtgtctcgggggaccctcgctctccacctcctgggtctctcttcctgctttaattttgtgcgggtgccactggcactttctttcagctggaagggcagtgtggcccagtggttaagcacccagaccaaagccagacagcccggggtcaaatcctgcctctgctcttaataaactgtaaattacttagcctctctgagcctcagtttccccagctgtaaaatgagagtcatcacagtatgcatgccacagggctgtggtgggggtgactgagagaacagatatggggtgctgcctctgaggagcccggctctgccttgacctgggtccaccatccagggatttaggctccttttaaggagctgataaaagccagaagccagctgggcgtggtggctcatgcctgtaatcccagcactttgggaggctgaggtgggcagatcacctgaggtcaggagttccagaccagcctggccaacatagtgaaaccctgtctctactaaaaatacaaaaattagccgggaatggtggtgggcacctataatcctagctactggagagactgagacaggagaatcgcttgagcctgggaggcggaggttgtagtgagccgagactgtgccactgcactccagcctgggtgacagagcaagactccatctcaaaacaaaacaaaacaaaaaaaccctagaaacaaacaaaaagccagaagccaaggcctgaagttagaatcctccagcacctgggagatgaaagcagacccccggccgtccacactgttcacgctgatcctggtgcaagcccagacgtgctttgcttctgccctgtgaatgttgccttgccggggcacgtggaattcacaactaacctcagaatttggaaccatctcctccaacatctgcgaggagaggctggtgcccatatatgggtaatgaggtgtcgggaggacaggagatcctgcgtcccagatgcccactccctgggcctagctgggggacaaacgcacagcccgcttcagctgtcttgggtttgggctaaggatcagagtcagtaggtttggggatttgaagggtacagggtgttcccactgctctgagaacgttcttccgtccgcataagggaaactgcagaaggggagggtggggaggacctgtctacccggttatgccaacagatccctgagacctgtccctgcttctccctccactggttctacctgggaacgcgtctcctgcgcatcctcctccatctgcccctctggcctcaccttgatcaaagtcaccacttcttacctggcccaatgcaacagccacccactctcttttctgagagcatttgggagcacaggtaagttttagtttggatgatgggatgatctggttgcatcatacaaagacctaagagttggggagatatgcttcccggcctcctgcccccaggagagacgtggaccctccaaggacaccatgaatggcaaccttccagccatcagcgacctggaagggggctccctgggtgggggtggcttcaagagccacccttgatgtcttcagctgtacctgttcaagtcacatggcaccaactggcccattctttctaccctgcctgcaggggaggaaactgaggcagcctggccagggcagggaacgtagcctgtgttgtggctctaacccaggtgtgggctcgggcagattccttagtctctctgtgcctcagtttcctcatctctgagacagggataggaattgatcccactgcagagggttgagataattcaaggagataacccttataaatgaaagcgctttgggtgtggccgcaccatgattaggataactgggtttcatcctcttcctccgtgtcactggtgggggccttgccagggcagggctctttgtctgttgttcactgccatgtccgtagcgcccatcagactgaatgaactatgctggcttttggaataacagcatgtattactccacctgtctcagccttaatttctttcaacataaatggggttatcatgcctgcttgtcacggaacaagcagaaagacactcaacagctggaaaacattcccacaggagttcaggtattaagttgctttgtatgcaaggccagcactgttcaacagaaactgaacctgagccacacagaatttacatttttctagtagccacgtgaaaagagtaagaagaaatgagcgaatttttttctattttatttaacctaatatatccaaaatatgatcaatttgacaggtggtcaacagaacattattaacggatattttacattctctttttcacactaagtcttcaaaccctggcacacagacatacgtgcacagcccatgtcacggggccagtaattactgaataggactgcgagattctaggtgattctggggcacccggacctgctttgctctaagcccgcagtgaccacagtctctcagttctgctgtaggaaagctgatgggcgctcagagcatcttccagtctcactcggtgcctggtacccagggacacctaataaatgctcattctctttgaaccccgtgactcctcctgcccacactcactgattagatgtctgccccaggacagggtctcctctgtgggtccctccctggctgcctgactccaaaacaacctggggctccccactgtgcccactggagcctggtgcctgggtgtggaggaccctggcacgaagaccgcagcaagacacccttccccaggtccccagagcccctgcaaccctgtccataggccatggggctgtgctggaggcacctggcctgctcacagccatccccttctccaggctgcgagagcagccaccccggtaacagatcatactttagcaacatcggaggggccacgttcctgccatcacctccaccccagctgtccctgtcgcccagaactgctgtgtcccctgctggctcacagcccagcctgcactctcctcccatgtgtggacacaggtccctgcaggctcagcactccctgcctggccagggccactggcctttgatcacatctgcagttccttcctctgggggttaattctgtctcagtgggtgtgtattggggttgcattgctgctggaatgtctggaacgcacaggagggtacacccctccctggaaccagcctcacctgtcccagagcccagagaaggggctgggcctcctgccaccacggtcatcctcttctggcgtcctgcctgcctggagggccagcttgggggaggtgcacctccggtgccgagtagccctctgcccctaccttctttaaacactgcctggctcctgaaacatctgccctggctctgacacaaaggcaaccaccgtggacactcaggaaataactgatgaatagtaacaacactgagggcacctactgggtgcccagcgaccgctcagtccttttgtgcatcacccattgacgtctcatagccctaggaagtagccacccttagtgttactggggctcttaatcctacctattaggctattaaatttttggacaaaaagaacttactcacctttttgggggcccttctataaccttaattccacaccttgcgtagggctgggctcaataaataggtgttgaactgagcagatgttttaatgcaattcggtaactcttatgtctctgtgttctaggtgaagataactgaggctcacagaagttaagaaactggtccgagtttacacagctgggaagtggtggtgccaagattcgaacccatgaagacgggcttcaaaaagccaccttctcagtacaaaggggacatcagtatcaatccacacccaccccttacagacaaagggacaagagacatcggagagacaggatgatgggaccaggcattcaccacccagggaagcagagtgatttacagtttgttgtcattttcatcagtacaattaatcccagtggttggttgggtaaggattagtgatggtaaacggagactgagtcattctcctaagttgtccccacaagggactcccagcctgtccctccaaacagacctttcaggcggaagcaactgccattgagtgagcaccttcctggcccacaccctaccctagcaccggaagcaggtttcatctctgatccttataacaactagttgaggtacgtgctatcatagctccattgcagatgaggaaactgagcctcaggaagaccacttgctcagggtcaataggttagtaagaggtctatgcttgtaactgctgcagccccaactgggcactttctagatattcagtaattgccaaataaattttcgaccccaccccaccaactctttgtcatctctctgccccttacaggccctggcaacaggcccttcaccattaacaagcccccagagatatgaattgtccacatgctataaaatacctgctcaatttcacacctatttatggagccccaagcttatgtaaggcctggaattaaggacaacagaaggccctctcccaaaagatgagtaaatcccaactattcaaaagcttgtaagctagtaggtaggttaaggaaaaacaccccaatgggtataattacaaagatttggcttggcgcggtgactcatgcctgtaatcccagcactttgggaggccgaggcgggcagatcacgaggtcaggagattgagaccatcctggctaacatggtgaaaccccatctctacgataaatacaaaaacaaaaatagccgggcgtggtggcaggcgtctgtagtcccagctacttgggaggctgaggcgggagaatggcgtgaacctgggaggcagaacttgcagtgagctgagattgtgccactgcactccagcctgggcaacagagcaagactctgtctcaaaaaaaaaaaaaacaaaaaaaaaccaaaaacaaagattttagatcacttacaccagggtattttcatccactgtgttccatttaggccttataatctaactttaatgatgaaaatatactcaatccagtaaaaaccaggaaaagagcaaaatggaaacaaagggaaagcatgataaatagggcactatggtggagtaggttcaaacacattagtcattacaataaatgtaaatgagttaattttgcctattaaaagataaaagactctccggtgagattacaaaacacacaccttccccaagctatatgccattttataagacacacacacttgaaactaaatgatacaggaaggttgagaataaagaatggagagtgacataccaggcaactgatactgaagagagaaagcactgtccatatatctcaaagacaagagggagcgaggcaatccatgtaactatgtggttcccaacagctgcacatcaaaagaatgatgtctggacccatgtccatggagattttgacttaactggtcttggaaagggctctgacatgctgttcaaaactcctcaggtgattctaatgtacagccagggatgagaacaaggaactgaaccacagcaaggtttaaaagaagcaagatgccgaagaatcctagatctctataggaaggaagccctgtgagaaagcagtacacagaatgtgcccaatgaataccagattgattggtcaattgactgattctctcactactagaaactcctgtgctaattagacagtaaatgtcctcacacccagctattaatcctgtggaaatatatcctaagatgagaaggttgctggtgtagtaattccaggtctgtttttaaggcctaatctgtttctgcccagggaaggccgccctgcctccaggcctctgatggggcctagggttctgtgtcaggtgagtgcttttgggctccttttacaaacatacagaagttcaagctgcttcaggtaacaccaaggcaggtcttgaagacagggcaacacagcaagaccctatttctaccaaaaataaataaataaataaaattagctgggcatggttgtgcatgcctctagtcctggctgctcaggaggctgaggtgggaggattcatagctcactgcagctttgaattcctagactcgggggataaacagggctcaagccaactttggtgccccaaggcatcaggatgtcactctgggttcaggaccactggagaaagagcaccagcctcctttttcattttttgagacagagtcttgctctgttattcaggctgaagtgcattgctgcacttcactcactgcagccttcaactcttgggctcaaacacaaaatatattttgtatttttagtagggacagggtttcaccatgttggccaggctggtctccaacacctgaccttaggcctcccagagtgttgggattacaggcatgggccactgtgcccggccatctcagcagttcttacccagacactttgagagggctggcagggtgtcctggccgccccgcccatcctttcctaggcagagggtttttgtcatgctttgtaagataaaacacaccagagctgctggctgagcctgcaaggccgcagggctgtgggagaaatagaacttgcagaattttttgctgcccccactgcctgggctaggatttcaggctgataccttttagggtttcaaattctctgccttcgccatggcgatggtttgtttcccatcgaagggtgggaaaggattccaagtttgtaccacaaagaagagacagggcttcaaccctgcttcaatctcagataagaaactctatttggctgggagcagtggctcatgcctgtaatcccagcactttaggaagccgaggcaggtggatcacctgaggtcaggtgtttgcgaccagcctggccaacatggtgaaaccccgtctctactaaaaatacaaaatatagccaggcgtggtggtgggcgcctgtaatcccagctacttgggaggctgaggcaggagaatcacttgaacccaggaggcagagaggttgcagtgagctgagattgtgtcacttcactccagcctgggcaacaaaagtgaaactctaccttaaaaaaaaaaaaaaaaaaaaaaaaaaaaaagatctgccgagagtcctggagcgagtcactcaaactctctgagcctcacttggaacgagagctgagggtagaatttatctcagacaatgtaataatcataatttagggtgatggttttaagctagcacccaacctcaaggcctttctgtgttcatacctttcccagttctggtcccctcccctctcacttccttgcagagactctccatttttgtctccccatccagaacctgcctgcttgccttccaggactgggccccctttgcttcctgaggtccctcttcttcctctcccagaccttttattttgctatggactggactctgagacccaggactcagggcttgcctgcaggctcttcccacgctgtgccccccgccagctgtgccccacgccagctcgccttctctactccacccttcacctaaactggaaaactcgtgatctactcagacatgcagaaaagtactgaaaagaatcagccacgcatgtccccaccaccacggtttggttgatgttttcacagtaccatctttgctgcagatttttctaaaaaggaagagaaatgttattgttcattatcctttcaggccccttcttaggagtagcagaattttagatttactggttcttcctaagcctgttttattttatttatttagagacagggtcttgctctgttgcccaggctggagtgcagtggcacaatcacagctcactgcagccttgaattcctggactcagggatcctcccctctcagcctcctgagtagctaagactagaggcatgcaccaccatgcccagctaatttttttttttttttggtagaaatagggtctcactatgttgcccaggctcgtcttcaactcctggcctcaagtcatcctcccgccttggcctcccaaagcgctaggacaagtgcgaaccactgcacctggttccctaagctttccaatacatagacacatctgcattcaggaagagtaagtggaattgctctgtgtatgtttctaaaaatgtatatatgcaagcatcatctttgcatccttcatcaacttgctttgcttgctcactgtcatgccttttcgggtcgtggatacacacatccccgtcaccttctgtcaactgcactctctttatcctctcatctccaactgatccccgggttcggcgtggaggacctctcctgaagaagcctgtgtggctgggtcagggccctcctttatctcactatcactccgcattgctgccagctgtgtactcagccaactctctgctcaccgtcctgcacgcaggaggtgactggatggggacagggcagggggcagcctgctcaggcctcgcactcctttccactagctggaacccctgccccattcatccccacctccgggctctgctggtcctggggtgtgaagcgcagggcaatgtatgctctcttgaaatgctgagggaaggggagaatcttagcagtcccccatggcttactctcattcattcattcattcagcacgcgtgtagcaccagtgtctgggggaaggcagccacacagccacatgtggctaccccggagtcacatagctgctgagataagagctaccaaggagaaggggagtccatagaataggtggatctaccccagcagagaggttggggaaggcttccctgaggaacagaaggtaaacctggaagtggaagagaagcagtgaaaaggggtgggaggggcattctgggcaacaggaatggcagagggaaaggccttgtggccgggcacagcgtggaaacaagacggtgacaggcacatgttgatgtgcagggcaccagctcccagggcctaagagcaaagagaggtctggggcaggggttaagcagctggaggtatggtcagatttatgtcgtaaggagctccctggctgccatggggagaagggactggagcgctggagtggaagaaggaacagtgaagagggactggaggcctgctgggctgctggctctgcaggcagggagaagtggggatccatttaaagggaaagggcctgcgtgcagtggctcatggctgtaatctcagtgctttgggaggctaaggcaagaggctcacttgagcccaggagttcaggaccagagtgggcaatatagtgagaccccatctctacaaatattaaaaattagcggggcacggtggtgtgcacacctgtagtcccagcttcttgggaggctgaggcatgaggattgcttgagcccagcagttcaaggctacagtgagctatgatcgcaccactgcactccaatctgggtgatacagtgacagcctgtctctaaagaataaagaaagaacacttaaaaaaaataggttggggtagggaagggcagggctgggacctgaagagagctttgtcccacccggaggcagaaaggggcaccaggtggcctcccgggctccagaggctgcagcacagcaacccatcagaagccgggagaacaaagaccagaggccgtttccccattcgctcccaagacaggccggggcaggcaggctgggaggatgcaaggtggtgccggtaacaccggcacagacctgccgggagcagagagcagctgcacgctgggaagccagggttctcttccccagacgaggagctttggaagctctctaaagcagcttctcccccaggtcccctacttccagggcctcccccaaccacacccttagggtattgcttaaagggtgtggacggagctgagtctctcccccaaaataccctttcccaacatgatccgcccgacagtgcctgaaatgctaccattagcagctgttcctccaggtaagctcagctctgtcctgaatcgaatttatccagtctcattccttcttccaagagaactgggcaagggatggaggggcaaagctagagagaagagaggtagagggggttgctgggggtagaggcagtgagcacaaacaccaatgactctaccatttggcctggagcagtccccaggcacagttgctgccagatccaggtacgagtggggaggcctcatttgcttccccaggcccccctggacttccagcatcagccatttgtgagctgtgagctcaaggtgaatgtgagccctctgtgaaacaggacacttccacctgcatggcaggcccgctgtcagaatgagatgtaacatccatggccttgctgggctcacagtatgtgcctgagaaatggcggggcggctctctctaagctgttacccacatgggtcccctcccatatcgatcaggcgttcctaccaacactgatcgatgggtgcatgtgcgtgtctgcttgagtcagctccctggtcagctctgggcttggctcagtcatgaatcttttttttttttttttgagacggagtctcgctctgtctcccaggctggagtgcagtggtgtgatctcggctcactgcaatctctgcctcccaggttcaagtgattctcctgcctcagcctccccagtatctggctgggattacaggtttccgccaccacacccagctaatttttaatatttatttttgtagagatgggatttcaccatgttggccaggctggtcttgaactcctgacctcaagtgatccgtccgccttaccctctcagagtgctgggattacaggcgtgagctaccgcgcccagcccgtcatgactcttaatagcagtgtgtgcttcctagtattggctgctatgatttgccgggcactcgctctgaaccaggtcatgggctggacccatcatgtgcatcccctcatttgatctacccagcagcctcaccaactgggggttgctgttgtcaccccacctcatagatgaagaaactgaggctcggagacattaagtgacttgcccaagatcaaacagcttaagagacccagagctgcggcctgaactcatgcccagctagcatcaaacactgtgttcttgcttttttttttttctttttgagacagagtctcactcttttacccaggctggagtgcagtagcacaatctcagctcactgcaacctctgcctcccaggttcaagggattctcctgcttcagcctcctgagtagctgggactacaggcacccacccccatgcccagctaataaaacactgtgttcttaaccactaagaggctcagggtaccccaggtgcctcccagtagagcatgcttcccttttgccagctctcccctcaaagcctggggtcctgcctcccatgcaggagcgctccatcagggcggccccagtgttgcaagacccgtctaggcaaggccaggctgctgggtgtttactgggacccaggtctgggtggaggggcaagattaatcccattcaacaaattcagaagcgctggggctcagggatgctatgtttcttttcaagcagaggcagaattgagcctgactgcagagctgggtcttggccactccatcccaccccgtgacaggtcagatgcctcctctgtgaagtcctccctcacctcccagcatctgtgctctgactgtgacaactctcacttgaggcctgtcacaaagtatgtgagtggccagggtggagacctcatctgtccggctctatgctccattgctcctgcctggccccatcagtccgacgctcatgtaaccatacatgtactgaagcttaactccatcttatctctgtgatgtgactgccagcgactcaagtgcagggaggttgtccacgtctcctccacgaccacgtgctaaaacccagcaacagtgcctatggaattgtgcagtgcacagcctgtccaccatgatatcaagtttaaccctgggtacaccacagctagcttgcccgcatttgcttaataactgtaatcgtcacagatgctattacctgcggccgcttatcattcacaacctttcccctgcattatttcatttaatcctgagccaacatcgccaggcaggcaccgtgcttattcccatcccacaggtgagaaaacaggctcagagaagccaagcagctcctctgaggtcgcacagccaggagggtggcagcgggtctcctccagggcctctctactaggctggaggctgtcctcggtcacctgcaccatctggcctgactctgtcattagctcaggtgtgaacatcaactcccacacctgtcattaggaacccgggcaacgggagcaacggggttcacaccctgtcccggccctccccagcttcagctgctaaaaggcagacaaactggaaggggtggctttctcggtggggtgttccgttcactaatccacactttgtagtccaaaggcctgactaccttgggtatgaaagtcaccacttggggctcctgggtcccctgggctcggaaagggctgctaccctcatccgggcacctcctgtgtgctacagcactgctcctcccagcagccctatgcatgagacactcagtattaccacccgtgctgtgcagaaagggaaaacaaggcttcgagaggctccagggtggagatgccaggatcaacagtgaggcattctgctctcagtgctggagctcctactgccccccatgctgaatctcaccagcaattttgtcctcccccagacaatggagcgggcccctggaaaactcagagtgaaggaataacttggggatccactccctgtgaccagcgaccacagcctagagccgcaagtctgtcccctccacccccccaccaagacacttgctatggggctggctgggcatcaggcaatgttcaagagatgcgtttgagaggatggggtacagggctacccccaccccacaatccagtctgcgaactagtccccactaaggggagggggcagagggatgcactgggcttggagaccacccggggaggcatctgacatctgctcagggctgtggctgtgctcattctgtgctggggtggcaaggctcaaaggaatggtcttgcaccccaggctggggagagaatcaggagggcttcctggagaaagagacgtctaaatggagatctgggaccaatggctatcagcctaggacagaccgtggctgccttgggccagatatacagagagtggcaggaccccaaatctttgccaccccagaccctcccagtccctgcagctataaaggatgggatgcctttcatcctcatgcttctgggaaagcccgcacccctcccagcttgtctgggttcattagaaccttttgttaggtccaagctggggccttcaggatggagagctgcacgaaggagggaggctgggaggaggcagagggcggggcgaggcctggccccaccactggtatgtgggtgtctgcatgtgtgaaggactggatgggtctagtctctggggtggagaggacagaacggttctccacggctggcacggagcatccaattgtgcaatgccccagggaacagtgcagggactggacgggcctctggttgggtctgagtgccagctggacgcagccatggaggaggggtgtgcaggccctgcccagtctctggggttgtgaaagataggggaggggtggggaaatctctaaaggcgggtaatgcctctgagcttgaaagagcccaaacggagatacgggtgggtgggatcacagggcaggggggtttctgaaagggctggaaggccccggaatggagtgtcgcactccagcgtgctagggccccgccgcctgcacctgtccgactggtcggcctaggccggactgcaggggttgagtgggagccctgggcccagaggcctctccttgcctagggaagaagtgaggagctgcttgagggcacagtgggggctcccagtgagagcagcttgggggcagaactcccagacaggagagccatgtaatgtgcgggcccctcacctgcctgaagcctcttgtccgagaagctggcaaaatggtccttgctagcccagagcccccactctattttccgaagtggggatataaggcaggggctggattcccaccccctccgtcaatctcagcatctccaccaggctcccctaaaccggttattaagtgaacacattaggcttatcaaaagggacgtgggctgcttctccctgcaaacacatcaagacatgccattcccctcccaggccgccctgggaacccgcggctcagagacgccgccagtttcggggctggggtgggggcagggagccacacccctgcgaaaccgagcttcgaagaggaggccccgaagccgcccaacctccgctcagaacccagagggtggggaggtaagggggtgcctccccctgtgcccctcgacccgaccccacaccccccagggcctccgggcgcggctctggcgcgcagggtggcaggtgccgggaagtgcagcggcgggtggcccgccccctccggacacccatccctcgcctccccgacgccaggaacacttgcgcggtctcagaggcgctggagagcgccccccgacgccagctcagtttccctgcctcagggcgccccctggacggagcttcctgggtcgcccgcagcgaccccgccttgagtgcccggtcctccaaaaactccgccccctcatccaggtgactattcccggtcctgtgcgaccctctgcgcaagagcgaccctgggacacgggggtgccctgtacccccagctcagctgcccgtgccctaggccctcaaggcaatgctccctgggctcccggagtcccctgtgttatgctccccctcggggaccccagccagtcccttcccacctggcggcgcttcccagcttcagggtggcctcggtcccgcgttcccgagagtcccgcactccgggttcagttcccggttcctggacccccgtaccccccattcctacactgcccgggaggtcttccaggtcctgtgcgcccacaggggcaagagcgtcccggagcggagctgtgggcgcctcctcacctccgggtctgcacagtggggctgtatttgcctttgtttctcttcctgaagagcgagttcatggtggcgctcggggtgcgggcggcggcggctggcgggccgggcgcgcaccgaggggcgggcgggagcgcaggtgagcgagcggcggcgcg

SEQ ID NO: 915 - DNA, 15572 bp, Homo sapiens
cgcgaggaagcgcggtcacgtgactgctgcgggccagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcagtgagtggccaagggtctgggagggacgatgctctctcagccgttgatcctcggttctaaccgccccggggagtcgaggcggaagtgctcctttagtcgccgcctttgggcagctctccgagattagacgagcggttctgccccagcctttcctgggtgggtctctaggtatagccggcgttaatcttgccacgtgtcagaagtgtgttaagtgaatccattgcgtggtctcacgtaattctcctagtaagtggaacccaggtgcgtggaactccagggctagtgctggtagctacgtccctgtgcagctacccttgtcaggctatgtctgagctgacaggatatttcattcctcatccctcaacgcagagctctgcagacagatgttttcatttgttcttcatgtccagcttttccccacagtgtgcagggcagcggtgtctgctccctcattattctccacgttggtatcttgagagggtagctcaaccccatctcaggaagaagtgggaacagcactagttgcctttaatccctgtttagaatctgctatcctagggtgatggggtagagtgggacttcctagggatggctctgtggtgggaaaattccactatccagacaatctagattagtttaattgagcacctactgtttgccaggcatcatgttaagtgaaggtaggtaagattcaggccctatctctgtgtgcctcctagagcaatctgaacaagaattggccgcattctctgttctggctagtgaggagcagagagaggttttgaaatatcttactttccaaaacactgtccgtgattcagcctgagttgggagattatctgactttagattgctgcttctggtacattaaagggatcattctcatttttcagactccaaaccccatgatgagctcttgcagaacaacagaattcagattgtggggttgacagaacttcagagtcttgcaggtaggatgccgtcaactccagaatcctctgaatccatgggctgggggcagggggtgttcgtttgaaaagccgtgcagattgccagacgctcctttggtagtcacaggtgttttctgacttgcagttgggccccgagttttccagtacggagtcaaagttgtacttcaggctatgtacttgctgtggaagttgatgtggagggagccaggtgcctatatctttctccaggtgtgtatcagcctctgcctccctctgtgagagccatgttagcagtttactttccagcacaaattggtactatattgcatattcatatgtgtgtgtgttgtgtgtatgggcgtttaaagacatgagtaggagcctatggtatgtgtctatttatggcacctatccatgctctctgtgtcattacagatagtcttacattgtactgactgtgtatcaagtgttttccatgtattaactcatttagtcctcacagttaccctaagaaatattgcatgtaggtaatacaagaacctgtttcttaaggttgttctcatttagatgagaaaacctagactgagaaaggctctgtaagtagcccatcgccatacagctaggaagtggtggaatcaggatttgaacgtaggtcgtcagtgtggttctatagtatacacacgcacgcatacgcgcgcacacacaaacacacatatatttttttgagacagagtttcgctcttgccgcccaggctggagtgcagtggcgtgatctcggctcactgcaacctctgcctgccgggttcaagtgattctcctgcctcagcctcctgagtagctgggattacaggtgcccgccaccacgcccagctaatttttgtatttttagtagaaatggggttacgccatgttggccaggctgttctcgaactcctgacctcaggtaatccgcccccctcggcgtcccaaagtgctgggattacaggcgtgcgccaccgcgcctggcctatcgttatacttttaatcccttcccttgatcactttttctttaaaaaatttttctttcttttctagctgaaggaagaatacttttttttttaaatcaatttttaatatatagaagcaccttcctcttttatttatttatttttatttttcctgagatggagtctctgttgctcaggctggagtgcagtggtgcgatcttggctcactgcaccttctacctcccgtgttcaagtgattttcctgcctcagcctcctgagtagctgggattacaggcatgtgccaccatgcctggctaatttttgtaattttttttagtagagatggggtttcgctatgctggccaggatggtcttgaactcctgacctcaggtgatccacctgcctcggcctcccagattgctgggattacaggcatgaaccatcgtgacccacaccttcctcttttaataggcagccttgaattccaatatgtgatgtactatactgcatgtatttagtctcatgttaatggatactcagattcttcctgattttgtttttacttttacaaatagtgtggctccaagcacagcgagcatatgccttttgtataagtccagtttctttcttagggtaacttcccagcagtggaattgtgtagtcaaagttgatgcattttaaaaatgtgtatgttactggatagctttagagtaaggttgggtcagtttggcccccgctgagtgggggtacctcttctcccccatgcttaccatcaccagctgttgttagacctttttagaatttgcattccaacaggtgaaaaatgccatctctttgttctgttttttgcctccttgattattgatgatcttggacttttcaggttggttctgtttgtttgtttggtttttgtttgtttgttttagaggcagagtctagctctgtcgcccaggctggagtgcagtggcacaatcatagcttaactgcagcctcatcctcctgggctcaagtgatcctacctcctcagcctcctgagtagctggggctgcaggtgtgtcccaccacacctggctaatttttaaattttttgtagagatgaggtctcactgtgtttcctaggccggccttgaactcctgggctcaaatgatcctcctgccttggcctcccaaagtgttgggattacaggcatcagccaccgcacctggcccattctgtttcttttatgactttttacatctattttggtggtggagagggtctttcttctgcttattatcaagagctctgtaaagataacagactcatcaccatgtgtgttgtgactatttttactgggtttattgcctagcatggtctgggtttcctccccttcaagtctctatctttcctagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtgagagtctaggaagagggtaaaataccgtcccctaaaccactcaaggatgagtgagaagaagggccatagtgggcctccggaagtcggttccttgtgggctctgcaggaggtggggtgaggctggtgaatcaggccgaatgctggttccaaatgatagaaacaggcctcagcaaaggaccacattttttggcccatgaaatggaagtgtctgtggaaatggttggtttcgagctcagcagtgtcactgggacccagctcacgtctgtctccacactcccttctggtggtggttcccggaactctcctagctcttgtcctcacgtaggctcattggggagggcagccctttctgattggctcatgtaggttacctgccttcctctgatctgcctgttgaggccagggggcaagtgctccagcagaagagctgggtctcaggagcatccatatctcatggacagagggtgggtgagggcagatccccaaattaaaacccagggctgctgttggtagctggagaagtgggccacagttgctgcagctgatgtgacagggagggaagaagggccagtggtagcagtgggacgtggagctgggaaggtcatctgctgtcctctgagcccaactataacatctctgttatactctgcacggccagccttcaggtgcacatccagcctccgtgtgcatgtccagctgctgcgtgtacttccggccttgggccattggctggctgtggccttcgccctgatagtttgttcactggcagtggtgacagcagcagcaaacagcttagttgagcaaatggagcagaatggtcaatggtgagcacctgctgcatgccagtcctccatccaagccctttttgtattttaccctgttcaatctctatgcacctcaggagggtgtaccttttacaagtcaggaaactgaggctgagaacgattatgcctcttgccacacagctaagtgtgaggaccaaaatatcccaggcaagcccatttccgagctttctctgcatcttgagaggaacaggcgatgataccctggcggtgataaataacccagaatcgcgcatgccgtgttccggctctaccctgcgatcagggctcagtctccgttaggagagaatgtgtacaatgctcactgaatccctttgccccacgttgagagcaagccgtgaccttacagcctttgcagtggtagcacagggtggctgagatcgctagtgaggccttcattgtatttcttccttttttttttttttttttttttgagacagtctcactctatgtcccagactggagtgcaatggcgccatctcggctcactgcagcctccgccttctgggttcaagcaattctcctgcctcagcctcctgagtagctgggattataggcacccaccaccacgcctggctaatttttgtgtttttagtagagacagggtttcaccacgttggccaggctggtctcgaactcctgacctcaaacgatccacctcccaaagtgctgggattacaggcatgagccaccgcgcctggcctgtatttcttccttttacagcaagagagaggatgttcactttggcagtgatacacagtgtccttctatttatttttttaaatttgtatttatttatttatttatttgagacggagtcttgctttgttgcccaggctggagtgcagtttccttttaaagtgattgtatttaagccaacaagtgacacaacataaaggagggtatatacagcataaagaaagaacactggcacagctggggctcagggagctcaaactctcccagctctgcggccttttctctgttgagggatgtcgagtcacgctgtggtggtagcggaggcctgtctagggctctgctgactgctgatctctcttttcaggtacgagaagttctttgggcgcctgtcccacctgaacctgtgtgttaccaatgctatgcgagaagacctggcggataactggcacatcaggtaccatggcctgggatgacggcggcctgggagaggcgcggggcccctgattggctgcagtgagagctgccttgcctgctgccgtcctgctgaggggcaatttgaaatactgagggcctgggaggtggtctttggtttggggaagctgggggaggagggggcagagtttctttcttagccagccagggggtccaggcagttttggtcctaggacgtctctctgtgcattcccaagtaattgcaaggcttcttcttgtcatcatctgagacttggattccccaagcgtccttcttttcctggagcctctgagtcctctgttcctgaggcctttcttcagccctcccaatagccccgtcatgatttcattgcagggctgtgaccgtctacgacaagcccgcatctttctttaaagagacacctctggacctgcagcaccggctcttcatgaagctgggcagcatgcactctccgttcagggcccggtaggcctcccatcctcagctgccttctctcctgctcgccactgccctggcctctccccttctcactgcagacctgggaacccactcatccaggggttggcaaactaaggctacaggccagtctgctgcttttgtaaatcaagtttcactgggacacaacacactcattgccttctgagttgtctacagccgcctttgagctgcaatagcagaatcgcgttttgcaacagagaacctgtggcccgcaaagcctgaagtatttactctctggccctttaagaaatgtttgtggacccctgcgctgtcttactctcctgccagtggcttcccaggcctgtggcaggatctgtggacctgtgtgtcccctggggtgtctcatggggctaaggaggggacctttgtgcaggtctacgcaccctgaggtgtgccctgggtaagctggggtggtgtgggagggcgtccctgcaccctcatcttgagtccaggggatgataagacagtaagtcccgtggagaaaaggaatgagtcagtcttgtttgctgttgtaaccttagcacccagcaacaatattagagaaagcaagcccaggcctcagatggcaggggtggcctggtgctgctgatgtggctgggcaccccaacctctgggagcctgcaggcctcgccacggcaggagatgcctctcctgggtcccgggcctgctctatggcctctcacaggctttttttctgctccttcagctcagaacctgaggacccagtcacggagcggtcggccttcacggagcgggatgctgggagcgggctggtgacgcgtctccgtgagcggccagccctgctggtcagcagcacgagctggacaggtctgcaggacccctggggcacttggggttggtgtgacgggcacctggccaacctgtgttctcctcacccctgccagtcctgcatgctcccaccctgccacggtctcaatgagaacgggagggcctgtgagctggaagaggggtgtctagaaacaggcccctgacattcaattctcttctcatagaggacgaagacttctccatcctgctggcagctttagaaagtaggtgtgtggctgcggtgaggagctctgggcttgtcgggggccactgagctgtaagctgcttgcctggcctgcagcatgttcctgtcccaggccactgggtggggcagcctggggacagcgggggtggtggaagtgggccgccctgaatccccagttgggtcattgagtgaccaggccctcaggctgaaatgccccctccaggagagtatctcacacaggctggtggcctccccgccagagcagtgctctttctccacctgaccaggtgactctggctattgtttatttaaaaatttttttctgaatgggcatggtggctcaaacctgtaatcctagaactctgggaggccgaggcaggcagatcatctgaggtcaggagttcgagaccaacctggccaacagggcgaaacctgtctctactaaaaatacaaaaattagctaggtatggtggtgggcgcctgtcatcccagctacttgggaggctgatgcacgagaattacttgaacccaggaggcagaggttgcagtgagctgagatcgcgccattgcattccagcctgggtgacagagtgagagtctgtcagaaaaaaaaaaaaattctatcagaaattccatgtagaattgtttctttttctaaacacagagtttgaacaactgactcttgatggacacaaccttccttctctcgtctgtgtgataacaggtactgcctgggaccctgggtgtctgtttggttgggggatggcggagggggaggggcacgcagcctttaccctgtgcttcccatgatcttgtctccttaatcctcactgcagctctgccatagggtcttatactgcttgacatgggggaaactgaggctcagaggcagggcagggagcccagatttgaatctgtagataccaagctttctactttttcagtagtttccaagcatcttttttttgttgttgttacgtcattggtgtcttttttttttttttttgagacagagtctctgtcgcccaggctggagtgcagtggtgcgatctcggctcactgcaacctccgcctcccacattcaagcaattctcatgccccagcctcccgagtggctgggactacaggtgcccaccacaactgcctaatttttgtatttttagtagagacagggtttcaccatgttggccaggctggtcttgaactcctgacctcaggtgatccacccgccttggcctcccaatatgctggaattacaggcacaaatcactgtgcccggccatgtcattggtgccttaaccaagcctcttaatttttcaaacggaagagcccctgtcccacagttactgctgctgagccctttcaaggtgactcagtgaggagggagaaaagcggaagcggtgtgggaagaggccgggtctgggccagctgctggtcctgctctcctccctcctctggcctctaggctcccaggagtggtttggaacccgcgccatatgctctgggggctgtgccagggcaggaggagtcctcgtgtcccctgtgcacaacacagacaaaaggctgggtccacccagtgggcggtcgggtgccaggccagtgcttaccccgccatgtttgcagcccgaggccagctggctgcaggtgaaaggctatgcgtcaggggtcagggtgcacacacccctgcaggtctcagggctcctgggttgcttctggaagggcccggatggggcctgactggagctgctgaggggtggagcttctgggaaagggatccctcctaggggggagtgtcttgggcctggggccacgtggcagggacagagatgggtccatggcagtgtctgctcttctctgtgaaggcaaagggcctctgagggagtattatagccgcctcatccaccagaagcacttccagcacatccaggtctgcaccccctggctggaggccgaggactaccccctgcttctaggtgagaggccagcaggaggctcagggaggaggcggggggaacagggtgggcgggatgtactttttctgaaaaggtggctctggaggccactgggggacgggacctgggctctggctgaactcccaggaggaggctacttcctggtgtgccagcccctccctgccaggtggccccaggggccgtttaccaaggggtttgaggaggccacgtcctttcagcctgccacgccctccattcagtcctcttccttcctgcaggagggctgggcctggggttggggccactgttgcccaggtgtgggagggcagtggctttgggaggtacggggacgatgtgtcaaacagcgtcgcctctcccagtgagatggttctcctttgcctccgtctctttccccgttgatttctccaagtggggagtcgtgccttggtcctgatgcgtctctagagctgcatcttccagcttcgagtgagcagagcagttggaggctgaaggccttttcctggcaggactctccacctagtctttgttttagacagtctcgctccgttgcctaggctggagtgcatgatctcagttcatgcaacctctgcctcctgggttcaagcgattttcccacctcagcctcccgagtagattacgggattacaggagcccaccacaacacctggcttatttttgtatttttagtagagacagggtttcaccatgttggccaggctggtcttgaactcctgacctcaagtgatcctcctgccttggccttcctaagtgcttggattccaggtgtgacccatcacgcctggccccagctagtctttagaaatgttaagctatttggctttattttcacagtgacagctggtttgtggtgggtgtgctgtggtttattattattatcattttgagatggagtttcgctcttgtagaccaggctggagtgcaatggtgtgatcttggctcacgcaacctccgccttcccgggttcaagcgattctcctgcctcagcctcccgagtagctgtgactacaggcgcctgccacgatgcttggctaattttgtattttttttagtagagatggggtttcaccatgtgggccaggctggtcttgaactcctgacctcaggtgatctgcccgccttggcctcccaaaatgctgggattacaggcaggaggtgaacctgggaggtggaggttgcagtgagctgagattgtgccactgcactccagcctgggtgacagaatgagactctgtctcaaaacaaaacaacacaacaacaaaaaaaccaaattgtggttacgtataaaaagtgtcaacttacattttcagatgtcccagccaggctgtgtggctgcttggccagcttaagccacttgtgtttggggctgttgggggccttatctgattttcactctccttgggggatgctgcctcactgtgctgggaggatttgtgttcccagggcagagaccagtgctctgacccacccctcttgcctagcagggtcggcggacctgggtgtctgtctgcacacgtcctccagtggcctggacctgcccatgaaggtggtggacatgttcgggtgctgtttgcctgtgtgtgctgtgaacttcaagtggtaggagcagaacccaaatccttctggggatagctttgcagatccaccgctgagggggaagcagtgcagagggagctgcccacagtgaggccctgcccctcggtcagtccggcacacactggaggccatgaggaggagccctgcggttactgtggctgggctgagcctcactgaagtagttgcttccatttagagctcatgttatatttaggttggtacaaaagtaatcatggtttttgccattaaaaatggcaactacttttgcaccaacccaatatgaaaacaaaaagcaccttaaataccagaactccactcggggcttttgctcctagggtagaattggtgggaattgcctgcaggcttacatggttttctttgtttttctctcccaccatgtcccttttggccaagctcacatggtcggtttgaatcagttaaatgagtgtcatgctgtggcctcactgcacccagcgtagacgggtgtttggaagggcagtgttagaggagattctagaagcagtagccccagcacaagttgagcccttggcccctgctcaggagccggcccctggatgggatttagggatgtgagcccctcgtgtgagctgagctcagggaatgtcgggatcaaacctggtgccctagaaaagtcatcttttatgtgctgagccagtccccagggcgttgcctttacttgttccatggccatggaattaagaaaaacatgcaaaaataattcttcagtccttgaagagcatccagcacagaaggtacaaaccccccttaaggctccctcctcaaatgggtgtggccattttgatgtgcacccccccaggcctttatacccttcagatgccaaatctaagaaccagctcccggaaaccacaccccctgttccaacccccagcctggcttgagcatggggtgtgtgggggagcccaggtgggcaccccaggggtctggtgtcttctacaggcagctctcaggctcccttggttctctctgcagtttacatgagctggtgaaacatgaagaaaatggcctggtctttgaggactcagaggaactggcagctcagctgcaggtagccacgtctgccaccacgccagggtggggagggttctggagactggcaccgagccaggctccctgatccctgcttcccacagccagggtgggaccatgtggggtctggcggaaaagctagggagggagcagaggtcacagaggctggcccactctgctgtcccgtttcggtacagtaggctcgggaaagttaagacacacccccacctgccctctggatttatggagctgacactccacaaatgatgctggagctgggtgggccgggctgcggttgaggaagtgatcaggatcacgtaggtgggcgggcaaagggagcttctgggaccagccttgaaagatgggtggaattctgcaaaggttacttgtttcttattgcaaaaagtaatacatcattcttgccaacagaatgattggcaggattttcagtaaaggtccaggtcggaagtcgtttagactgggttccccagtctctgtcagaaccatggtactctgttggggtgtgaaagtagccacagatcatctgtagattaaggggtgtggctttgttccaataaaactttatttacaaacacaggctgtgggctggatttggcctgcaggctgtagtttgtgatccttgattcagacagtttagcaaggctgcaaagaacaccgacacccccttgttacccacagatgggtgagactgcgttggccagaggccgagaggagggtgctcacaggggaatgggcagcacgtagaggccgggaggtgctccagggcaccaagtgtgggaaagtgggacatgcggggaagtttccagaaactgtgatgtcaagttggaggcggagtgctgctggggtgtgaagggtctcgagtccaagtgagggagttagggacttgggaggggttgttgttgggtcggggacctggggtcagccaggtggtgacctgggatggggtggggacaggcaatgaggtaagctctgctctttatttttttgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacacgcttagatagccgatgtcttattagagggcagtttgtggttcctgatttggaaattaacattctccaaacattccagtccaatgaaagttttatccgctttcccatataaaaattcttcccatgagagtgacttgattctcacaatcccgttggagtcgtgtgtgagtcctacagggtgagattcagcattgccatctccaagtgctcttcgtagggaaacagtttctgctcatgacgaggttccacttcccatctgatcccggcccggcctggaaacagagcacatgtgtttgaggatggcggtgtttggggacaggacatgagggtattgtgtggggctgctaggacaggcctggcggggtaggggggtgtccaagtcagtttacttggttcacaggttcccaggcccacccaggtgcctagaattggcctccaggatgggaccagaaagctggttttgcatagaaatggctagcagcaggcaccgtgccgctgtccactctctgcctgtgtctgccccagcacttggcacagcgggacagaagcagagatctgaatagtcaacccactcttcacaaagcttagaaagcggccgggcacagtggctcatgcctgtaatcccaacactttgggaggccaaggcgggcggatcacttgaggtcaggagttcgagaccagcctggccaacatggtgaaatcccatctctacaaaaatacagaaattagccaggcatgatggcgagtgcctgtaatcccagctacttgggaggctgaggtgggagaattgcttgaacccaggaggtggaggttgcagtgagctgagattgtgccactgcactccagcctgagtgacagggtgagactaagtctcaaaaaaaaaaaaaaaaaaccacacgcaccacacacacacccacacacacacacagcttagaaggggctgctgttctcataagcacagatgtctgaagagccgttagccagaatgattctttttttttgttttgagatatgatcttgttctgtcacccaggctggagtgcagtggcacagtcattgctcactacagcctcgactcctgggctctagcaatcctcccacttcctgagtagctgggatgacaggtgcgtgccaccatgccagtaatttttttattttgtagagatggggtcctgaacgcatggcctcaagtgatgctcctgcctcagcctcttttattatttgtttttagacgaagttttactctgttccccaggctggagtgcagtggcacaatctcagctcactgcaacgcctcccaggttcaagtgattctcctgcctcagtctcccgagtagctttgactataggcgtgcaccaccacgcctggctaatttttgtgtttttagtagagatggggtttcaccatgtgggccaggctggtcttgaactcgacctcccgtgatctgctcacctcagcctcccaaagcctcagcctcttacagtgttgggattacaggcgtgagacactgtgacccgggacgattttcaatcacagttttttgttacgagtggaaaatgcgtatttataagaatgaagtagtacagacatgaatgtgtagaaatctctataatcctgccatccaaggatggcacctgttaatgtgtatatcagggatgtccaatcttttggcctccctgtgccacactggaagaagaagaatcgccttgggccacgcataaaatacactaacactagcaatacctgatgagctaaaagaaaaaaaatcacaaaaaaacctcgtactgtttgaagaaagtttacagatttgcgttgggccgcaagttggacaagactgctatatgtatattctaggttttcccctataggtatacttatgtgaaaatgattattgtgataaattttgttttgagatgaa

SEQ ID NO: 916 - DNA, 9099 bp, Homo sapiens
attcagaatccacacaccacctggtggctccttttattatatcaatttattcaagtgattaaaaaacttcttggcagcaggatgacaaaacaggtctgtaaacatgatctcatccccccatcccttcttccaaggagcttcctatgacaggaaatcgaattctagttggcaaatccagtgatgaggtctgtagaaaaggggtcccgtgtcacagccaggaaggcagactcgtccctttaacccactccagccaggggtgctggccaggatgtgctgttctgtcatgacgtggtcactgagtctggttcgttggcagccccttccccaggaggagggagactctttggcagtgcggcagccctcccgggggcacgggcttctcggcagcagacacaggcaggccagaagcaggcagctgagcctctccagcgagcatggtattgctagggttgcaggtgccctggcaggtggccaggtgaggggctgaggcacaagtgctatcaggaacttggctgccccacaggggctgaggacacccagatggtccacgccagtggccttgaaatttcccctgcagaagccagaccgtggggaaacaagctttcgcgacgtgccaccccgggcagcttgaggcttcagtccttgaaggggttgtgggcgccccctggctgctccttctctgcggccagaggctccccgttcatctcctgcagcgggtggtatgcatagtccccatgcaggcgccggttcctctctgctctggacaggagcaaggacaggtttgctgcagtgctgatcagcaggaggaaggccagcgccagggtgagggctagccaggcggtcctgcagacaggagagaagccccaagtgggggactgctgggtgggctcagggcttgggtagcactggaggggcttccctctacccggcatagatagcactaaatcaggtgcctccagggaccacacagggaatgttatgagcaaaatggactaggtggggatggggcaacatttaagacatgtgcagggaacagcagaggcagtcatgacgtacaatgcaggtccgtgctgccccatctcctgattttttttttttttttttgagacagagtctcgccctgtcatccaggctggagtgcagtggcatgatctcagctcactgcaatctccgcctcctggcttcaaacgattcccctgccttggactcccgagtagctgggactacaggctcgaatcaccacgcctggctaattttcgtattttcagtagagaccaggtttcaccatgttggccaggctggtcttgaactcctgacctcaagtgatccacctgcctcggcctcccaaagtgctaggattacaggcgtgagccaccacgcctggcctgatattttaagagaagccattaaaaaggtttttaaggctgggcgtggtgctcatgcctgcaatcccagcactttgtgaggcttaggcgggcgtatcacttgaggtcaggagttcaagaccagcctggccaacatggcgaaatcctgtctctactaaaaatatgaaaattagccgggcacctgtaatcccagctactcaggagactgaggcaggagaattgcctgaacccaggaggcggaggttgtggtgagctgagatcgcaccactgcactccagcctaggcaacagagtgagaccccgtctcaaaaaaaaaagtttaaaaaaatgtgaatgttactgatttttagatgctgctgatatattttaactttttaaaaattatgtaagccaaataaaacacagctggatgctgggcatgggggctgggaggccaaggtgggaggatcacttgagcccaggactgtgcacctcgtctgtgcaaaatagtgagatcctatctctaaaaaacagtaagaaataaaattagccgggcatgggggcacgtgcctgtcgtcctagctacttgggaggctgaggcgggaggatcgcagtgagctgactgtactacagcacttctgcctgggtgacagaatgaggaaacctcctgcccccaccctgggatctcatctagcccagtttgcattctgagctccagtgggggatgctgacaacagaggctgggcactcgaaggccctgggctctgctccagggtccccaaagcagacagtggggagagctggtcccgcttcctctaaggcagggagctggcaggggacaagggcagagatggacctcacaggggaagggtgcgggagagaagggggattcctcccgccctggccccagctcccacagaagcacctacctggtgaaaaaggagagttctcccgccctcagggtggcttcaggtggctggagacactgctttactgtaacataccagagacaggctgaaggggccggagcaggagcgtctgcccatacccctccccttggagggataggtacctctggagacgctgcagttgccagtcttggggtcacagggacaatggtgctcacacttacaaggcctctggcagcccggcccatgccagccaaggggacactctatggaaaggagatgggaggagggaggagggaggagaaaggttggggcctccagtgtcagagcctttctcgacaggacaggatacctgcccctgcccatgtgtacagagccgggctaaaggtgaagcaccccctgccctccctggactagcccctgaacgtgaccttatttggaagcagaatctctacagaggcactgcagttaggatctcaagataagaccgtgctggatttgaggtgggccctggagccagagcccggggacccttgttttagccgagccctttgtggaacgggccgcagcagccacaggggagtcacacagtgatgtgcaggtgaggccggggcagaagacaagaggcaagcatttcccagaccagaaggtggagacagaagcagcagaggagcagtgggggctgccgggggccaccgtctccccatccgctagtggcgtggcagctcctaccttcactgcagttggacccggtccatccggcatcacagcggcagccggctgccgagacaagaccggggaggccaggtgagggcctagggcaaggcagggctgggcagagccccctccccagaacccccactcactctccgtgcacagtccgtgctggctgcagttagaggggccacagtccagctcatcacagccgggaccccgccagaagtgcccggtgcattggcagtgcccgtccacgcaggtcccgtggccgtggcagtcaggcggctggcagcggggttcgtgcacacacaccacggtggacacttggcggggacagcgccacatgttgtcctggctgtagagggatgtgatgtgtgaggagaggacacccccagacggcccctcaactccctccaggctgcccccaaccacccctctctccattctcacctgtctacctacctacctacaagatggcgtctatctatttttgagatgaggtattgcgatccttccacccgagcctcctgagcagctgtaaccgtaaggtgtgcaccatcacgcctgcctaatttttttttattttttcataaagacagggtctatgttgcccacactggtcttaaactcctgggcccaagcgaacctcccacctcggcctcccaaagcactgggattccaggcgtgagcccctgtgcccagccctctccagtcttttataggttcctccgctccctacaatccctcccagccctgggcctttcacatgtggtgccctctgcccggaaggctctcccacccccacccagctaccacctccttcagatctcagttcttattctgtcatcctcagggaggtctttgctgaccaactgaccctgctcctaggcctgggtagtactggcatcctgggggagggactgcagcaatttctgctctcttgaacccccggggcctggcacatagcaggcactcaatattggctgaatgagacaggctggggcagacctggacttcagccctcacgaaggcggctctcacgtgcttaccagtgatctgacgggtaactggccaaggtcccgttgagcacaaaggtggcagagccacccccatccaggttgatggcgttgaccacgtcctgtttcagcaggaactccgccatttcccacaggttgatgctgcggcacaaagcggcgctgctcaggctcagcgcccaccatcatttctcatttaactccttttccttccacagtgcagagcatcacgcccacagtgcaggcacatttctaagtggcccccgcccccaagcatgtctcatcctagcccccggaagctgtgaacacgtgagatcacacccatgcctgtgctgttacatggcataggaatccttaagggaggggaaacggcccggaggatctgggtgcagccactggaatcacaggagtgttcaacacagagagccttctctggctggtgacagaataggaagtgagatttgaaatacgagggggatgagagggtggccggacaactgggggagaggacacacatgggaaggaacctgggcagcttgaaggagctgaggccccagatggcggccagcagggaaaccaagacctcagtcacaactgaggaggcgacggggattcttccaacaacctaaacaagaggattctttccagataagagaagagccctgcctaaccagcatcttggttttgtccatgggacaccctgaacatagaacattccaagttgaccagcctggccaacatgatgaaaccctgtgtctactaaaaatacaaaaattagccaggtgcggtgactcacgcctgttaattccagcactttggaaggccgaggtagatggatcacctgaggtcaggagttcgagaccagcctggccaacatgatgaaaccccatctctactaaaaatacaaaaattagctgggtgtggtggcgggtgcccgtaatcccagttacctgggaggctaaggtgggaggatcacctgaacctgagaggtagaggttgcagtgagctgagattgcaccactgcactctggcctgggcgacggagtaagaccctgtctcaaagaaacaaacaaacaaaagaacattccctgctgagtgttgctaaatttgtgctggttatgcaaccagagcaaaccaaaacactctctttacaggggctagaaatgaggctcagggaggccgagggacttgtctacggcataggtgggtagacaagtcatcgatggctaagctgggattggaaccaagatcttctccctgctcactttgtgaccatttccttgtatcctatctagggttcaggaaaggtgaggcctaaagctgaagatgatgagttcttggaatcggcaaagatctcagaaccctcatcctgtgggaaggtgagggggccctgggaggggggacagataggtgtcaacatcccagaaagcaggtagagtcagagggtggctgtcattgggtcaacgttcctcctagcaggactgagccccggccggggggcctcagctcccaggactcacccacgctgctccgtttggccgtctgcatgaaagagcaccagctgccctttccggtcgtggccaatggccgtcctggctgatatcacattcacaaatttgctaaaggaacctgaaggaaaagcagcctggctgatcaccgccccttgggaggcctcctgcttcttgcctaactccacttcccactggtctgagctacctggtacctccctgggaagcacagcagcctccttgctcgtctccctgcctcccctctgcacatcccagtctccccagggcagccggggggtctcttcttacaggtaaaccaagctatgccagcctccaggtgaagaccctctaatggtttcccctgttcttagaacaaaatccaaagagccagcatgccctccccagcctcttcctcctcctgcctcagctcctgggtgtcccctcaccaccctgcagccactttgcacttcctgttccctctggctgggaactgtgcttttctctagcttgctcctttgtcagatcacctccttagtgaggccttccttgaccgcccactctttttttttttttgagacaaagagtctcgctgtgttgcccgggctggagtgcagtggcatgatctcagctcactgcaacctccacctcccaggttcaagcaattctcatgcttcagcctcccaagtagctgggactacaggcacacaccaccatgcctggctaatttttgtattttttttttttgtagagataggtctcactatgttgcccaggcaggtcttgaactcctgggctcaaccgatcctcccgcctcggcctcccaaagtgctgggattataggtgttagccaccacacctagcttactgcccactctaaaatggtcatggtatcctgtccccatcccagtattctgcatcccagtggttctcaaccttgagtgtcggtcagagtcaccatggaggcccgttaaaacatagactcttgggccttgcctctgattctgcaggtctgagggtgtggggctttgaaacaagctcctgggccacgccgatgttgcaggtccatgaagatttttttctcttcacttttctcttcctgtacccacagctccggtccccatctctcccctttcccctaactttatttttgtttctgagcacttatcaattcttttcagcatattctataactattttttgtcctatatattcaatataagcctatcttcctccccatgaatccccagtacccagaatagtgctgggcacaaagtagctgctcaatacttgttgaaagacttaagaacagctccgcccagcccactggtcctggttctcgagagggttgttgccaacagcctccccatccaacctgtctcctgtgtctcgtcacactctgtggcttggctctcgttgatgtagatgcttccattacgaatcagccacacgaccccactcagcagctgcacaaatgggttctcagtgtccagcacctcctcctcagacaggtacctggatccggggaaggtgggaagctcactcaccagcaggggcaactgcagatagtcaggctctttctccctagccatcccaacctggctgctagattccccctcatgccccaggaacctcctggggcctgagtgtagctgggacaacttaacagccctaggaatctccctgttgtcagagctgaagctggacagggttctgacaatacaatccccacaagcctttgcaaacagtctgtttcatttaacagaaatgaccatcccccaacagagctcaaatccatctatggccctcaatccccaggccatacccagcccaactaccacttgatccctgttacggcccttcattggcttccttgtttctccactgctctctcccacctggtcccactcaggatcagaacaagctttatcatcaacaaatactttttttttgagactcaaataatttttaagataattttaaataattcaaatcatcaatcttgccagggcgtggtggctcacacctgtcatcccagcactttgggaggctgaggtgggtggatcacttgaggtcaggagttcgagaccggccaggccaatatggtgaacccactcccccgttccccaccccatcccgtctctactaaaaatacaaaaatcagccgggcgtggtggcacacgtccgtagtcccagctactccagaggctgaggcaggagaatcgcttgaacccgggaggcagaggttgcagtgagccggtatcatgccactgccctccatcctgggcaacagagcaagactctgtctcaaaaaaaaaaaaatcatcagtcttgatgagttgatgtttctgacaccccactcctttttcagtccctcatacacacaagcccccctgagcctctgagcctttgtgcgtggggttcctttggactgaaacgctcttcctccagttctgaccttggctcacttagtgattcatcttcaagttcccactcaaaggtcacctcggagaggcgtgttccagatcaccctccctaaaatcaacactatttacaacgggttcaccccgttggttgctttgctgcacacacagcaatcagaatgtatgttagctatttacccggcttttgttgatttttctagtaatgggggagggctgttaaggcaaagactgtgttgttcacggctatctcaccggggcgcggcacattgcctgatacaagcaagtgctcaatgatactggatgatgaataaactctgcaaggaagcgattcctatccccattctgcagaggaggaaacaggggctcagcttggttaagtgacttgaacacggaggcacggctacaacccaaatctcaggccctctgccctcgacagcacggggctccctgcctcctcacccggtgaccagggtcccgtcgcggcggatcccgaactgcgcgttctgcagccccccggagctgctcacccgccgctcgtcgctcaccacgttccccaggcactcgcccgagttcatgcggaagaagccgccgttctgggcgacacggcagtcggccgcccgcgccgtctcctccacggtggcgcgtcgtctcgccgcgcagccgccgggtccaccgggctccagcaccgagaaggtgcgcaggggctcaacggcccgcgtcaggtggccggccaccgcgcggtccctgaagtgcgacacgaaggtgcgcacggccagaccgccggcgccgggagtcgcgggaggcggaggccaactctcgtgctcgcggttgccggcgcgcacccgtgtgcagtcccgggggaggcgcgcgcgcgcgcgtggatagggcagtagcaagtcgtcgtcgcgggaggccctgcggggacgggcggccgtgagctcagggggctgtcctcgtgagctcggaggacaggggggaccccccgaaccaggctggcccagggagctgcactcaccccgagtcgaggccgccggacgcttcccagaggaagccgaatagtgcaagccggaggagaagccagcgacccgtggaggtcgccatattggaccggggcctcgggtcatgtgg

SEQ ID NO: 917 - DNA, 9271 bp, Homo sapiens
cagtagcaagtcgtcgtcgcgggaggccctgcggggacgggcggccgtgagctcagggggctgtcctcgtgagctcggaggacaggggggaccccccgaaccaggctggcccagggagctgcactcaccccgagtcgaggccgccggacgcttcccagaggaagccgaatagtgcaagccggaggagaagccagcgacccgtggaggtcgccatattggaccggggcctcgggtcatgtgggctcgcctcacgtgactcaagtcccagggtggccgctttcagctcggactgaattacctgcgctcttttcggctggcgggctggcgggcggtgctggtgatgttaactttttatctccaggtaatctcaaacctacaggaagttgcaaggagagcataaagaactctcgtagaactgttattcatgtttagcagtggtttaggcttgcctgatttactcaatcatttgtactttgttttttttttttcctgaaccaatggcaaccaaattgcagatgtcatgatcctttaccccatacctcgccatgaatctcctaagaacaagggcattttcttaaccacagggcaaatatcattaggacaactcccattgacatttctgtgatgtcatccacagctaaccttcaattgtccctctaatgtctttttttttcttttcctttttgtccgcccctgaccctgtaacccaggagttgcttttagttgtcatgtctctttgatctcttcatctggaaggctcctcagccttttgtcttttactaccttgacatttttgaagacagcccagctacatgatttgtgtgactcaatgcaaaatgaaaacgtggggacacttactaaaaaacccagaaaactattaagaatttcaagatggtcagagcaaatggttgcagcaagccagggaccttctgagtgagcccatgaagctggccctgagtatagaagccagtttattttgtagcatgtacttcaagcttcctttgagaggattcttctcttcaggcctcctgtcccagtgcagtgtccagggttgggtggtgtcttggtgccagtgcagtgcgtgggccattccaggagccacggcaagtctaattggcttgatactgttgcggtcttgccagtgcaccttaatatagcagtttctccttgtctgaactagtcccggggttctttgtcctacctccaagaaaactaaggagcgtggacacaagggtggggttggagcgaacgtttaataagggaaagaagaaagctctccaaagtggagacgggagtccgagtggattgtcgggttacagctgaatgcaaaaagctttttttttttttttttttaagacagagttttgctcttgtcacccaggctggagtgcaatggtgcgatcttggctcactgcaacctcaacaacctctgcctcctgggttcaaatgattctcctgcctcagcctcccgagtagctgggattacaggcacacgtcactgcgccctgctaatttttgtattttgggtagagacgaaattttaccatgttggccaggctggtttcaaactcctgacctcaggtgatccgcctccttccgcctcccaaagtgctgggattacaggcgtgagccactgtgcctggccgcaaaaaacttttataggacactgctctcctcctggtaactgagtaacttcttaccagtaaaactgcctgtgcagctccccttatgttatgcagctgtgggtatgtctctaggcaagtgcaaatcgctgcttctcttgtttgtgtaactgtgggtttgttttagataaggccccctcctccctgtgccggtttccatggagcccactgtgtatatgcctgaaaaggagaggaaactttttcccgggagcctgctaattatgcaaagaacaaagggcttctgcgctggaccctgtctgcttatctccgtgcaggtccagcctgagttttttcccaggttgctttatttttgccagtttctatgacttttcaggcaggccacttctgaggtcagaattttccccaacggatttttcttttccttctccctcactaccacaggtatggggggacacagataggggccaggccagccccttttcatccacagtcagcacttctggtgcttgatctcaggcccctctttgagccactgctcctttgagccagtccacggtgagggttagtgaactcagttagagagtgtccccccaaactcatgtccttaccagaacctcagaatgtgaacttgtttggaaattgggtctttgcagatgtaattagttaagatgaggtcattctggagtagggtgggccctgaatccaatctgactggtgttcttgtaaaagacacaaatacacacagaggaaagaagctcatatgaacacaggcagagattggactgatgcagtcataagtcaaagaatgcaaagaaggctagcagccaccaagagctaggagagaggcgtgggagagactcttgagctttgacagagaacatggccatgctgatgccttgcttttggaaactaatacaattcagggacctcaaaggggtcccgggaacagctctgacgctcctagttcactttaaccatgtacaaaatgactgctcctcctagaggcttaaatgaccaatatattgatgtgaagggagtatatctttctgagctttgcattgggctgctaaaaataaccagcagaggagcccaggcctgacgcctactccctgcctccggaagcgctctttttttctgcctcagttaggagttgcaggaacaggcagtctttggcaagttctgactttggttttctccctactttgaggtttgctactcctttgccaagtttttctaagcacataacgggtgccacagaaattctgcatttgaacagagcagcccatatccacagttctagccaaagctgctaagaagccaagggttttcttttttgctcttcagcctggaatacttttgtcccctcttagcatcctcatttgagttctaccatcatttgtgtgttcaacaggctgagcacctcgtatgtgctccgttgcagctgatccctgccttcatggagcttagcttttcaaggggaaacagacatgaaacagttatgtgatgaatgcaagaagcaaagggcaggactgcgagagaaggatgttgcaggtgtggcagggaagcctctccaagcccctttagactgtgattgaaggaaagaaaagatgcggctgtgtgcagatctgggccagagcctgaagtgggaaacagcttgggaggtgcagcaggaagagccacctggtgggagaggagggccgtgggggaggggttggaggtggtgagcagggttgaagtgggagggccaaggcaaggccagatcgtacatgcagggatccagggaaatgagtatggatttcagccaaagtgaaatagtaagccattggaaggtttttttttaaactttattaagataaaatttacatactgtaaaattctcctaagtgtacaatgcaatgatttgtagtaaatgcacagcgatattccagcatcaccattatccagttttaggattttttttatcacccaaaaaagttttgttatgtaattctattattatttagagacaggatcccattctgttgcccagactggagtacagtggtgcaatcatcgctcactgcagcctcgacttcttgggctcaagcagtcctcccacctcagcctcctgagtagctgggactacaggtgtgtactaccacaccaggctagtttatttatttatttttagatggagtctcactctgttgcctaagctcgagtgtagattgaaatggcctgatcttggctcactgcaacctcagcctcccaggttcaagcgattctcctgcctcagcctcctgagtagctgggattaccggggtgtgccaacacgcccggctaatttttgtatttttaatagacacagggtttcaccatattggccaggctggtcttgaactcctgacctcaagtgatccacccccgttggcctcccaaagtgttaggattataggcgtgagccactgtgcccggcccgaaagtcatttttgtaaaactcttaggaaatggaaacgtcaaaggatcaatttcttctgtccgtgctgtgtatagtatctgttgtgtaaagggctgggagggcattaacagcatcccagaaactggcgttgaggttctgaggggcaggagattctgtcataggctgcgtgtctggtaggtggcccccacgtccagttgggtacattaggggtgcccctcatcccatgtggacttgcagggtggtgtgggggctgccagctgggcagaccagactcaagcacgctcacagcccaaggtcccttccaccagctaagacctggacaaaacatctccaggtgcctcttttttctttttcttcattttttctatttaattcagcaaatattttttaaacatttctatgttccaggctgtatagtaggagccaggcacctgaagaggagcaagacatcgtctgtgccctaaagtcattcacaatctgaaaatagagttgacaagcacacaaacgaagccagagtgagctgccacagagcagtgtagggaatgagatgggcaagtaggtgtgaggaggggaggaggcttcacagaacaagggacaaccttggggaatctttttttttttttgagacggagtctcgctctgccgcccaggttggagtgcagtggcgccatctcagctcactgcaagctccgcctcccaggttcatgccattctcctgcctcagtctgccaagtagctgggactacaggtgtgtgccactacgcccggctaatttttgtattttagtagagaaggggtttcaccatgttggttggccaggatggtctcaatctcttgacctcgtgatctgcctgcctcggcctcccaaagtgctgggattacaggtgtgagccactgcccccagccaatcacggggaatcttaaaggacaaatccaatttaaccagattgggggtgggggcagattcgcaattgcaaaaatgtggaaccagcccaaatgccaatcaatgagtggataaacatcatatatatatgatggaatactactcagccataaaaagaaatgaatgaatggcattcgcagccacctggatgggattggagactattattctaagtgaagtgactcaggaatgggagaccagacatcacacgttctcactcataagtgggagccaaactgtgaggatgcaaaggcataagaatgatacaatggggccaggcgcggtggctcccacttgtaatcctagcattttgggaagctgaggtgggtggatcacctgaagtcaggagtttgagattggcctggtcaacatggtgaaaccccgtgtctattaaaaatacaaaaattaggccaggtgcagtggcacatacctgtaatcccagcacttcgggaggctcagttgggtggattgactgagctcaggagttcgagaccagtctgggaagcacggtgaaaccccatctctgctaaagcacaaaaaattagccaggcgtggcggtgtgcacctgtagtcacagctactcaggaggctgaggcaggagaattgcttgaagccgggaggcggaggttgcagtgagcccagatcgcaccactgcacttcagcctgggggacagagcaagactctgtttcaaataaacaaacaaacaaaaaaacccccaaaattagccgggtgtggtggcgcgtgcctgtaattccagctactcaggaggctgaggcacaagaattgcttgaacccagcaggcggaggttgcggtgagccgagatcgcaccaccactgcactccagcctcaaaaaaaaaaaaaaagttacagtggaatttgggaactcgggtggggaagaatgggaaggaggtgagggataaaagactataaattggtttcagtgtatactgctcaggtcctgggtgtaccaaaatctctcaaatcaccactcacgtaaccaaataccacctattccccaaaaatctatggaaataaaaaatgagaaagaaagagaataggtgaagacccagaaaaagcaaggatactggtgggacattgcccaagtcagtcttcctggctctggtgggtgagggggcagaagcttagccactgagagatgggagtggggaagcagtcatgaaagggtggcttgaactcgccccagctctcaccaatcccttccccgccctctcttgctctctcagacctcattccaagcaacagttctgcagatactgttctcacaactccttcacactaaagctacatgatggagaaagtcttaactcattccgtttcctgtgtatatttacatcttaagaggaaacactttcaaccaggcatggtggctcatggctgtaatcccagcagaggcaggaggattgcttgagcccaggagttccaggccagcctgggcaacacaccaagacccccgtctctttaaaaaaaaaaaaaaaaaaaaaagggccaggcatgctggttcatgcctataatctcggctctttgggacgccaaggcgggtggatcacctgaggtcaggagttcgagaccagcctggccaacatggggaaacactgtctctactaaaaatacaaaaattagccgggtgtggtggcacgtgcctgtaatcctagctactcaagaggctgaggcaggagaaccgcttgaacccaggaggtggcggttgtagtgatctgagattatgctactgcactccagcgtgggtgacagagtcagatcctgtctcaaaaaaaaaaaggaaaaactttaagaacatgatgacttaatggaattacttgtttacagtaggattttataccttgagccgggagccggaaggaatgcacttttgaccaaggattgtggcaggggcacatagagccaccgtgggctgggtgcttccaccaatgagggcctctctctcggggtgtgtatttggggggcagggaaagaaggccttgatgaagccctgaggtggggtttgtgccgggggaacctgcttttccatccctctctcatttaactccaagtcccaagcctcctttcctccctgtcttcctcccacccgctccaaacaatctgcctgtgactggtttttctgctctctgtgctacttgaacaggaggctgtcaggagctgttctgctccaacgaggagaaccattgactcatttgtgggtgctccttgtcttgacctcgagttttgtttcaagccctttggagggttccctctttttttcttttgagacaagttctcgcactgtcacccaggctgggatgcaatggcatgatcatagctcactgcagcctcaatctcccaagtctcaagtgatcctcctgcctcagcctcccaagtagctgggaccacaggcacgggtcaccatgcccagctgatttttgtgtttttttgtggagatggatttttctcatgttgcccaggcaggtctccgaatcctgagctcaggcaatccgcccacctcggtctcccaaagtgctgggattctaggcatgagccactgcgcctggtcatatgagagggcatttgagcagagactggggcaaagtggagtgtgagccacgtggatgtcaggggaaaagtattcagaaagataggagagccttgcaagggacgtgaactccatgtgggctggatgtgtgtgctgagtggataaattccagggagtttttgggctacagttgggctgtggcatgccactgagaaagttctttttgtgtttgtttgtttttgcttttttgagatggagtcttgctctgtcacccaggctggagtgcagtggcatgatcttccctcacggcagtctctgcctcccaggtgcaagcgattctcctgcttcagtttccctagtagctgggattacaggcgagagccaccacgcatggctaatttttgtattttcagtagagatggggtttcaccatgttagccaggctggtcttgaacttctgacctcaagagatccgcccaccttgagaacgttttttttaattttcggtttcacatcgatcctttaaatagaggatcaggctgtgaaccaggtcatcaggacgggtcatctgcttccccacgggtgtggttgggctgcagggaccttgttgctgagactaggaacagctccttgaggcaggtgctgcattagtttctggggctgctgtagcaaggtgccatcaactgggaggcttaaaccacagaaatgtatggtctcaccgttcaggagtgctgggattataggcatgagccaaggattgcctttccttgaaagtgactcatacgctccgctttcctccacagtcatttcaccctctccctggtttggtaactgaagccttctgaaatgaaccagtgtcaggctccagtgaggactccatccccaattcaggaagcacagaggtggagcataatccccccaatttgtttatgtgcggctgacttctctcaagatggtgtgcctgtttgggaaaacttttgtttgcaagacaatgtgaaagaaatccttaaagctcacagactgctgggtggatatgacattctggcccttggttcccccaagaaaacagcaacttgcagatagcaagtcaaacttgtcagcagaatccagggatgttcctcgaggcctgacaagttaagagcaatcatgggaaggcattcagaggaccgcagcagaggatcaggtcaagggaaacctacctcctaaaggaaagatcgagaagaaccatgcgccccaccacccacctgggctgctcagctgggcacagaagcagccaaggatattttcattcggatgctcacatatgactgagttgccacatgaggatgatccgtggcgattttccaccttgaggcaaagcaggacaatgcgtgtaaagaggtttgcagccccgggaccgggttttcagctggtttttctaccccaaagtccaatgcgtgcaggctgtcatcagcaccacagacagcaccagaacccatcataatgtcccagaaggttttattgctaaattagtgtcagagctccagggaacacattcagatatagtcacactgagtcagagctcgagggaagagctgtaagctgggaaccagagaaccgatgacaaggcagcggcctcttctggcagcttccggaggagcccccacttaatgggacgtcatcacttgaggcagcaggtaa

SEQ ID NO: 918 - DNA, 28297 bp, Homo sapiens
gttctttcttacaaatcacatatatttacattgtggatctgggatacacttatcacagtaggagctgctcaaatcaatctgaatgctacgcaatctgggaacctccccataactgtttgagccagcatttcagattatagataagctgtttccagctggactgggtttggaaagttcactctaaagaatgaagtcacctgttgtcactgtcctcctctccaggattccttttggggccaggtaccatcctgtggctccttaaggaggcttctctctttaattctccatgaggcatccagggtggtctgggctatgggaagaacccttcaacttgggagtagacaggtgctccaattcatagtgcccattctcagaggccttgtgtgtgagtttctccttcatgccttccttctggctcttcttgtgctccataatctgctggagctggtgcccagcatagtctggcttggtggtcagcgggccagccggcacagctacaccaaggacatctgacaccatgtaggggcgcagccagcccaccaagggagtgcttccggggctgtagtgggtctgtttgtggtagaagagaagtccatctacctataagacaaggggaaattgaggatcaaatgacttctggggccacatgtttccaggagagcctatacacacaagggcagctcttgtggtccgactcctttttctgggtcactgacagaggaaagagtcccagcttctcacacatgccgtttctctaaataaagaaatggcctagaaaactaaatttgagaaaataaaaacattggctgggcgtggtggctcatgcttataattccagcactttggaggctgaggcaggcagattgcttgagctcaggagtttgagaccagcctgggcaacatggtaagactccatttctactaaaaattcaaaaaaatagccaggcatgtgtggcacatgcctgtaatcccagctactcgggtgtctgagacacgacaaccgcttgaacccagtaggcagaggatgcagtgagctgagactgcaccactgcactccagcctggcgacagagtgagactctgtctcaaaaaaagaaaaaaaaaaaggaaaggataaacataaatagcactttcctgtttacagagtgctttcctgcccactattttactatcttacccatgacggtgtctgagagatggggctgctcatactcagggagttctgaggacctccttaaaacacacagtgagtaggaagcaggacttcaacttgaactctggtcttctgtccccagattccacggactttccaccacttaggggtctgtgttgtggtggatgagctctgtgcatggaatgaaaagcagaggaactggacaggcccctccggggcagcagattgctgcacacagtggaaacaggctgtccagatgccctgcttccctggctactgttggttgcctaaacctccccctaaattgtttgtgagccatgttctgggaaacagtttttctcaacgggaagacctcctacagtcccacattttattttctatgattcagtgactcatctctaaaaagcatttattgtcactggggcataagggttataaataaagatggtattcttaccaccttcttaattgactcccagaaatgctggcaactcagcctttgccatttccttatttgggaagctgtgatccttatataaaattacatccagttcaagcaaatgcttgcagtgactgggcagatttttttttttttttttctttctgagatggagtttcgctcgttgcccaggctgcagtggagtgcggtggtgcgatctcagctcagtgcaacctccgcctcccgggttcaagagattctcctgcctcaacttcccaagtagctgggactacaggcgtgtgccaccatgcctggctaatttttgtattgttagtagagccggggtttcaccatgttggcgaggctggtcttgaactcctgacctcaggtgatccaactgcctcgacctcccaaagtgctgggattacaggtgtgagccactgtgcccggccaaggcagaatttttaagggaatgatgggcaaaggaaaatgtgcttgttgagcctagagaaggtagctgcaggttctgaggctgacaagactgttgaggactggggagcctctggggctgtgaggtttgttttttgttttttttttttgagacagagtcttgtgctgttgcccaggctggagtgcagtggctcaatctcggctcactgcaacctctgcctcccaagttcaagtgattctcctgcctcagcctcccgagtagctgggattacaggcatctgccaatacgcccagctaatttttgtatttttagtagaaacgaggttttgccatgttggccaggctggtcttgaactcctgacctcaagtgatccaccggcctcggccttcccaagtgctgggattataggcgtgagccaccatgcccagccgctgtgagactttcagtgctaaaacagggcgagtcctgagcaaactggaatgaggtggtcacctgactcatgctcctgctcagcaagtgctgctgtccccaagggccatcttctttggtgaggaaaggattagggatttggacatttgttggagtcattcagtcacagaagcaccttcactttacaagcagccacgacagccaaaccagggacctgggtctcagcttgcagtaggaagaggcacacaagaaggatctaggcatgcaagtcttgctcctatctgggcctcagtttctccggacctcagtttctccatctgtaagatgagggagttggacgagctgtccattaagggcccttccagtgccagcattctgacttatccagcatgggtggagctcaggctctgaagggcagcaagtacatcctttctccagaatcagctttgtcccattctgatgctttgacacagcacaatcaaggaatattttaagactttgtgtaactaagtctctctgcagcctatcatcatgtcaaggcaataaagacaatggtttcgttacctcaaaagggaaatccatagatagcacatcacacaggctttcgggagtgcaagggaagttctttagccccacaaatttaaactgaaatagaaattagaacaaggaattagtacgttataaatgatactggcccaagcaattgaaaatctctgtcaggccaggcatagtggctcacacctgtaatcccagcactttgggaggcaaagtcaggaggatcacctgaggtcaagaaatcaagacaagcctggccaacatggtgaaaccccgtctgtactaaaaatacaaaaattagccaggcatagtggcatgtgcctgtagtccaagctacttgggaggttgagggaggaaaatagcttgaacccaggaaggggaggttgcagtgagccatgatcatgccactgcactccagactgggtgacagagcaagactccctctcaaaaaaagcaaaaagaaaagaaaatctctgtcaaagaagaaaaacttgtagtcccagctacttgggaggctgctgaggtagaaggatcgcttgagcctgaggtcaaggctgcagtaagctcagattgtgccactgcaccccagcctgagtgacagagccagaccctgtctcaaaaaccaaaccaaaccaaactaaaccaagccaaaacaaaaaaacaaagaagaaaagttttcagtctcatccttctctactaattcccctctacttactctcttaactactaggtcgtggttcccaatctttcctcccccttttttttaagagatgagatctcattctgtcacccatgctagagagcagtggcacaatcacagctcactgcatcctcaaattcctgggctcaagggattctcccacctcagtttcccagtatgctgggattataggcatgagccactgtacccagccccaaccttcttttatccacaagaatcatctagggagcttttaaaaattactgatactcaggaggctgaagcaggaaaatgacatgaacccgggaggcggagcttgcagtgggccgagattgtgccactgcactccaacctgggtgacagagcgagactccgtctctaaaaataaaaaataaataaaaataaattactgatgctggccaggtgtggtggctcacgcctgtaatcccagcactttgggaggccgagaagggcggatcacgaggtcaggagttcgagaccagtctgaccaatatggcgaaaccccgtctctactaaaaatacaaaaattagccaggcatggtggtacatgccagtagtcccagctacttgggaggctgaggcagaagaatcgcttgaacctgggaggcggaggttgcagtgagctgagattgtgccactgcactctagcctgagcaacagagcaagactcggtctcaaaaaaaaaaaaaaaaatattactgatgcacaggccctactctgagattctgactgaactggtctggggtgggatccaggttttttgttgttttttttgagacagagttgcgctctttcacccaggctggagtgcagtggcacaatcacagctcactgcagcctcaacctcttgggctcaagtgatcctcccacctcagcctctcaagtagctggaactataggtgcacgccaccatgcctaatctgtttttgtatttttttgtagagatggggttctgctgtgttgcccaggctggtctcaaactcctgggctcaaacaatccacctacctcagcctcccaaagtgatgggattataggcacacatcaccatacctggctaatttttttgtttgtatttcttttgtagagatggggttttgccatgttgcccaggctgctccgaactactgagctcaggcagtccacctgccttggccacccaaagtgctgggattacagatgtgagtcactgtgcctggcccaggtattttttttttttgagacaaagtctcgctccctcacccaggctggagtgcagtggcacgatctcggctaactgcaagctcggcctcctgggttcacagcattctcctgctcagcctctcaagtagctgggactataggcgcccaccaccacgaccggctaattttttgtatttttagtagagacggggtttcactgtgttagccaggatggtctcgatctcctgacctcgtgattcgcctgtctcggcctcccaaagtgctgggattacaggcgtgagctaccgcactcggcctggcccaggtattttttttaaagctcttcactgggccgggtgcagtggatcacgcctgtaatcccagcactttgggaggctgaggcaggcagatcacaaggtcaggagatcgacaccatccttgctaacacagtgaaaccccgtctctactaaaaatacaaaaaattagccggtcgtggtggtgggcgcctatagtcccagctactcaggaggctgaggcaggagaatgctgtgaacctgggaggcggagcttgcagtgagccgagatcacgccactgcactccagcctgggtgacggagcgagactctgtctcaaaaaaaaaaaaaaaaaaaaagctctccagctgattttaacatacagtcaggagtgggaaccactgtattgtactaggttgagtggttgtgtgttattctcttggccccatgacagctaccactaataaagggctagtgaaatccttttcacacctgcaaggatttttagactgaagcagcataactaagtgattagaactacaaactctaaagtcagattgcttgggtttgaatcccattctgccaatcatttaacctccatatactttcatcttcccatctgtaaaatgggataacaacagcacatatctacttcgtagggttactgtgtggattcagtgagataatatacatagagcacttaaaccagtgtcttagagagagcagtcttccccttcctcaatgcatgttcctccaggacctacatgataataacatcactgaaagtactgatcatatttattctcctataactggttgtccaattccctttaactttttttttttttttttttttgtgacagagtctcgctctgttgcccaggctggagtacagtggcacaatcttggctcactgcaacctccgcctcccaggttcaagtggttctcctgcctcagcctcccaagtagctgggattacaggcgtgcaccactacacttggctaattgtttttgtatttagtagagacagggttttgccatgttggtcaggctggtctcgaattcctgacctcaaatgatccacctgcctcggcctcccaaagtgctgggattacaggcgtgagccacggcgcctggcccttggctttaacattttttgtgagcaatccaagcaaatgccaatctgcagggctaataaaatgccctgaaaatagctgtcacatatttaaatcactgattattattgagtgcctaccatgagtattatgttaggaggacttgcatatttatataatttggttcttataacaaccctgtaaattagatgttattaccctatttttcagatggaaaatctaagggtaagtgagattattaacttaacttagtaataaattttttttagtctttttttagttattattacttcaataggtttttggggaagaggtagtgtttggttacatgaataagttcttttgtggtgatttctgagatttggtgcacccaccacccaagcagcgtacactgcacccaattatccctcatcccccttacccttccccagagttcccaaagtccattgtgtcattcttatgcctttatatcctcatagcttagctcccaattatgagtgagaacataggatgttaaattagtaataataaaagccaaaaatggaattcagatctacatgattgatactcttccctttataccatgctgcctcaaaaaagatcatttcatacataatgattatatttagataacagaccaatccacactactccccataaggaactcagtgatcctaacaccaggccttacaggattaagcttggttttctctcccagtccttcttcttctggtaactttgaatgcatccagtagaatcggaaatcagtctgccacagagaagggaaacagaaagatgaaatactttccatttcaaactctaatataaacaaaaacaccccatgctatttttttttttttttttttgagatggagtgttgctctgtcacccaggctggagtgcaatggtacagtctcggctcactgtaacctccgcctcccaagttcaagcgattctcctgcctcccaagtagctgggactacaggcgcccactgccacaccaggctaatttttgtatttttggtagagacagggtttcaccatgttggccagagtggtctccatctcctgacctcttgatctctccacctcgagcctcccaaagtgctgggattacaggtgtgagccactgcgcccaccgggcctcttcattcttttaaattattttgcttttggaaatttaaaaagatacatacagtcttttgtttacgttataaaaatatatttggttttagttaccaaatttgtaggttgtgaatacatgtaataaaatatccttcagcagaattaaaggaaaatatgttctagattgaatttatgttctgagttgtaggcttggttctacacgtgggcaaggtacttaagacctgtgcttcttagcatctcagcttccatatctatatgtcaaggacaggccaggtgcagtcgttcatgcccagcacttcggtaggccaaagtgggtggatcacttgaggtcaggagttcaagacagcctggccaacatggtgaaacgccgtctctactaaaaatacaaaaattagctgggtgtggtggcaagcgcctgtaatcccagctactcagaaggcggaggcaggagaagtgcttgaacccaggatgcggaggttgcagtgagcccagatcgcagcactgcactccaacctgggcaacagagcgagactccgtctcaaagaaaaaaaaggatgataatagtacttaccttacaataaggacgtgttgtaagggatttaatgagctaatgcagaaagtgcttagcaatgcacatcttgattgttattgtttgaatgagatgcaccttagaattctgagtaccaatacctagtgtgttttggaaacctagtatgcgggaatggcttagaaagaagcagcctatggtgacagcctgcatgaagatcactggaggcctgttcacacatcagcctcaggcccatttctacaacgttctgatatgcctggtctggagactacacaccgagaaccactatgataaactaattgacagggagcaaaaggaagtaccaaaacccccaaacccaccattatacaactgggacaatgacggggagagtgttcttaacagggatggaggccggtggggctcactcagcctcacctgatgactgctgctgttacctgttaagaatcaccaatagtaaaatgttgggggtatggtgaaacagaaggggagaatattggggcctctcctcctttgaaaagtctcctcctagagctaacctttgagatttgaggttctgggtcataccaaggaggccctgccattttcagggtcaggatgtggttggtgaaggagtggaggttgcaggagtctagtagatggtgacttacattcaattccaccttctcttcctggggctgctgcacaaggtggcatccccacccccttgccccacaatcttcactgccagaaatcctcccatactctggagagagataagggggtgggtgcagctgctatcaagtcccagcctacacccctgccatttctttctttcttcctctcaagaactgcatgtttctcttagttcctcctatttctcttttaaaactaagctaatttaaacacactcaaagatgcagggagcattagataatgttcttgatataccacatcctgtgcacaccaagaagttggtcacataccaaacccacatgctgagccgctttcccaggaggagaggagaagacaggaagagccacgagaggaggatccatccctacctggcaatcataaaaagggtgtccccgccagcacatcacatccagaacgtagtaggtctggtttacctcattgtaaatgcaatctagaatggtgtagtctgaggacacaaagcagaaagtcagcacagagttcttcttccaaccaggttccctccaccacaacctagggagccccatcccagaggcttgagtccaacaatcctcagtgcttgcagcagtcactggcactaaggactaaggattcactggggagagaaccctgcctggctaccagctacagcttcatggtgactcagggtaagacagcacaagacgcatcaaggcaaaccttaagcaaagtgagaattctgaagttttagataaactggcacatttactcacctcaacgaggtttaaaagcaagtcatcttccattttagtttacaactgctttttgagttcctatcataggcactgtgttatgtggggaatattaactataaatattccctgcctttaaggaagttaccatttggttaaggggataagatgatcacagaagaactaagagctaaattacagagctcatactaagagcaacaggagttcccgaaagagaaggctggagcagcaggaaatgcttcaagggagagatgccatacaaatagtcttctgggaccagccgggtttaaacaacagggcagaggggagaagagagggcatttcagacccaagtactgatgtggcatgagcaaagccccagaggcagaatgaactgggcacatgtggggagataagtcagctgaacagaaggtgggtataaggagtaggggaaagacatgggatgggtgggacaaagcctgcatgtgaaaggtactaaacgccaacagagaagtcagagcaaggccaggtgcagtggctcacacctatactcccagcactttgggaggccaaggcaggcagatggctttgagcccaggagtttcagaccagcctgggcaacatggcaaaaccccatctctaccaaaaatacaaaaaattagctgggcatggtggcacactcctgtagtctcagttactcaggaaattgaggtgggaggatcacttgagcctgagaaataaaggctgcagtgagctgtgatcatgcccttgaacccgagcctgggccacagagtgagaccgtgtcaaaaaataaaaaagagaagtctgggctcagtacagaggacatgaggaaccaccaaaggagcctgagcaggtagagaagaaagcaagcccagctctgccaattccttactgaataactgtgggtaagttatttctcccccacgaccttagtctactcagctaggcccagtggggaggaagaacctaaggttacaacaatgagaaaggagaaaagggagtttggcagggaagccccagcatcagctggctgtaccattatgcttagtattctctcagagacgtttccccccaaatctgtatctgttgtcccgtaatagaagtccaaagatatgttgaccttaattcaggaatttacggaccatcaggcctcatggggctgcatttattctgcaactggggacgcttgaccttgaaggggaggtccttggtccaggggccaggatggtgtctacatgcagtttcaaagataagctttcaggccgggtgcagtggcttatgcctgtaatcccagcaatttgggaggccaaggtgggtggatcactttgaggccaggagttcaagaccagcctggccaaaatggtgaaatccagtctctactaaaagtacaaaaattagccgggtgcagcctataatcccagctactcaggaggctgaggcaggagaatcacttgaacccaggaggcggaagttgcagtgagccaatatggtgccactgcactccagcttgggtgacaaagtgagactctgtctcaaaaaacaaaaaaaaaaaacaaagataagctatcaaagtgggtcttttttttttttttttttttttttttgagacggagtctcgctctgtcgcccaggccggactgcggactgcagtggtgcaatctcggctcactgcaagctccgcttcctgggttcacgccattctcctgcctcagcctcccgagtagctgggactacaggtgcccaccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcccaaagtgggtctttaaagcaaattacactgtcttttactgatcaataagtagacactctatgtaggtaccttttgctgttgagtttcgcctgttgcctcctggcagaagtgaagaaaacctgttgacacagtagccactcttggtgtaggcactggtagaaccctgcatggagagaaagttaccattcttattagacctcaaggtctcctcgccctcttgcctcctcattctgcaggaatgttactcgaccaaagatggctctcaacaaaccttcctgcaggaaagtgtttcaagctccactccaggcacagctgttgtggcgtatgaggaaaatggagcacaaagaatccctcccactacagaccaggcctactggcatagggggcaggcagctactcaccctggaggccacgataagggctctttttccaacagggcacacgaccacaatccattcctgccccaaatctgaaggaacgtcaattaaccactcagaaagcatcaactggaaatgcaaaaaatagtgttaaagatcagcaggggtgtgctactcgaaagtctgcaatgacaaggcattaatatcctgtgtgtatattaaaaacctgagtgaaagaatgagggcagagagccgggcacgggggctcatgcttgtaatcccagcactttgggaggctgtggcaggtggatcacctgaggtcaggagttcaagaccagcctggccaacatagtgaaatctcgtctctactaaaaaatataaaaaattagctgggtgtggtggcaggcacctgtaatcccagctactaggaaggctgagccacgagaattgcttgaacctgggaggcagaggttgcagtgagccgagatggtgccattgcactccagcctgggcaccaagagcgaaactctgtctcaaaaaaaaaaaaaaaaaagaatgagggcagaaaaggctgacagtggcacctccaccccatgtgctctagggagttggctgtgtctcctgcacagctgacaggatgatgggggccactgactatgaactttggcttctctcctccatctccacctgcaaccacaccatgcttactgcctcacctcccgggtcagggtgatgaaccctcttcctttccttactttgtccatctgctcctatcatcattactattatgtttgccacaactcagagatgaataagatccctgaccttgagatgctcttagactagaccagcatttctcaaaccgatgccccaaatactatactacaggatgttaggaaatctgtcttaaaaaacgaaacaacgccaaaccaaaccaacaaaaacagtgatgtggtgaaattaatttgggaagacaaactcttccactcagtctcttccatctgtaaagactttgtcccatgggctgggcgaggtggctcacgcctgtagtcccagcactttgggagaccaaggcgggcggatcacgaggtcaagagattgagaccatcctggccaacatggtgaaaccccgtctctaccaaaaatacaaaaattagctgggcgtgttggcgggcacctataatcccagctactcaggaggctgaggcaggaaaatcgtttgaacccaggaggcgcaggttgcaataagccaagatcacgccactgcactccagcctggtgacagagtgagacttcgtctcaaaaagaaaaaaaaaaaaagactttgtcccatcaattaatctctctcattgaatctttcatttctccttccctttaggcactcactcccaatctttttttttttgagatggagtctcgctctgtcgcccaggctggagtgcagtggcgctatctcagctcactgcaagctgcgcctcccgggttcacgccattctcctgcctcagcctcccgagtagctgggactacagtcacccgccactgtgcccagctaattttttgtatttttagtagagacggggtttcaccgtgttagccaggatggtctcgatctcctgacctcgtgatccgcccgcctcggccccccaaagtgctgggattacaggcatgagccaccacgcccggctcactttaaaaaaaaactttttgtggccaggaacggtggctcacgcctataatcccagcactttgagaggctgtggcgggcagatcatgaggccaagaaatcgagaccatcctggccaacatggtgacaagccgtctctactaaaaatacaaaaattagccaggcgtggtggcatgcacccgtagtcccagctactcgggaggttgaggcgggagaatcacttgaagctgggagatggaggttgcagtgagccgagatagcaccactgcactccagcctggcgacagagcgagaccccgtctcaaaaaaaaactttttgtcactcagcatttctgttgagctactccactttctcctagtttaaaaactacttaatacttcttgatgctgccttcttgctcaatctgacagccacagtccagatttcctaccccacagtcctactgaaggccctctgacctcttctcataactcttcctttttttcctttttttttttttgaactggagtcttactctgtcacccaagctgaagtgcagtggcacaatctcggttcactgcaacctccacctcccgggttcaagcgatcctcccattttagcctccctagtagccgggactacaggcacacgccactacgcccggctcatttttgtatttttagtagagacagggtttcaccattttggccaggctggtctcgaactcctgacctcaggtgatccacccacctcggcctcccaaagtgctgggattacaggtatgagccactgtgcctggcctcccatacctctttcttatcctccccactctactcctcgccttacgtaatgctaccagccacatctcccttcctgacatccgttcccttggcaccatgacatagcactactctgtttttccctctaaacattcctccacacactcccccaaaatatgtaatcttcagggggctgttttaggtcccccttttctcttagatgctgttcccattaggggtggatctcatctatttctatagcttcacttgtgcctcctaatgctccttcatctccagacttctttcctccacactcatctatattgcgagatgtctgcttggtatctctttctgtttgtctcctctgcaccgaaaactcagtatatccagagtggaattaactgccttctgttgcctaagtacttcccacccctgaaacacctacccttcccttctgcgtctcataaccttgttaatggcatcaccactccgttactgaatcttagagtttaagcataatctaggcaaattagactacatcaaaatttaaaaattctgtgctgccaacaatatcaccaagaagacaaaaagacaacccacagaatgaaagaaaatatgtgcaaatcatgtatctgataagaaacttgtatctagaatatattaaaaactcttataattcaataataaaaagataaataactcaattaaaaaacaaggagggcagatcatgaggtcaggagatcgagaccatcctggctaacacagtgaaacctcgtctctactgaaaatacaaaaaaaattagccgggcgcggtggcgggcacctgtagtcccagctgttcgggaggctgaggcaggagaatggcgtgaacccgggaggcggagcttgtagtgagccaagatcgcgtcactgcactccagcctgggcgacagagcaagactccatctcaaaaaaaaaaaaaaaaaaaaaaaagagcaaaggatttgaatagacatttctccaaagaagatatacaaatgaccaatacgcacaagaaaagatgtttaacatcaggccaggtgcagtggctcacacctgtaatcccagcactttgggaggccgaggtgggcggatcacaaaatcaggagttcgagaccagcctggtcaatacgctgaaaccccgtctctactaaaaatacaaaaattagccggaagtggtggcgggtgcctgtagtcccagctactcgggaggctaaggcaggagaatcgcttgaacctgggaggcagaggttgtagtgagctaagatcgtgctattgcactccagcctgggcaagagagggagactccaactcaaaaaaaaaaaaaaagaaaagaaaagaaaagatgtttaacatcattagtcactagggaaatagggaaatacaaatcaaaaccacaagaaaccacttcacacccactaggatggctatatttaaaaggatggacaataacaagtgttggcaaagctgtggagaaattggaacacttatatgttgctggtgggaatgtaaagtagtggagtcactttggagaacagtctagcacttcctcaaaaggttaaacagagttatcatatatagacccagcaattccacttctaggtatatacacaagagaaatgaaaacatatgctcacacaaaaacttgtagtacaagaatattaataatggcattatttggctgggtgcagtggctcacacctgtaatcccagcacattgggaggccaaggcaggtggatcagctcaggtcacaagttcgagaccagcctggccaacatggtgaaactcccgtctctactaaaaatataaaaattagctgggtgtgatggcacacacctgtagtcccagctactagggaggctgaggcaggaagatcacttaaactcaggagatggaggttgcagtaagccaagaacatgccactgtactccagcctgggtgagagagtgagacttcatctcgaaaaaagtaaataaataaaattaattaaaaaacaaataaaaatggcattattcataatagccaaaaagtaggagcaactcaaatagccataaactgaagaataaataaacaaaatgtagtctatccatacagtggaatattatttggcaataaaaaggagtgaagtactgatacatggtacaatatgatgaacgttggaaacctcatgctaagtaaaagaagccagtcacaaaagtccacatattatatgattccctttctatgaaatgtgcaaaataggaacagaaagtagattaatgattaggggctacagggaagaatggagagtgacactaattagtatggggtttcttttggggataaggaaaatgttctagaattaaatagtcgtgatggttgcacagtcttgtgactacactaaaaaaaaagaaaccattaaactatacaataaaaataggcaaattgtatggtatgtgaattatatctcaatataactgtctaaaaaatagtagtagcagctaatacttgtggggcacttccagactctgggctaggtatttaaggcatattatttcatttaatccttctaccaatcctatgagataagtactattactatccccattttacagataagaaaccaaagacttagagtggctaaaataccttgcttaaggtcaacacagagcctagctttgagatcagatctgtgtgacctcaaagcttacatcctttcccacttcttatactgcctctcatatccagtccactgctaagttcttccattctatctggcaacatttcttttttatttgttttatttattttttattttttatagaaatgggatcttcctatgctgtccagctgggattacagacacccatcacacctggctaatttttgtatttttaatagatggggtttcaccatgttggccaggctggtcttgaactcctggccttagcctcccaaagtgctgggattacaggcatgagccactgtgcccagcctctgcacatatttttgaggccctttacatctcttctgccatactccttctcccaactctatgccactctaccctaactggcctgcaaactgctcccgggcacaccatatactcctttctggcttctgggcctcgtgctcagcctgtttgttcccactgcctggaatgccctaaaatgcactgcacttctatctattaatgtcctacttacccttcaaggctgcctcttccttcattaacccttctctgatttcacaccccctccttcctccttggttggaaggaatctcatttttttttttttttttttttttttgagacggagtctcgctctgtcgcccaggctggagtgcagtggtgtgatctcggctcactgcaagctccgcctcccaggttcacaccattctcctgcctcagcctcccaagtagctgggactacaggcgcctgccaccaccacgcctggctaattttttttttgtatttttagtagagacggggtttcaccatgttagccaggatggtctcgatctcctgacctcgtgatccacccgccttggcctcccaaagtgctgggattacaggcgtgagccactgcacctggccagcatctcacttttttatagcacaaaacatcttctacacctattctaggagcacaggggctatttctgctccacatctatcttcccatgtcatagcctagtttaacacagagcaggtctttcaataatgcttactgaacaaaattgaattgtactttgtcacagaggatgttatctgtactgtatttggggtaaagaaaggggctgtgggagtgcatccaataaccatattctattgtgtttttttttttctttagagatggggtctctccgggtgcagtggctcactcttgtaatcccagcactttgggaggccgaggggggtggatcacctgaggtcgggagttcgagaccaacctgtccaccatggtgaaaccctgtctctactaaaaatacaaaaacttagccgggtgtggtggcaggcatctgtaatcccagctactcgggaggctgaaacaggagaactgcttgaacccgggaggcagaggttgcagtgagccacgatcgtaccactgcactccagcctgggcaacaagagcaaaactctgtctcaaaaaagaaaaaaaaagagatggggtctcactatgttagccaggttggtcttgaactcctggcttcaagtaatcctcccaccttggcctcccaaattgctgggattacaggtatgagccaccacactcaggcccaggaaccatattctaaaggcaggggagaattctgagatgacaagatacttgggttctagacacaagtatatgatagcagggtagacctccatcccaacttggacccataccctgctttctgaaatacctgagctgcctggaacacaagaacagtctctctccatacctctttccctatggtaccacagccatgttggtttcctctctggatctaaaagggcactgagtcaggtttattatagtgatctgctgcttcatggcctgaacctcaccttggccagctggctggtctggggtggctgggcaggctcactttattcaagggcagctgtacttcccacttgccaccacctgagtgtgaaatttcaagactggcctcatagtacactgcctgggaaagactctaccacccagggaagtggaaggagtcagtggtaggctgggcaggcccaatccagaacagctgtgcagtgacaactaaaaaaaatgacaaggatatggagtgtgttactatatcaatagctcaggggctttctgcagtgggctggcagcctttggtaacagcacaggctaatagttcccaaaccccactacccacagattccatcagtgattcctagtcagtccatagcacagtaagccatctctacttatcatcccatatgatctacgtacactggcatgttctttgcagttcctattcctttttcctgcctcattctcctctctttatgacagcatttatttcagtgggctttgactgcatagtaaagggagtgagattagctgggtctcatcttctctggaccacttacttgattagcatagtgttttggtaacttcttgacagtgtcaatgtccatttcttcatcatctttcttattttcttcctcactctccatccctgtccagtcatcttcagccagtcttctggcatggttcacataatccagccgcttgctggaaggaaaaaaaaggcataaggacatatcttttcttctttttttttttttagacagggtctcgctctgttgcccaggctggaatggtgcaatctcagctcactgcagcctcaacctcctgggctcaagtgatcttcccacctcagcttccacagtaggtgggactacaggcacacaccaccacccctggctaatttttgtattttttgtagagatggggtttcaccatgttgcccaggctggtctcaaactcctggcctcaagtgatctgcctgcctcagcctcccaaagtgctgggattattaggcatgaaccaccgcatctggccagggcaggtctttatgtcttttaggaagatgccctataatgcgacacatttaattcaaaagctccaaatttgggagcaacttggggattctggtggaagtaagaaatgatggaatctcctttgcaaggctaaaacagtgaccgccccctcaaaatcctaaatagcgaaaccccctctgaatacactcagccttcctcagagtttcctaagaatgcaaaataaaatatctaaagaaatttccaaggttcactagatggaaaggctagcttcacccctaccccatcccaccccagatgagagctgacaccttcctgcctagcagacatctcatccaaagaccccaggggtggaagagaagagccactgagatgcagtgagaagtctaaagcaaggacagcttctggagatttctgccttatacaccttttttgtttttaaagagaacttttttttttacggaccgtaggtgtatgccactgtgcccagcttatacagctttctcagaagccaggcctttctccagttcctgtctaactttcaaaaaaggtcacttagtttacaatttaatatattttatttatttgtttccctttatcgttatcttgttttaaaacaacacatgctagaaagtttgggaaactgaaaagaaaaaaaaagaatcttttggaacctaattgtttcaaagtgatttggaaataccacataacctcccacatttgatttcttcaatgctaaggcaggaattcaaccactgaggcagtgaaaccaacacagctggtttctcttaaacacatacatgttcatgctcattataaaaaggcacacaccagagagaacatatgaaagcacaatggtcttttatctcgagaataaaagagctggtatatttgtacatgtgtgaaagaaagtctgtctgtggttatttcctgaacattgtttgtaatcacaagagaagaaaactgcccagatgcccatcaggagggactggcttgatggcattatgaagtatccattccacggaatacctagcaccacgaaaaaggaatgatgtggtactttatgaactgatatagaatttctcccccaaaacaccactaaataaatgtgcagaacagtatatagtatactgctacttgtgttaaaaaaaaaaaaaaaaaaaaaaaaaaaagccaggtgcagtggctcctgcctgtaatcccagccctctgggagggtgaattggccagatcacttgagctcaggagttcaagaccagcttgggcaacatggtgaaattgtgtttctaccaaaaataaaaaaattagctgggtgtggtggcctgcaccagtggtcccagctacttgaggggctgaggttgcagtgagccaagatcatgccacagtactcagcctgggagatagagtcaaaaaaaaaaaaagcttttgtacacatactaccacacacacttgctcatatatgtatagaatatcttcggaagggccaggcgtagtggctgacgtctgaaatcccagcactttgggaggtcaaggtgggaggatcagttgagcctaggagttcaagatcagcctgagcaatatagggagaccctgttcctacaaaatataaaaaaattagccaggtgctatggagtgtgcctgtagtcccacctacttcagaggctgaggtgggaggatcacctgagcctgagaggttgaggctgcagtgagccgggatctgcacactccagcccgaacaacacagtgacaccctgtctaaaatatatatatatttggaaggatacaccagaaactaataatataggagaggaactggatagctaggggacagaaatgggaagacctcaccatatactcttctatttattttatttatttatttatttattggagagagtctagctgtgttgcccaggctggagtgcaatggcgcgatttcggctcactgcaacctccacctcccgggttcaagtgattctcctgtctcagcctcccgagtagctgggactacaggcacgcaccaccatgtcgggctaatttttgtatttttagtagagacaagttttcgccatgttggtcaggccagtctcgaactcctgacctcaggtgatccacccacctcggccacccaaagtgctgggattacaggcgtcagccaccatgcccggcctcttatgtatattttaaattttcaaccatacaaatgtattacctattcaaagataactacatttttaaaaatggggagaggaatgatctgggaatgtattctgcaagccacccagagccacagggaaccatctctgccaaacacaaccagtgatgcaacactgggcaaaatgcagactgtatggaaactatgcagctgttagtagtttcttctgatccctaattccttaatttatgacccagaagaggcccatgctgcattgagaatacaaggatcggccctgccttcagagtagctcagcctcaaacactcttatcctgccctctttccctgtttgcacatcttggcacttagaattaagtatatggaagacatttcctcagattcccttaggaattatttgtcttgaactcccaagagtgccacagaaacatttgggctgaaggcagatgggaagaccacaccaataccagcattcagagtgcagaagccaaacacaagcatcccaggaaatgtggggagtgaaagtctgggcgtggctttcgcaagttcctaaaccacagagctcagtacagctgccaggaaaaaaagaaaaacttaaccaaataattgagcttttggtttcaaacttcggtgtctccctaattcctcatcttctcctaagctctgggtataaaagaaacctacctctgccaggatttacccctcccaacctgtgggcaagaagatcagcctacaaagagtctactttgaagggagagtctgtagagacaagcctagagccttcggaatggttcatagctcctagcccagagaaagaagacaaggagttaaagcttccttacgatttctgcagttccagtaacctccggcggcgctcactctgctccaaggaactgtacttggacttgtactgggataggcgggggtgtggggcagctgtgctgttcagatcttgagacacagaaaagctactagccagggcctgactcaactcttccatcttccctacaaaggaaaacgtaagaaaatggttcattcatttcatatcatctcctgtatacagacagttatgcagttatgatatgatggccacattcctgaaaaaaaattaacttaatgcaaaatcacaagtgtttccatgagacaaaaggaagttaaagggtaaatgagtcatatattagcaataacattattttcctacagatatttccttttttttttttttttgagacagggtctctctctatcacccaggtcggagtgtagtggtgcaatcacagctcactgttgcctcaatctactggacccaagcaatcctcccacctcagcttccccagtaactgagactacaggtatacaccaccacacccagccaattttaaaatttattggtacagacgggatctccctatgttgcctaggctagtcttgaactcttgggctcaagcaatcttccctcctcagcctctcaaagtgctggcattataggtgtgagccactgcgcccggccttttctgagcagttcctctacagtttcctgaatagccatcactcattaaccaatataactctccatgcagtttattcaattggttatttaattctcaactaagtgccaactcatattatgaaaatttaattccagaggaaacactggttctagggtccctggaggaagacaaaagcaatcaaaaaccccaaactcgccaggcacgatggctcatgcctgtaatcccagcactttgggaggccgaggtgggtggatcacaaggtcaggagttcgaaaccagcctgaccaacatggtgaaaccccgtctctactaaaaatacaaaaactagctggatgtggtggcaggcgcctgtaatcccagctactcgggaggctgaggcagaagaatcgcttgaacctgggaggcggaggttgcagtgagccgagatcgtgccactgcactccagcctgggcgacacagcaagacttcatctcaaaaaacaaacaaacaaacaaacaaaaaaacaaactctagcgacctgggattacaggtggctcatgcctgtaatcccagcactttgggaggccaaggcaggaggatcacttgaggccagtagttcaagaccaacctggacaatgtagtgagactatgtctctactttttaaataaaaaagtaaaaaattattttaaattataatttattttttaaaaaatctgattgttacttcctcatattctagttgtgttttgtttttgggtgggcagaaagaaggtttcagggctacttatgtgggactcacttggaaaagagctaggatgtggaaggctgcttaacaagtaacgtcaatgctccagtagtgtgaagaacttccataaagtacattagggaaacaagacaggcatggagtagatgtcattttgaaaacagacttcccactttaggtggaccctaaagaatgggagtggggagaaaggtgaattcacacttcattcaagcgcctgtgagccttagattataagaaaacaggaacatttgggagaaatctgacttgcactgctgggctggcccagccctttggttctagtgtaaaccagagggcacctccagtgcttaacctccatcccaggccaggtccagtgctctgagcatcaaaatcaacaggttcattccagagcctctacagtgaaaaatacaactccataggcctctacttggccagtgagttactttccattgcacaagtgaagtcagatatttttcttgatttgaaacattagattttgtttaatttaaaaggaacttaaaaatcgtggtttgccaggtgcagttgtgcttgcctttagtcccagctactctggaggctgaggcaggaggtatgcttgagcccaggagttcgaagccagcctgggcaatatagcaagaccttgtctgtaaaaagaaaaaaaaattgtggctaaatacacatatcatgaaattcatcatcttaaccatttgtaggtgtacagttctgtaaagttaagtatgttcaacactgctgtgcagaactctccagaactccttttatcttgaataactgaacctctgtaacctttaaacataaaagaaacttttttttttttgagacagagtttcactcttgttgcccaggctggagcacaatggcacgatcttggctcaccacaacctccgcctcccaggttcaagtgattctcctgcctcagcctcccgcgtagctgggattacaggcgcccgccaccacgcccggctaattttgtttttgtattttttagtagagacggggtttcaccgtgttagccaggatggtctcgatctcccgacctcctgatctgcccaccttggcctcccaaagtgctgggattacaggtgtgagccaccacgcccggccttttttttttttttgagacagggtctcactttgtctcccaggctggactacagtggtgtgatctcggctcactgcagcctccacctcctgggttcaagtaactctcctgcctcagcctcctgagtagctgggattatagacatgcaccaccatgctcggctaatttttgtatttttagtagagaagaggtttcattatgttggcgtggctggtctgaaactcctgacctgaagtgatctgcctgcctcagcctcccaaagtgctggaattacaagcatgagccactgcacccggcttgaggtgtgccttaatatctttgcaatgcaaccaagggttgccattcctgagtgactgaggcctcatgatgagtgcttgggatccatatggtatgttattcaaatcatccataatggtatgtatgctattgtctctacttttctgtacttttgtgtaagtttgaaagctttcatgataaaattttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttcagtagagacggggtttcaccgttttagccgggatggtctcgatctcctgacctcgtgatccgcccgcctcggcctcccaaagtgctgggattacaggcgtgagccaccgcgcccggccgataaaaatttttaaaaagtcattatgttttcagttcatcaccaaagtaatgaccaaatccaaagcacctttattaggcctatcatgcactatcttggtgtgggctcccgctctgccaagaaccacacaacctttgaaactgatgtcctgggcctggcgcggtggctcacgcctgtaatcccagcactttgggaggttgaagcgggcagatcacctgaggttaggagatcgagaccatcctggctaacacagtgaaaccccgtctctactaaaaaaaaaaaaaaaaatacaaaaaaattagccaggcatggtgacgggcgcctgtagtcccagatgctcgggaggctgaggcaggagaatggcttgaacccgtaaggcggagcttgcagtgagtcgagatcgtgccactgcactccagcctggacttcgtctcaaaaagaaaaaaaaaagaaaaactgatgtcctggatactggggcggttcctttaccttccttcaaggctgttcttggcgggttcctgctgtttcgttttgttttttctttgttgttgttgttttttttttgagacagagtttcgctcttgttgcccaggctggagtgcagtggcatgatctcggctcactgcaacctccatctcccggattcaagcgattctcctgcctcagcctcccgagtagctgggattacaggcacgcgccacaacgcccggctaattttttttgtatttttagtacagatggggtttcaccatgttggtcaggctggtctcaaactcctgacctcaggtgatccgcccacctcggcctcccaaagtgctgggattacaggcgtgagccactgcgccccgccgggctcctgctgtttcaacccattccttggatggtgctgcctccaagtgttcggaccttagccccaggtggtcttagcaccagtaacccccgctccaactccctaaagtccgacccgccccaggccccgcccacgctccaccctccctccctgtctagccccctcccccatccccttccccctccttcgcgtctccccatccggcgcccccgcctcgcgtcccctgggtccgcatcctggcagcctccgcgtttccctacccctgctaccgggctccagccccggggacgctatctgcttcactcggccgtgcgcgccgccaccgccccgcactgcctttttctaggcatggggtcatctaggccatgcatgattcgcccctgccccacagaagtccctgaggggtcctggccggacagcacggaatagaagaacggaaactctcccaaaaggagtcccaggcctggctctatccctccagatgacgtcccaggaggccagagtgcagggccggccagagggagtcacagtccggcaccgagaggcaactcggcagctggcggggcccgggctcgaacccagggactcacccaaaccgaggtgaccgtcgcacgcgccgccgccaccggggccgacgaatcacctgccctgggaagctaggtccgccctccccccgcccccagctgctgcctcaccgctgggcccacaggcctcgcgccctgagtttccggctcctccctcctttgcgaacgctgggagttccgttgcctacaggccgttatttccgccttcaacggctggggcatttcccatcggctagggagggggtcttcttgcatttgctttgcactgtccgggactcttcctgctagatgacttgaccaggccgaggcctccctcctgaacacaagctcttcggggctcctttcgccaatgggaggaggctgatcttgtggccgggcattcaacgccctgggccctgccgcctcccgcagatcttcccgggccttagggcttcacctggagtccccttcccctcttgggcccgtgctcttaaacgggcagtgccaattgcctggattactccaactaacccctcacacccaagtttcagacacagaccttcgctcccccacttgcccttaacaaaagcagatacatacctcgattactgcctgtttgctgcttttgcgagcttctttcccactcggctgcgggctgagcaatggtagggacctggcttgattcctatttaagtagccagagtccagcacaagggatggcgctcagtagaccctgcgtg

SEQ ID NO: 919 - DNA, 28024 bp, Homo sapiens
gttctttcttacaaatcacatatatttacattgtggatctgggatacacttatcacagtaggagctgctcaaatcaatctgaatgctacgcaatctgggaacctccccataactgtttgagccagcatttcagattatagataagctgtttccagctggactgggtttggaaagttcactctaaagaatgaagtcacctgttgtcactgtcctcctctccaggattccttttggggccaggtaccatcctgtggctccttaaggaggcttctctctttaattctccatgaggcatccagggtggtctgggctatgggaagaacccttcaacttgggagtagacaggtgctccaattcatagtgcccattctcagaggccttgtgtgtgagtttctccttcatgccttccttctggctcttcttgtgctccataatctgctggagctggtgcccagcatagtctggcttggtggtcagcgggccagccggcacagctacaccaaggacatctgacaccatgtaggggcgcagccagcccaccaagggagtgcttccggggctgtagtgggtctgtttgtggtagaagagaagtccatctacctataagacaaggggaaattgaggatcaaatgacttctggggccacatgtttccaggagagcctatacacacaagggcagctcttgtggtccgactcctttttctgggtcactgacagaggaaagagtcccagcttctcacacatgccgtttctctaaataaagaaatggcctagaaaactaaatttgagaaaataaaaacattggctgggcgtggtggctcatgcttataattccagcactttggaggctgaggcaggcagattgcttgagctcaggagtttgagaccagcctgggcaacatggtaagactccatttctactaaaaattcaaaaaaatagccaggcatgtgtggcacatgcctgtaatcccagctactcgggtgtctgagacacgacaaccgcttgaacccagtaggcagaggatgcagtgagctgagactgcaccactgcactccagcctggcgacagagtgagactctgtctcaaaaaaagaaaaaaaaaaaggaaaggataaacataaatagcactttcctgtttacagagtgctttcctgcccactattttactatcttacccatgacggtgtctgagagatggggctgctcatactcagggagttctgaggacctccttaaaacacacagtgagtaggaagcaggacttcaacttgaactctggtcttctgtccccagattccacggactttccaccacttaggggtctgtgttgtggtggatgagctctgtgcatggaatgaaaagcagaggaactggacaggcccctccggggcagcagattgctgcacacagtggaaacaggctgtccagatgccctgcttccctggctactgttggttgcctaaacctccccctaaattgtttgtgagccatgttctgggaaacagtttttctcaacgggaagacctcctacagtcccacattttattttctatgattcagtgactcatctctaaaaagcatttattgtcactggggcataagggttataaataaagatggtattcttaccaccttcttaattgactcccagaaatgctggcaactcagcctttgccatttccttatttgggaagctgtgatccttatataaaattacatccagttcaagcaaatgcttgcagtgactgggcagatttttttttttttttttctttctgagatggagtttcgctcgttgcccaggctgcagtggagtgcggtggtgcgatctcagctcagtgcaacctccgcctcccgggttcaagagattctcctgcctcaacttcccaagtagctgggactacaggcgtgtgccaccatgcctggctaatttttgtattgttagtagagccggggtttcaccatgttggcgaggctggtcttgaactcctgacctcaggtgatccaactgcctcgacctcccaaagtgctgggattacaggtgtgagccactgtgcccggccaaggcagaatttttaagggaatgatgggcaaaggaaaatgtgcttgttgagcctagagaaggtagctgcaggttctgaggctgacaagactgttgaggactggggagcctctggggctgtgaggtttgttttttgttttttttttttgagacagagtcttgtgctgttgcccaggctggagtgcagtggctcaatctcggctcactgcaacctctgcctcccaagttcaagtgattctcctgcctcagcctcccgagtagctgggattacaggcatctgccaatacgcccagctaatttttgtatttttagtagaaacgaggttttgccatgttggccaggctggtcttgaactcctgacctcaagtgatccaccggcctcggccttcccaagtgctgggattataggcgtgagccaccatgcccagccgctgtgagactttcagtgctaaaacagggcgagtcctgagcaaactggaatgaggtggtcacctgactcatgctcctgctcagcaagtgctgctgtccccaagggccatcttctttggtgaggaaaggattagggatttggacatttgttggagtcattcagtcacagaagcaccttcactttacaagcagccacgacagccaaaccagggacctgggtctcagcttgcagtaggaagaggcacacaagaaggatctaggcatgcaagtcttgctcctatctgggcctcagtttctccggacctcagtttctccatctgtaagatgagggagttggacgagctgtccattaagggcccttccagtgccagcattctgacttatccagcatgggtggagctcaggctctgaagggcagcaagtacatcctttctccagaatcagctttgtcccattctgatgctttgacacagcacaatcaaggaatattttaagactttgtgtaactaagtctctctgcagcctatcatcatgtcaaggcaataaagacaatggtttcgttacctcaaaagggaaatccatagatagcacatcacacaggctttcgggagtgcaagggaagttctttagccccacaaatttaaactgaaatagaaattagaacaaggaattagtacgttataaatgatactggcccaagcaattgaaaatctctgtcaggccaggcatagtggctcacacctgtaatcccagcactttgggaggcaaagtcaggaggatcacctgaggtcaagaaatcaagacaagcctggccaacatggtgaaaccccgtctgtactaaaaatacaaaaattagccaggcatagtggcatgtgcctgtagtccaagctacttgggaggttgagggaggaaaatagcttgaacccaggaaggggaggttgcagtgagccatgatcatgccactgcactccagactgggtgacagagcaagactccctctcaaaaaaagcaaaaagaaaagaaaatctctgtcaaagaagaaaaacttgtagtcccagctacttgggaggctgctgaggtagaaggatcgcttgagcctgaggtcaaggctgcagtaagctcagattgtgccactgcaccccagcctgagtgacagagccagaccctgtctcaaaaaccaaaccaaaccaaactaaaccaagccaaaacaaaaaaacaaagaagaaaagttttcagtctcatccttctctactaattcccctctacttactctcttaactactaggtcgtggttcccaatctttcctcccccttttttttaagagatgagatctcattctgtcacccatgctagagagcagtggcacaatcacagctcactgcatcctcaaattcctgggctcaagggattctcccacctcagtttcccagtatgctgggattataggcatgagccactgtacccagccccaaccttcttttatccacaagaatcatctagggagcttttaaaaattactgatactcaggaggctgaagcaggaaaatgacatgaacccgggaggcggagcttgcagtgggccgagattgtgccactgcactccaacctgggtgacagagcgagactccgtctctaaaaataaaaaataaataaaaataaattactgatgctggccaggtgtggtggctcacgcctgtaatcccagcactttgggaggccgagaagggcggatcacgaggtcaggagttcgagaccagtctgaccaatatggcgaaaccccgtctctactaaaaatacaaaaattagccaggcatggtggtacatgccagtagtcccagctacttgggaggctgaggcagaagaatcgcttgaacctgggaggcggaggttgcagtgagctgagattgtgccactgcactctagcctgagcaacagagcaagactcggtctcaaaaaaaaaaaaaaaaatattactgatgcacaggccctactctgagattctgactgaactggtctggggtgggatccaggttttttgttgttttttttgagacagagttgcgctctttcacccaggctggagtgcagtggcacaatcacagctcactgcagcctcaacctcttgggctcaagtgatcctcccacctcagcctctcaagtagctggaactataggtgcacgccaccatgcctaatctgtttttgtatttttttgtagagatggggttctgctgtgttgcccaggctggtctcaaactcctgggctcaaacaatccacctacctcagcctcccaaagtgatgggattataggcacacatcaccatacctggctaatttttttgtttgtatttcttttgtagagatggggttttgccatgttgcccaggctgctccgaactactgagctcaggcagtccacctgccttggccacccaaagtgctgggattacagatgtgagtcactgtgcctggcccaggtattttttttttttgagacaaagtctcgctccctcacccaggctggagtgcagtggcacgatctcggctaactgcaagctcggcctcctgggttcacagcattctcctgctcagcctctcaagtagctgggactataggcgcccaccaccacgaccggctaattttttgtatttttagtagagacggggtttcactgtgttagccaggatggtctcgatctcctgacctcgtgattcgcctgtctcggcctcccaaagtgctgggattacaggcgtgagctaccgcactcggcctggcccaggtattttttttaaagctcttcactgggccgggtgcagtggatcacgcctgtaatcccagcactttgggaggctgaggcaggcagatcacaaggtcaggagatcgacaccatccttgctaacacagtgaaaccccgtctctactaaaaatacaaaaaattagccggtcgtggtggtgggcgcctatagtcccagctactcaggaggctgaggcaggagaatgctgtgaacctgggaggcggagcttgcagtgagccgagatcacgccactgcactccagcctgggtgacggagcgagactctgtctcaaaaaaaaaaaaaaaaaaaaagctctccagctgattttaacatacagtcaggagtgggaaccactgtattgtactaggttgagtggttgtgtgttattctcttggccccatgacagctaccactaataaagggctagtgaaatccttttcacacctgcaaggatttttagactgaagcagcataactaagtgattagaactacaaactctaaagtcagattgcttgggtttgaatcccattctgccaatcatttaacctccatatactttcatcttcccatctgtaaaatgggataacaacagcacatatctacttcgtagggttactgtgtggattcagtgagataatatacatagagcacttaaaccagtgtcttagagagagcagtcttccccttcctcaatgcatgttcctccaggacctacatgataataacatcactgaaagtactgatcatatttattctcctataactggttgtccaattccctttaactttttttttttttttttttttgtgacagagtctcgctctgttgcccaggctggagtacagtggcacaatcttggctcactgcaacctccgcctcccaggttcaagtggttctcctgcctcagcctcccaagtagctgggattacaggcgtgcaccactacacttggctaattgtttttgtatttagtagagacagggttttgccatgttggtcaggctggtctcgaattcctgacctcaaatgatccacctgcctcggcctcccaaagtgctgggattacaggcgtgagccacggcgcctggcccttggctttaacattttttgtgagcaatccaagcaaatgccaatctgcagggctaataaaatgccctgaaaatagctgtcacatatttaaatcactgattattattgagtgcctaccatgagtattatgttaggaggacttgcatatttatataatttggttcttataacaaccctgtaaattagatgttattaccctatttttcagatggaaaatctaagggtaagtgagattattaacttaacttagtaataaattttttttagtctttttttagttattattacttcaataggtttttggggaagaggtagtgtttggttacatgaataagttcttttgtggtgatttctgagatttggtgcacccaccacccaagcagcgtacactgcacccaattatccctcatcccccttacccttccccagagttcccaaagtccattgtgtcattcttatgcctttatatcctcatagcttagctcccaattatgagtgagaacataggatgttaaattagtaataataaaagccaaaaatggaattcagatctacatgattgatactcttccctttataccatgctgcctcaaaaaagatcatttcatacataatgattatatttagataacagaccaatccacactactccccataaggaactcagtgatcctaacaccaggccttacaggattaagcttggttttctctcccagtccttcttcttctggtaactttgaatgcatccagtagaatcggaaatcagtctgccacagagaagggaaacagaaagatgaaatactttccatttcaaactctaatataaacaaaaacaccccatgctatttttttttttttttttttgagatggagtgttgctctgtcacccaggctggagtgcaatggtacagtctcggctcactgtaacctccgcctcccaagttcaagcgattctcctgcctcccaagtagctgggactacaggcgcccactgccacaccaggctaatttttgtatttttggtagagacagggtttcaccatgttggccagagtggtctccatctcctgacctcttgatctctccacctcgagcctcccaaagtgctgggattacaggtgtgagccactgcgcccaccgggcctcttcattcttttaaattattttgcttttggaaatttaaaaagatacatacagtcttttgtttacgttataaaaatatatttggttttagttaccaaatttgtaggttgtgaatacatgtaataaaatatccttcagcagaattaaaggaaaatatgttctagattgaatttatgttctgagttgtaggcttggttctacacgtgggcaaggtacttaagacctgtgcttcttagcatctcagcttccatatctatatgtcaaggacaggccaggtgcagtcgttcatgcccagcacttcggtaggccaaagtgggtggatcacttgaggtcaggagttcaagacagcctggccaacatggtgaaacgccgtctctactaaaaatacaaaaattagctgggtgtggtggcaagcgcctgtaatcccagctactcagaaggcggaggcaggagaagtgcttgaacccaggatgcggaggttgcagtgagcccagatcgcagcactgcactccaacctgggcaacagagcgagactccgtctcaaagaaaaaaaaggatgataatagtacttaccttacaataaggacgtgttgtaagggatttaatgagctaatgcagaaagtgcttagcaatgcacatcttgattgttattgtttgaatgagatgcaccttagaattctgagtaccaatacctagtgtgttttggaaacctagtatgcgggaatggcttagaaagaagcagcctatggtgacagcctgcatgaagatcactggaggcctgttcacacatcagcctcaggcccatttctacaacgttctgatatgcctggtctggagactacacaccgagaaccactatgataaactaattgacagggagcaaaaggaagtaccaaaacccccaaacccaccattatacaactgggacaatgacggggagagtgttcttaacagggatggaggccggtggggctcactcagcctcacctgatgactgctgctgttacctgttaagaatcaccaatagtaaaatgttgggggtatggtgaaacagaaggggagaatattggggcctctcctcctttgaaaagtctcctcctagagctaacctttgagatttgaggttctgggtcataccaaggaggccctgccattttcagggtcaggatgtggttggtgaaggagtggaggttgcaggagtctagtagatggtgacttacattcaattccaccttctcttcctggggctgctgcacaaggtggcatccccacccccttgccccacaatcttcactgccagaaatcctcccatactctggagagagataagggggtgggtgcagctgctatcaagtcccagcctacacccctgccatttctttctttcttcctctcaagaactgcatgtttctcttagttcctcctatttctcttttaaaactaagctaatttaaacacactcaaagatgcagggagcattagataatgttcttgatataccacatcctgtgcacaccaagaagttggtcacataccaaacccacatgctgagccgctttcccaggaggagaggagaagacaggaagagccacgagaggaggatccatccctacctggcaatcataaaaagggtgtccccgccagcacatcacatccagaacgtagtaggtctggtttacctcattgtaaatgcaatctagaatggtgtagtctgaggacacaaagcagaaagtcagcacagagttcttcttccaaccaggttccctccaccacaacctagggagccccatcccagaggcttgagtccaacaatcctcagtgcttgcagcagtcactggcactaaggactaaggattcactggggagagaaccctgcctggctaccagctacagcttcatggtgactcagggtaagacagcacaagacgcatcaaggcaaaccttaagcaaagtgagaattctgaagttttagataaactggcacatttactcacctcaacgaggtttaaaagcaagtcatcttccattttagtttacaactgctttttgagttcctatcataggcactgtgttatgtggggaatattaactataaatattccctgcctttaaggaagttaccatttggttaaggggataagatgatcacagaagaactaagagctaaattacagagctcatactaagagcaacaggagttcccgaaagagaaggctggagcagcaggaaatgcttcaagggagagatgccatacaaatagtcttctgggaccagccgggtttaaacaacagggcagaggggagaagagagggcatttcagacccaagtactgatgtggcatgagcaaagccccagaggcagaatgaactgggcacatgtggggagataagtcagctgaacagaaggtgggtataaggagtaggggaaagacatgggatgggtgggacaaagcctgcatgtgaaaggtactaaacgccaacagagaagtcagagcaaggccaggtgcagtggctcacacctatactcccagcactttgggaggccaaggcaggcagatggctttgagcccaggagtttcagaccagcctgggcaacatggcaaaaccccatctctaccaaaaatacaaaaaattagctgggcatggtggcacactcctgtagtctcagttactcaggaaattgaggtgggaggatcacttgagcctgagaaataaaggctgcagtgagctgtgatcatgcccttgaacccgagcctgggccacagagtgagaccgtgtcaaaaaataaaaaagagaagtctgggctcagtacagaggacatgaggaaccaccaaaggagcctgagcaggtagagaagaaagcaagcccagctctgccaattccttactgaataactgtgggtaagttatttctcccccacgaccttagtctactcagctaggcccagtggggaggaagaacctaaggttacaacaatgagaaaggagaaaagggagtttggcagggaagccccagcatcagctggctgtaccattatgcttagtattctctcagagacgtttccccccaaatctgtatctgttgtcccgtaatagaagtccaaagatatgttgaccttaattcaggaatttacggaccatcaggcctcatggggctgcatttattctgcaactggggacgcttgaccttgaaggggaggtccttggtccaggggccaggatggtgtctacatgcagtttcaaagataagctttcaggccgggtgcagtggcttatgcctgtaatcccagcaatttgggaggccaaggtgggtggatcactttgaggccaggagttcaagaccagcctggccaaaatggtgaaatccagtctctactaaaagtacaaaaattagccgggtgcagcctataatcccagctactcaggaggctgaggcaggagaatcacttgaacccaggaggcggaagttgcagtgagccaatatggtgccactgcactccagcttgggtgacaaagtgagactctgtctcaaaaaacaaaaaaaaaaaacaaagataagctatcaaagtgggtcttttttttttttttttttttttttttgagacggagtctcgctctgtcgcccaggccggactgcggactgcagtggtgcaatctcggctcactgcaagctccgcttcctgggttcacgccattctcctgcctcagcctcccgagtagctgggactacaggtgcccaccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcccaaagtgggtctttaaagcaaattacactgtcttttactgatcaataagtagacactctatgtaggtaccttttgctgttgagtttcgcctgttgcctcctggcagaagtgaagaaaacctgttgacacagtagccactcttggtgtaggcactggtagaaccctgcatggagagaaagttaccattcttattagacctcaaggtctcctcgccctcttgcctcctcattctgcaggaatgttactcgaccaaagatggctctcaacaaaccttcctgcaggaaagtgtttcaagctccactccaggcacagctgttgtggcgtatgaggaaaatggagcacaaagaatccctcccactacagaccaggcctactggcatagggggcaggcagctactcaccctggaggccacgataagggctctttttccaacagggcacacgaccacaatccattcctgccccaaatctgaaggaacgtcaattaaccactcagaaagcatcaactggaaatgcaaaaaatagtgttaaagatcagcaggggtgtgctactcgaaagtctgcaatgacaaggcattaatatcctgtgtgtatattaaaaacctgagtgaaagaatgagggcagagagccgggcacgggggctcatgcttgtaatcccagcactttgggaggctgtggcaggtggatcacctgaggtcaggagttcaagaccagcctggccaacatagtgaaatctcgtctctactaaaaaatataaaaaattagctgggtgtggtggcaggcacctgtaatcccagctactaggaaggctgagccacgagaattgcttgaacctgggaggcagaggttgcagtgagccgagatggtgccattgcactccagcctgggcaccaagagcgaaactctgtctcaaaaaaaaaaaaaaaaaagaatgagggcagaaaaggctgacagtggcacctccaccccatgtgctctagggagttggctgtgtctcctgcacagctgacaggatgatgggggccactgactatgaactttggcttctctcctccatctccacctgcaaccacaccatgcttactgcctcacctcccgggtcagggtgatgaaccctcttcctttccttactttgtccatctgctcctatcatcattactattatgtttgccacaactcagagatgaataagatccctgaccttgagatgctcttagactagaccagcatttctcaaaccgatgccccaaatactatactacaggatgttaggaaatctgtcttaaaaaacgaaacaacgccaaaccaaaccaacaaaaacagtgatgtggtgaaattaatttgggaagacaaactcttccactcagtctcttccatctgtaaagactttgtcccatgggctgggcgaggtggctcacgcctgtagtcccagcactttgggagaccaaggcgggcggatcacgaggtcaagagattgagaccatcctggccaacatggtgaaaccccgtctctaccaaaaatacaaaaattagctgggcgtgttggcgggcacctataatcccagctactcaggaggctgaggcaggaaaatcgtttgaacccaggaggcgcaggttgcaataagccaagatcacgccactgcactccagcctggtgacagagtgagacttcgtctcaaaaagaaaaaaaaaaaaagactttgtcccatcaattaatctctctcattgaatctttcatttctccttccctttaggcactcactcccaatctttttttttttgagatggagtctcgctctgtcgcccaggctggagtgcagtggcgctatctcagctcactgcaagctgcgcctcccgggttcacgccattctcctgcctcagcctcccgagtagctgggactacagtcacccgccactgtgcccagctaattttttgtatttttagtagagacggggtttcaccgtgttagccaggatggtctcgatctcctgacctcgtgatccgcccgcctcggccccccaaagtgctgggattacaggcatgagccaccacgcccggctcactttaaaaaaaaactttttgtggccaggaacggtggctcacgcctataatcccagcactttgagaggctgtggcgggcagatcatgaggccaagaaatcgagaccatcctggccaacatggtgacaagccgtctctactaaaaatacaaaaattagccaggcgtggtggcatgcacccgtagtcccagctactcgggaggttgaggcgggagaatcacttgaagctgggagatggaggttgcagtgagccgagatagcaccactgcactccagcctggcgacagagcgagaccccgtctcaaaaaaaaactttttgtcactcagcatttctgttgagctactccactttctcctagtttaaaaactacttaatacttcttgatgctgccttcttgctcaatctgacagccacagtccagatttcctaccccacagtcctactgaaggccctctgacctcttctcataactcttcctttttttcctttttttttttttgaactggagtcttactctgtcacccaagctgaagtgcagtggcacaatctcggttcactgcaacctccacctcccgggttcaagcgatcctcccattttagcctccctagtagccgggactacaggcacacgccactacgcccggctcatttttgtatttttagtagagacagggtttcaccattttggccaggctggtctcgaactcctgacctcaggtgatccacccacctcggcctcccaaagtgctgggattacaggtatgagccactgtgcctggcctcccatacctctttcttatcctccccactctactcctcgccttacgtaatgctaccagccacatctcccttcctgacatccgttcccttggcaccatgacatagcactactctgtttttccctctaaacattcctccacacactcccccaaaatatgtaatcttcagggggctgttttaggtcccccttttctcttagatgctgttcccattaggggtggatctcatctatttctatagcttcacttgtgcctcctaatgctccttcatctccagacttctttcctccacactcatctatattgcgagatgtctgcttggtatctctttctgtttgtctcctctgcaccgaaaactcagtatatccagagtggaattaactgccttctgttgcctaagtacttcccacccctgaaacacctacccttcccttctgcgtctcataaccttgttaatggcatcaccactccgttactgaatcttagagtttaagcataatctaggcaaattagactacatcaaaatttaaaaattctgtgctgccaacaatatcaccaagaagacaaaaagacaacccacagaatgaaagaaaatatgtgcaaatcatgtatctgataagaaacttgtatctagaatatattaaaaactcttataattcaataataaaaagataaataactcaattaaaaaacaaggagggcagatcatgaggtcaggagatcgagaccatcctggctaacacagtgaaacctcgtctctactgaaaatacaaaaaaaattagccgggcgcggtggcgggcacctgtagtcccagctgttcgggaggctgaggcaggagaatggcgtgaacccgggaggcggagcttgtagtgagccaagatcgcgtcactgcactccagcctgggcgacagagcaagactccatctcaaaaaaaaaaaaaaaaaaaaaaaagagcaaaggatttgaatagacatttctccaaagaagatatacaaatgaccaatacgcacaagaaaagatgtttaacatcaggccaggtgcagtggctcacacctgtaatcccagcactttgggaggccgaggtgggcggatcacaaaatcaggagttcgagaccagcctggtcaatacgctgaaaccccgtctctactaaaaatacaaaaattagccggaagtggtggcgggtgcctgtagtcccagctactcgggaggctaaggcaggagaatcgcttgaacctgggaggcagaggttgtagtgagctaagatcgtgctattgcactccagcctgggcaagagagggagactccaactcaaaaaaaaaaaaaaagaaaagaaaagaaaagatgtttaacatcattagtcactagggaaatagggaaatacaaatcaaaaccacaagaaaccacttcacacccactaggatggctatatttaaaaggatggacaataacaagtgttggcaaagctgtggagaaattggaacacttatatgttgctggtgggaatgtaaagtagtggagtcactttggagaacagtctagcacttcctcaaaaggttaaacagagttatcatatatagacccagcaattccacttctaggtatatacacaagagaaatgaaaacatatgctcacacaaaaacttgtagtacaagaatattaataatggcattatttggctgggtgcagtggctcacacctgtaatcccagcacattgggaggccaaggcaggtggatcagctcaggtcacaagttcgagaccagcctggccaacatggtgaaactcccgtctctactaaaaatataaaaattagctgggtgtgatggcacacacctgtagtcccagctactagggaggctgaggcaggaagatcacttaaactcaggagatggaggttgcagtaagccaagaacatgccactgtactccagcctgggtgagagagtgagacttcatctcgaaaaaagtaaataaataaaattaattaaaaaacaaataaaaatggcattattcataatagccaaaaagtaggagcaactcaaatagccataaactgaagaataaataaacaaaatgtagtctatccatacagtggaatattatttggcaataaaaaggagtgaagtactgatacatggtacaatatgatgaacgttggaaacctcatgctaagtaaaagaagccagtcacaaaagtccacatattatatgattccctttctatgaaatgtgcaaaataggaacagaaagtagattaatgattaggggctacagggaagaatggagagtgacactaattagtatggggtttcttttggggataaggaaaatgttctagaattaaatagtcgtgatggttgcacagtcttgtgactacactaaaaaaaaagaaaccattaaactatacaataaaaataggcaaattgtatggtatgtgaattatatctcaatataactgtctaaaaaatagtagtagcagctaatacttgtggggcacttccagactctgggctaggtatttaaggcatattatttcatttaatccttctaccaatcctatgagataagtactattactatccccattttacagataagaaaccaaagacttagagtggctaaaataccttgcttaaggtcaacacagagcctagctttgagatcagatctgtgtgacctcaaagcttacatcctttcccacttcttatactgcctctcatatccagtccactgctaagttcttccattctatctggcaacatttcttttttatttgttttatttattttttattttttatagaaatgggatcttcctatgctgtccagctgggattacagacacccatcacacctggctaatttttgtatttttaatagatggggtttcaccatgttggccaggctggtcttgaactcctggccttagcctcccaaagtgctgggattacaggcatgagccactgtgcccagcctctgcacatatttttgaggccctttacatctcttctgccatactccttctcccaactctatgccactctaccctaactggcctgcaaactgctcccgggcacaccatatactcctttctggcttctgggcctcgtgctcagcctgtttgttcccactgcctggaatgccctaaaatgcactgcacttctatctattaatgtcctacttacccttcaaggctgcctcttccttcattaacccttctctgatttcacaccccctccttcctccttggttggaaggaatctcatttttttttttttttttttttttttgagacggagtctcgctctgtcgcccaggctggagtgcagtggtgtgatctcggctcactgcaagctccgcctcccaggttcacaccattctcctgcctcagcctcccaagtagctgggactacaggcgcctgccaccaccacgcctggctaattttttttttgtatttttagtagagacggggtttcaccatgttagccaggatggtctcgatctcctgacctcgtgatccacccgccttggcctcccaaagtgctgggattacaggcgtgagccactgcacctggccagcatctcacttttttatagcacaaaacatcttctacacctattctaggagcacaggggctatttctgctccacatctatcttcccatgtcatagcctagtttaacacagagcaggtctttcaataatgcttactgaacaaaattgaattgtactttgtcacagaggatgttatctgtactgtatttggggtaaagaaaggggctgtgggagtgcatccaataaccatattctattgtgtttttttttttctttagagatggggtctctccgggtgcagtggctcactcttgtaatcccagcactttgggaggccgaggggggtggatcacctgaggtcgggagttcgagaccaacctgtccaccatggtgaaaccctgtctctactaaaaatacaaaaacttagccgggtgtggtggcaggcatctgtaatcccagctactcgggaggctgaaacaggagaactgcttgaacccgggaggcagaggttgcagtgagccacgatcgtaccactgcactccagcctgggcaacaagagcaaaactctgtctcaaaaaagaaaaaaaaagagatggggtctcactatgttagccaggttggtcttgaactcctggcttcaagtaatcctcccaccttggcctcccaaattgctgggattacaggtatgagccaccacactcaggcccaggaaccatattctaaaggcaggggagaattctgagatgacaagatacttgggttctagacacaagtatatgatagcagggtagacctccatcccaacttggacccataccctgctttctgaaatacctgagctgcctggaacacaagaacagtctctctccatacctctttccctatggtaccacagccatgttggtttcctctctggatctaaaagggcactgagtcaggtttattatagtgatctgctgcttcatggcctgaacctcaccttggccagctggctggtctggggtggctgggcaggctcactttattcaagggcagctgtacttcccacttgccaccacctgagtgtgaaatttcaagactggcctcatagtacactgcctgggaaagactctaccacccagggaagtggaaggagtcagtggtaggctgggcaggcccaatccagaacagctgtgcagtgacaactaaaaaaaatgacaaggatatggagtgtgttactatatcaatagctcaggggctttctgcagtgggctggcagcctttggtaacagcacaggctaatagttcccaaaccccactacccacagattccatcagtgattcctagtcagtccatagcacagtaagccatctctacttatcatcccatatgatctacgtacactggcatgttctttgcagttcctattcctttttcctgcctcattctcctctctttatgacagcatttatttcagtgggctttgactgcatagtaaagggagtgagattagctgggtctcatcttctctggaccacttacttgattagcatagtgttttggtaacttcttgacagtgtcaatgtccatttcttcatcatctttcttattttcttcctcactctccatccctgtccagtcatcttcagccagtcttctggcatggttcacataatccagccgcttgctggaaggaaaaaaaaggcataaggacatatcttttcttctttttttttttttagacagggtctcgctctgttgcccaggctggaatggtgcaatctcagctcactgcagcctcaacctcctgggctcaagtgatcttcccacctcagcttccacagtaggtgggactacaggcacacaccaccacccctggctaatttttgtattttttgtagagatggggtttcaccatgttgcccaggctggtctcaaactcctggcctcaagtgatctgcctgcctcagcctcccaaagtgctgggattattaggcatgaaccaccgcatctggccagggcaggtctttatgtcttttaggaagatgccctataatgcgacacatttaattcaaaagctccaaatttgggagcaacttggggattctggtggaagtaagaaatgatggaatctcctttgcaaggctaaaacagtgaccgccccctcaaaatcctaaatagcgaaaccccctctgaatacactcagccttcctcagagtttcctaagaatgcaaaataaaatatctaaagaaatttccaaggttcactagatggaaaggctagcttcacccctaccccatcccaccccagatgagagctgacaccttcctgcctagcagacatctcatccaaagaccccaggggtggaagagaagagccactgagatgcagtgagaagtctaaagcaaggacagcttctggagatttctgccttatacaccttttttgtttttaaagagaacttttttttttacggaccgtaggtgtatgccactgtgcccagcttatacagctttctcagaagccaggcctttctccagttcctgtctaactttcaaaaaaggtcacttagtttacaatttaatatattttatttatttgtttccctttatcgttatcttgttttaaaacaacacatgctagaaagtttgggaaactgaaaagaaaaaaaaagaatcttttggaacctaattgtttcaaagtgatttggaaataccacataacctcccacatttgatttcttcaatgctaaggcaggaattcaaccactgaggcagtgaaaccaacacagctggtttctcttaaacacatacatgttcatgctcattataaaaaggcacacaccagagagaacatatgaaagcacaatggtcttttatctcgagaataaaagagctggtatatttgtacatgtgtgaaagaaagtctgtctgtggttatttcctgaacattgtttgtaatcacaagagaagaaaactgcccagatgcccatcaggagggactggcttgatggcattatgaagtatccattccacggaatacctagcaccacgaaaaaggaatgatgtggtactttatgaactgatatagaatttctcccccaaaacaccactaaataaatgtgcagaacagtatatagtatactgctacttgtgttaaaaaaaaaaaaaaaaaaaaaaaaaaaagccaggtgcagtggctcctgcctgtaatcccagccctctgggagggtgaattggccagatcacttgagctcaggagttcaagaccagcttgggcaacatggtgaaattgtgtttctaccaaaaataaaaaaattagctgggtgtggtggcctgcaccagtggtcccagctacttgaggggctgaggttgcagtgagccaagatcatgccacagtactcagcctgggagatagagtcaaaaaaaaaaaaagcttttgtacacatactaccacacacacttgctcatatatgtatagaatatcttcggaagggccaggcgtagtggctgacgtctgaaatcccagcactttgggaggtcaaggtgggaggatcagttgagcctaggagttcaagatcagcctgagcaatatagggagaccctgttcctacaaaatataaaaaaattagccaggtgctatggagtgtgcctgtagtcccacctacttcagaggctgaggtgggaggatcacctgagcctgagaggttgaggctgcagtgagccgggatctgcacactccagcccgaacaacacagtgacaccctgtctaaaatatatatatatttggaaggatacaccagaaactaataatataggagaggaactggatagctaggggacagaaatgggaagacctcaccatatactcttctatttattttatttatttatttatttattggagagagtctagctgtgttgcccaggctggagtgcaatggcgcgatttcggctcactgcaacctccacctcccgggttcaagtgattctcctgtctcagcctcccgagtagctgggactacaggcacgcaccaccatgtcgggctaatttttgtatttttagtagagacaagttttcgccatgttggtcaggccagtctcgaactcctgacctcaggtgatccacccacctcggccacccaaagtgctgggattacaggcgtcagccaccatgcccggcctcttatgtatattttaaattttcaaccatacaaatgtattacctattcaaagataactacatttttaaaaatggggagaggaatgatctgggaatgtattctgcaagccacccagagccacagggaaccatctctgccaaacacaaccagtgatgcaacactgggcaaaatgcagactgtatggaaactatgcagctgttagtagtttcttctgatccctaattccttaatttatgacccagaagaggcccatgctgcattgagaatacaaggatcggccctgccttcagagtagctcagcctcaaacactcttatcctgccctctttccctgtttgcacatcttggcacttagaattaagtatatggaagacatttcctcagattcccttaggaattatttgtcttgaactcccaagagtgccacagaaacatttgggctgaaggcagatgggaagaccacaccaataccagcattcagagtgcagaagccaaacacaagcatcccaggaaatgtggggagtgaaagtctgggcgtggctttcgcaagttcctaaaccacagagctcagtacagctgccaggaaaaaaagaaaaacttaaccaaataattgagcttttggtttcaaacttcggtgtctccctaattcctcatcttctcctaagctctgggtataaaagaaacctacctctgccaggatttacccctcccaacctgtgggcaagaagatcagcctacaaagagtctactttgaagggagagtctgtagagacaagcctagagccttcggaatggttcatagctcctagcccagagaaagaagacaaggagttaaagcttccttacgatttctgcagttccagtaacctccggcggcgctcactctgctccaaggaactgtacttggacttgtactgggataggcgggggtgtggggcagctgtgctgttcagatcttgagacacagaaaagctactagccagggcctgactcaactcttccatcttccctacaaaggaaaacgtaagaaaatggttcattcatttcatatcatctcctgtatacagacagttatgcagttatgatatgatggccacattcctgaaaaaaaattaacttaatgcaaaatcacaagtgtttccatgagacaaaaggaagttaaagggtaaatgagtcatatattagcaataacattattttcctacagatatttccttttttttttttttttgagacagggtctctctctatcacccaggtcggagtgtagtggtgcaatcacagctcactgttgcctcaatctactggacccaagcaatcctcccacctcagcttccccagtaactgagactacaggtatacaccaccacacccagccaattttaaaatttattggtacagacgggatctccctatgttgcctaggctagtcttgaactcttgggctcaagcaatcttccctcctcagcctctcaaagtgctggcattataggtgtgagccactgcgcccggccttttctgagcagttcctctacagtttcctgaatagccatcactcattaaccaatataactctccatgcagtttattcaattggttatttaattctcaactaagtgccaactcatattatgaaaatttaattccagaggaaacactggttctagggtccctggaggaagacaaaagcaatcaaaaaccccaaactcgccaggcacgatggctcatgcctgtaatcccagcactttgggaggccgaggtgggtggatcacaaggtcaggagttcgaaaccagcctgaccaacatggtgaaaccccgtctctactaaaaatacaaaaactagctggatgtggtggcaggcgcctgtaatcccagctactcgggaggctgaggcagaagaatcgcttgaacctgggaggcggaggttgcagtgagccgagatcgtgccactgcactccagcctgggcgacacagcaagacttcatctcaaaaaacaaacaaacaaacaaacaaaaaaacaaactctagcgacctgggattacaggtggctcatgcctgtaatcccagcactttgggaggccaaggcaggaggatcacttgaggccagtagttcaagaccaacctggacaatgtagtgagactatgtctctactttttaaataaaaaagtaaaaaattattttaaattataatttattttttaaaaaatctgattgttacttcctcatattctagttgtgttttgtttttgggtgggcagaaagaaggtttcagggctacttatgtgggactcacttggaaaagagctaggatgtggaaggctgcttaacaagtaacgtcaatgctccagtagtgtgaagaacttccataaagtacattagggaaacaagacaggcatggagtagatgtcattttgaaaacagacttcccactttaggtggaccctaaagaatgggagtggggagaaaggtgaattcacacttcattcaagcgcctgtgagccttagattataagaaaacaggaacatttgggagaaatctgacttgcactgctgggctggcccagccctttggttctagtgtaaaccagagggcacctccagtgcttaacctccatcccaggccaggtccagtgctctgagcatcaaaatcaacaggttcattccagagcctctacagtgaaaaatacaactccataggcctctacttggccagtgagttactttccattgcacaagtgaagtcagatatttttcttgatttgaaacattagattttgtttaatttaaaaggaacttaaaaatcgtggtttgccaggtgcagttgtgcttgcctttagtcccagctactctggaggctgaggcaggaggtatgcttgagcccaggagttcgaagccagcctgggcaatatagcaagaccttgtctgtaaaaagaaaaaaaaattgtggctaaatacacatatcatgaaattcatcatcttaaccatttgtaggtgtacagttctgtaaagttaagtatgttcaacactgctgtgcagaactctccagaactccttttatcttgaataactgaacctctgtaacctttaaacataaaagaaacttttttttttttgagacagagtttcactcttgttgcccaggctggagcacaatggcacgatcttggctcaccacaacctccgcctcccaggttcaagtgattctcctgcctcagcctcccgcgtagctgggattacaggcgcccgccaccacgcccggctaattttgtttttgtattttttagtagagacggggtttcaccgtgttagccaggatggtctcgatctcccgacctcctgatctgcccaccttggcctcccaaagtgctgggattacaggtgtgagccaccacgcccggccttttttttttttttgagacagggtctcactttgtctcccaggctggactacagtggtgtgatctcggctcactgcagcctccacctcctgggttcaagtaactctcctgcctcagcctcctgagtagctgggattatagacatgcaccaccatgctcggctaatttttgtatttttagtagagaagaggtttcattatgttggcgtggctggtctgaaactcctgacctgaagtgatctgcctgcctcagcctcccaaagtgctggaattacaagcatgagccactgcacccggcttgaggtgtgccttaatatctttgcaatgcaaccaagggttgccattcctgagtgactgaggcctcatgatgagtgcttgggatccatatggtatgttattcaaatcatccataatggtatgtatgctattgtctctacttttctgtacttttgtgtaagtttgaaagctttcatgataaaattttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttcagtagagacggggtttcaccgttttagccgggatggtctcgatctcctgacctcgtgatccgcccgcctcggcctcccaaagtgctgggattacaggcgtgagccaccgcgcccggccgataaaaatttttaaaaagtcattatgttttcagttcatcaccaaagtaatgaccaaatccaaagcacctttattaggcctatcatgcactatcttggtgtgggctcccgctctgccaagaaccacacaacctttgaaactgatgtcctgggcctggcgcggtggctcacgcctgtaatcccagcactttgggaggttgaagcgggcagatcacctgaggttaggagatcgagaccatcctggctaacacagtgaaaccccgtctctactaaaaaaaaaaaaaaaaatacaaaaaaattagccaggcatggtgacgggcgcctgtagtcccagatgctcgggaggctgaggcaggagaatggcttgaacccgtaaggcggagcttgcagtgagtcgagatcgtgccactgcactccagcctggacttcgtctcaaaaagaaaaaaaaaagaaaaactgatgtcctggatactggggcggttcctttaccttccttcaaggctgttcttggcgggttcctgctgtttcgttttgttttttctttgttgttgttgttttttttttgagacagagtttcgctcttgttgcccaggctggagtgcagtggcatgatctcggctcactgcaacctccatctcccggattcaagcgattctcctgcctcagcctcccgagtagctgggattacaggcacgcgccacaacgcccggctaattttttttgtatttttagtacagatggggtttcaccatgttggtcaggctggtctcaaactcctgacctcaggtgatccgcccacctcggcctcccaaagtgctgggattacaggcgtgagccactgcgccccgccgggctcctgctgtttcaacccattccttggatggtgctgcctccaagtgttcggaccttagccccaggtggtcttagcaccagtaacccccgctccaactccctaaagtccgacccgccccaggccccgcccacgctccaccctccctccctgtctagccccctcccccatccccttccccctccttcgcgtctccccatccggcgcccccgcctcgcgtcccctgggtccgcatcctggcagcctccgcgtttccctacccctgctaccgggctccagccccggggacgctatctgcttcactcggccgtgcgcgccgccaccgccccgcactgcctttttctaggcatggggtcatctaggccatgcatgattcgcccctgccccacagaagtccctgaggggtcctggccggacagcacggaatagaagaacggaaactctcccaaaaggagtcccaggcctggctctatccctccagatgacgtcccaggaggccagagtgcagggccggccagagggagtcacagtccggcaccgagaggcaactcggcagctggcggggcccgggctcgaacccagggactcacccaaaccgaggtgaccgtcgcacgcgccgccgccaccggggccgacgaatcacctgccctgggaagctaggtccgccctccccccgcccccagctgctgcctcaccgctgggcccacaggcctcgcgccctgagtttccggctcctccctcctttgcgaacgctgggagttccgttgcctacaggccgttatttccgccttcaacggctggggcatttcccatcggctagggagggggtcttcttgcatttgctttgcactgtccgggactcttcctgctagatgacttgaccaggccgaggcctccctcctgaacacaagctcttcggggctcctttcgccaatgggaggaggctgatcttgtggccgggcattcaacgccctgggccctgccgcctcccgcagatcttcccgggccttagggcttcacctggagtccc

SEQ ID NO: 920 - DNA, 28024 bp, Homo sapiens; identical to SEQ ID NO: 919

SEQ ID NO: 921 - DNA, 86406 bp, Homo sapiens
attagccctgatattttaatggaaatactgaccaagtttacaacatttcaaatgcagatcacacggaaaggtgactaagtacagaataacaaatgtgatttaaaacaaagataacctgctgctgcatataatacaggttgggtttagagcttggagctcagatgtcagacagcaggaggaataaaaatgctacttgtgaaaacccaggctgtaggtaaaacttactcttttgttggttgcactggtgggttgggactttctcctgaactggccttgaaatcctatcctgacctgcaggcaagtgctctggacaaaacactgcaggggcagcaacagctggggctgaccctgatcacaccccaccaatttcccctatggttccaggtcaacatgacctttcttgagggaacacggggataggtgaattatttgagaaaacctcaagatctttcccctaaatcagtacacatgaccaccgccaagtcagacactgccccagctttgccctaaaatctcatcccacaaagctctttttggcaccctacactttggctcacagtctcttctccccagtacaaaaaaagcctaaaatcaggccagggtggctcacacctgtaatctcagcactttgcgaggccgaggtgggaggacagcttgaggccaggagtttgagaccaacctgggcagcatagcaagaccctgtctctacaaaaagttaaaaaattagctgggcgtggtggcatgcagctactcaggaggccgaggtgggaggactgcttgagcctgggaggtcaagcctgcagtgagctatgatcgtggcactgcactccagtgtgggtcataaagcgagacactgtctttaaacaataaaagcctaaaatcagagaggtctaccatgtgttttgaaaatccaggagccaaaaaattttgtttttctttttggtggtggtggtgatttttaactaaaaagcaaacataaaacacacagaacattgctggttacaactaagacttgcgtaatggttgctgaagaaaaatccaccagagtactgggaggggctcagttggtctttgttcagaaagtccaggttaaccacatagaaaaatcctaatcattcatgtttaaatgtctgctagtttaaatttatgtaattaaaaaaataggtatcccatttcaaattctctccctcccaactccatttataaggtataccacatgccttatgcacacttttttttcaaacactggtttggtatttaagttgctcacccccatccatcaccaatgtgaataagaaaaaatatatagaaatacaaactacatagcttgacaacttacccaaatataaaatattttcagattatttgaacaagggaaaaaaacacgtactaaaagacttaagtattctaagattttggaatattttgatttgggacaagtaacaagtattttaagcaaaatcctgtttctaccctggataaggaactgaagtcaaaatccctgcttcacagtattttctggtgaggacaagggacgtgggttgagagtttattccttaagtaagaaccaagctttatttatttacaaaaaaaaaaaaaaaaaagttgggggcaaaggggaagacaagttttacacaaaagtactacaatggtaactccctttggtaaaaagtgtaataaatgtcttgtacatctgttcataggtactaaatctgaagccacagtactatggtacacaagaagctagagcagttatgctagcacatcaaagcatatttcttttaataaaaaattgacagtatgtacattatgtacaaaaaaacaagttaaaattgtgtgtgtgtgtgcgtgtgtgtgtcagagagtaaagctggtggatggcactaaggtagactagtaaagaggcagatacaaaacagttccacgggagctaaaaaggacaactgatttgaactcgttgaggttgagaaccagaggagagaaaagggtaggcagcaagggaatcgtcaggaataaaatccacaagatgatcaatcccaaagccaaactgcaggtcccagataaaacctaatgggtgatcttagatgtgctcgagtgaccagaaaaaaaaaatcaaatccagcttttttttccttttgtggggaggggagaggagcagtgaccatgatagttccaatccatctgagtattaagtccttctccagtctgttttgtaaatgcatctccatccagtcaaagtgtgaacagcatccggttccctcattgaaagttaggccacaggagactccagtcttagctctgctggtgtgtgcaagcaaactgcatgtctttgcttgcatggacttccttcccctccagggcaggctatacccaaaaccctttgggaaaagttccagcttcagctttgtaaggtattcatgttcctaacaggtagcccacttggtgccaggctgcaccagccacacacaggtcaggtggccatgtcccagagaggcccagtgaggcttgaaaggcatcttccttgtttcttcagtgtgtgagtgcataggcccacacacacatccccacacacaccccaagttatctgctctggctttgcagttaaggggctttgaatactgtgccgtatttgacacgatacttgttaatgctcacaaaatgcagggtctctgtatcacaggtggtggtacagggcaccaggccctccagcccctcacccatgagccacttgctggtctctgctgccatttcacggggcacatgctccttggtccatttatctacccaggcctggaatctctgatgtagacgcttgcttacacgctcatgggactgcaaaacagaaaaaaaaaattttattaaatgaagcagaaccaaaaaagagcccttcaaatacaaagcctaattttcttctaaaggagcaaaggaaagatgtgggctcaagtcttagataccactgtttttttcttaaaagaaaaaaaaaaggattctctgtttaaagagaagttaaagaggtaagaacatagaacatgtgagggcatgaaaatccataaagcctccaaagaaatgcgaacacaggctctgggctgaaaaagctcgctgttctcaattttagcatgcgttagtataaccgagggaatgtgttaaaaaatacacatttctgaccaggtgcagtgactcatgcctgtaatcctagtactctgggaggctgaggcaggcagttcgcttgagctcaggagtttgagaccagcctgggcaacatggcaaaaccccatctctacaaaaatacaaataataactgggcgtggtggcacacacctgtagtcccagctacttggtaggctgaagtgggaggatcgcttgagccaggaggtggaggctgcagtgagccaagatcgcaccaccgcaccccagcctagatgacagagccaaaccctgtctccaaaaaaaaaaaaaaaaaaaacccaaaacccccaaaacccacatttccttggtttaccaatgtgcattttaaaccagcaatccagctgattctaatgtatcctgggtaggacccagtgagccattgatcacttctatcagcatggagatccacctctaagccagacagtgcaaagcaaagggcttaaaaccactctccctccactgtgttaccccaccctgggaagcagagtccaggcttggcagatgttctgcagggggttctgttcccaccaacacattcaataaaaatttattggtgtccacatgcaaggatactagaagagatacaaagacaaaactggtgttgcccagtgtcccaaataatgtgaatcagagacaggcagacacacaacacatagcaaaaaaaatgagccaggtgtggtggtgcacgcccgtaatcccagctactcgagaggctgagacaagagaatctcttgaacccgggaagtggaggatgcagtgagctgaaatcatgccactgcgcttccctcagtgccatgagagaagtagagcagactcttgaacaacacagctttgaacagcgcagggccactgataggcaagttttcttccacctctgccaaccctgagacagcaaaaacaacccctcccttcctcctccctcttcagcctactcaacaagatgagaataaggaccctttatgatgagccacaaccacttaatgaagagtaaatgtatcttctcttgcttatgacttaacattttcttttctctaacttactttattgtaagaatatacagtataggctgggcacagtggctcacgcctgtaatcccagcactttaggaggctgaaatgggtgggttgtttgaacccttgagtttgagaccagccctgggcaacgtaaggagaccccgtgtctattttcattaaaaaaaaaaaaaagaaagaaaaaaagaatgcagtatatataatacatacaacatacaaaatatgttgtttatcagtaagccttccagtcagtagtagactatcagtagttccattttgggggagtcaaaaattatacacagatttgactgtgcaggggccagtgccccaaaccccttgtcgttaaagggttaattatacattaaactgtctgctcaacatctcccatttgaaagttttgtagtcctttcaaacttaaaacagcacttcatctgtctcccaaacctcataaccctttcctattaacaggtgagcccctaaaatctccacttaagcaaaacaaaacaaaccaaaaaaccccaaaactaatcaggcaccatccttgatgtccttcttttgcttacccccacatttgatccaacaccatctcttgtcaattaaatatctaaataatatctacatctgggcgtggtggctcacgcctgtaatcccagtactttgggaggctgaggagggtggatcacttgaggtcaggttcgagaccagcctggccaacatggtgaaatcccatctctactaaaaatacaaaaaatcagccaggcatggtttgagacacagcgaaactctgtctcaaaaataaatgcataaagtctacaatgtaattcttgcaattccactgccaccctagtagtacgggtggcccccacatctcatttggacaagggcacccttttgagtggtctctgctcttccaactttatatatacccatctccactgtcctcacagaactccaagctatctttgtcaaatgtcccagtgcatctcaaacaaattacaaaccatggcctatcattagacaaagtgatgtggcctctgcctacccttctaacttcatgcaaccttgagccacaatggtgtttgtaatttcttgaatatgccaagtcctttcctcccagccttgtactagctcttttgtctagaaaacacccatcctctactcttcaccaggctaattccttgtcattattcaggcctcaagcatcacctcctttgagaagcctcctccagtgaaagcaaggcctgtatgctagttacccttgatcacttcacctgatttgtttccctggtagtgcatatcatcgcattacttcatctgctctacttcatggctgtagtcccagggcctggcataacaccctatacgcagctgcaccaggaaggtttcacaattgagacagaatgtaaagacaggtaggattcatacaagcaaaagatcagatactacttgagatgtaaatactgggagtaaattcaccaaaaaggtgccaccgggtatttacgtgctcttacaggctgaactgtattctccttaaaattcttatgttggccgggcatggtggctcacgcctgtaatgctagcactttgagaggctgtgtcaggtgagactctgtctcaaacaaacaaacaaaaaatcatacattgaagtcctagcccccagtacttccgaatgtgacctcatctggaggcagacacacacacacaggtaggaacaccatatgaagatgaaggcagggatctacaagcccaggaatgccaaagattgccagcaaagaaccagaagctaggagaggcctagaagagattgtccctcacagtcctcaaaaggaaccaacactgctgacacttgactttggacttctagtctccacaacttttgtcatttaagccacagtctgtggtactttgtcacagcatccttagcaaccaacatacgtacttcctcagttaagtctcagctccaagaacaggtttgcataaacaaagaaaaacaatcagaagactctgggcctcccctggtcctagctagggtgggagatgtgtacagaaatttcagttactggttctcacctgatgagcccggagcagggcggtcctccgatacatatagtcctctgatttgatcacatacaccatcttgtaggaattcagcttgaatctacactccagcttatccagactatccacattctccatggtcttcttgctgtttccttccttcccttccttttcctgctgctctcgaccacgttgacacttccggatccgccgtagattcctattgcagaaaagccccggaggatgagagctcgtccagatgcagattcccgtgacttccccaaagtgagttttctttattatatgcttgcatagtactcatcccaatttgttaaatacatacacaaatgttcagttgtttcactgcaaaaaaaatttcaactgcaaaggtacacagaataaaaagcagaaatcttcacccatcccctacttgacttagcagatgtagccagttaagagttttaatgagaaacttctaggcctctgtctgtaaatttacacatgtaattaccagctacagttctgctttgggatttgtttttaagacaaaataggatcatactatatattttgtcctcaacttttcacttactgtcatgaatattttttcatttcatgatagatttgtcttattctctttaactgctgcagaaaaatgtaccccaatttaccattccttaacagtttctttcaactgaggttcctcatctgaaccacataacaaaaatttatttgaatgactatttttaaaaattcccccagatgatataaactagtgccattctacatacacaagaaagaagataattcacatgaatggatgccctgaggggtggtaggcttgctaaatctcaacatccagtgaaaaaagttatcagctagacaattatattgtttctcataacttgctattaaaaacactgcttcaggttggccactgtggctcatgcctataatcccagcactttgggaggcaggtggattgcttgagctcaggagtttgagactagcctgggcaacatggcaaaaaccccttctctacaaaaaaaaaaaaaaaattaggcaggtgtggtgacgtgtgcctagagtctcagctacttgggaggctgaggtgggaagatcgtttgagcccagaaggcggaggttgcagaaagccaagatcccaccactgtactatagcctgggacacagagccagacactgtcttaaaaaaaaaaaaaaaaaaaaaaaaccaaccagcccaaaatattgcttcagtgagaatctttgtatacaagtatttctgtagacagcagttctttgtccaaagggtcccaggaccctttcaggagatctgtgagatcaaaactattctcataataatactaaaacattatttcccttttttgctgtgttgacatctgcactggcaccattaaagtaatggtgaacaaaaatgctggtggtggcgccaaactgtatttgcaatatcgaacaaattgttaccaaattccaatatcaatttgtacatcactgagcttttcatacagttgtcaaactctgttggtttatcttgtaccatcaatgaatccattttacttccatgattttgcaccttcatgcgactgcaattcaagtctttgaacttcacactgaccatacaatgacattaagtgaaaaaagccagtttcacttaagaatgtttctgatgggccagtcacagtggctcatgcttgtaatcccagcactctgggaggctgaggcaggcagatcacttgaggtcaggagtttgagactagcctggccaacatggggagacctcatctctaataaaagtacaaaaattagccgggagtggtggcgcgcacctgtaatcccagctattcgggagggtgagacaggagaatcacttgaacctggctggtggaggctgcagtaagccaagatcgcgccactgcactccagcttgggcaacagagtgagactctgcctcaaaaaaaaaaaaagaaaaaaaaagtttctgatgaagcagtaacattttctattaaatcccaacccctcaatttacatctttttaacatgctgtgtgataaaatgggaactacacataaagcacctttgtgtgctaaagtacaatggtattcttatagaaaagcacttgagcaattgcttgagttgtaagtggatcatcatttttacccgaaagaacaactgactaaatatagtcaatctcagccaagtatttggcagatgttttctcaaaaatgaacaagggagcctatcacttcaaggaaaacaatgttgccaatggtaagactggaattttcaagcaaaactatgaattttggtgaactggtatcagccaccctgagcttgacagcttcccaatacttaaagatgtgtttgatgacctagcgatagcgatattaaatcaatgtgatttcttttggagacactgtaaaatatatcaacatttagtaggtgtgtataacttattttccaaatagccaattgcgtaaagttacaaaatcatagaggaaaaaaagattcattcatgatacaaaataaatcaatggatttttacaactgcatgaaaagcccactgatgtataaattgatattccaactaacctttaagaaactatcactggggccgggtgcagtggctcacacccgtaatcacagcactttgggaggccgaggtgggaggatcacctgaggtcaggagttcaagaccagccagaccaacatggagaaatcccatctctactaaaaatacagaatcagccgggcgtggtggcacatgcctgtaatcccagctactcgggaggctgaggcaggagaatcacttaaacctgggaggcaggggttgcagtgagctgagatcacaccattgcactccagcctgggcaacaagagcgaaattccgtctcaaaaaagaaaaacaaaaacaaaaactatcactggtagttttgttgtcatatcaaagaatatccagttatctgaaggatctgaaaatattcctttttccagctacacatttgcgtgaggccagattttcttcacatatttcaatcaaacaacatacataatgcaacagattgaatatagaagcagacatgagaatccagctgttcttctggtaagccagacactaaacaaatttataaaatataagcaatgccactctattcactaatttttgttttgaattagcttttcattaaaaaatattatttaagaaaatataatagggatatatatatatatatatatattttatttttgaggcagagtctcactcggtcacccaggctggagtgccgtggtgcgatctccactcactgcaacctccgccttccggttcaagcaattctcctgcctcagcctcccgagtagcttggactacaggcgcctgccaccatgcccagctaattttctgtatttttagtagagacagggtttcactgtgttagccaggatggtctcgatctcctgatctcgtgatccacagcctcggcctcccaaagtgctggagttacaggcgtgagccactgcgcccagcccaatattgttatttttcaaatgaattaaagattgaaaacatttctttgtttttatttctaacttggtaaatattactagtataatccatataaacaaaagctttttggagtactcatgctctaagagtgtaaggggtctcaaggccaataagatgagccccttagctgtcagacaaatcattagaaactgaaattctggagggaagattccatacacttcaactaccctgccaccagaacgattatatcaatttccttttcctcacagtacataaatgtgcctccttcctcatatcatggtgagagacacatgatgacaggtttattgtagtatgttattagcatggagcctgttttgttgagaggaacctgacacagagcaactgctcaaatgtgttaaatgattcaatgaatggagaacccggcagggccctttttgctggtatctcttttcccatgttctcattaggactcaataagtctaataacactgggatgatactttcttggaaacctaagacataagatttcaattcaaaacttttaggaaggaagaaagccattctacccattttatacttcttaaactgttttcatatacttggaggatcagtatcacaatctgcctatacacagagggaacatttttaaaattctgtgcagaaaagagttaatgtagcaggcctaagattgctattctttgaaaagcctgcttataaaagttggcccttggctgggggctgggatcttggattttgggcaatgttctaccattccttaactcatataagtgtctcactgtacctaaactatttgtacaaactctatagcttatgctgaaaatgtgctttctttctgagagtttgggattttggtacatgctaggcatacagtgcctagatgactacatctcaataaaaatcctggcacagagtctctaatgagctgccctggtagacagcattttgcatgtgttgtcacattcattgttggaagaattaagagtgtcctgtgtgactccactgggagaggattctaggaagcttgagcctggcttcctccagctttgccacaggcaccttttcgctttgctgattctgctttgcatcttctcgctgtactaaatcagtctgactatatgcagagtcctgtgagtcctcttccatcgaaccatggagactctgacacacattcccatccaaagtacggaggttattgttgattctctacaactctcacctcccagatgctttgacacatgctccaggtaagctcatgttgtgacagccatataaaaccttgaattagcatccccagcagatagaacaaatgaataaaatatgtgaaggccaagaacgtgaaagtcatttaactctccattcctcaatcatgcacagtatggactgctgacagatgacatggctcactcacctggggagaaatactggtttctgtgctagatgttcacgaagctcaggcgaggtagtatctgaattcatgtatcgctccacgtagtctgaccagcgctaagatggcaaacacaaaatacaggtggaaggaaatcacaaaaacagctcctaatgcattgggcactctagtaaattctatgattacaatgccccgaattcataaatttcaagatcaaaaaagtccctttctataaagacatgattgttagtaggtattggaacacggattaaaaattctgttagccagcaatactgctaagtttctgaggtgctaaggttatgagaagtcataaacaggtagaagctggctcactgacaagtttcatttccccacagagcattttgttaaagaacaaaatttatagtggcaaatgtgtgaaagtttccttcacattacaatctagatttctgacatcgcttaaaaaaaaaaaaaaaaaaaaagatctgccaacaagccaacattcccaccaaaacaagtcatcccacacgaccccccccaacatcatacatatggcctgcatctcctgtgtacattatctgccataaccaactatgataatcacacctgtctattcaggggttgaaaactctggactttatcagtccaataaaaagtaaacatgacacaaagaatcaagatgacatgagaaagacctcatttgttgttttttatactttaggaaaaaacaggaaagctgccaaccataagacttccttagaggagatagctttactaagtgcaagatgaggttaacatctataaccaggcagcccgtctcttcagctgaagacatggctggattgacttgtactttaagcatccaggtcctgacccttaaacaggcctgaggtgccttggccttttggcagacagggtcactggacagactctcaaggcacgccagctctgcttggcacctggggtctgtgatgtacttgctcatacctctgcttccacagggtcatccgaattctcctcttctgtgtccagaagctcaatagtcagctggacctggccttggctctgaataaacataagctgcaaataagaaacctaagcgtaaacaaaagaccgtctctgtagctgtaatctatcttctcaaggaatgagaggtgcagaggcaataaacttagtaaactttgctccaactgaagagatgaggaagatactagatcttgggtggccagtgataaaggcaaaagtctacacttactacaagtaaaatgaaatatattaaagcaaaaggtactatttcatgtttcaaacttctagaattcgctaaaataataatcaatgtcagtaagaatgttttacaaaacaaatattttgtcagaaagaaatatggcacatgtagccagaaccacaaaatgtcaatgctctgtccattggtaatcccacttctaggacgtaatagaggaggtaactatcagaatcacatggagaaggtcagagcctggaaggaaacctgagaattttttatttcaaccttcttcattttacacagagacaaaactgaaattcagaagagttctggtttctcaaggcacaccactaatcaatatacatgcagagccagaagctagatctagctcagtgttcttttaaagctttaaaaattgctctctgctagtaaagcttacaacctgacaataacataatatatacacacacaaatacagttatttccaaaatagatttcggggtgggggcagaccctgcattttcacaatttataatttaagaattgcaaaatctgtctccagtattcataacaggatgtcattaaccagtccccatagtgggttggacgtctaggatgtttccaactatttgcttttataattatccattataatggtgaaaaattggaaacaacctaaatgtccaccaatacaggcattaattctctaaaaagtgaatatcaaatagccataaaaaagacaataaagacccagaagtgttgttaattgagcaaaaatacattaaagaccatttccggtcagatgcagtggctcacacctgtaatcccagcactttgggaggctaaggcgggcagatcacttgaggccaggagtttgagacaagcctgcccaacatggtgaaaccacatctctactaaaaatacaaaaattagaccgggtgcagtggctcatgcctgtaatcccagcactttgggaggccaaggagggcagatcacctgagctcaggagttcaagaccagcctgaccaacatggtgaaaccctgtctctactaaacacacacacccacacaagctggccatggtggcacgtgtctgtaatcccagctactcaggaggccgaggcaggagaactgcttgaacccaggaggcggaggttgcagtgagctgaaatagcaccactgcactccaagcctggacaacctggacaacctggacaacaagagtgagcctccatctcgggaaaaaaaaaaaaattagctggacatagtggtacatgactgtaatcccagctactagggtggctgacgtgtgagaatcacttgaactcaggaggcagaggttgcagtgaaccaagattgcgccactgcactccagcctgggcaacagtgtgtgtccctgtcttaaaaaaaaaaaaaaaaaagttaaagaccattttgtccagtataaactctttcaaaatatatactcaagcatagagaagtttagaatcatagagatgtcatcaatgataatttcaggaaagaattctaaggtgactttttttggttatctgcattttattttcatttttttgggacagagtcttgctctgtcacccaggctggggtgcagtgacgcgatcaggcctcactgcagcctcgacctcccaggctcaagcaatcctttttttttttttttgagacggagtctcgctctgtctcccaggctggagtgcagtggcgcgatctcagcttactgcaagctccgcctcccgggttcacgccattctcctgactcagcctccagagtagctgggactacagacgcccaccactacgcccggctaattttttgtatttttagtagagacgggggcaatccttctacctcattctcctgagtagctgagactacaggtgcacgctaccatgccgggctaatttttgtattcttgtatttcttgcagagatggggttttgccatgttgcccaagctggtctcaagtgatccgcccacctcggcctcccagtgtgctgagattacaagtgtgagccatgtgtgctgggcctatgttttcttttctataatgatcatgaccatggatttcatgtaccaacatttttctaacaataatatttacaaagcatactatgaaaaatgttcagagaaaaagaatacaaaattgtaaaaatcatatataactagttttttttttttctttaaaggcaggaaagaaacaaagtagattgtccaggaagacaattacttccactttgtagttctctggtgaactcattaaaaggtccaggagtagaatcacaggtcaaagtaccccggctttaacttctggttcagagaatcctaacaactgacattgtcaccagcaaggtcttcgactacctgaccaactctcaccttaaagcaattctcatctgacattagctgctcagctttccgctgatacgttgactccaggaggctccttgagttctgtgtgttcagctggcctccggtggccccattattattttctgccaggtaaaggtcagtcacctgcacacagatctcatcactcacgatatgctgcagctggaagcaaacaaaggcaagcttttagtgaacacagaaaacatttctccattatacagtcaacgttcctttgatgtagtcattcaactccaaaaaggtttttctttttttgggggggtgggggggtgctggcaattttagaaaattaatcacacaaaccactgtatcattttcttggagaataatcaagccaggattttcaaccatatcagtggtccatggtaaaactttcctatctatttaaaataagaaccatagagaactcaggataatcgtactatttaaaattctaagcatctttaaataattttctataggtcatatctttattgcattttaaaatcatttacaattggctctcatacatattctttctcatttgatcttcacaactgccctgggaaggcaagctagacagagagttggggccagttaggagacaaatttacacaatgcatcagaaaggtggctcacgcctgtaatcccagcactttgggaggccgaggtgggccaatcacctgaggtcaggtgttcaaaaccagcctggctaacatggcgaaaccccatctctactaaaaatacacaaatagccgggcgtggtggcaggagcctgtaatcccagctacttgggaggctggggcaggagaatcgcttgaacctgggagatggaggttgcagtgagccgagactgcaccactgcaaagctcaccgtgagctggggtgaggaagggagccttggagaatcatgaatgcagtatctatgtctatattcccaggccaactacaaagcctgaaactcattaagtatttaagaaatagctgctgaattattgcccaggggtgctcagctgaagaaggagggttgggactaaaagtcaaggttcctgactcctagcccaatacttttccaaacacatcacctatttttctgtatctgatagaaagtatagggcttaagttgtacataaagttaactcactttccatacaggccaatcatgattgactatcagtagcttttgtgacaatcttaggaaactaatgactagaaagttgaacgtttcagagttcccattctcatgtcatgctatttctattttgaaataaaaatccttccaaatgaaactttatcatcaaaatgacagaagtgaaaaatagatacaagaagaaagcaaaacgttaatttcaatattgatttgtctgtttaaaaaactttaagatgatcataaccaccaagccattctatttttaggaagacacattctttttaagtgttaggaaccatgataactatttattcttaagtcctaaatgaccagtatgtgtattagtagataactggacacagtgaaaggtcagaacggtgactgagtgtggcagaaagggcagtatctccagcaactacagatggataaataaatcacaatgagtccagataaaggattctgatacaaccattaaaataatgcttatgagtacctgatatcatgaggaagattaagatacagtgttttaggagaaaaaagaaaaggtggaaaaaaacagatggaaagcatgacttcaatcatacatacagatgcttccactttctactttctttttgagacagagtctcgctctgtcgcccaggctggagtgcagtggcatcgtgatcttggctcagtgcagcctcaacttcctgggctcaagcaaccctcccatacctcagcctcttaagtagctgggtctacaggcatgtgccaccacgcccagctaacttttttgtattttcagaagagacggggttttgccatgttgcccagtctgatctcaaacttctgagctcaagtgatccacccgccttggcctcccaaactgctgggattacaggcgtgagccaccgcctctactttatactttcttgttgaagtagactgtattactgattccccacccatactctctttttggatatctggcccctcctcgagtcttcagaaaagacagcactacaaatccagagacagctacggaactcccacccccactgctaagcagatcagattctctatcttgctaattggagatgacagagagggtgttcaatagattttttgaggaggagcatctgtatggaaaggtctagtaacactgggaccaggggtactgggagggcaagccaaagcctcagaggctggaggagcctggagcacatgccgtatgttcatctgcagagcaaagcacaagcatggagcagaagtccagagtgaaggcatgcaggagagaaaaatcacctcccagcccaatccttccatggtgtggtcctattttgagttctgtacttggatgtctgtgaggttgcctattgtattcttaatacaaatccctcttaagccagcctacaataggtaagataaatgtaatggcttcacttggctggaatgcagtggtgcaatcacggctcactgcagcctcaacttcctgggttcagatgatcctcccaccttagcctcctgagtagctgggactacaggcatgtgccaccatgcccagctaattttttgtatttttaatacaaatagtgtttccccatgttgcccaggctggtctccaactcctggactcaatatatctgcccgccttggactcccaaagtgctggtattagaggcatgagccaccatgaccagccttgactttgaaatatatgttgtacattcagtcagcagtggaatctgagggaacaccaaatatgaggagaatgagagaagagatacctccagttaaaggagttgagaagcttgaaaatgttttaaaaagtcactgtaggctgggcacagtggctcatgcccgtaatcgcagcgctttgggaggctgaagtaggtgaattgcttgagcccataagtttgaggccagcctggacaacatggcaaaactccatctctacaaaaaatacaataaattagccggtgtggtggcccctttggtcccagctacttgggaggctgaggtaggaggtcaaggctacagtgagctgatcacaccactgcactccagcctgggcaatagagtgagaccctgggttggaaaaaaaaaaaaaaaaaaagtcactgttttggggttttctggatgaaacctgtttccattaaaaaaaaaaaaaaaaagcggggggtgggtggagatagtatttattactgattcaaaatcataaccagatacagtaaataattgtaactattgtttcgaaaaccaacctcagaattattaaaagttagttttattggattttttttttaagctgtgctggtggtatgaaagacttcgttcctagctgaagcagcagcaagcctgtaatcagcaacataagcacagggtaactggagtctgtattttatataaatttcagggaagttaaggaagattagtctgaaaaagtatgactatgggtgactatgtatccatctaatgatttctgccagttaccatccagacctcttatgggaaggcctaacaacttcttcaacttattggaaacaactatctgacaactttcccccagatgttaaggttcatttatatgaagggctcttcctcaatcctgtgtagatactgtgggaggagtacagaggcatgcacccttccaaaaccaaggcaaaagcatgggtactttgcaaagaattcaatattttagcccaagagaacattaagcaacaagctctttccttctacagtggcagtgtggattctagaattagaaattgctttttacaagttttcacttaagtacttcaccgcctttctgctgagctattctatggaagagggctgtaggtagccacggtacccaggtggaacagcatgatcctaaagccctacttccacaaggaatcgcagtggcccatggccacgtggttcaaccagccagcccagaagatctgcagatgcaagcaaaagtataccacattgacctgcaccctgcatctggacccatctgacccatggtaagctgccccacagtgaggtaccacaccaaagtacaagctggcaggggcttcagcttagaagagttaagggtgaccagcatccacaagagggtggcattagtacaccatgtccctgtgggccaatgttcagcacctgaaggagttaagactccaagctcaacctcttctccaggaagctcttagcccccaagaagggagacagttctgaaaaactcaaatcagccacccagctgacaggaccaataatgcccatatagtacgtctataagaaggagaaagctggaatcatcactaagaactttaaggtatttgccagtcttcacacagcccacatcaattttcagctctttggcatatgggcaaaaagggccaagggagccacagaacaggatgctgaaaaggaaaaatgaagccctgctggggacttgcagtcaatcagcagtagagctgggtctccagaaaaagaaaaaagcagttaaccaacaatctctctgggagttcagaactcaagtccaagaagtagaaatgtgactatctgttacaagctattttttatatcattgttgtaaagaacaacatgtttacaagttcccagggtgccacaggaagaacacacaaaaccaaccagaaacctaacttagagggaaccgcagatgagtgaggtgggcagagtattataaaagatgttatgtgaaccctttcttataaaaagaatttcaaatattaaacaatgcaagtacataagagttaccaacaccttgaccaggcgcagtggctcgtgtctataatcccagcgctttaagaggccaagacaggaggatcacttgagaccagaagttcaagaccagcctgggcaaaacagtgacaccctgtctctatttaaggaaaaaaaaaaaaaacttaccaacacctatggaagacgcaatgttccacactgtgtgcttacccatggcagacaaggtaagagatagacaagttgtgcaggaagctggggtcaggaccactgcactctacaggtggccagcaagaaaggatatggggtaggcaggctcatacactgcaactttgttaacatgagaaatcaggcatcacattaacctcccctcctctcttcagaaccctacgttcataaacactgttatatgaaaaagttgcctttccttttccttgcgtggcccatctctaggtaaggatttcttcccttactcaccctagcctcctccatgccctcacctgtctgacaatgctctggatcagtttgtccatggtaaaggcaatgtaggcatgaatggtgaacatctctctcagtgaatcttcatactgtgatgagtctatgttgccatccagcaggctccgcaccatgtccaggaaagctgggtaataatcttctacatcaacatccactgtgggagagatgggattggtgaggccttaccttgctaagaaaagactagggatagagtacagggcaaatcccacagctggcctaaatggcatttgaaagtatgaacactaggtattcaaaatatactcactcattccaatgtaaacagagatgaattccgacaggtgactacaatcaccagcactatcagagtgactctgcaactttaacagtggcttctaatattctgactaccatgctagaaagatacttctttatggtactgctgggccactttcagagaggaaaatatcctagggaagccagtccttcaaagagctgttggctcccctgctgagagaggaacctactctcccagcctgcacaagagcattcctcacatgggtcacttgctcataaagctatttcaatgaagcataaagtacagatgaggaaaggcagacacagccatactccagcactgggaaacctcttgggaacacaaaaataggagtgcaaattaaatcctttatgaataatgaagtaatctgcatttgtcaaagtccttttgtttaaaaatggattcgctacgttgtatttcacaaattgcattaaatcatctgtagttgctgcacatgaatcatttcaatcactagctagaataaatctcatcagttgttaaagacatttggcaactagcagagggcacaaggagtattaaagagtgctgcctttagcttactaaagacccatttatataaagttcaaaaatagacaaatctaatctctagtgttagaaatcaacaaagtggaaaaaggactggttatcagagtactggttatgtttcgtttcttgaacataggtacgtctagtctgtaaaaattcactgagctgcacaattctgatttgtatacttttctatatatacatgccgtaccttatatgtatttttttgtagagatggggtctcacttattaaccaggctggtctcaaactcctggcctcaagtgatcctcccacatcggcctcccaaagtgctgggattacaggtgtaagccactgcacccggcctatacattgcacttcaacaaaaagttgactaaaatgaaaaaagttacaaaacgaactatttgtcactgactaattggttacttgctagttgtgtttgtgctggagaaaaaaggctaggagcaaaaccaagttgtctccatttatctgaagtctgacgaattcattaaaaaacaggcaaaacaggacaaatactgtttaaaagaggcaactggcttgagtttcatcacagactatcacattctttagctccatagaataggtataggctatagactccaaaatataccactgctatgaaaactgcttttatgccagaataaagttttgagtccaaaccacagatttgtccaaacaagctgtggtaagtgtgagggttggcattatcagacaagacaacattatgtaagcctcaaaccaggttaagtcagtggccaagccaggaataggccatttaatttctaatttctacccaagtagatggaatcaccacaatgagatctaaaatttatctctttcgagctaggactagtctagataaaagctttcagaattatttttcagtgtcattagctcctcaacagatagaaagctagggccatatctgggcttcctacatcagcaacacataaaaaaaaaaaaaaagaagaagaagatacactcctcaggttggctatttccttaagagcccagaagaaatgcttcatgaaaaagcttttggctcacagctcaagtacctaatttatgacgtgaactggaagcaggcagcacaaaattacataaagcacatgacagcgtcctgaaccctcacttactttccttttcctgagttctacatctttatccctgtcctgcctgttctccatgtctcatatcaccttttgagttccagtctcctttccataaactatttctacatattaagaatgagccataaaccccactggttaaacagaagtcctgctcaaaaatatgagaaaattctgttttaagcactaggaatttatgttctgtcatggattgaaattggctgtgacagtttagtctctatctgtactttgaaacagatggcagtaacccagaaatctgccatttgagaaattaactgtgatacccccttcccaggtgcgtccacagtaccaaccactgaccaagtgtccatgatctaagccctgcataggatactttgcacaaagcaacaccacaagcaactagagcctccatttttcagataaacaggttcagagagtttaactacacagactctaatgcctgtgctctattaataaaagaagcagtcccaagtctaggtggctctaaggtcctcaacctcacacatcctctgtaaatcagaggtctcggcactcactaggttctttgagacgtagctgaatggcagggctgtcactcttgtctcgctttatgcccagcacttcccgttcccattctctctctcggttttcttcttcaatttgccgttcggcttgggaacaaatccgtagcagcctcaggcagagaatctggtgcagtcgcataaaaatataccagttgttgttgacatagaagaggttgtatacttcatccattcctcttaatttttgagctgctgtgttactaaacagtaacttggacttagggggactgcccccaacaccattgtgcttcttaactgcccctgtggcttcatctacatccatctcttcttcttcctcttcctccacatctgagagatcacctctttgggcaaagagcaaatctggaataaaatgatgcatgatttgttttatcttatatttgtcctccttctgaatgcctgtctgcctcttcacatggtggataatcagagcagcagcatcttccagtatttgtttgtcttcatacgcaagtgagaggtgtgggccaacaggtacaccagcattctcctccgtagcctgctcttgcctctgatgggacagagacacaaaagtattctgtgagatgtctacagcgacaacatgtctacaagaccacatcagccatacatcccattatcaaccacagtgtctatatttttctaatcaaaaacttaggacctgggactgggagcggtggctcacgtctataatcccagcactttggtaggccgaggagggtgatcacttgaggtcaggagtttgagatcagcctggccaatatggtgaaaccccgcctctactaaaaataacaaaattagctgaacatggtggtaggtgcctgtaatcccagcccttgggatgctaaggcaagagaatcacttgaacccgtgaggcaaaggttgcagtgagccgagatcgtactactgcactccagcctgggcaacagagtgagactctgtctcaaaacaaaacttaggacctgactataacaataatttttgtccctcttccagaaacaaataggtaatgacagagacgtggtttgatgtcaaaatacaggtaccttctacacactgatgacttacagggagagtaggacagaattggaaccatctttctttcttttttttggcagggtcttgctctgtcacccaggctggagtgcagtggagcaatcttggctcattgtaacctccgtctcccgggttcaagccattcttatgcttcagcctcctgagtagctgggattaagaagtgcaccaccatgccaggctaattttgtatttttagtagagatgaggtttcaccatgtcggccaggctggtttcgaacttctggcctcaagttatctgtccacctcagcctcccaaagtgatgggattacaggcgtgagccactgtgcccagtgggactatctttcaaaattctggattagtatctatataaaggatatgatatgagatctgtgatttactttacttctggggtgggggtatggagggtgacaaagtaacatcagcaaaatatggaggattaagtttatttattttattgattttgagacggaatcttgctctgtcacccagactggagtgcagtggcatgttctcagctcactgcatcctccacctcccaggttcaagccattctcccacctcattctgccgagtagctgggactacaggtgcacaccaccacgcctggctaatttttgtatttttagtaaagacggggtttcgtcatgttggctgggctggtctctaactcctgacctcaggtgatctgcccgcctcagcctcccaaagtgctgggattacaggcatgagccactgtgcccggcctgattaagttcacataagagctcattttactatttttaaagttcaggatcaccccactccaggaattcccaattgcactgcatttatgtttctatccatctcctaaaactgagcccacggaaaccaggatttattgcttattcatctctgatcctagctcctagtactatttatagtcctggtaggcatgctgaataagcaaggattacaaagagtttggtggtcaatgacaaattttgaagctgtaagtaaggagagatgggactatatggatacaaggtattattgtttgaaggaaacaggtagtcggagaagtggaaaatggaggcaggaggtataagttgaaaccaggacagtaaactaggaaactagtcaaacagcttaggtataaaggtatagtttagatttaaaatggtagaatgaggaatagaaaaggctatgacagctatcaagcaagaatcaacaggtcttagagagtctcacctgcatttaacaaaggtaatttccagaaatcaaagctgtgctaaatatagactagagtcctctcacagatgcagaaaccccccgctcacctcatcatagatactctcaatctcattgagtaagctcttagacctcaggaccttggtgtcattctgtttaaagttgatcccctggtggtccagagacttcaagtagtatttctcattttgttctcgccatactttgttaaagcctctctgagcttctcgccattcttcctctttcatcttcaacctagtgaagcgggaagggatggaaacaacacatgggaattcagagggtttagaagaaagaaatttgccaggcttactttagttaaagaaaggtgcaaagctatattaggtctctcaaaattactggcaacttgggatgctatcaaaccagtcttgaactctgtttcatgagggaattactcatccaagacttactttgaggaaatgatttatctcaaagtcaaataatttacctagaatggttacttaaaaacagcattccagggaatatctttcaggtataagtattccttgaaaaaaagagttcttgtttctttgctataggactttgcaaaacgttcacaatgctaatagaaacacagaagtccaagacaagagaacttgcacagttatgttcctctggatacagtcaggaaagttctgatcagaactgattctaataacccagaagagaacagactaagacaaaaaaaagcactaaaactgaagaataacctgtatctcaaaagccagaagttaaatgctacaggcaagaagaagaaaccatcaatctgtgccagctcttgaggggaagatgagggagaagaaaccatcaatctgtgccagctcttgaggggaagatgagggaggacaaatcaaatctgggtatttgtgaactgtgcagcaaataagaattaatttttaccagatgatactgagagagaaccaagctcctaacaaaggattcacagtgtggtcaataatgacatggggctgggtgtggtgtggcttgtgcctgtaatgccagcactttggggaggccaaggcaggaggattgcttgagcccaggagttagaggccagcctgggaaatatagcaagacctcatctctattaaaaaaaataaaataaaaattagctgggtgtggtggcacattcctgtagtcccagctattcgggaggctgaggtgggaggatcacctgagcctgggaagttgaggctgcagtgagctgtgttcacactactgcactccagcctgggtgaaagagtgagatcttgtctcaaaacaaaacaaaacaaaaacaaacaaaccacaaagatgttaacaacagttagtcctgagtgtggcaggaacatgggtggtaattatcttcttttcttttctgtattttaaaatactcccccaaacatacacacagagccttccaccatgaacttacaagatttgttctctaatgttggttacacaggacccccaaaagaagttccattctgcacctgaattccaacaaccagggttggggagaaagagaggtctcatgggacaaccaggttgaaaatgagagccttatttaatgagacactgaaccggtagtgaagtacactaaagcactaagggcacatttgctcatgtaccttttaaggacaattggaacagcaatggagggattctttctcagaccatcaatgatgtcagctgctttatcagcatatatcctctggagtgcttttctatggatgacttctgatgtgcccccaagggtgttgtccaagcgaaatttggcttgttcttcagcagacaagcgggaaagcttcttctgtattgcttccagaacccggattgttgccagattggtctctaaaactacatcaagctgaagaggaagacaaagaagggtatgctcaggacccaaatcaaaatagaatagagtagtgtttagaagaataaggtagggagtcaaactccttggatttgaatcctggttctgccctactagctacataagactgtttctttatcagcaaaatagggataacagcacctattactctcacaaccctgtgtctggattaaatgatacaatccacataaagtatttagcacaatacctggcacataagaaccacaggatgaagttggataaatggtagttattaccaccaccgtcgctgctgccgccaccaccaccgtgtgctttgcttaggactactgattttagaccagaggaaccaaacaggagatgactttactgaaacgtttccctgaactttcctgaattgctaagatccattatgaacaaacaataacaatcaaaacaatcccaaaagaccgctttgtcttgagagttttttggtttaacttgaaatatttaaatatattcaaatacttaaatattcaatagccttgttccacatccagtaataataagagcagtgactatcataacttaaggagttcactgttgtagctgcgggtaaccatttaaattcttattggactcctggcaacctttgagtctactttttccctagcttaaaataaggttctctaaatgagaaacagaaaatgaagtaaatgagcagtctcaacggtctacaaccaactgtttgcagaagtgttccctaagttttcttgttttgggaatgtggtagtcatttggtcaatatttctggcccctcttgctctccaattatgaacaaaaaatggactaaacttcctggctcccttatgattggatagggccatgtaactagttttgaccaatgagttgttatgagatgagtagaagtaatgtttattacttctaggctgcagcatttaaaggtgtgagatcattccaagctctcttttcctcctagtgactagcaacattcataatggcagcaatcccttggcctgaatccccaagtaattctgatatgccaaatcccctgctaaacatcaatgtacatgtagaatgattagaaattaaacccattggttttacaagtcactcagatgtgggagttgtctgtactgaggcattactaacctatcttgattggtaacgcacattccttcaaactagctcatcccaccaaatcttaaacacatgcacaccccacttctttcatgtttgcccttgtagtcacaaatgggaaatgaagttgcctctcatttggaggcataccagctgagagaggataggaacactctgtcaaaaacaaatgccaagctctgctaaactcatcagttaaccttactaaacgtaagtaacaaagaaatgccttctttagcttgataacactccctatggaagttaacatctgtcttgatttagctttctgcaaataggtgcaactccttataaatgctggggcaaagatggccaaccacctgccagtggccaggcagcatgtggttctcaattaaaaacacaccagaaactgctgaaccaagtgtgaggcgggaaaactggcaaagagctaaaagagtaccaaaacaaacaaacaaacaaacaaaaaccagcaagatacctatccacacaagtaagcacagccagtcaatttaatgtaacagatacactaaataggatacgtatcattttacatctttagacaaaccagacttccctttttaaaaatgataatgtaaaccagacatataaacacactgaggattgagcccactttcagtagtccctctcctgatataggtggtatggggccttctaccacctcatttattcactccactcttcccttcctaattacttcaaaataaagctcctgggacaggcgcagtggctcacacttgtaatcccagcactttggaaggccaagacgggtgggtcacttgaggtcaggagttcaagaccagcctggtcaacatggtgaaacccatctccactaaaaatacaaaaaaaattagccgggtgtagcggcatacacctgtagtcccagatacttgggaggctgaggcaggataatggcttaaactcgtgaggcagaggttgcagtgagccgagatcacaccactgcactccagcctggttgacagagcaatactctgtctttaaaaagaaaggggtccctaatttagccttctttcaaaaggagccaatcaggccaggtatggtggctcatgtgtgtaatcccagcactttgggaggccagggtgggatgatcgcttggacccaagagtttgagaccagcctgggtaatgtagtaaaacactgtttctataaaaaacaaaaaattagccacagggggtaggaggcaaggggagggagagcattaggacaaatacctaatgcatgtggggcttaaaacctagatgatgagttgataggtgcagcaaaccaccaaagcacatgtatatctatgtaacaaacctgcacgttctgcacatgtatcccagaatttaaagtttaaaaaaaaaaaaaaaaaatttacccaggcatggtagcacatgcctgtagtcccagccactcggtggcgggtaggggtgggggtctgaggtgggaggatcacacttgagtctggaaggttgaggctgcaatgaactgtgattgtgccactgcactgcagcctgggcaatagaatgagaccctgtctcaaaaaaacaaaacaaaacaaagcaatcagctgggcgcagtggctcacacctgtaatcctagcactttgggaggccgagacgggtggatcacgaggtcaggagatcgagaccatcctggctaacacggtgaaactccgtctctaataaaaatacaaaaaattagccggacgtgttggcgggcgcctgtagtcccagctactcgggaggctgaggcaggagaatggcatgaacctgggaggcagagcttgcagtgagccgagattgcgccactgcactccagcctgggagacagagcgagactccgtctcaaaaaaacaaaacaaaacaaacaaacaaacaaacaaaaaacaacaaagcaatcaataccagaaacatgaaagaaaaatgccagttctcagagctggtttgctaaccatggcaagatacttgctaagggtaacaatacacacagatcttaaataatttaaaaacagcttcaagaaagtactataaaccttaggatactgattttcttcaccatgcaaaacataataatcttaaaatgccatgcaaaatcaaaagaactattatttagtcatcaatggacaatttcagttaaaagggctaaagtggcctagataagtcacatttgccataaagcatgtactaatatatacatttgaccaatgcataaagcatggaaagtaccacaacaagcacttaccatagaagaatgtgagcctttggctcttccatcttaataaccctcagagacaggtactgatagtctcactgagcatctcccatttcccccaacttcaaatgccaaacaagcttgtacctcaaagcgttcatcttcacaacgataaatatgttcttcatattgagtcttcttggaactcacaaaggtagagtcctcagaccacgaagggaaggaaacccaggtatcatttaaaacctttgggtagaagaagagagactgaaacaaaagcctaaaaaagctttctggtgattaagcattctgaatgaaaagacaaaactctagcagagaaataggcaactaatattacttcacaaatttcacctttagcaagtttacaaaaagctattagtaagaaaagggtgctgaatataagcggaaatataattccagtgctttgggaggacgaagcaggaagatcacctgagcccaggaggagtgacccaatctttacaaaactaaaaacttttatttttatatttttagctgggtgtgaaggcatgtgtaagtcccaggtacttgggaggatcatttgagcccaggaggttgaggcactatgagccgtgatcacatcactgcactacagcctgggtgacaaaacgaaaccctgtctcaaaaacaaacaaaaaagtagaaaacattttctttttaaaaaggattaaaagggttcttaatttcatcattcatataaattctcaatccttggtaccaccactcccttctggaaaaagctgaggacccagggctgatctttgctagggaaggccttacctctttacagagaggagtccgtcctgtacacttgggctgctggtaactctttggtaaggctcgatagctggagcccaatcgtttacaagaagcataatctatctccatagcaatgccctctgtggctcgctcctttggataagtttccagatgtacagactccttatagcccagaaagtttttaaaccaattaaacaactcagggaatttcctgaagaatcaaaccaaaaagtgacaagcaattaggggcaggatgcagttatcctgaggtatgactactaccatctggttttggatcagaaatctgctaccagggatgaattatttcctgcctaagaagaactgcttctgagcatttggtttcccctttttctaataaaatactctcagatcagttaaagtggtgatcaaagagttgtaccgaaaccaggcaaaataacaagccattcttttgatcaagaatattgctttaatgttcacataattcttaggttgtcaaatatagtaaagattccagactcggtgtagtggctcatgcctgtaatcccagcactttgggaggccgaggcaggtggattacctgaggtcaggagttctggaccagcctggccaacatggtaaaacaccgtctctactaaaaaacataacaaaaattagccgggcgtgtggtgacaggcacctgtaatcccagctacttggggggccgaggcaggagaatcacctgaacccaggaggcggaggttgcagtgagccaagatcatgccatcacactccagcctggggaacaagagtgagacttcatctcaaaaaaaaaataataataataatttttaaaaaaattccagaactctgggagagatttttcttgataaacatccagcactggttagaagatcaggagaccactagtcttggccattagtcgataaatacttaatgccctctctattttctcatctctagagctggactagaagacttctcaggactcttctggcactaacatttgagtcaactgatgtatctcaagtaaattaactttgcctatcatatactctcacaaatcaaacattacctggtctccatatcatgcatcagggctaagcccctcacttcacttaccccaggaaaggagagactagttgcacaagctcagcacgagagatcacctcctggttaaaaataacaagacagcgtaggaaattttcgtaggcttctgcactccgaagagcctttcggaccttatggagacaacgggaagaaaaacagtttttgtttttcttaaagtggggaactgaaaagggcctcgctctgtcgcccaggaggaggcgcagttgtgtaatctcagctcactgcagcctcccatcctcagcctcccaagtagctgggactacaggtgtgagccaccatgcctggctaatttctaaattttttgcagagacgaggtcatatattgcccagctgccctgccattagtttttaaaaactggggaaatttgtggctgggcgtggtggctcatgcctataatcccagcactttgggaggccaaggtgggtggatcactggaggccaggacttcgagcccagactggccaacatgctgaaaccccgtctctactaaaaatacaaaaattagccaggcatggtggcacacgcctgtaattccagctacttgggtggctgagtgaaacataagattatcacttgaaccctggaggcagacgttgcagtgagctgggataatgccactgtactccagcctgggtgacagagcaagactctgtctcataagtaaaaaaataaaataaaaacggggaaatttaaactgatatttgatgacactaaggaatcaacgttagtgtttttagatgtgataatgattatgtttgcaataaggagtttttttgttttgttttgttttttaaacgcagtccagcactgttgcccaggctgaagtgcagtggtgcgatctcagctcactgcaacctctgcctcctgggttcaagcaattctcctgcctcagcctcccaagtaggtgggattacaggcatgtgctactacacccggataatttttctatttttagtagagacgaggtttcaccgtattggctaggctagtctcaaactcctgaccacaagtgatccacccgccttggcctcccaaagtgctgggattacaggcgtttgagccactgtacccagccacaaaaaggagtcatttttaaaagaaacttactaaaatatgtatggatgaaataaggtatctgcgatttgtctccaaataaactgggatgggtgggaatatatatgaaacaagtaactggctagaattgggaaccgctaaagctggatggtaggtacgtgaggaatcattttactattctgtttatgtatgttcaaaattttccagctgggcgcagtggctcacgcctgtagtcccagcactttgggaggccgaggtgggtggatcacctgagatcgggagtttgagaccagcctggccaacatagtgaaaccccattctactaaagaaaaaaatacaaaaaaattagctaggcgtggtggtgggcacctgtagtcccagtgactcaggaggctgaggcaggagaatcgcttgaacccaggaggcagaggttgcagtgagccaagatcacgccactgtactccagcttgggcaataagagcgaaactccgtctcaaaaaaaaaataccataataacaatttaaaaactgagatctcggagtataccttctcatatgcttgattctccacaccatatcagagttactcaggtttttgttgcctctttttcttttttttttttgagaccgagtttcactattgttgtcctggctggagtgcaatggcgcgatctcagctcactgcaacctctgcctcccgggttcaagcgattctcctgcctcggcctcccgagtagctgggattataggcacctgccacaacgcccagctaatgttttttttgtatttttagtagagacggggtttcaccatgttggccaggctggtcttgaactcctgacttcaggtgatccacccacctcggcctctcaaagtgctgggattacaggcgtgagccactgcgtccggcctgttgcctctcttaacatgtttacagcaagaatctttgccaaggctgttttaaactctggtaatctggaataacgctctcttaagatagttctgtcctctgatctggtcttttttcttcctctatttacaatattgagcatcttaataccaaaaacccaaaaatgatcaatggcatagacaaagtaaaactagtctagctagattaccaatctggagtttcagttccaaaataagtatttagcactgtgatcctttggtgaagaccacagactgccaccaaaccaagtggcttatcagcaacccctgctccagacttccgtatgcttttcttaactattcatcagtagacactatatagaatctagacttttaaagctaaagataaaagaacactgtaccttttatactgtataccctatttacctttactttttattagcttttaaacatacacaaaagtagacagaagtataacgaacctatgtactcaccccaacctcaatgatctatagtaaattttgtttcatctatacttacttctcctaccactgcattttaaagcaaattccagacatttcatctagatatagtatatatgtttaagaaaaagtactaagaaaatgccattacaggactgggtgcagtggctcacgcttgtaatcccaacactttgggaggccaaggcaggcggatcacctgaggtcaggagttcgagacagcctggccaacatagtgaaaccctgtctctactaaacatacaaaaattagctgggtgtggtggtgggcgcctgtaatcccagctactcgggaggctgaggcaggaggattgcgtgaacccgggaggtggaggttacagtgagcccagatcacaccattgtaccccagcctcagcaatggagtgagactgtcccagaaaaaaaataaaaaaaaaacaaaaaaacaaaaacaaaaacaaaaaacccattactcttagaaattaacttattttcagaagactccttaaggcaaggcatggtggctcacacctgtaatctcaacactttggaaggcaaatgctgaggccgaaggaggaggattgcctgagcccaggagtctgagaccagccagggcaaaacattgagaccccctctctccaaaaaaattttaaaaattagctgagtgtggtggtctgtacctgcaagtcccagctactcaggagggtaagaaggatcacttgagcccatctcttaaataaaaaaggccaggtgtggtggctcacacctgtaatcccagcactttgggaggcgaaggagggctgatcacccgaggtcaggagttcaagaccagcctggccaacacagtgaaacctcatctctactaaaaatataaacattagccaggcgttgtggcggggcctgtaatcctagctactcaggaggctgaggcaggagaatcgcttgaacccaggagatggaggttgcactgagccaagatcacaccacttcactccagcctgggcaacaagagcgagactctgtctaaaaaaaaaaaaaaacccaaaaatgtaaaaaagattccttaatagcatctaatattgagtccgtgtcaagttcaattgtctaattaatgtcttaaaaattggctattggccaggtgtggtggctcacacctgtaatcccagcattttgggaggctgaggtggatcacctgaagccaggagttcaagaccagcctggccaacatggtgaaaccctgtctctactaaaaatgaaaaaattagctgggcacggtagtaggcgcctgtagtcccagctgtttgggaggctaaggctggagaatcgcttgagccagggaggcggaggttgcagtgagccaagattgcgccattgcactccaagctgggcaacagagtgaggctctgtctcaaaaataaaaataaaaataaaaataaatcagcttttaaattcagaatccaaagtctgcatgtcacatttggcttatatatttcttaattcttaatttataatagcttcccttccatacccttttcttgacatttattggttgtgatctagacttccacacttgtctaagagcaccaaccgcccaagcagactttggtaatgattcacatcagagctaaggactcaacactcttgcaggactctcctgcaaaaagctcacataggcacagcagacagaaagggatcaggagatactaatcacggagatgttaaatcatctgcccttctgcaaaacccaagaggcagaaaatagagtcaatcaccacagatcaatccaggttgattcctaccagtgagaagcccaacaggtgccagctaccctgatgaaagtttcctgctaatcatcaagttgactccgaggagcaaatcacacttaagtttatgtggccaaactaaggcaccacacaacatcatttatgccaataatctcaactctcgttgctcattagaatcagctgggtagctttgaaaacatgcaagtaaattagaattcccctgaatgctatgtatgtgtgtactacaaataactatcacagcaataagattacaagtcatcggccaggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggtgggcgcctgtagtcctagctactcgggaggctgaggcaggagaatggcgtgaaccccaggaggcggagcctgcagtgagccgagattgcgccactgcactccagcctgggcgacagcgagactccgtctcaaaaaaaaaaagattacaagtcatcttaaatcctcaaaaattggtacaggcactggtactgcctgccacacagacctggatatctacaatgggagctccaaacatctttcaagagaaacataatacattttctaaaaatctgtcttctgccccaaactgcttcataaaaccaaagcaaacaatgctaccatttttctagctatgctaatagtactagcagactcaaaggactcacaactgggaaactatgttaaaaaacagaaagtcctaattagcctgacacctttaaaacgaaaccttccagggggataagatgattttcttttggcattaacaggcactatcaaatctaactcatccattactcaccttatcaaaaaataacgattctgttccaccaccatgtttgctggcatctgccatagaagaatccttcagattgagcagtttgggtttcttctgcaaaagaaagatacaaacatgtgagattcaacgagtggttttctctgaattttatttttgtctgtattcaatggtttcatcactgaaaccactgctgattaataatttgaaacaaatgagagaactctaaccaactcactccataccctctaagatttcaactcatattttctatttcagtttgcctattaagtttctttctacaacagaggttcaaagatcattctacccccaaaatattttctccagaaatgatcatgacattactgtgacaaacttttagaatatccttactttttctaggggcccaaagtaacttcatgtagaatctaatgccactgttttgttctcctaccagctgagggagaaaaggctgtttgtaaaaagagctcacaaattgacagaaatcaatctttaaccctgaataatatttcaattaaaaatttacttaaaaagcataatttgctgggcatggtgactcatgcctgtaatcccagcactttgggaggccaaggtgggcagatcatgaggtcaagagattgagaccatcctggccaacatggtgaaaccccgtctctactaaaaatacaaaaaaattagctgggcgtggtagtgtgcgcctatggtcccagctactcaggaggctgagacagaagaatcgcttgaacccaggaggtggaggctgcagtgagccgagatcacgccactgcactccagcctgggcaacagagtgagactccatctcaaaaaaaaaaaaaaaaaaaaaaaaaaaaaggcacgccagcaatatccactcagactaatttaatattgttcttctaaagggaaccaacaggccatgatataatcctgtcaggcaagaagttacttttaaaatccaccacttactctctatgaagaaatgcacaaactttgtgagaagtagcacatttaccttggctatctcagagtatactttcttaagagccgcagcctctgcttacactgcctatggagaaagtaggcggagaattttaagcccccactatattcttgccacctgtaggtaatcaagagtgggcggacgtaaatccaagcatggagtgtatctactgagctgattcttgctacccatataactaattctctttattgaaatgaagaaatagaaaccattattatgttcaacttgatttcaaaagatttcaaaagaagaaaccatgacaaacactaatgaaaaggatacttcaaaagtgtcagtaacacctagtacgtcagaccttgtagtcagtcaatcactattcatcagccacctcttactattagaaattcccaaacttttgtcattatttaattctgcagacatatctgtctcttctatattacatactgctttgaaattcactgaagaattaaacattcaatacatacaactagccctctccctatcatagctgtgttacatcaaagaagggagcaagctaagttttctgcaggcagaccatcagtgttaactataacaaaaaacatcatgtaatggattactaagaggagtttaagacttccctctgctacagcccaaaggtcctgccttggagattaagatgatacacataagatctggtaacccaacaaagaactttgagcaggacagggttctagaccagagatctcaaaaaacacatgcactctactcacaagaggacctcagagaccacttatttctgaaataattctcaagctcaagaatgttctttcttaacacaaggcagatttaaagcatcaaagaagaaggggccaggcgcggtggctcacgcctgtaattccagcactttgggaggccgaggtgggtggatcacctgaggtcaggagttcaagaccagcctggccaacatggcgaaaccccatctctactaaaaatgcaaaaattagctgggcgtggtggcacacgcctgtagtcccagttactcaggaggctgcggcaggataattgcttgaacccgggaggcagaggttgtagtgagctgagatcacaccactgcactccagcctgggcgacagagcaagactccatctcaaaaaaaaaagaagggaaaaaaatttcaagtattggaaattcttagtagcaaccaaaacattaaagaaatgacagctcattgcaaaggagagataataaagaactcagaaaagtacagtaatccaagcaatcaatgttattctaatactcttttgcaaagccagataaactctgcactgagtttctgtgacacaatactaacttcctccaaatatctaggacccaaccgttaacacacttaagaacacatgactgccgggcacaggtaatcccagcactttgggaggccgaggcgggcagatcatgaggtcaggagatcgagaccatcctggctaacacggtgaaaccccgtctccactaaaaaaaaaaaaaaatcagcccggtatggtggcatgcgcctgtagtcccagctactcgggagggcgagacaggagaatcgcttgaacccgggaggcagaggttgcagtgagccgagatcgtgccactgcactccagcttgggcgacagagcgagactcggtctcaaaaaaacaaaaaaaaacaacaacaacaaaacacatgaccacctctagagtacctctccattagaaatacttgtgagtgtcaaaatgagcagctgctgcccattctcaccttaactggaggggtggttcctgtaggatgtctgcggatctggcagccattctggctgggcctctgcggcttgttgttcagttggggcttcttgacagtgcctccatgatcatttctcacagaatcaaccttctcagcagttgttttgcttaaaagctgattaagacacatgaatgagattaatgctcttatcaaagcaaacaaatatcatctaggaaaagtccccttctgagcacagttttccaactcatctaagataataatagtaaatagtgtaattcttattaaaaaaacataccacggagctgttggcatctggtaggaattgtccaaactctgacaacaaatcttcctggtttttaaagagacgagcaacctgggcatacacctcctgctctgtcaatgctggagtgtagtttcctccagcttccttggcatttctctgctctttctgaggaattgcaaatgaaaagagatcatttgggctactgttttgagtcactcatctttgcacgctttctggaatcactgttatctatttaggctgcatgtaagaagaaagtctatgttcttagcacccgttctgaccacagactttcaagttgagaaaaaaaaaaagttgaagatggtggatgacaattcctttcaaaactagggtagtaaatatttttgagacggagtttcactcttgttgctcaggctggagtgcacttgtctcggcctcccaaagtactgggattacaggcgtgagacaccatgcccggcctagggcaataaatattaatgcccaggggaccactaccaactgacaaaaccttagaaatttctcctcctcctactgtacattaactagactatataaatcaccatctaactgtcccagataaaactgagtttcatttcatgggacagtgactaacaatcctgactgaggccgggcacggtggctcatgcctgcaatcccagcactttgggaggccatggcgggtggatcacctgagaccagcctggccaacatgttgaaaccccgtctctactaaaaatacaagaaatcacttgaacccgggaggtagaggctgcagtgagccgacactgcactattgcactccagcctaggcaaaaagagcaaaactctgtctcaaaaaaaaaaaaaaaaatcctgactgaatgttgcagggcaatcaagtcaggcaaataaaactggctttatagcatgggggcggtggctcacgcctgcaatcccagcactttgggaggccaaggtgggcagatcacaaggtcaggagttcgagaccagcctagccaacatagtgaaatcccatttctactaacaatacaaaaaattagctgggcgtggtgggcggagcctgtaatcccagctactagggaggctaaggcaggagtatcacttgagcccgggaggcggagactgcagtgagctgagatcgtgccactacactccagcctgggtgacagtgcaagactccgtctcgaaaaacaaacaaacaaacaaactggctttaaaaacatgcatgatagtttctaactggttaatttccagtatgaattaatggacacaataatggttacttgttattggactagatgccctaagagggtgacctggttaagacaggctgaatgggcactccttacctgatatgtgtgcaaaatctccaggaatgctttgtagatgtctggttggccctgaaatctgttcttgatcttattaacatagttgatggcatgattaaactccacaggttgattgttctgcaaggatggggccgttcccaacgagattgtcactggtgtgtgaggctggaccggcggagaacgtggggatgcatacggtggaagtgggggagtctgctgactggccggagtatgtgcttgcagttgggagggctagaaagaaaagaaatctttattctcttcagatgcatagatgagttgatacaaggaaagttcaaactaaagagaaacaaggtgtcaacgtatatcctttatttactcactcaggccaggtcattttagtccaacacaaatcatactgggcagcagtgggagttgtaggcggttcaaacatgctgatacaaatatttcagtctcacattttctaaataaaaccttaaaactggagccatctccaattacagggaagaatttttcatatgcaatgttttagcttagtagctcaacaagtacacatagaaaaaatctcattctacatagccttttgatgtcaacaacaagacaactgttgcagtagctccacataaaaaagtcttctacgccaactctgtcctgtagaactgagatgatggaaatgtcctttatttgcactgtcttatacatagccaccagccacatgaggttactgagcacttgaaagctagtgcaaatgaaaaactgaatttaatttaaatagtcctatgtggctagtggctactgtgtcagacagtgtggttctagaccaagaacaccccatcttcatcaccatcactatcactattcattagatcttctacttagcttgatataatctagttagtgaaataactttcataaaataaccatgtgggcagcagcacaatttgaccaggataagacgatggtttctatctgtgctgtcaactactactacacaaagtcaccacctgttgggatgttcatggttttataagcagaaactgtaaaaagaaagaccttgaaagttgttgctgtgttgatttaaatagatacctaagtaagtgatgtgtaaatgtgaaccatgtcatagtgaagttttcatacagcatttttctatgacgaaatctttgtaactttgtttctcagtatctaagtcttatataaaggggaaacatcaaaggaaggtgctctctagggatgcattcatattgatgcaatattttccaagtgctcaccttgctgactttggcaggtgggggctgaggagctggctgggcaggagctggggctgactgggctgaaggctgggaaggatgttggggtggtggttgaggctgtggctggatgccatgggtgggaatctgatgaacctggccaggagttgtcacattcaccatgtcattggtttgcacctcaattttgtagccagggggcaagaaggtgttgaatcccattatcagatcggggtggcctttgaatagctgggacacacgactaatcactcctggggtgtcgatgctgataaaaaacaaaaagaaaagtgataaactgtaagcttaacaaacaccctgttaagaaaaaatttcatgtttttttttcttttgagacggagtctcactctgttgcccaggctggactgcaatggtgcaatcttggggtcttggctcactgcaacctccacctcccgagttcaagtgattctcctgcctcagcctcccaagtagctgggattacaggcatgcgccaccatacccggctaatttttgtatttttaggacaggtggggtttcaccatgttggccaggctggtctcgaactcctgacctcaggtgatccgcccaccttggcctcccaaagtgctgggattacaggcatgagccacctcactcaaaatttcactttctactaggttttctctaaacaggaaaacagatcatctacgcattttaaaattaacacacgaactctgaaattccaaagccatttagttttagactcaaagatacttggccacaatttgttttttttttttttgagacagagtctcattctgttgcccaggctggagtgcagtagcacaatctcggcacactgcagcctccgcctcctgggttcaagcaattctcctgcctcagcctcccaagtagctgggattacaggcacccgccaccatgcccggctaatttttggaatggtcaaaatttttaacagaatatatgttcattgtaataattctaccaagcagatactcagatgatatatataaagctacatatcccaaacaagattcactctttgatataccagtatacatcatttcagcacacatctacattgttcagatgagttacactcttacaacagtgaaccatgccagaatataagggtatctaaaccaattcagaaaccaagtagcctaaatcactaccagtgctacttccctgattgagacaaaacactggaaaaaatttagttaaggaaaatttaccaatagggataaaaaagtctagtggccataatttccatcaataaaggtatgcataaaataaaggcatgattttgaaaattcagctgcaaaaaggagcatcctttatcttccagtaaataaactatatcctcttccttccaaaatcaatatgccagatacaaagcttgagtacaatcacacatcttttacctctgagatttaaattccttcatgatgtcaaggaaatcattgtagacctgaggctgactaccaaactgcagcttcacctggtcaagataagatagcgcatcctccacctgaggcagggataaatatcaaggttataaaaagaaagtaagctcataattacaaaaaaaaaacaaaaacaaattatttatgcctaagtatgcttaatgcagtaaatgaagtaaaaatatattaaatatatacttaaaagttagtatggataccaataataaactcaagcttaaaataataatcaactcataaaatctgtagccttgccttggaaaattttgaacagaatgatcagtgaagaataattacaatgatatatcatttattaattcatttcacaagtatctactaaactgcaacataccaggcccaatgtgagtaccaaggattcaatgacaaataatttgtagcccctcgtctatagacatttgtttgtatgtagtcaggaatcataacacagtgggtaacccggtaatcactccatgcctggagatgacatgggaaggacacgtcttctccaccaaaaaaagtgaggcttccccaggaggtaatgtataaactgagacctaaagatgactataagctagcaaaagtgaagaccagtgaagaaaatcaaaagcggcagcacgggtaaaatcctagacaggatacgatatgggatatttagaaatctgaaaacagtttagtttggctggaggatctgtagtgaagaggaaggaaaagtaacaaaatgagacagaaaaaaaagcaggatctagattctgaaaggatttgtaaatcttgtgaaaaagcaatttagatttttatcatctgcattttcgtgtacgcaatttgactgcagtgttgagaaaaaattggcacaagagcagaaaagattgaaaggaggtaggaagaccaggtatgctacaggaataactggacaactcatgtgaaaacagtggcttgaattatagtactggcccagaacaacagagagaactgcatagataaaaaagctttttgggtagtagaagtgacaggattggggaactgactgaatagaggagctaagggagagccagcattcaaaagtgatccgccacggagcactgaggaagaacagtcaagagtgactctcggaccgatcaaagcccacatgccactgcatcccgcactcagcgcttacatccttccacatcaccaccacacccaagagaaagcctgaaggggatgctaaaggagatagagccaaggtgaagaacaacccagagaagatccgcaaggttgtatgctaaacctgctcctccaaagccagagcccaaccctaaaaaggatgcaggctgggcgcagtggctgacacctgcaatcccagcactttcagaggcagaggtgggaggatcatctgaggtcaggagttcgagaccagcctgaccaacacggagaaacccatctctactaaaaatacaaaaattagccaggcatggtggcgcatgtctgtaatgccagctactcgggaggctgaggcaggggaatcacttgaacccaggaggcggaggttgcggtgagtcgagatcatgccattgcacaccagcctgggcaacaagagtgaaactcggtctcaggaaaaaaaaaaaaaaaaaaaaagtcccctgcaaaggagagagaggaggtacccaaagggaaaaaggaaaatgctgacactggcagggaggggaataaccttgcaggaaatggagatgccaaaacagaccaggcacagaaagctgaaggtgctagagatgccaagtgaaacatgtgcatttttggtaactgtgtacttctggtgactgtaaagtttgaactataaagttatgaagtttgtaaattttgaaataccattgtttaaatcaagctttataaaaatgcagaattttgttttgctttttctaaagcagtgttgttatcgcacacagaacacttcattgttgttttggtgggaaggatcacaggtcactaatagaatgtctttgaagctggactgacgtggggaaaacacctttcccttctagttttgagagacttcctcttggcttatagaagaaattccctgactttatttacttatttatttagagacagagttttgctattgttgcccaggctggagtgcagtggtgcgatcttggctcactgtaacctctgcctccggggttcaagcgattctcttgcctcagcctcctgagtagctggggttacaggcacccgccagcatgcctggctaatttttgtatttttagtacagacaggatttcaccacattggccaggctggtctcaaactcctgaccacaagtgatctgccagcctcagcctcccaaagtcctgggattacaggcgtgagccaccacacccagcctagattccctgacttttaacacacatggccaccttggcacaaacaccttgtgggatggaaaaacaaattcatttttacatcctgttctccctccccaccttcacagacctaactcccttttacccagacacctgttgggacctaacccccaataactggttaccaatatgtcaggcagtcaaactttccagtgatgccactgaaatggcagccctcaaaagagcagtggttgctttttctagactgtggatcttcagataagtcctgccattttcatttcacttcctgaaagtcagggttggcttgtgaaaagttgttaaacaacatgctaaatgtgaagtgtcaaccttcactctaaactttccctgttcagagcatcaaatgagacttcactgggttttatagtggcttttttttttttggtagctcattgttaaggattgtccatgttctgcctgaaataccatgactgtttttggaaagtatctttaaagctggatacagtttggctgggggagaaaaaaaactgacctatcacaaagaagaacaggttggaaaggctaagctatgagtctgatttaggacagagacacccaaaagaaatccccactaggtgtttcctatttactctgagatacgttaagttttattttggtagtttaactgaagcctaaatatttaaaattatacaaaatatcaggtttaagaaatttcagaaataaacatttgatgtgatttaagccagtctttttcttttttttttttttgagatgggagtctcattttgtctcccaggctagagtgcaatggcgcaatctcgggtcactgcaacttctgcctcctgggttcaagtgatatctcctgcctcagcctcctgagtagctgggattccaggcgcatgtcaccacatccaactaatttttttgtatttttagtagagatgggatttcaccatgttggccaggctggtcttgaactcctgacctcaactgatccgcctgcctcagcctcccaatgtgctgggattacagatgtgagccaccacacctggccaggcatagatagtcttttgatttgttgcaaaatggaacatttacattcaagtcaatcattaactggtgctgtggtctgaaatgtgtcccacaaaattcttacatcgaaacttaatcaccgatatgatgatattaagaagtgaggccttcagaaagtgattgtggagccctcatgaatgggattagggaccttataaaagggctggagtgaaccagtgttagtcccttcggcccttctcccttccagtgtaaggacacacattcagggaccatctcgaaaaacagagttcaggccctcaccagacaccaaaccaactggcacctggattttattttattatttattttatttattattattattatttttttagatgaagtcttgctcttgtctcccaggctggagtgcaaaggcacgatctcagctcaatacaacctccgcctcccgggttcaagcgattctcctgcctcagcctcttgagtaactgggattataggcgcctgccaccacgcccagctaatttttgtatttttagtagagatggggtgtcaccatgttggccaggctggtctcaatctcctgacctcgtgatccgcccgcctcggcctcccaacgtgctgggattacaggcgtaagccactgcgtctggcctatttatttattttgagacatggtctcactctgtcacccaggctggagtgcagtggcacaaattcggctcactgcaacttccacctcctgagttcaagcgattctcgtgcctcagcctccagagtaactgggattacaggtgcatgccatcatgcctggctcatttttttgtatcttcggtagttttaccatgttggccaggctggtcttgaactcctgacttcaaatgatctgccctcctcagcctcccaaagtgctgggattataggcgtgagccaccgcacccggccagcaccttgattttagatttcccagcccccagaacttctccagaactgtgagaaataaactgctattatttagattatacagtctcaggtattttgttatagcagcactaatggattgagacaaatggccgcttttttgtttttgttttttttgagacagagtctcgctctatcgcccaggctggagtgcagtggcgctttcccggctcaccgcaagctctgcctcccgggttcacgccattctcctgcctcagcctcccaagtagctgggactacaggcgcccgccaccacggccggctaatttttttttctatttttagtagagacgggatttcactgtgttagccaggatggtctcgatctcctgacctcgtgatctgcccgcctcggcctcttaaagtgctaggattacaggcgtgagccaccgcacccggccccgagacaaatggctgtttaagagttcttcagacttccattacggccatggttaatcagtgtttcggtgttgctagaaatcagattgtatagttggtcaatacccacttgtttgatggttagtttttctatacaaatatcatgacaatttctgttgaaattcaatggactattttaattcatattctgaactttccatactaaaatgtttcattaatgaccaacttaagtgaacacaaaatatattaagtttgcaaaaggaaccaagactttggaagatatttaagaatagcatgcatcattacacaacaaaagaacagttatcaataagacatggtatggtataaggtaactactgcagagacggaaaaagtacagaaacccaaaagaaagcaattatgtgtgatatgtatatgtctgaaacaaaaaggtactgaaagtcacagcaaaccaagcaaaccactgtttaaaaattagttataggccaggtgtggtggctcatgcctgtaatcctagtactctgggaggccaaggagggtggatcccttgaggccaggagtttgagagcagcctggctaacatggaaaaaccccgtcctagtaaaaaaaaaaaaaaatacaaaaattaggcttggtggtgcatgcctgtaatcccagctatttgggagactgaggcataagaatcacttgaacccaggcaggggagggtgcagtgagttgagatggcgccactgcactacagcctgggcagcagagtgagactctgtctcaaaaaaacaaaaaagtaaaataaaagttatagaataatcctatgctttaaaaactctgcatgacactcacataataaataagacacctacatgtaaaaatagtgaggaaattctctcatcacctaaagcatagtccaactcttatataaactctctataaatgcatgtatacagttctaggtagcacaacttaaaaaaaaaacttggatgtagttatttagaagctacagatttaaggaagcacttggggagacccttagactctgctgataaagtttcttagctcacttcaacagggatttactattaaggccccgaatctcctgaagtctacaatcttgttgggagagaaaaacacaagcaactgtaaagataacctgctaaatatgtaccaaatatcactgctgctgacattcaataactaaataacaccaaacatgcctcaaatcgttcaaatcccttcttgtcaccaccaatctaccaaagacaaaaaacaaaaaaaaaagacaatgttgaggcttgaaataatgtgtaagcattctcactgaacatttctttttttttgtttgttttttctgagacggagtttcactcttgtcgcccagactcgagtgcagtggtatgatcttggcttactgcaatctctgcctcctgggttccaacgattctcctgcctcagcctcctgagtagctgggattattacaggcatgcgccaccatgcctggctcattttgtatttttagtagaggcatggtttcatcacatttgtcaggctggtcttgaactcctgacctcaggtgatccacccacctcggcctcccaaagtgctgggattacaggtgtaagccaccatgcccggcctacattattatagaatataaatgatttattgaagttgattcaaatgcttgtaatgcattttaagactgatccaaaaatgacaggcaatgtgggaatactgagttaaattacatggaggtacaagaagcattttacctctcctcatcagaaaggaaattcaacaagttattttatgcaggaatatagtcaagagcttgtgactaaaagaacacaacaagaaatcctaactctatctatgactcactctataaccccaaatccaaaacctttccttgtttccttgccagtttccataaagcaaacaaaacataatccatatacttataccaaagagtcctgtgaggaaggtgggtaaaaactggtgttgtgctttgatagggttgattgaaaaaggctatagaaatacatatgtttttgttagtttaataagcaagtttataagctattttgcaacattaaagtataactactgaatatacagtgttaatacagaattaaatcacgcacaaccaagttttaaaaaaaatattttcaggacttagtaaagtgctaagcccgcagcaataatacattttggtacacagccatcactctacaacagactgaaaatgttttaaaggaaacatcaatattccttatacacattttcccaaagacagaatccagagtgaagcttcaggcctaaaaaacctgtactctctttaaaaggctatgcattagtcaatactatgtaagccaatatagagagtaaattttacaaaattactctaaatcacatagctttgctgtactttataatatttatgtagcatttaatactcttaggccaatattaaacaagttcccaagaatccacaccaacgagggcagggatcaagaagaactaaagtaagtatcagggaaaacagaagaaacaactatttgctgcatatggatatgtccttagagggtttatttctcattcgtgcctgcaagcaacataagtaggttgcaataaccaaatgaagatttaacatctcttcagagttcctccatttattatttcctgaacttaattttatataaacgtaaaattagaaaaattgaaacctgaacacttgctgcaacaatcacatattttgaaaagtaacattcaagtggtcagagatacaaggttagctgggaacacaagcttcacttctccagggatgcctcatgaatttcaaagcactgaaaacgtaccacacatactcagcagaaaatatgaaaacactgataattcattcacagttacagttttccctgaactttataaagattccccccaaaaaggagcatgtgttttactaagaatggacttgatgatgtgagtcaattcagctattcataaacaggaataaaaagataaaggtaataagaacattacaggcatgagctgggcatagtggctcgcacctgtaatcccaacactttcgaaggccaagatgggagaatcacttgaggccagcagtttgagaccagcctggggaacacagtgagactcccatctctgaaactaaaaactaaaaaaaaaaatttttaagaatttaaaaagattgaactgtaagatatattactgggccaatttactgtactaacctgtagccaatcatatatgtgctcaatagagagttcaaaaggaagcagccaaaaaatgaattttaaggtttattttgtattaaaatggccccacaatcctgataacatttgaccgacatgcattcatacagtccacaaacatttgagtatattcttctctggatcaggcactgatgccaagataggaaacataagcaaatttcacaaaacaaaaacggtaaaacttgtgattcgacagctagtatctcaggttagaagttgtaccaccacaaccaacaagctgcaaccagtatttcctgctaaagataaattttttgacccaagaaaaagagctgaataccaccttcagcctctgaaattgctgctgtccctgcactggtgcaactggtggggctggatgagcatgactctggaccacctggcctccgtggggctgcaccgctgttgggtgatgatggctgctatgaactgctgctatagcgggcccatgactgccggagctctgtggcatggctgaaacctggggtgaacaaaatacagacaggaaacttcaaggcttgtacattcttccccaaatgagtctaaataactaacacaaatgcacaaagataattaattggaaacccaaatttctgctgggcgtgatggctcacacctatctcacctacataggaagatcgcctgaactcaggagttcaaggctgcagtgagctatgatcatgccactgcattccagcttgggccacagagtgagaccacgtctctaaaaagagaaaagaaagcctgggcaacatagtgacacccatctccacaaaaaataaaaacttggccaggcatggcaacatgcacctgtggtcccacctactccagaggctaaaggaggaggattgcttgagtccaggagttcaaggctgcagtgagctgtgatcacaccactgctctctagcccaggtgacagaatgagaccgtctctaaaaaaaaagaaagaaaagaaaaagaaagaaacccaaattttccacaaaaggaactggttaaataaattacagcccaccaaagttataacaaaattatttgtagctattaaaaattatatagccgggcacggtggctcatgcctgtaatcccagcactttgagaggccaatgcaggcggatcacgaggtcaggagatcgagaccatcctggctagcatggtgaaaccccgtctctactaaaaatacaaaaaattaaccaggcgtgttggcgggcacctacagtcccagctactcgggaggctgaggcaggagaatagcgtgaacccaggaggcggagcttgcagtgagccaagatcgtgccactgcaatccagcctgcacgacaaagcaagactccatctcaaaaacaaacaaacaaaaaaatatatatatagtttagctgggaacagtgtctcacacctgtaaccagcactttgggaggcccaggcagacagatcacttgagttcaggagcttgagaccagcctggccaacatggtaagaccctgtctctactgaaaataccaaaaaaaatagctggacgtggtaacacgcatctgtaatcccagctactgagaggctgaggcacggtaatcacttgaacctgggaggtggaggttgcagtgagctgagatcatgccactgcattccagcctagaaaacagagcaagactctgtctccaaaaagaagaaaaaaaattatatagtttatctcaaactgtctgtggtaaaggatgagtttttttcttaaaatttcaatccatcagggaccacaacttttataaaaatccaataaaaataaattactatgaaagtgaaataaaaaatacataaacccgccgggcgtggtggctcatgcctgtaatcccagcactttgggaggccgaggtgggcggatcacctgaggttgggagttctcgagaccagcctgaccaacatggagaaaccccatctctactgaaaatacaaaattagacaggcatggtggcgcatgcctgtaatcccagctattcgggaggctgaggcaggagaattgcttgaaccagggaggtggaagttgcggggagctgagatcacgccactgcactccagcctaggcaacaagagtgaaactccatctcaaaaaacaaaacaacaaaaatacataaacccgtaattttttttcttacctttttattgagacagggtcccgctctctcacccaggctggagtgcagtggtacaatcatggctcactgcagccttgacctccccaggctcagatgatcctcccaccccagcttcccgagtagctgggactacaggcatgtaccaccatgcctggttaattgtcgtactttttgtagaaacagggtttcaacatgttgcccaggctggtcttgaactcttgggtatggagtccacctgccttggcctcccaaagtgctggggttatagacgtaagccactgtgcccagcctgtaactttcattactggattttacaaataaaaaatgatcatgtccaattgctctaatagtttctaaacaatttctatacttatgccattacaaactagtaacaaaggatacagattagccatttttaagccacacttcaacaatgatatatatggatatatttgaatctgaaaaaaaagttcataatccacaagttgaacatattcatgtactgtatataaacttttaaatagttttttaaagcacattacactggctgacaaagaccctgtctcaaaaaaataataaaagcacattacaaagcagtatgataaaaagatttcaaaccttagacaactaatatatagcaaaatgttggcatttaatcttgtggttacagaattaaagatgactcttactttgtttctttttgtttttgaaacactctcgctctatcgcccaggctggagtgcagtagcacaatttcggctcactgcaacctgtgcctcccaggttcaagcgattctcctgccttagcctcctgagtagctgggattacaggtgcctgccaccatgcccagctaatttttgtatttttagtagagacagggtttcaccctggttagactggtgtcgaactcctgacctcaaatgatccacccgtcttgggctcccaaagtgctgggattacaggtgtgagccaccgcgcctggcctacttggcttattttgcttatcttgatttgctacgagcactgtatctaatgtaaaataaattttttccccctaattcttgatggtttggcctcaaacaaatgtcttttctattcttttatctcagtctttctcctgtcctcttacaagtttgaggaaataaaagccaaaactactttccttctatatctatttcaagaaatgctacaaaatttttttcagaacttttttcctttttcagaattgttgatcaccacagaagacaacaatctgtccaaatgcccaaatgccccatccccaaaataaggagactaaataacatgaaactttctttctctaaacaatgttaagttttataccacaatttaagagagaataaaactttttttcaaatcctcacttttataaaaattatcctggagggagatgaagaaatgagggagagggagaaaccaagcaactatgcataaatccacagaaacaaaacaaggtgtattaagagtaaaaagaaactatttagacaattctaaaagctctaatgtacctcaaagatgggctagtattctgagcttctgtattccaacatgcatgttttttacagggtttacaggctttcactagactgacttatacaaacacattatagtttccattcggaagaaatttaactatcccaaatgtagaaaacagtcattaacctgtttagataatgaaagtaatcacccaaggtaaacaagcaacttttttttcttccaagtcctaaaagatgccatctgttggcagtcttctgactgctgccccagccccacaggaagggattagacagcctcaaggggactcctgaggaagagtgacacctaaggaatcaccatttcctacttcagctgcatttcctcttctttatatttttatactaaattcctagaaatggaattgccaggtcaaaaactaacaaaaccatctgacacaaactgccaaattgctctcaaaaaagattacgtcagtttatattcccattaccagccgtacatttttaaggtcactaacaaatgaggttgaaggcctccccagaccagttatatgctgaagtagaaagatatccactatatattaaatgaaaagagcaaacagcacaatagtatgtaatgtatgatccacattgtacaaaaagaaaagcagaaagggcggacgaggtggctcatgcctgtaatcctagcagtttgggaggccgagtcgggcagatcacttgagtccaagagttcaagaccagcctgggaaacatggtgaaactctgtctctatagaaaaaatacaaaaattagccaggtgtggtggcatgcacctgtagtcccaactacttgggagactgaggtgctaggattgcttgagcccaggaggtgaagggtgcagtgagctgagatcatgccacagccttccagcctgggcgagagtgtgactctgtctcaaaaaaaaaagtaaatttagatagctagacaggttgatatagatgagcttgtatatgcatataaaactggatacccaagaaattcaccagtgggagaaaatctgaggtgtgacagaaaaaaagtcattttatatcctttttttaaaaaaaaatcaaagtgtggcagggtgcagtggctcacacctgtaatcccagcactttgggaggtcaaggcaggcagatcacttaaaaccaggagtttaagaccagcctgcccaacatggcaaaaccctgtctctactaaaaatacaaaaattagccgggcatggtggcttgcgcctgtaatcccagcgactcaagaggctggggcatgagaatcacttgaacctggaagccagaggttgcagtgagccaagatcacgccactgcactccagctggggcgacagagcgagacaccatctcaaaaaaataaaataaggccgggtgcagtggctcacgcctgtaatcccagcactttggaaggcagacaggcggatcacctgaggtcaagaccagcctggccagcacagcgaaaccccatctccactaaaaatacaaaaattagctgggcgtggtggtgcacgcctgtaatcccagctactcgggaggctgaggcaagagaatcgcttcaacctagaaggcagaggctgcactgagccaagactgaaccattgcactccagcctgggcaacagacagagagtctgtctcaaaaataaataaataaataaataaaataggctaggcgtggtggctcacacctgtaatcccggtactttggaaggccaagaggggcagatcacctgaggtcaggagttcgagaccagtctggcccacatggcgaaaccccatctctactaaaaacacaaaaaattagccaggcatggcagcaggtgcacgtaatcccagctactcgggaggctgaggcaggagaatcacttgagcccgggaggcagaggttgcagtgggccgagatcgcaccactgcactccagcctgggtgataagagcgaaactccatctcaaaataaataaataaataaataaataaatgaataaaataaaaaataaaaaaaccaaagtgatacattactttcataataaaaaagggcaaaaaccaaatttcttcacttctacaaaacagagtaacagatgaatgatcagtgttggtcaggacatagaacaggaatatacaatgcttgggggaacttgctaaagatgcatataccctgtgacacagcaatccctttcataggtacttgacaaactcttgtatgtcctcaaacctgctgactggtttccaacaggttaaggagtttgcaccacaatgtaaaccaacgatggtagacccttgaataacacgggtttttgttttgtttttaaggagacagggtcttgcactgttgtccagtctgaagtacagttgcttgatcacagctcactgcagccttgacttcctgggcttgagcaatcctctcacctcagtctcccgggtagctaggactacagatgcacaccactatgcctggctaattttttatttattttttcaaattaattaattaattctttctttttgagacaagttcacactctgtcacccacgctgggtgcggaagcatattcactggagcctcaacctcccaggctcaaatgatcctctcacctcagcctcccaagtagctaggaacacaagtgtgcaccattacgccctgctaatctttatttttaggagagacggggcttgctatgttgcccaggctgatctcaaactcctgggctcaggcaatcctcatgcttccaacttcgccaactgttgggattatgggtgcgagccactgcactcagcaacaacacaagtccacttatacatggattttctcccacctctgccaaccctgagatggccagactaacccttcatcttctttctccctcctcctcagcctcctcaatgtgaagacaaggatgaagacctttatgatgatccacttccacttaataaatggtagatatattttctcttccttatgattttcttagtattttgtttcttctagattattttaagaatatagtatatgacaaatatacaaaatacatgctaatcaaccatttatgttatcggtaaagcttctggacaataggctatttgtatttaagttttaggggagtcaaaaattatacattggccagacgcagtggctcagacttgtaatcccagctctttgggaggctggctgggggaggatagctttgggccaagagtttaggaccagcctgagcaacacagcaacacctcatctctacaaaaatcataaaaattagccaggcatggtggtgtgcacctgtagtcctagctactagggaggctagggcacgggaggactgcttgagcccaagagtttgaggctgcagtgagtcatgatcgcaccactacaccccaacaggggccacagagcaagacactatctcctaaaaaaagaaaaaggaaaaaagttatacatgtatttttgactgcatggggggaagtcagtgcctcaacccccacactgtccaagagtcagccatatttcactacaatgatgtttaattcagctgtcttttttaaaaataaatagcaaaactgtcttaataagtgcgttgatttaaattctggcacaagcttcttattttgtcatgaattgccactgagtgcactaagacaatatcacaatgttcacagcagcacctttgtaaaagcaaaaacctggaaacagcccaatagtccaacagtagaattgacaaataaattgagtatatgcatgtaatttacactacagtgaaaatggtggaattacagcgatctataaaaatatggggtttttaaaacaaagtgagtcaaagaagaaaatgtttccatttatataaaagttcaaaaataccgaaactaaacaattatgttagtttttttaagtaaataaagtcaagggaatgataaatacaaagtttagatcagtggctacctctgaagggagggaaaagaagggagcagagtgggatacgcagggaacttcaaaggtcatgacaacattctttttttaaaaacttgtatggtgagtacacagttatttttttttttaccttacacatactcaacaatttttaatatctaacacagtattaaaaaaagttttataattgcctaaaaccactatttctcttccctcattctagtcccttggttggctccagcttacctggtagctgggtgttacagagtactgaattcccgtagctgactgcatggtctcagacactgcttcatacacaggaggggcaggggcaagcacccggtgctggtgaggaaaagcctctgtgctgccagggatccgacgctgctgggctgcatacaccggtgactcctggtcatccaaacgccgcttcattctgtgctcatgctcagggatgcactacaaaacctgcagaaaccaaaagcaatagcatgcaagtcaattctcactccagtatgatgtacgccacttaggaccagtcacccaagtttagtaaaagcttgactcccagaactgatcatctatttcatcttagtgatgaagtttaagtgcatgtgggcataccaccccccaacacagtgaacaagttataactgaaaaagacaaatatttaaataacataattttaattaatttggtattatgaagttgaaaaatacgctccaatttaaaaatataaacacaaccttgtttccctttattctctagttttctcctcaaatgctatcactcctaatattaattacatatctacatgctgcaaaaatattcaagtgcttcttctttttttttttgagacggagtctcactctgttgcccaggctgagtgcagtggtgccatctcggctcactgcaagatccacctcccgggttcacgccattctcctgcctcagcctcccgagtagctgggactacaggcacccgccaccacacccggctactttttttgcattcttagtagagacggggtttcaccgagttacccaggatggtctcgatctcctgaccttgtgatccatccgcctcagcctcccaaagtgctgggattacaggcgtgagccaccgcgcccggcctcaagtgcttcttcttaaatcctctcaaaacctactactataattgtggtctaatttaaaatttgtttcaacaattataatggtatcatggaaagaataccgtgccaggaatgggaagacaaagattctagacttgccaatttaagatgctacgtaacttcaacaagttcctcattctatgtgaatttcagtttctccaactataaaataagaaaagttggaacagatcactcctaaattttcttctggttttaacagttataagaagagattctcttagcttaataatacctccgtgggagacaatttcattcctgcaggacacagtaatctacttggcccagtaatctacttgggtcttcagagcttttccatatcagtatcactaacacaagcataacacaccatcagtgagaaagaatgaatcagccatccaaagaaaaaaggccccaccacttttccagtcccaaaaaaatctcttaaataagataccactgctatggaaagaagataaaatttacagtaatagtgggagatttggcaagccaccccctcatctgaaatacggttaagttaaaaaaaaaaaaaatctttacctaattcataagtctacccaagatcttttctttatcctctgggagcacacaagccctgaagggaaagtagtctttacaaggactctccatggctgtttcaccttttctttgtcctcactatagtcctcaatctgcctgccactctaatccttagctctgaaatcctgtctcaggtttttctcacatttcacatacctaagtgggaccctgacacagcagcacaacccattaatttgcaagctggctacttttatctatttgtaaactcaagccacaaatatgctctctgtggcctatataacttcagactaagtctctcagctttgtgtgtgataatatgtggaactcagttaaatggagttgagaacgtttctgacagctgctgaggacaaataatttaaaatgtcttagctagttatgctttcctatgtttttctagcatgaaatagcatgtttagcttagtattcaaaaaccttttagacatattaagaggttgagtatatagatttatgcatgttatttgccactaatcaactacgaacactaaacctcagcgtgttttgggatgaggaactgagtctaatcacaggtagagtaaaatgtctttttagctatttcttatatacgttcatgactttcagtggtttggtcttgggttctgttggtttaaaactgatgcttaactcatcggagattaacctctgtaaccaaaaatgaagtcaatactttattggccggatgcagtggctcacacctgtaatcccagcactttgggaggctgaggcaggcagatcacctaaggtcgggagtttgggaccagcctggccaacatggtgaaaccctgtctccagtaaaaatacaaaaattagccaggtgtgatggcgcacacctgtaaaacctgctacttgggaggctgaggcatgagaatcgctagaatccaggaggcagaggttgcatgaggggaggtcccaccactgcactccagcctgggcaacagactgagactctgtctcaaaaaaaaaaaaaaaaaaaaattatagaaatgttatgatagggcagcactgggtttaaaaaacaaaaacttcataggctggtcacagtggctcacacccgtaatcccagcactttggaaggccgaggtgggtggatcacctgaagtcaggagttcgagaccagccaggccaacatggtgaaacccagtctctactaaaaatacaaaattagctgggcatgatggcacgcatctgtaatcccagctacttgggacgctgagacgggagaatcgcttgaacctgggaggcggaggttgcagtgagcaaattcgcaccactgcaccccaggctgggggacagcgcgactgtctcaaaaaataacaacaacaaaaaaaaactttataaataataagccaaaatcagatgtgaagagcacggcacgactatagaaaaaacactagagtaccttttaagaactggattctgttggatgggagaatgtttgagggcaaaaaataaaaacaaacaaaaaagaactggattctactccaaactctatctaccatgaagctttctaattttggccctgttttcaaacaggggcaaaaggaggggatcagcctacattagtgatttccaaatgctggtttatgaaccagtctataaggaaaaagaagattgtagtgagcttttcatacattaagtattacagtactatggtttattctgatatcatactctatcttttggctgttaaaatatcgtttcttttattaagtgattgggatttcatatggtacttaacttcatccacctccagagtttgctttccataccacctctacaacactacagaggctgaactttctctgaaccatactttattcctttaacaattaccactcataggccgggcgtggtggctcacgagatcaggagatcgagaccatcctggctaacatggtgaaaccccgtctctactaaaaatacaaaaaattagccaggcgtagtggcgggcacctgtagtcctagctactcgggaggctgaggcaggagaatggcgtggaccgggaggcagagcttgcagtgagccgagatcatgccactgcactccagcctgggcgacagagcaagactccatctcaaaaacaacaacaacaaacaaacaaacaaacaattaccactcaaagttctattcctaactctctctcaaataaattgcttccgctctaatcatacctcctggtttcaggccctgatcatccttcacaacaaccttataagcaaggtgttctctaatttatgaatgaggaaactgaaaaacaaagattaagtaaactgcccaaggttgcacagctagtaagaggcaaagctgtgatataaatccaggaaatctgtctccagagcctggctcttaactacttcactaccttacctctcacagaagagaagaagtgaaggaagaatccctttacttatttaaggcacacatgcagggagcaagttcagctttttttaacctttcacacacttagctaactcatccttcttcagcctaaacctaataaagcagaaatgctttagtagcattcattcattaaaagcaaatgttcagtgagtagatatgaagttggtagatgatttcagcccttgccctctaaaaccatatatagcctcactagtaataaaaaacgtgtaaagtaggccgggcgcggtggctcatgcctgtaatcccagcgctttgggaggccgaggcaggcggatcacttgaggtcaggagttcaagaccagaccggccaacatggtgaaaccctccctctactaaaaatacaaaaattagccgggtgtggttgtgggcgcctgtaatcccagctactcaggaggctgaggcacgagaatcacttgaacctgggaggtggaggttgcagtgagccgaaatcgcgccactgcactccagcctgggcaatagagtggaactgtctcaaaaaaaaaaaaaataaaaggtcaggcgccgtggctcacacttgcaatcctaacactttggttcgccgaggcgagtggatcacctgacgtcgggagtttgagaccagcctgatcaacatggagaaactctgtctctactaaaaacacaaaattagccgggcatggtggtgcatgcctgtaatcccagctactcgagaggctgaggcaggaaaatcgcttgaacctgggaggcagaggctgcagtgagccgagatcgcgccactgcactccagcctgggcaacaagagcaaaactccgcctcaagaaaaaaaaaagtaatttactccaaagcaatttaaaaaaaaaaaagatgacagtgtgggtaaggatacagggaaacactgatggaggaggctttaattggtacagcctatttagctggcaacttgtaggtatttattaaaattttaaatgtgcatacccatcccatgcatattatggaaaactatgtaagaatcagatcaaagtttatccacgagtataagaaatgaactctaaaacatactagattttggaatactgaaactatcaattccactttcaggcctgtatcctacacatctgctgagtatatttattgcagcaaaatatgaaaatctaaatatctatcagctaaataaatgtgatcatgcatattatggaaaactatgtaggaatcagaaagatcagggtttatccacaagtacaaagaatgaactctaagacatattaagtgaaaacagcaggctaggccggatgcagtggcttacgcttataatcccagcactttgggaggccgaggcgggtggatcacctgagtttgggagttcgagaccaacctgaccaacatggagaaaccctgtctctactaaaaacacaaatattagctgggcgtggtggcgcatgcctgtaatcccagttactcaggaggctgaggcaggagaatcactcgaacccaggaggtagaggttgaggtgagccaagatggcgccactgcactccagcctgggcaacaagagtgaaactacgtctcaaaaaaaaaaaaaaaaagaagaagaaaacagtaagctatagaatacatacagcatgatctcatgtatgtatatatacacatacaaaatgtactaaagatttgtacatttcattgtatgtaaaatttgcattgaaagaaaaatgtgcctgggcacagtgattcatgcctgtaatcccaacactttgggaagctgaggctcaaggatggcttgagcccaggagctggagaccagcctgggcaacaatgggatgaccctgtctctacaaaataaagaaacaattagctggaagtggtggcgcacaactatggtactagctactccagtgactgaagtggaaggatctcttgacctcagaagttgaggctgcaaggttgtagtgagcagtgataacgtcactgcactccggcctgggcaacagagtgagactctgtctcaaaaaaaaaacaaaaaaaacaaaaaagaaaaagacaaagaaaaaacatgctagccacgcacaatggctcacaaagtgcctgtaatcccagcactttgggaggccgaggcaggcggacctcttgagcacaggagttcaagaccagcctgggcaacatggcgagactccatctctacaaaaaatacaaaattagccatgcatggtggcatgtacctgtaatcccagctatttaggaggctgacgtgggaggatcatgtgagtccaggagacagaggctgaggtgagctgagatctcgctactgcactcgagcctggacaaaaaagaaaaatgctataaacaatattaaactctagataatgataaacatgctcaagtgcttagatgaagtatactaatgtctgcaatttattttgaaatacatcaaaaaatcagattcattgatggagcgatggatagatggacaggcatatgttaaacctagtagtagaaaaatgataatggtaaaatctaggtagtgtgtatatgggtgttcattatatttactaaaattctatcaactttgttgtgtatttggaaattttcttgataaagtcttggaaaaaaacatccacaggttctgaggattaggaaaaaaaaaaacaggaagaaaagccaacaatacaaaccagctcttgagtggaaaaaataagtactataaattgggaaagggatacagacaggtacacttgggaagactctataaaggtaaatattcagctacatcttgaaaattagagatgaattagaacacaggggtatagagcatgaaattaaaatagtaagtttagacttgcaggcaatagttatttacaatctttgccaagtcattcatcccacaaataattagcaagtgcttaagacatgcctggccctgtgcggagggttagaagtccagcactgagccagagatttcctccccgacaacagccaagtcttccatgtatgactgctatcagctgatgtcctcctcgcaacaatcctgtcagataggcagtcccagaaccctttttttttttttgcaatagcataccattatgtccaccaggctggagtgcagcagggctatcacggctcaccgcatccccaacctcctgggctcaagtaatcctcccacctcagcctcccaagtagctgggacataggcagcgccaccatatctaacttttgtattttttgtagagacagggtctcgatatgctgcccaggctggtctccaactcctggcctcaaacaatcctcctgtcttggcctcccaaagtgctgagattataggcatgagccactgcgcccagccagacccctctttttttgagggaaactgatactcaaattaaatgacttattcaaggtcacatacctgactaaaagagcaagaggttaaattcttcctccttggaatatgaacaatctaaagtagaaacattggacaagactgtaaaaccacgcttgcagaggggtacagtgtaattctagaatataaagaaagccaaacgatggaaccacaaagtcagccacaaaagtactgtcaagtcccgcttcagccaacatggttgatctccatctgtttcaaatttggagtttatagtactatcagaactctagtctaggaagacattataaaaagaaaaaaaaagcactttgacgtatagaaactatggagagaagactaaataatggcagcagaacatttaaaggtcacctggtgggcacagtggcttgcacctgtaattccagcactctgggtgactgaggaggaaggatcatttgaggccaggaggtggaggttagattaagcaagattgcaccactgcactccagcctgagcgacagaggaagatcccaaatacacacacacaaaaaaaacacctacaggtcctaaaagtcacctggccatgtgttataataaaactgggcgcggtggttcacacctgtaatcctagcactgtgggaggctgaggcaggcggatcacttgaggtcaggagttcaaaaccagcctggccaacatggcgaaactctgtctttactaaagcacgaaaaacaaattagccgggtgtggttgtgggtgcctgtaatcccagctactcaggaagctgagacacaagaatcgcttgaacccagggtgcggagggtgcagtgagctgagatcgcgccaccgcattccagcctggttgacagaacaaggctctccgtctcaaaaaacaaaacaaacaaaaaaaaaacgggtgggatgctgggtgtagcagctcacatttgtaatcctagcactttgggaggccgtggtgggaggattgcttgaggccaggagtttgagatgagcctgggcaacaaagtgagacaccgtctctacaaaaaaattttattaaaaattagctgggcatggtagtgagcacctgtagtccttgctgcttaggaggctgaggtgggaggatcatttgagcctgggaggttgaggctacagtgagctgtgattatgccactgcactccagcatgggtgatggaataagaccctgtctcaaaaaaacaaaagtctatcctggtcagtttgtttaaatgcatactcttagaacaaaaaataaaataaataaatgcatactcttttttgcttatttttaaatgcatattcttgaaacaatggaaagtttctcttcaaaagcaaacttccatcgcagtattaagtcaatgtaaacttcaacccagtgcaattttgagtagtctaattcaaaatttgtccaaaagtccacctctggttttaaatctgctaagaaagaatctattacagaatgaaaggcactctatttagatttcatatattgattagaattattgcttggaaaaattaacaaccagctcttctcaaaagacaccattagatctaatatccaagcctcctttgaactcagtttttatattcttctaatgcagtggtcctcaactaggggagattctgcctcccaagggcacatgtagtaatgatggaagacatttttggttgtcacaactcgggaagatggaatgctactgatatctcacagatagagtaaaaggatgttgtcaaacatcctacaatgcacacgacagtctcctcacaacaaattatttggcccaaaatgtcaacagtgtgtgaagactgagaaacctaagtttaatcataaccccaactgtcacatatcttttttttttttttgagacagagtcttgctctgtcacccaggctggagcgcagtggcgtgatcttggctcactgcaagctccgcctcccaggttcatgccattcttcggcctcagcctcccaagtaactgggactacaggcgcctgccaccacgcctggctaattttttttttgtattttttagtagagatggggtttcactgtgttagccaggatggtctcgatctcctgacctcgtgatccgcccacctcagcctcccaaagtgctgggattacaggcgtgagccaccgcacccggccatcaatgcttcttttacggcatatgatacacctttaacccgcattataccattacgcattggccagacactctgacctaaagttttttagaactcttatctttttttacgcctggtctcctttcgtccctctcttaggcttgatctgtaaaactcttctgactcaaaattttagagcttttctgataccataatgctcattaaatctgtaaaaattaaaaataacgccaagtgtggtggctcacgcctgtaatctcagcactttgggaggctgaggcgggcggatcacctgaggtcaggagttcaagaccagcctggtcaacatggtgaaaccccgtctctactaaaaacacaaaaattagctgggcgtggtagcgggcgcctgtaatcccagcaactttggaggctgaggcaggagaattgcttgaacctgggaggcggaggttgcagtgagccaagatcacgccaatgcactccagcctgggcaacagagcgagactccctctcaaaaataaataaataaataaataactttaaaaaaaccccatatcgttattacttactattttaacaagaatgtaagtagcaaatttgtttttttttttgagacacagtcttactttgtcacccaggctggagtgcagtggtgcaatctcaactcactgcaacctctgcctcccaggttcaagcaattcctgtgcctcagcctcccaaagcagctggaattacaggtgtgtgccactacacctggctaatttttgtatttttagtagaaaaggggttttgccatgttggccaggctgttctcaaactcctgacctcaagtgatctgcccgcttcagccacccaaagtgctgggattacaggtgtgagccaccatgcccagccttaagtagcaaatctaaatttttattccgtactttcctggacactgggagatataaatatccaaaatgtgcaacatcctttaaaatgcaaccaagtactcatcaaatgtcatgcatgaacttggaacacagccattctataaattttttgtttcttttaagaaacaaggggtcgggcgcggtggctcatgcctgtaatcccagcactttggaaggccaaggcaggcggattacgaggtcaggagatcgagaccatcctggctaacaaggtgaagccccgtctttaccaaaaatacaaaaaattagccaggcgtggtggcaggcgcctgtagtcccagctgctcgggaggctgaggcaggagaatggcgtgaacctggaaggcagagcttgcagtgagctgagatcgcgccactgcactccagcctgggtgacagagcgaagactctgtctcaaaaaaaaaaaaaaaaaaaagaacaagaaaaagaaacagggttggccaggtgcagtggctcacgcctgtaatctcagtactttgggaggccaagtcgggtagatcacgtgaggtgaggagctcaagaccagcctagccaacatggtgaaaccccatctctactaaaaatacaaaaaaattagccgggcatggtggcgtgtgcctataatcccagctactcaggaagctgagtcagtagaattgcttgaacttgggaggtggaggttgaccgagatctcgccactacactccagcgtgggcaacagagccagactccgtctcaaaaaaacaaaaaacaaaataaaaaaaaaacagggtcttgctctattgcccaggctagagtacagtggcatgatcatagctcattacagactgctgggctcaaacaatcctcccacctcagcttcctaagtagctgggactacagagtggctaataagaaaaaaattttttttagagacagggtctccctacattgcacaggccggtcttgaactcctggccacaagcgatcctcctgcctcagcctcccgagtagctggtgtataccactacacttggcttccactctgtaaacaggtacacaccaccacgcttggcttccattttgtaaattttgattccaggtttcaggtacagctctagtaaggttctagcttatcacctctgggtctttttttccctttctgcccatcaaatgaaatactttgaaaactcacttcataattttgttggagagaacagtcatcttctttgctccataatcataagcattctcatttttagactaataaatgtcaatcagaatgaacaatccaggctgagcgtgtggctcttgcctctaatcccagcactctcagaggccgaggcgggtggatcacgaggtcaggagattgagaccatcctggctaaaacggtgaaaccccatctgtaccaaaactacaaaaaattagctgggtgcagtggcacgcacccgtagtcccagctactcgggaggctgaggcaggagaatcgcttgaacccaggaggcagaggttgcagtgagcaaagaccatgccactgcactccagcctgggtaacaagagtgagactctgtctcaaaaaaaaaaaaaaaaaaaaaaaaaaaaaaaaactgattttttttttcatttttacataatttttccttctaaccatctttatacatatacgtaactttggcacctgtccacttacaaactgcatcaactaagttttggtgtacaaatatcttgaaagatgaaagaatactatcatacatctttttggcaaagtgcagtggttttgattgtttttttttttcatttcttaaaaatagaaatggggtctcactatgttgcccaggctggtctcgaacgtctgggctcaagcgatcctcccacctcagcctcccaagaaggtgggattgcaggcatatgccactgcacccagcccagttctgattcttataaaaagaaaatcacattctagctggatgcctatagtgccagttacttgggggaactgaagcaggagaacagcttgagctcaggaatttaaatccagcctgggcaacatagtgagatagatcccatctttaaaaaaaaaaaaaaaaaaaaaaaaattcaccgctgggcatggtggctcacgactgtaatcccagcactttgggaggccaaggcaggtggatcacctgaggttgggagttcaagaccagcctgaccaacatggagaaaccccatcttttactaaaaatacaaaaaattagccaggcatggtggtacatgcctgtaatcccagctacttgggaggctaaggcaggagaatcccttgaacccaggaggcggaggttgcggtgagccgagattgtgccatggcactctagcctgggcaataagagcaaaactctgtctcaaaaaaaaaaaaaaaaaaaaaatcacattctaaactcatctagggtacagtcacatatgtatatgggtggagacagaatcttgctatgttgcccagcctggttttgaagtactgggctcaagtgatcctcccatctcagcctcccgagatgctaggattacaggtgcacgccaccatgcctggctgaagactcttattttacaacttggtttatataactttaccgtcatcctaacagtctagagtactactgtcacacagcattcatctactagttcctctgaaatgtcttctgtagtcagttttcttctctttgccattataggaggaagatgaaaaactatggatttttaaatatgtccaatgaaagcttaaaagttgaaaaatagtataaaaattaccatgtactccttcacctagattctccaaatgttaacatcttacataatgtttaagatggtatctcccaacttcttttatactttcttgaaagatgctgtaggctgggcatgctggctcatgcctggaatcccagcactttgggaggctaaggtgggtggattgtttgagcccaggagttcgagactagcctagacaacatggcgaaacgttctctctacaaaaaaaatacaaaaattagccaggtgtggtggcacatgcctgtagtcccagctacttggagggctgaggtgagattgcttgagtctgggaggcgaaggttgcagtgaactgagattgcgccactgcactccagcctgggtgacagagtgagaccctgtatccaaaaagaaaaaaaaagttgctgtaagttttgggaaaagcaataagaaaactgaagggctgcggtgcacacctatagtcccagctaccgaggatgcttaggagggatgatcacttgagcccagaagtttgaggctgcagagagctatgatcataccactgcccttcggcctgggcaacaaagcgaggccccatctctaaaaactgaagtgtaaaactaatgatttatttcactactgcatatccttttaagcaattctataattctccctttgtcatattattttagtcctctttagcatatttgagaattgatgagtaatgatgaaataattcctaggatgatgaaataccaaaacatttcaatatacaggaaaaataagatcagtaaaactccacaacattgtttcgatgtacaagtggtaatagctaaaatgagtttattcctttggaaaaaaaataaattttcaggctgggcatggtgactcatgcctgtaatcgcagcacttcgagagataagaagtttgaggccagcctggccaatatggtgaaaccccatttctactaaaaatacaaaaattagctgggtatggtggtacacacctgtaatcccagctactcgggaggttgaggcaggagaaccagttgaacccaggaggcggaggttgcagtgagccaagatcgcgctactgcactccagcctggggatggaacaagaccgcatctcaaaaataaaattaaaaataaaaataaattttctctttgctgttttgaagacctccaataaataaaagtcatgaaatatacatctttacaagtagttagtactgctttaaaaaaaaaaagcaaaactcaaaaactaaaattgagtccagaccaggtgcagtggctcaggcctgtaatcccagcactttgggaggccgaggtgggcagactgcttgagcccaggagtttgagaccaatctgggcaatacagacttcggtgacactgatgttacccagacatttcttactactgtaggtagaaaatgaacagaaatttagttaaattcaaaatgtattaataattgttatcaatgttgattttctgatttgatcactgtattgtggttttaaaagatgcacttggggaatctaggtgaagattatagggctattatttgtattatttttgcaactctctttgaagtctaaaattatttccaaagaaaaagttttttaaaaattaagtattaggccaggcatggtggctaacacctgtaatctcagcactttgggtgtctgaggcaggtggattgcttgagtccaggaagaccagcctgagcaacatggtaagaccctatctctatttaatataagaaatataatctttcaaaatatctataaggccaggtgcagtggctcatgcctgtaatcccagcacttcgggaggccaaggcaggtggattgcctgaggccaggagttcaagacaaggctggtcaacgtggtaaaaccctgtctctactaaaaatacaaaaaattagccaggcatggtggtggcgcctgtgatcccagctactcaggaggctgagacaggagaactgcttgaacctgggaaggggagattgcagtgagctgagatcgcgctactgtactccagcctgggcgacagagcgagacactgtctcaaaaaaaaaaaaaaaaaaaaaaaaattagccaggcatggtggtgggtgcctgtaatcccagctactcgggaggctaaggcagaagaatcacttgaacccaggaggtggaggttgcagtgagctgagattgtgccaagccgagattgcaccactgcactccagcctgggagacagagcaaaactccgtctcaaaataaataaataaataaataaatagctgggtgtagtggcgcatgcctgtaatcccagctgctcgggaggctgaggcaggagaatcacttgaagctgggtgtgtgtatgtgtgtgtgtgcaatgagccgagatagtaccactgcactctagcctgggcaacacagtgagaccttgtctcaaaaaaaagaaaaaaaaaaaaaaaaaagaaagaaagaaaagaaaatagagcattacaaagaatagaacttgagatagttcttgaaaggacaggtggaagtgtcactcacatctcacactgcttttatcacattagctcttctgctcccacacaaacatgggcacataacatctttaaccatctatgtatcctctaccatgctcagcatactgctttgtcttgtctgtggtggaaaccaaatcattcattcatgtatacattctctaatatctactgagcacatactatgcaccaggtgttttaggagctggagatacaacggtaaacaaaaatctcttccctcaagaagcttatattttagtgaaagatgacacaatagacaaagtataatatttagaatagtaggcagtgacaggtatcaagaacaaaaggcaaggaagagtttttgaaattgtagataagaatggtcagataatacctactgataaggtaacttctgagtaaaggaagtgagggagctagtcatgcagaaattagtggaggaagccttctaggcagaggggacagcaaccgcaaagaccctcatgtctttgtgagggctcacatgtgcttgacatgttccaaaacagcatgaaggctgggtagctgaagaaaaacgaaagaaggactagtcagaaatgtagtcagagaggtactaggataagggtggcaggcagagggtacatcagatttgttcttacaggtgtttttttattttttgacacagggtctcattttgtcgtcaaggctggggtgcagtggcacagtcatggctcactgcagcctcaagctcctgagctcaagcaatcctcctgcctcagcctctcaagtaactgggactacaggcacgcgccagcatgcttggctaatttttaatttttttatagagacagggtcttgttatgatgcccaagctggtctcaaactcctggactcaaacgatcctcccacttgagctcccaaaatggtgaaattacagacatatccttttttttttcttttgagacagtctcgctctgtcgcccaggctagagtgcagtggcacgatcttggctcactgcaagctccacctcccgggttcacaccattctcctgcctcaacctcccgagtagctgggactacaggtgcgtgtgccaccatgcccggctaactcttttgtattttttttagtggagaccatgttagccaggatggtctcaatctcctgacctcgtgatccgcctgcctcagcctcccaaagtgctggtattacaggcatgggccaccgcgcccagctcattacagacatatctaaataaggactcaggtttaatactcagactgaaatggaaagccactggatggttttaagcagagaagtgacacggtatgacttaggtttcaaaagaatcacttgggttgctatgttgagaacacatttaagagccgcagtaacaaaacaaggagaatagaatccaagctagagatgcacaggcactgactagggcagtggagatgcagatcctaagtggtctaattctggatagtattttgaatataaagcagtaaaatttactgatggaccacatatgaaaaagacacagaagagtcaacaatgtctcttagttatccaagaggagacatcgagtggagaccttgagtgggccactaaacatattagtctatggtagagggagagatccccgttagagtcatcagcattgtttggattttagaaaggtaatatggtacatatactgtatcatctctctctcccagctagggctgagtagctccccataatcaagcagtcacatttctgcatcatgcaggatagcccaggtcaggctgtaccccaaaactagttgtggaactagacttaccaaaaaacaaaaactcttgcatttcagaactgcaaataaaggatgtggacctgcatatcctccaatagcccatatgtcagcaagcctagccctggaggacaccaagaagactcatgaagggtccactgtcatgctgagaaatatgggtaacatacaagcatacaagacaaaaagtgggtagggaaaacaaaagcaaaaggggcaaataagaaatacatcaggtagaaattgccacccatgaccgggcacggtgactcacgtcttaatcctagcacttttgagaggctgaggcagaaggacctcttgagcccaggagttcgagaccagcctgggcaacacagcaggacttcacctctataaaaatataaaaaaaattagccaggtgcgtggtggcacacacctgtagtcccagctacatgggaggctaaggtaggagggtcgcttaagtccagaagatcaacactgcagtgagctgtgatcatgccactgcactccagcctggtgacagagcgagacttcgtctaaaaaaaaaaaaaaaaagacatgagaaaaaaagacattatgcggccgggtgcagtggatcatgcctgtaatcccagtactttgggaggctgaggcgggcggatcacgaggtcaggagtctgcgaccaacctgatcaacatggtgaaaccctgcctctaccaaaagtacaaaacttagccaggcgtgtggtggcgccccagcttcttcttcgtggaggctgaggcaggacaatcgctagaacccgggaggcggaagttgcagtgagctgagattgcaccactgcactccagcctgggagacagagcaggactccatctcaaaaaaaaaaaaaagtctagtgcctaacacagtatctgtgacacagtaagtgctcaataaatatcagcttttatttttcaaggggcgaggaaggtgtattttgaaaaagcatatactatttatttttttaaaggcctacagaaagtaaagcttaacaaactcttggctggtggattgcccagaaaagagagaaagccatgaaaagcactatgctaaactactgaatgccagggatataacctcttaattccagttaaaattcccaggtactaacatctgccatgcacagctctccagtgtcttgtctgctcccactgaagatgtaaaaagaattatacttcaccaggaatcttgtcaaattactacacacctccttccttaaaaaagaaaaaaagtctttctctgtatgtaaattattaaaaccctcttaattacgaagtgccaatctttctaagctatttatctctgaacaaaattatagtatataaaataattatctggagattatgaagcatttatgaaaatgttcctaatacagcaaaaccaggttcttacttgaatccttatagactcttctgtgttccccagtatacagcactgcaaatcatgggaactatatatgtagcccaaattttcctcaatggtcaatcgttctccactatctctctcagtttatggcatcagaaaaaaccacctggattttttgtctccccaccaattctattacagccatcatttgctaaactaaaatgctattgcttttgcaacttccttagcagagaaggtaggacccacctacccttttcacataaatatagcacagggtaccactcaggccctactaaccaaagcacaaatctagaatttcacttcagataattaaccagaggctcatttagacattactgcataaataaacattggttccatgtttatttttctcatgaaaaatgtgaaaaacattgaaataatttctctcaataggaaaagataatgtatcaagtgaaagcaaaaacctcatctaatgtggttctgctatctaaatctgaaatgccctaaggcaactctccaatacaggctggagggcaacgctacagaagtcacatacagaaggctaccctgatccacaattccaccctcctctgaaataaaaagggcaacaacactgtactatgtagagtataaatagaaagtggtctagatggtctaacataagtacataaaataaaaaagaaaagacttttcacctatagttacctaaatagcaaattctttaggaaaccaagtttttttggttgttttttgaggcggagttttgctcctgtcgcccaggctacagtgcaatggcaccatctcggctcactgcaccctcgcctcccgggttcaagtgattctcctgcctcagcctccccagtagctgggattacaggcgcttgccaccacgcccagcttttttttgtatttttagtagaaacagggtttcgccatgtaagcctggctggtctcgaactcctgacctcaagtgatccacctgcctcggcctcccaaagtgctaggattacaggcatgagccaccgcgcccgtccaggaaactaagtttatatagcagaaccatgtgcacaatgaaagcattcaaaaatacaactgtcagagatatcggagtattttattcaaagtctgagttcttaaaaaaaaaaaacaaaccctactttataaacagaccagttttgagattaaaatgtaaatccaaactttcctgttataaatctcagccttgtaaagaggaggagcttccactgccttttcaaggctaacttcgtttaaagtcctaacgcaccgaaacagacgccaagtctactacccaccacccattggctcaaaggaagccccgccccgtacagccacggtaactgaacatcaagggaaccccagggaaggttttccctccgccacatttctagtctctgatgactccctgcccctcccctaccatcaccaccgcggatctagggttccagcaccagccacgcacgctcctacaagaggaccttgggcacttcgccccaatagttacaaccaagaggggagtgggggtgaccatgctcccactctcctggctgcacggtgccagacacgctgcatggagcaaagcggagaaagcagctccggcacagggcccttgtgcccccaggcagaaggcatgacccagccacaagagtaagtcctgacacctccacagctcccagtcggcgggtgcccctccctccccacggagacatagggcggggcagatctaggcgccgagactcccagccagacccgacagcgggctttccctagcacctcctcattgccaaggaggcggaaacccggggcctgggcggggtgcagggggggacggccaaggggagtggcatcacggatcagtacggcccctccggccaaccggatcccaagaaggcggaggaactcagacttcacgccccctccctgccgcgccctgaatctacacgcgggagacccccccctacccctccccgaccccagcaggccagagcgcggccgccagcccgaggccccgcccaccccaggaggaggggagggggtggtcggccgcaaactgcactcagcgcgaagccggccccgcccctttctccacaatcgcacgcgcgcgccggccccgcctctgagcggcggcgcgagagcccgcccccctccgcgcgcaccgggactacgctctcctccccctcccgcgcggagagctaccccgctccgccccccacccccctcacacaaccacacacctcccgcccgtctgctctacgggaagccgaggaggtcagccccccccccccaaaatacacaccctcgagtccggcgttacccgccaccaggctcccgcccggcccccggcccagcgtgctctcaccgcaaagctgcttcggccgctcgtcactgcgtgtccctctcagcgtgagccgcgagctcagcagggaggccccgagaacggcgcggggcacaggcccgccgaagcggactgccagctacctctccactaacgaagcggtcacaggctccggtgcccagactgggaaggagggagggagggagggagggaaactccgaggggggaaggggaggggggaagatggagaaaccgtctccgccgcctctaccgccgcggccgcttctctgttacccgggaaatcccgcccactcccccgaccccgccccgcagagggaagactcagcttcgttccaatacaggacgcaatacccgcccgtcaaagactcagccaaccaccgaggcctgtcttatgattttcccgccccttccccctcgactggtaggggagggggagccgctctccttctccacgcccctattggcggggagcttccctaactcaaccccgcctattggagacggactgctgaagcccacccccgagccccaacactattggaggaagcagggaagctcttcctgtctcattggaggacaccacataacccgccctgcagcgtctcagccacaggcctaacaagttggctcccgcctccgctggtcatcgcattggaaggctacccctggctctcccaccgccccagtaaggtaagtaaccgatgtggggtaaaatgtctgtaagtgaaacaggctccgcctaccgcactgccgggccaggccccgccccaagagtcggattggatatcttggcgctggtaggaccctccattggccagggcgcccgtctaggaaggagctaattccaccctgcgcgaggaggctgaaccttagcagtccttttgtggaatgtttacactagagactgaagctcggagttccagggcccgagataggagggggagcggagctcatcagcggagactccacatcctaggatttgaaggaaaggcagcccaccatggaggactccctcacaaaaaaaatgagagaatgagaactcatccttccgtccagttatctttacagtttacattctacacactgcgtccttgtaaacacaaatatccggagcagctggcaactcctttcagccaagtagagtacagaactaaggtctggagacctaggcggagaagtaaactccctagagctgaatatgcagtcctaagagggcggagataaccaaaagagaggcgggctctaacagccaccgccctggcaagcctccggaaggcggagcgtgaggcacaaggtactcacgatctcccgggtggatctggaggcatcctcagaactgagaaaggagaggaaaacaccaaaacaggccacggcataaattaacattggggacatgccacactcagagaatggataaaatttccgtagttggggacataagataacggctgttcaccttctccttggccgggagtgttaatagcagttcctgtgccctctctgtgtaggtaacagtgcctcgaacacacagtgagacaaagtgctttcaattcctagtttgcttttatttattcaccaaatagggcgtgggcctgacgctgatcttactttggggggcgctctctcagcgccaggagaggtgacgggattacgttgttaccgctctcccgaataagtagaaccctcctcccagagagctaagaccccaagggacacgcccagggaacccacgcctaggtccaacactgtcctccctctgcaatccagcggaaacggccaggaacgagctctggcagcaggtgggcctgactccagcgatggcttcgagccgcgaaaccacagcagcgaattgtgaactccaagggtagccgacaggtgggagcagcctcgccagtagccaagccctgccccaggacagagctctaaaaataagtcagaccaacgaagcgaccccagggccaaactgctcggaggttaggaggaagcggcactccagcagaactgacccacggctacttttaactttgcgccgccttccaccactagactgagtaccacagggcattcccaccatggtatcaagaactactcagaacccaagccagcattaggccgcccacgacttcccgtgaacacagggtaccacctgcgctaagatctcgcctaagggccccaggccagggcactaggttgtcagagtctcagatacagccaactaaggacagccgctgccatgcctaggaaagaacagacacttgcagcgtctgcagagttctcgagcttaagctcagggaagtcaaggggcacggaaatagccaagcgacagggttagaactttagtacttggccccggccccgaaaggcagatctcaaacccagcagaacctccggagtttcgctcccgaaatccactccgcactgtaatcccctggcttcaccccgaaggctactaggtctcgagcctcggtggaacctttgtgtggcttctcggctctccccgcccccctcgccaagggcgccgagcctaggacttccgggcgggagggcagttcgaaggagctaggcgggcctcacacatgtgcggagcgcgctcaagagcggagggaggcggggagcaagggtggacttcccctcccagctctctccgccggaggaggccgggctacccgccccaccaatcagaggcgggggcgggaccttgcgcctcacgtcatccgcaagaaccgtccctcctccctccgcgaaaaaaaaatcctagcaacttaaactccagcccggcctcccgataggcggagctcgggagaatgtcatccaatccacatccaagaaggagaaaaaaagggagtctcgcctagccagtggaagacaagagaaggcggggcctccgggagagccggaggtgggtgggagagaggaaaggggtccgcccctcagctcccctgcaggcgggttgcacaagccgccggcggagtagatagtaaacagtctgggccgaggagtgcaggcaagggccgcccggcgctcggtggactgggcccctgcgccgcctctcccggcgtcgccccgcccggccgggacggttcccgccggcgccccgcctacccgcccgcggccgccatcccggctgacaggcgcgccccccgcgcccctccccgcccgctgatgcatttccttttcccgattccgagcgtggagactgttttcccagtttccgaccttcactgcccctttcaggccaccccctcgtgggcgcgcacacgcccgcgcccccgcccccgccccatccgcgccgagcggtccgcagcagcacctcgcgggaagggggagcccggcggcggcacggtcgggggaggggaagagagcagcagtcgccgccgccgccttggggtgggcggggaagcaggcagctccatgtttgcaaggggatcagccggggccgcggacgaagccgccgagtttctgggggttttccgcaccaccgatgcgagctccttgctgggtcgcggcctgacgggttccggcaccgaatgctgactcgaccgccacggccagggagtttggagacccggcagctcgcagggctagcggcgaggcgcaggggctctttccggtggcctctcccgcccccggccgcccctcccgcaagtccggtgttgcccccgcccccagagtccataacaaccgcgggcccacagtgcccgcgcctctccggagcgcgcccaccgccccctccaagtttgcgggcaaaaacaaaaccctcggggcggctgccgcccttgtccagcgtgggtagccagggaagccgcgggccccggctcgctcgctaactccagctctcgagcaactccgagcgccgcgagctcagtgggccccgccgaccatgctcgagccgccgccccctgccgagcccgcacgccgcagctccggcccggttctagtcggtgtgcggaatcccccttttctttccagtatttttctttttaaaaaaacggcacaacaggagtcgggggtctcctgcccgccccttctccagtccgccgccaaaacctaccgaaaccgactgctcggtgagataaactaggctacacggccggcgcagggacgaccccaggccaggcccacccctctcccacggctccggccaggctgggaaacacacacactggcgagcgggcggcgccaagagctctccttcctggcctgtccctcgcctacctcggccgcggaactccgagcctcccctcagctcggtcccagggcccgcagggcccacaccacgtcgggccggccagaccgagcggccggcggactagccccccaaacgcctgagattggggggaccaaattaaaagcagctgtttaac

SEQ ID NO: 922 - DNA, 82369 bp, Homo sapiens
attagccctgatattttaatggaaatactgaccaagtttacaacatttcaaatgcagatcacacggaaaggtgactaagtacagaataacaaatgtgatttaaaacaaagataacctgctgctgcatataatacaggttgggtttagagcttggagctcagatgtcagacagcaggaggaataaaaatgctacttgtgaaaacccaggctgtaggtaaaacttactcttttgttggttgcactggtgggttgggactttctcctgaactggccttgaaatcctatcctgacctgcaggcaagtgctctggacaaaacactgcaggggcagcaacagctggggctgaccctgatcacaccccaccaatttcccctatggttccaggtcaacatgacctttcttgagggaacacggggataggtgaattatttgagaaaacctcaagatctttcccctaaatcagtacacatgaccaccgccaagtcagacactgccccagctttgccctaaaatctcatcccacaaagctctttttggcaccctacactttggctcacagtctcttctccccagtacaaaaaaagcctaaaatcaggccagggtggctcacacctgtaatctcagcactttgcgaggccgaggtgggaggacagcttgaggccaggagtttgagaccaacctgggcagcatagcaagaccctgtctctacaaaaagttaaaaaattagctgggcgtggtggcatgcagctactcaggaggccgaggtgggaggactgcttgagcctgggaggtcaagcctgcagtgagctatgatcgtggcactgcactccagtgtgggtcataaagcgagacactgtctttaaacaataaaagcctaaaatcagagaggtctaccatgtgttttgaaaatccaggagccaaaaaattttgtttttctttttggtggtggtggtgatttttaactaaaaagcaaacataaaacacacagaacattgctggttacaactaagacttgcgtaatggttgctgaagaaaaatccaccagagtactgggaggggctcagttggtctttgttcagaaagtccaggttaaccacatagaaaaatcctaatcattcatgtttaaatgtctgctagtttaaatttatgtaattaaaaaaataggtatcccatttcaaattctctccctcccaactccatttataaggtataccacatgccttatgcacacttttttttcaaacactggtttggtatttaagttgctcacccccatccatcaccaatgtgaataagaaaaaatatatagaaatacaaactacatagcttgacaacttacccaaatataaaatattttcagattatttgaacaagggaaaaaaacacgtactaaaagacttaagtattctaagattttggaatattttgatttgggacaagtaacaagtattttaagcaaaatcctgtttctaccctggataaggaactgaagtcaaaatccctgcttcacagtattttctggtgaggacaagggacgtgggttgagagtttattccttaagtaagaaccaagctttatttatttacaaaaaaaaaaaaaaaaaagttgggggcaaaggggaagacaagttttacacaaaagtactacaatggtaactccctttggtaaaaagtgtaataaatgtcttgtacatctgttcataggtactaaatctgaagccacagtactatggtacacaagaagctagagcagttatgctagcacatcaaagcatatttcttttaataaaaaattgacagtatgtacattatgtacaaaaaaacaagttaaaattgtgtgtgtgtgtgcgtgtgtgtgtcagagagtaaagctggtggatggcactaaggtagactagtaaagaggcagatacaaaacagttccacgggagctaaaaaggacaactgatttgaactcgttgaggttgagaaccagaggagagaaaagggtaggcagcaagggaatcgtcaggaataaaatccacaagatgatcaatcccaaagccaaactgcaggtcccagataaaacctaatgggtgatcttagatgtgctcgagtgaccagaaaaaaaaaatcaaatccagcttttttttccttttgtggggaggggagaggagcagtgaccatgatagttccaatccatctgagtattaagtccttctccagtctgttttgtaaatgcatctccatccagtcaaagtgtgaacagcatccggttccctcattgaaagttaggccacaggagactccagtcttagctctgctggtgtgtgcaagcaaactgcatgtctttgcttgcatggacttccttcccctccagggcaggctatacccaaaaccctttgggaaaagttccagcttcagctttgtaaggtattcatgttcctaacaggtagcccacttggtgccaggctgcaccagccacacacaggtcaggtggccatgtcccagagaggcccagtgaggcttgaaaggcatcttccttgtttcttcagtgtgtgagtgcataggcccacacacacatccccacacacaccccaagttatctgctctggctttgcagttaaggggctttgaatactgtgccgtatttgacacgatacttgttaatgctcacaaaatgcagggtctctgtatcacaggtggtggtacagggcaccaggccctccagcccctcacccatgagccacttgctggtctctgctgccatttcacggggcacatgctccttggtccatttatctacccaggcctggaatctctgatgtagacgcttgcttacacgctcatgggactgcaaaacagaaaaaaaaaattttattaaatgaagcagaaccaaaaaagagcccttcaaatacaaagcctaattttcttctaaaggagcaaaggaaagatgtgggctcaagtcttagataccactgtttttttcttaaaagaaaaaaaaaaggattctctgtttaaagagaagttaaagaggtaagaacatagaacatgtgagggcatgaaaatccataaagcctccaaagaaatgcgaacacaggctctgggctgaaaaagctcgctgttctcaattttagcatgcgttagtataaccgagggaatgtgttaaaaaatacacatttctgaccaggtgcagtgactcatgcctgtaatcctagtactctgggaggctgaggcaggcagttcgcttgagctcaggagtttgagaccagcctgggcaacatggcaaaaccccatctctacaaaaatacaaataataactgggcgtggtggcacacacctgtagtcccagctacttggtaggctgaagtgggaggatcgcttgagccaggaggtggaggctgcagtgagccaagatcgcaccaccgcaccccagcctagatgacagagccaaaccctgtctccaaaaaaaaaaaaaaaaaaaacccaaaacccccaaaacccacatttccttggtttaccaatgtgcattttaaaccagcaatccagctgattctaatgtatcctgggtaggacccagtgagccattgatcacttctatcagcatggagatccacctctaagccagacagtgcaaagcaaagggcttaaaaccactctccctccactgtgttaccccaccctgggaagcagagtccaggcttggcagatgttctgcagggggttctgttcccaccaacacattcaataaaaatttattggtgtccacatgcaaggatactagaagagatacaaagacaaaactggtgttgcccagtgtcccaaataatgtgaatcagagacaggcagacacacaacacatagcaaaaaaaatgagccaggtgtggtggtgcacgcccgtaatcccagctactcgagaggctgagacaagagaatctcttgaacccgggaagtggaggatgcagtgagctgaaatcatgccactgcgcttccctcagtgccatgagagaagtagagcagactcttgaacaacacagctttgaacagcgcagggccactgataggcaagttttcttccacctctgccaaccctgagacagcaaaaacaacccctcccttcctcctccctcttcagcctactcaacaagatgagaataaggaccctttatgatgagccacaaccacttaatgaagagtaaatgtatcttctcttgcttatgacttaacattttcttttctctaacttactttattgtaagaatatacagtataggctgggcacagtggctcacgcctgtaatcccagcactttaggaggctgaaatgggtgggttgtttgaacccttgagtttgagaccagccctgggcaacgtaaggagaccccgtgtctattttcattaaaaaaaaaaaaaagaaagaaaaaaagaatgcagtatatataatacatacaacatacaaaatatgttgtttatcagtaagccttccagtcagtagtagactatcagtagttccattttgggggagtcaaaaattatacacagatttgactgtgcaggggccagtgccccaaaccccttgtcgttaaagggttaattatacattaaactgtctgctcaacatctcccatttgaaagttttgtagtcctttcaaacttaaaacagcacttcatctgtctcccaaacctcataaccctttcctattaacaggtgagcccctaaaatctccacttaagcaaaacaaaacaaaccaaaaaaccccaaaactaatcaggcaccatccttgatgtccttcttttgcttacccccacatttgatccaacaccatctcttgtcaattaaatatctaaataatatctacatctgggcgtggtggctcacgcctgtaatcccagtactttgggaggctgaggagggtggatcacttgaggtcaggttcgagaccagcctggccaacatggtgaaatcccatctctactaaaaatacaaaaaatcagccaggcatggtttgagacacagcgaaactctgtctcaaaaataaatgcataaagtctacaatgtaattcttgcaattccactgccaccctagtagtacgggtggcccccacatctcatttggacaagggcacccttttgagtggtctctgctcttccaactttatatatacccatctccactgtcctcacagaactccaagctatctttgtcaaatgtcccagtgcatctcaaacaaattacaaaccatggcctatcattagacaaagtgatgtggcctctgcctacccttctaacttcatgcaaccttgagccacaatggtgtttgtaatttcttgaatatgccaagtcctttcctcccagccttgtactagctcttttgtctagaaaacacccatcctctactcttcaccaggctaattccttgtcattattcaggcctcaagcatcacctcctttgagaagcctcctccagtgaaagcaaggcctgtatgctagttacccttgatcacttcacctgatttgtttccctggtagtgcatatcatcgcattacttcatctgctctacttcatggctgtagtcccagggcctggcataacaccctatacgcagctgcaccaggaaggtttcacaattgagacagaatgtaaagacaggtaggattcatacaagcaaaagatcagatactacttgagatgtaaatactgggagtaaattcaccaaaaaggtgccaccgggtatttacgtgctcttacaggctgaactgtattctccttaaaattcttatgttggccgggcatggtggctcacgcctgtaatgctagcactttgagaggctgtgtcaggtgagactctgtctcaaacaaacaaacaaaaaatcatacattgaagtcctagcccccagtacttccgaatgtgacctcatctggaggcagacacacacacacaggtaggaacaccatatgaagatgaaggcagggatctacaagcccaggaatgccaaagattgccagcaaagaaccagaagctaggagaggcctagaagagattgtccctcacagtcctcaaaaggaaccaacactgctgacacttgactttggacttctagtctccacaacttttgtcatttaagccacagtctgtggtactttgtcacagcatccttagcaaccaacatacgtacttcctcagttaagtctcagctccaagaacaggtttgcataaacaaagaaaaacaatcagaagactctgggcctcccctggtcctagctagggtgggagatgtgtacagaaatttcagttactggttctcacctgatgagcccggagcagggcggtcctccgatacatatagtcctctgatttgatcacatacaccatcttgtaggaattcagcttgaatctacactccagcttatccagactatccacattctccatggtcttcttgctgtttccttccttcccttccttttcctgctgctctcgaccacgttgacacttccggatccgccgtagattcctattgcagaaaagccccggaggatgagagctcgtccagatgcagattcccgtgacttccccaaagtgagttttctttattatatgcttgcatagtactcatcccaatttgttaaatacatacacaaatgttcagttgtttcactgcaaaaaaaatttcaactgcaaaggtacacagaataaaaagcagaaatcttcacccatcccctacttgacttagcagatgtagccagttaagagttttaatgagaaacttctaggcctctgtctgtaaatttacacatgtaattaccagctacagttctgctttgggatttgtttttaagacaaaataggatcatactatatattttgtcctcaacttttcacttactgtcatgaatattttttcatttcatgatagatttgtcttattctctttaactgctgcagaaaaatgtaccccaatttaccattccttaacagtttctttcaactgaggttcctcatctgaaccacataacaaaaatttatttgaatgactatttttaaaaattcccccagatgatataaactagtgccattctacatacacaagaaagaagataattcacatgaatggatgccctgaggggtggtaggcttgctaaatctcaacatccagtgaaaaaagttatcagctagacaattatattgtttctcataacttgctattaaaaacactgcttcaggttggccactgtggctcatgcctataatcccagcactttgggaggcaggtggattgcttgagctcaggagtttgagactagcctgggcaacatggcaaaaaccccttctctacaaaaaaaaaaaaaaaattaggcaggtgtggtgacgtgtgcctagagtctcagctacttgggaggctgaggtgggaagatcgtttgagcccagaaggcggaggttgcagaaagccaagatcccaccactgtactatagcctgggacacagagccagacactgtcttaaaaaaaaaaaaaaaaaaaaaaaaccaaccagcccaaaatattgcttcagtgagaatctttgtatacaagtatttctgtagacagcagttctttgtccaaagggtcccaggaccctttcaggagatctgtgagatcaaaactattctcataataatactaaaacattatttcccttttttgctgtgttgacatctgcactggcaccattaaagtaatggtgaacaaaaatgctggtggtggcgccaaactgtatttgcaatatcgaacaaattgttaccaaattccaatatcaatttgtacatcactgagcttttcatacagttgtcaaactctgttggtttatcttgtaccatcaatgaatccattttacttccatgattttgcaccttcatgcgactgcaattcaagtctttgaacttcacactgaccatacaatgacattaagtgaaaaaagccagtttcacttaagaatgtttctgatgggccagtcacagtggctcatgcttgtaatcccagcactctgggaggctgaggcaggcagatcacttgaggtcaggagtttgagactagcctggccaacatggggagacctcatctctaataaaagtacaaaaattagccgggagtggtggcgcgcacctgtaatcccagctattcgggagggtgagacaggagaatcacttgaacctggctggtggaggctgcagtaagccaagatcgcgccactgcactccagcttgggcaacagagtgagactctgcctcaaaaaaaaaaaaagaaaaaaaaagtttctgatgaagcagtaacattttctattaaatcccaacccctcaatttacatctttttaacatgctgtgtgataaaatgggaactacacataaagcacctttgtgtgctaaagtacaatggtattcttatagaaaagcacttgagcaattgcttgagttgtaagtggatcatcatttttacccgaaagaacaactgactaaatatagtcaatctcagccaagtatttggcagatgttttctcaaaaatgaacaagggagcctatcacttcaaggaaaacaatgttgccaatggtaagactggaattttcaagcaaaactatgaattttggtgaactggtatcagccaccctgagcttgacagcttcccaatacttaaagatgtgtttgatgacctagcgatagcgatattaaatcaatgtgatttcttttggagacactgtaaaatatatcaacatttagtaggtgtgtataacttattttccaaatagccaattgcgtaaagttacaaaatcatagaggaaaaaaagattcattcatgatacaaaataaatcaatggatttttacaactgcatgaaaagcccactgatgtataaattgatattccaactaacctttaagaaactatcactggggccgggtgcagtggctcacacccgtaatcacagcactttgggaggccgaggtgggaggatcacctgaggtcaggagttcaagaccagccagaccaacatggagaaatcccatctctactaaaaatacagaatcagccgggcgtggtggcacatgcctgtaatcccagctactcgggaggctgaggcaggagaatcacttaaacctgggaggcaggggttgcagtgagctgagatcacaccattgcactccagcctgggcaacaagagcgaaattccgtctcaaaaaagaaaaacaaaaacaaaaactatcactggtagttttgttgtcatatcaaagaatatccagttatctgaaggatctgaaaatattcctttttccagctacacatttgcgtgaggccagattttcttcacatatttcaatcaaacaacatacataatgcaacagattgaatatagaagcagacatgagaatccagctgttcttctggtaagccagacactaaacaaatttataaaatataagcaatgccactctattcactaatttttgttttgaattagcttttcattaaaaaatattatttaagaaaatataatagggatatatatatatatatatatattttatttttgaggcagagtctcactcggtcacccaggctggagtgccgtggtgcgatctccactcactgcaacctccgccttccggttcaagcaattctcctgcctcagcctcccgagtagcttggactacaggcgcctgccaccatgcccagctaattttctgtatttttagtagagacagggtttcactgtgttagccaggatggtctcgatctcctgatctcgtgatccacagcctcggcctcccaaagtgctggagttacaggcgtgagccactgcgcccagcccaatattgttatttttcaaatgaattaaagattgaaaacatttctttgtttttatttctaacttggtaaatattactagtataatccatataaacaaaagctttttggagtactcatgctctaagagtgtaaggggtctcaaggccaataagatgagccccttagctgtcagacaaatcattagaaactgaaattctggagggaagattccatacacttcaactaccctgccaccagaacgattatatcaatttccttttcctcacagtacataaatgtgcctccttcctcatatcatggtgagagacacatgatgacaggtttattgtagtatgttattagcatggagcctgttttgttgagaggaacctgacacagagcaactgctcaaatgtgttaaatgattcaatgaatggagaacccggcagggccctttttgctggtatctcttttcccatgttctcattaggactcaataagtctaataacactgggatgatactttcttggaaacctaagacataagatttcaattcaaaacttttaggaaggaagaaagccattctacccattttatacttcttaaactgttttcatatacttggaggatcagtatcacaatctgcctatacacagagggaacatttttaaaattctgtgcagaaaagagttaatgtagcaggcctaagattgctattctttgaaaagcctgcttataaaagttggcccttggctgggggctgggatcttggattttgggcaatgttctaccattccttaactcatataagtgtctcactgtacctaaactatttgtacaaactctatagcttatgctgaaaatgtgctttctttctgagagtttgggattttggtacatgctaggcatacagtgcctagatgactacatctcaataaaaatcctggcacagagtctctaatgagctgccctggtagacagcattttgcatgtgttgtcacattcattgttggaagaattaagagtgtcctgtgtgactccactgggagaggattctaggaagcttgagcctggcttcctccagctttgccacaggcaccttttcgctttgctgattctgctttgcatcttctcgctgtactaaatcagtctgactatatgcagagtcctgtgagtcctcttccatcgaaccatggagactctgacacacattcccatccaaagtacggaggttattgttgattctctacaactctcacctcccagatgctttgacacatgctccaggtaagctcatgttgtgacagccatataaaaccttgaattagcatccccagcagatagaacaaatgaataaaatatgtgaaggccaagaacgtgaaagtcatttaactctccattcctcaatcatgcacagtatggactgctgacagatgacatggctcactcacctggggagaaatactggtttctgtgctagatgttcacgaagctcaggcgaggtagtatctgaattcatgtatcgctccacgtagtctgaccagcgctaagatggcaaacacaaaatacaggtggaaggaaatcacaaaaacagctcctaatgcattgggcactctagtaaattctatgattacaatgccccgaattcataaatttcaagatcaaaaaagtccctttctataaagacatgattgttagtaggtattggaacacggattaaaaattctgttagccagcaatactgctaagtttctgaggtgctaaggttatgagaagtcataaacaggtagaagctggctcactgacaagtttcatttccccacagagcattttgttaaagaacaaaatttatagtggcaaatgtgtgaaagtttccttcacattacaatctagatttctgacatcgcttaaaaaaaaaaaaaaaaaaaaagatctgccaacaagccaacattcccaccaaaacaagtcatcccacacgaccccccccaacatcatacatatggcctgcatctcctgtgtacattatctgccataaccaactatgataatcacacctgtctattcaggggttgaaaactctggactttatcagtccaataaaaagtaaacatgacacaaagaatcaagatgacatgagaaagacctcatttgttgttttttatactttaggaaaaaacaggaaagctgccaaccataagacttccttagaggagatagctttactaagtgcaagatgaggttaacatctataaccaggcagcccgtctcttcagctgaagacatggctggattgacttgtactttaagcatccaggtcctgacccttaaacaggcctgaggtgccttggccttttggcagacagggtcactggacagactctcaaggcacgccagctctgcttggcacctggggtctgtgatgtacttgctcatacctctgcttccacagggtcatccgaattctcctcttctgtgtccagaagctcaatagtcagctggacctggccttggctctgaataaacataagctgcaaataagaaacctaagcgtaaacaaaagaccgtctctgtagctgtaatctatcttctcaaggaatgagaggtgcagaggcaataaacttagtaaactttgctccaactgaagagatgaggaagatactagatcttgggtggccagtgataaaggcaaaagtctacacttactacaagtaaaatgaaatatattaaagcaaaaggtactatttcatgtttcaaacttctagaattcgctaaaataataatcaatgtcagtaagaatgttttacaaaacaaatattttgtcagaaagaaatatggcacatgtagccagaaccacaaaatgtcaatgctctgtccattggtaatcccacttctaggacgtaatagaggaggtaactatcagaatcacatggagaaggtcagagcctggaaggaaacctgagaattttttatttcaaccttcttcattttacacagagacaaaactgaaattcagaagagttctggtttctcaaggcacaccactaatcaatatacatgcagagccagaagctagatctagctcagtgttcttttaaagctttaaaaattgctctctgctagtaaagcttacaacctgacaataacataatatatacacacacaaatacagttatttccaaaatagatttcggggtgggggcagaccctgcattttcacaatttataatttaagaattgcaaaatctgtctccagtattcataacaggatgtcattaaccagtccccatagtgggttggacgtctaggatgtttccaactatttgcttttataattatccattataatggtgaaaaattggaaacaacctaaatgtccaccaatacaggcattaattctctaaaaagtgaatatcaaatagccataaaaaagacaataaagacccagaagtgttgttaattgagcaaaaatacattaaagaccatttccggtcagatgcagtggctcacacctgtaatcccagcactttgggaggctaaggcgggcagatcacttgaggccaggagtttgagacaagcctgcccaacatggtgaaaccacatctctactaaaaatacaaaaattagaccgggtgcagtggctcatgcctgtaatcccagcactttgggaggccaaggagggcagatcacctgagctcaggagttcaagaccagcctgaccaacatggtgaaaccctgtctctactaaacacacacacccacacaagctggccatggtggcacgtgtctgtaatcccagctactcaggaggccgaggcaggagaactgcttgaacccaggaggcggaggttgcagtgagctgaaatagcaccactgcactccaagcctggacaacctggacaacctggacaacaagagtgagcctccatctcgggaaaaaaaaaaaaattagctggacatagtggtacatgactgtaatcccagctactagggtggctgacgtgtgagaatcacttgaactcaggaggcagaggttgcagtgaaccaagattgcgccactgcactccagcctgggcaacagtgtgtgtccctgtcttaaaaaaaaaaaaaaaaaagttaaagaccattttgtccagtataaactctttcaaaatatatactcaagcatagagaagtttagaatcatagagatgtcatcaatgataatttcaggaaagaattctaaggtgactttttttggttatctgcattttattttcatttttttgggacagagtcttgctctgtcacccaggctggggtgcagtgacgcgatcaggcctcactgcagcctcgacctcccaggctcaagcaatcctttttttttttttttgagacggagtctcgctctgtctcccaggctggagtgcagtggcgcgatctcagcttactgcaagctccgcctcccgggttcacgccattctcctgactcagcctccagagtagctgggactacagacgcccaccactacgcccggctaattttttgtatttttagtagagacgggggcaatccttctacctcattctcctgagtagctgagactacaggtgcacgctaccatgccgggctaatttttgtattcttgtatttcttgcagagatggggttttgccatgttgcccaagctggtctcaagtgatccgcccacctcggcctcccagtgtgctgagattacaagtgtgagccatgtgtgctgggcctatgttttcttttctataatgatcatgaccatggatttcatgtaccaacatttttctaacaataatatttacaaagcatactatgaaaaatgttcagagaaaaagaatacaaaattgtaaaaatcatatataactagttttttttttttctttaaaggcaggaaagaaacaaagtagattgtccaggaagacaattacttccactttgtagttctctggtgaactcattaaaaggtccaggagtagaatcacaggtcaaagtaccccggctttaacttctggttcagagaatcctaacaactgacattgtcaccagcaaggtcttcgactacctgaccaactctcaccttaaagcaattctcatctgacattagctgctcagctttccgctgatacgttgactccaggaggctccttgagttctgtgtgttcagctggcctccggtggccccattattattttctgccaggtaaaggtcagtcacctgcacacagatctcatcactcacgatatgctgcagctggaagcaaacaaaggcaagcttttagtgaacacagaaaacatttctccattatacagtcaacgttcctttgatgtagtcattcaactccaaaaaggtttttctttttttgggggggtgggggggtgctggcaattttagaaaattaatcacacaaaccactgtatcattttcttggagaataatcaagccaggattttcaaccatatcagtggtccatggtaaaactttcctatctatttaaaataagaaccatagagaactcaggataatcgtactatttaaaattctaagcatctttaaataattttctataggtcatatctttattgcattttaaaatcatttacaattggctctcatacatattctttctcatttgatcttcacaactgccctgggaaggcaagctagacagagagttggggccagttaggagacaaatttacacaatgcatcagaaaggtggctcacgcctgtaatcccagcactttgggaggccgaggtgggccaatcacctgaggtcaggtgttcaaaaccagcctggctaacatggcgaaaccccatctctactaaaaatacacaaatagccgggcgtggtggcaggagcctgtaatcccagctacttgggaggctggggcaggagaatcgcttgaacctgggagatggaggttgcagtgagccgagactgcaccactgcaaagctcaccgtgagctggggtgaggaagggagccttggagaatcatgaatgcagtatctatgtctatattcccaggccaactacaaagcctgaaactcattaagtatttaagaaatagctgctgaattattgcccaggggtgctcagctgaagaaggagggttgggactaaaagtcaaggttcctgactcctagcccaatacttttccaaacacatcacctatttttctgtatctgatagaaagtatagggcttaagttgtacataaagttaactcactttccatacaggccaatcatgattgactatcagtagcttttgtgacaatcttaggaaactaatgactagaaagttgaacgtttcagagttcccattctcatgtcatgctatttctattttgaaataaaaatccttccaaatgaaactttatcatcaaaatgacagaagtgaaaaatagatacaagaagaaagcaaaacgttaatttcaatattgatttgtctgtttaaaaaactttaagatgatcataaccaccaagccattctatttttaggaagacacattctttttaagtgttaggaaccatgataactatttattcttaagtcctaaatgaccagtatgtgtattagtagataactggacacagtgaaaggtcagaacggtgactgagtgtggcagaaagggcagtatctccagcaactacagatggataaataaatcacaatgagtccagataaaggattctgatacaaccattaaaataatgcttatgagtacctgatatcatgaggaagattaagatacagtgttttaggagaaaaaagaaaaggtggaaaaaaacagatggaaagcatgacttcaatcatacatacagatgcttccactttctactttctttttgagacagagtctcgctctgtcgcccaggctggagtgcagtggcatcgtgatcttggctcagtgcagcctcaacttcctgggctcaagcaaccctcccatacctcagcctcttaagtagctgggtctacaggcatgtgccaccacgcccagctaacttttttgtattttcagaagagacggggttttgccatgttgcccagtctgatctcaaacttctgagctcaagtgatccacccgccttggcctcccaaactgctgggattacaggcgtgagccaccgcctctactttatactttcttgttgaagtagactgtattactgattccccacccatactctctttttggatatctggcccctcctcgagtcttcagaaaagacagcactacaaatccagagacagctacggaactcccacccccactgctaagcagatcagattctctatcttgctaattggagatgacagagagggtgttcaatagattttttgaggaggagcatctgtatggaaaggtctagtaacactgggaccaggggtactgggagggcaagccaaagcctcagaggctggaggagcctggagcacatgccgtatgttcatctgcagagcaaagcacaagcatggagcagaagtccagagtgaaggcatgcaggagagaaaaatcacctcccagcccaatccttccatggtgtggtcctattttgagttctgtacttggatgtctgtgaggttgcctattgtattcttaatacaaatccctcttaagccagcctacaataggtaagataaatgtaatggcttcacttggctggaatgcagtggtgcaatcacggctcactgcagcctcaacttcctgggttcagatgatcctcccaccttagcctcctgagtagctgggactacaggcatgtgccaccatgcccagctaattttttgtatttttaatacaaatagtgtttccccatgttgcccaggctggtctccaactcctggactcaatatatctgcccgccttggactcccaaagtgctggtattagaggcatgagccaccatgaccagccttgactttgaaatatatgttgtacattcagtcagcagtggaatctgagggaacaccaaatatgaggagaatgagagaagagatacctccagttaaaggagttgagaagcttgaaaatgttttaaaaagtcactgtaggctgggcacagtggctcatgcccgtaatcgcagcgctttgggaggctgaagtaggtgaattgcttgagcccataagtttgaggccagcctggacaacatggcaaaactccatctctacaaaaaatacaataaattagccggtgtggtggcccctttggtcccagctacttgggaggctgaggtaggaggtcaaggctacagtgagctgatcacaccactgcactccagcctgggcaatagagtgagaccctgggttggaaaaaaaaaaaaaaaaaaagtcactgttttggggttttctggatgaaacctgtttccattaaaaaaaaaaaaaaaaagcggggggtgggtggagatagtatttattactgattcaaaatcataaccagatacagtaaataattgtaactattgtttcgaaaaccaacctcagaattattaaaagttagttttattggattttttttttaagctgtgctggtggtatgaaagacttcgttcctagctgaagcagcagcaagcctgtaatcagcaacataagcacagggtaactggagtctgtattttatataaatttcagggaagttaaggaagattagtctgaaaaagtatgactatgggtgactatgtatccatctaatgatttctgccagttaccatccagacctcttatgggaaggcctaacaacttcttcaacttattggaaacaactatctgacaactttcccccagatgttaaggttcatttatatgaagggctcttcctcaatcctgtgtagatactgtgggaggagtacagaggcatgcacccttccaaaaccaaggcaaaagcatgggtactttgcaaagaattcaatattttagcccaagagaacattaagcaacaagctctttccttctacagtggcagtgtggattctagaattagaaattgctttttacaagttttcacttaagtacttcaccgcctttctgctgagctattctatggaagagggctgtaggtagccacggtacccaggtggaacagcatgatcctaaagccctacttccacaaggaatcgcagtggcccatggccacgtggttcaaccagccagcccagaagatctgcagatgcaagcaaaagtataccacattgacctgcaccctgcatctggacccatctgacccatggtaagctgccccacagtgaggtaccacaccaaagtacaagctggcaggggcttcagcttagaagagttaagggtgaccagcatccacaagagggtggcattagtacaccatgtccctgtgggccaatgttcagcacctgaaggagttaagactccaagctcaacctcttctccaggaagctcttagcccccaagaagggagacagttctgaaaaactcaaatcagccacccagctgacaggaccaataatgcccatatagtacgtctataagaaggagaaagctggaatcatcactaagaactttaaggtatttgccagtcttcacacagcccacatcaattttcagctctttggcatatgggcaaaaagggccaagggagccacagaacaggatgctgaaaaggaaaaatgaagccctgctggggacttgcagtcaatcagcagtagagctgggtctccagaaaaagaaaaaagcagttaaccaacaatctctctgggagttcagaactcaagtccaagaagtagaaatgtgactatctgttacaagctattttttatatcattgttgtaaagaacaacatgtttacaagttcccagggtgccacaggaagaacacacaaaaccaaccagaaacctaacttagagggaaccgcagatgagtgaggtgggcagagtattataaaagatgttatgtgaaccctttcttataaaaagaatttcaaatattaaacaatgcaagtacataagagttaccaacaccttgaccaggcgcagtggctcgtgtctataatcccagcgctttaagaggccaagacaggaggatcacttgagaccagaagttcaagaccagcctgggcaaaacagtgacaccctgtctctatttaaggaaaaaaaaaaaaaacttaccaacacctatggaagacgcaatgttccacactgtgtgcttacccatggcagacaaggtaagagatagacaagttgtgcaggaagctggggtcaggaccactgcactctacaggtggccagcaagaaaggatatggggtaggcaggctcatacactgcaactttgttaacatgagaaatcaggcatcacattaacctcccctcctctcttcagaaccctacgttcataaacactgttatatgaaaaagttgcctttccttttccttgcgtggcccatctctaggtaaggatttcttcccttactcaccctagcctcctccatgccctcacctgtctgacaatgctctggatcagtttgtccatggtaaaggcaatgtaggcatgaatggtgaacatctctctcagtgaatcttcatactgtgatgagtctatgttgccatccagcaggctccgcaccatgtccaggaaagctgggtaataatcttctacatcaacatccactgtgggagagatgggattggtgaggccttaccttgctaagaaaagactagggatagagtacagggcaaatcccacagctggcctaaatggcatttgaaagtatgaacactaggtattcaaaatatactcactcattccaatgtaaacagagatgaattccgacaggtgactacaatcaccagcactatcagagtgactctgcaactttaacagtggcttctaatattctgactaccatgctagaaagatacttctttatggtactgctgggccactttcagagaggaaaatatcctagggaagccagtccttcaaagagctgttggctcccctgctgagagaggaacctactctcccagcctgcacaagagcattcctcacatgggtcacttgctcataaagctatttcaatgaagcataaagtacagatgaggaaaggcagacacagccatactccagcactgggaaacctcttgggaacacaaaaataggagtgcaaattaaatcctttatgaataatgaagtaatctgcatttgtcaaagtccttttgtttaaaaatggattcgctacgttgtatttcacaaattgcattaaatcatctgtagttgctgcacatgaatcatttcaatcactagctagaataaatctcatcagttgttaaagacatttggcaactagcagagggcacaaggagtattaaagagtgctgcctttagcttactaaagacccatttatataaagttcaaaaatagacaaatctaatctctagtgttagaaatcaacaaagtggaaaaaggactggttatcagagtactggttatgtttcgtttcttgaacataggtacgtctagtctgtaaaaattcactgagctgcacaattctgatttgtatacttttctatatatacatgccgtaccttatatgtatttttttgtagagatggggtctcacttattaaccaggctggtctcaaactcctggcctcaagtgatcctcccacatcggcctcccaaagtgctgggattacaggtgtaagccactgcacccggcctatacattgcacttcaacaaaaagttgactaaaatgaaaaaagttacaaaacgaactatttgtcactgactaattggttacttgctagttgtgtttgtgctggagaaaaaaggctaggagcaaaaccaagttgtctccatttatctgaagtctgacgaattcattaaaaaacaggcaaaacaggacaaatactgtttaaaagaggcaactggcttgagtttcatcacagactatcacattctttagctccatagaataggtataggctatagactccaaaatataccactgctatgaaaactgcttttatgccagaataaagttttgagtccaaaccacagatttgtccaaacaagctgtggtaagtgtgagggttggcattatcagacaagacaacattatgtaagcctcaaaccaggttaagtcagtggccaagccaggaataggccatttaatttctaatttctacccaagtagatggaatcaccacaatgagatctaaaatttatctctttcgagctaggactagtctagataaaagctttcagaattatttttcagtgtcattagctcctcaacagatagaaagctagggccatatctgggcttcctacatcagcaacacataaaaaaaaaaaaaaagaagaagaagatacactcctcaggttggctatttccttaagagcccagaagaaatgcttcatgaaaaagcttttggctcacagctcaagtacctaatttatgacgtgaactggaagcaggcagcacaaaattacataaagcacatgacagcgtcctgaaccctcacttactttccttttcctgagttctacatctttatccctgtcctgcctgttctccatgtctcatatcaccttttgagttccagtctcctttccataaactatttctacatattaagaatgagccataaaccccactggttaaacagaagtcctgctcaaaaatatgagaaaattctgttttaagcactaggaatttatgttctgtcatggattgaaattggctgtgacagtttagtctctatctgtactttgaaacagatggcagtaacccagaaatctgccatttgagaaattaactgtgatacccccttcccaggtgcgtccacagtaccaaccactgaccaagtgtccatgatctaagccctgcataggatactttgcacaaagcaacaccacaagcaactagagcctccatttttcagataaacaggttcagagagtttaactacacagactctaatgcctgtgctctattaataaaagaagcagtcccaagtctaggtggctctaaggtcctcaacctcacacatcctctgtaaatcagaggtctcggcactcactaggttctttgagacgtagctgaatggcagggctgtcactcttgtctcgctttatgcccagcacttcccgttcccattctctctctcggttttcttcttcaatttgccgttcggcttgggaacaaatccgtagcagcctcaggcagagaatctggtgcagtcgcataaaaatataccagttgttgttgacatagaagaggttgtatacttcatccattcctcttaatttttgagctgctgtgttactaaacagtaacttggacttagggggactgcccccaacaccattgtgcttcttaactgcccctgtggcttcatctacatccatctcttcttcttcctcttcctccacatctgagagatcacctctttgggcaaagagcaaatctggaataaaatgatgcatgatttgttttatcttatatttgtcctccttctgaatgcctgtctgcctcttcacatggtggataatcagagcagcagcatcttccagtatttgtttgtcttcatacgcaagtgagaggtgtgggccaacaggtacaccagcattctcctccgtagcctgctcttgcctctgatgggacagagacacaaaagtattctgtgagatgtctacagcgacaacatgtctacaagaccacatcagccatacatcccattatcaaccacagtgtctatatttttctaatcaaaaacttaggacctgggactgggagcggtggctcacgtctataatcccagcactttggtaggccgaggagggtgatcacttgaggtcaggagtttgagatcagcctggccaatatggtgaaaccccgcctctactaaaaataacaaaattagctgaacatggtggtaggtgcctgtaatcccagcccttgggatgctaaggcaagagaatcacttgaacccgtgaggcaaaggttgcagtgagccgagatcgtactactgcactccagcctgggcaacagagtgagactctgtctcaaaacaaaacttaggacctgactataacaataatttttgtccctcttccagaaacaaataggtaatgacagagacgtggtttgatgtcaaaatacaggtaccttctacacactgatgacttacagggagagtaggacagaattggaaccatctttctttcttttttttggcagggtcttgctctgtcacccaggctggagtgcagtggagcaatcttggctcattgtaacctccgtctcccgggttcaagccattcttatgcttcagcctcctgagtagctgggattaagaagtgcaccaccatgccaggctaattttgtatttttagtagagatgaggtttcaccatgtcggccaggctggtttcgaacttctggcctcaagttatctgtccacctcagcctcccaaagtgatgggattacaggcgtgagccactgtgcccagtgggactatctttcaaaattctggattagtatctatataaaggatatgatatgagatctgtgatttactttacttctggggtgggggtatggagggtgacaaagtaacatcagcaaaatatggaggattaagtttatttattttattgattttgagacggaatcttgctctgtcacccagactggagtgcagtggcatgttctcagctcactgcatcctccacctcccaggttcaagccattctcccacctcattctgccgagtagctgggactacaggtgcacaccaccacgcctggctaatttttgtatttttagtaaagacggggtttcgtcatgttggctgggctggtctctaactcctgacctcaggtgatctgcccgcctcagcctcccaaagtgctgggattacaggcatgagccactgtgcccggcctgattaagttcacataagagctcattttactatttttaaagttcaggatcaccccactccaggaattcccaattgcactgcatttatgtttctatccatctcctaaaactgagcccacggaaaccaggatttattgcttattcatctctgatcctagctcctagtactatttatagtcctggtaggcatgctgaataagcaaggattacaaagagtttggtggtcaatgacaaattttgaagctgtaagtaaggagagatgggactatatggatacaaggtattattgtttgaaggaaacaggtagtcggagaagtggaaaatggaggcaggaggtataagttgaaaccaggacagtaaactaggaaactagtcaaacagcttaggtataaaggtatagtttagatttaaaatggtagaatgaggaatagaaaaggctatgacagctatcaagcaagaatcaacaggtcttagagagtctcacctgcatttaacaaaggtaatttccagaaatcaaagctgtgctaaatatagactagagtcctctcacagatgcagaaaccccccgctcacctcatcatagatactctcaatctcattgagtaagctcttagacctcaggaccttggtgtcattctgtttaaagttgatcccctggtggtccagagacttcaagtagtatttctcattttgttctcgccatactttgttaaagcctctctgagcttctcgccattcttcctctttcatcttcaacctagtgaagcgggaagggatggaaacaacacatgggaattcagagggtttagaagaaagaaatttgccaggcttactttagttaaagaaaggtgcaaagctatattaggtctctcaaaattactggcaacttgggatgctatcaaaccagtcttgaactctgtttcatgagggaattactcatccaagacttactttgaggaaatgatttatctcaaagtcaaataatttacctagaatggttacttaaaaacagcattccagggaatatctttcaggtataagtattccttgaaaaaaagagttcttgtttctttgctataggactttgcaaaacgttcacaatgctaatagaaacacagaagtccaagacaagagaacttgcacagttatgttcctctggatacagtcaggaaagttctgatcagaactgattctaataacccagaagagaacagactaagacaaaaaaaagcactaaaactgaagaataacctgtatctcaaaagccagaagttaaatgctacaggcaagaagaagaaaccatcaatctgtgccagctcttgaggggaagatgagggagaagaaaccatcaatctgtgccagctcttgaggggaagatgagggaggacaaatcaaatctgggtatttgtgaactgtgcagcaaataagaattaatttttaccagatgatactgagagagaaccaagctcctaacaaaggattcacagtgtggtcaataatgacatggggctgggtgtggtgtggcttgtgcctgtaatgccagcactttggggaggccaaggcaggaggattgcttgagcccaggagttagaggccagcctgggaaatatagcaagacctcatctctattaaaaaaaataaaataaaaattagctgggtgtggtggcacattcctgtagtcccagctattcgggaggctgaggtgggaggatcacctgagcctgggaagttgaggctgcagtgagctgtgttcacactactgcactccagcctgggtgaaagagtgagatcttgtctcaaaacaaaacaaaacaaaaacaaacaaaccacaaagatgttaacaacagttagtcctgagtgtggcaggaacatgggtggtaattatcttcttttcttttctgtattttaaaatactcccccaaacatacacacagagccttccaccatgaacttacaagatttgttctctaatgttggttacacaggacccccaaaagaagttccattctgcacctgaattccaacaaccagggttggggagaaagagaggtctcatgggacaaccaggttgaaaatgagagccttatttaatgagacactgaaccggtagtgaagtacactaaagcactaagggcacatttgctcatgtaccttttaaggacaattggaacagcaatggagggattctttctcagaccatcaatgatgtcagctgctttatcagcatatatcctctggagtgcttttctatggatgacttctgatgtgcccccaagggtgttgtccaagcgaaatttggcttgttcttcagcagacaagcgggaaagcttcttctgtattgcttccagaacccggattgttgccagattggtctctaaaactacatcaagctgaagaggaagacaaagaagggtatgctcaggacccaaatcaaaatagaatagagtagtgtttagaagaataaggtagggagtcaaactccttggatttgaatcctggttctgccctactagctacataagactgtttctttatcagcaaaatagggataacagcacctattactctcacaaccctgtgtctggattaaatgatacaatccacataaagtatttagcacaatacctggcacataagaaccacaggatgaagttggataaatggtagttattaccaccaccgtcgctgctgccgccaccaccaccgtgtgctttgcttaggactactgattttagaccagaggaaccaaacaggagatgactttactgaaacgtttccctgaactttcctgaattgctaagatccattatgaacaaacaataacaatcaaaacaatcccaaaagaccgctttgtcttgagagttttttggtttaacttgaaatatttaaatatattcaaatacttaaatattcaatagccttgttccacatccagtaataataagagcagtgactatcataacttaaggagttcactgttgtagctgcgggtaaccatttaaattcttattggactcctggcaacctttgagtctactttttccctagcttaaaataaggttctctaaatgagaaacagaaaatgaagtaaatgagcagtctcaacggtctacaaccaactgtttgcagaagtgttccctaagttttcttgttttgggaatgtggtagtcatttggtcaatatttctggcccctcttgctctccaattatgaacaaaaaatggactaaacttcctggctcccttatgattggatagggccatgtaactagttttgaccaatgagttgttatgagatgagtagaagtaatgtttattacttctaggctgcagcatttaaaggtgtgagatcattccaagctctcttttcctcctagtgactagcaacattcataatggcagcaatcccttggcctgaatccccaagtaattctgatatgccaaatcccctgctaaacatcaatgtacatgtagaatgattagaaattaaacccattggttttacaagtcactcagatgtgggagttgtctgtactgaggcattactaacctatcttgattggtaacgcacattccttcaaactagctcatcccaccaaatcttaaacacatgcacaccccacttctttcatgtttgcccttgtagtcacaaatgggaaatgaagttgcctctcatttggaggcataccagctgagagaggataggaacactctgtcaaaaacaaatgccaagctctgctaaactcatcagttaaccttactaaacgtaagtaacaaagaaatgccttctttagcttgataacactccctatggaagttaacatctgtcttgatttagctttctgcaaataggtgcaactccttataaatgctggggcaaagatggccaaccacctgccagtggccaggcagcatgtggttctcaattaaaaacacaccagaaactgctgaaccaagtgtgaggcgggaaaactggcaaagagctaaaagagtaccaaaacaaacaaacaaacaaacaaaaaccagcaagatacctatccacacaagtaagcacagccagtcaatttaatgtaacagatacactaaataggatacgtatcattttacatctttagacaaaccagacttccctttttaaaaatgataatgtaaaccagacatataaacacactgaggattgagcccactttcagtagtccctctcctgatataggtggtatggggccttctaccacctcatttattcactccactcttcccttcctaattacttcaaaataaagctcctgggacaggcgcagtggctcacacttgtaatcccagcactttggaaggccaagacgggtgggtcacttgaggtcaggagttcaagaccagcctggtcaacatggtgaaacccatctccactaaaaatacaaaaaaaattagccgggtgtagcggcatacacctgtagtcccagatacttgggaggctgaggcaggataatggcttaaactcgtgaggcagaggttgcagtgagccgagatcacaccactgcactccagcctggttgacagagcaatactctgtctttaaaaagaaaggggtccctaatttagccttctttcaaaaggagccaatcaggccaggtatggtggctcatgtgtgtaatcccagcactttgggaggccagggtgggatgatcgcttggacccaagagtttgagaccagcctgggtaatgtagtaaaacactgtttctataaaaaacaaaaaattagccacagggggtaggaggcaaggggagggagagcattaggacaaatacctaatgcatgtggggcttaaaacctagatgatgagttgataggtgcagcaaaccaccaaagcacatgtatatctatgtaacaaacctgcacgttctgcacatgtatcccagaatttaaagtttaaaaaaaaaaaaaaaaaatttacccaggcatggtagcacatgcctgtagtcccagccactcggtggcgggtaggggtgggggtctgaggtgggaggatcacacttgagtctggaaggttgaggctgcaatgaactgtgattgtgccactgcactgcagcctgggcaatagaatgagaccctgtctcaaaaaaacaaaacaaaacaaagcaatcagctgggcgcagtggctcacacctgtaatcctagcactttgggaggccgagacgggtggatcacgaggtcaggagatcgagaccatcctggctaacacggtgaaactccgtctctaataaaaatacaaaaaattagccggacgtgttggcgggcgcctgtagtcccagctactcgggaggctgaggcaggagaatggcatgaacctgggaggcagagcttgcagtgagccgagattgcgccactgcactccagcctgggagacagagcgagactccgtctcaaaaaaacaaaacaaaacaaacaaacaaacaaacaaaaaacaacaaagcaatcaataccagaaacatgaaagaaaaatgccagttctcagagctggtttgctaaccatggcaagatacttgctaagggtaacaatacacacagatcttaaataatttaaaaacagcttcaagaaagtactataaaccttaggatactgattttcttcaccatgcaaaacataataatcttaaaatgccatgcaaaatcaaaagaactattatttagtcatcaatggacaatttcagttaaaagggctaaagtggcctagataagtcacatttgccataaagcatgtactaatatatacatttgaccaatgcataaagcatggaaagtaccacaacaagcacttaccatagaagaatgtgagcctttggctcttccatcttaataaccctcagagacaggtactgatagtctcactgagcatctcccatttcccccaacttcaaatgccaaacaagcttgtacctcaaagcgttcatcttcacaacgataaatatgttcttcatattgagtcttcttggaactcacaaaggtagagtcctcagaccacgaagggaaggaaacccaggtatcatttaaaacctttgggtagaagaagagagactgaaacaaaagcctaaaaaagctttctggtgattaagcattctgaatgaaaagacaaaactctagcagagaaataggcaactaatattacttcacaaatttcacctttagcaagtttacaaaaagctattagtaagaaaagggtgctgaatataagcggaaatataattccagtgctttgggaggacgaagcaggaagatcacctgagcccaggaggagtgacccaatctttacaaaactaaaaacttttatttttatatttttagctgggtgtgaaggcatgtgtaagtcccaggtacttgggaggatcatttgagcccaggaggttgaggcactatgagccgtgatcacatcactgcactacagcctgggtgacaaaacgaaaccctgtctcaaaaacaaacaaaaaagtagaaaacattttctttttaaaaaggattaaaagggttcttaatttcatcattcatataaattctcaatccttggtaccaccactcccttctggaaaaagctgaggacccagggctgatctttgctagggaaggccttacctctttacagagaggagtccgtcctgtacacttgggctgctggtaactctttggtaaggctcgatagctggagcccaatcgtttacaagaagcataatctatctccatagcaatgccctctgtggctcgctcctttggataagtttccagatgtacagactccttatagcccagaaagtttttaaaccaattaaacaactcagggaatttcctgaagaatcaaaccaaaaagtgacaagcaattaggggcaggatgcagttatcctgaggtatgactactaccatctggttttggatcagaaatctgctaccagggatgaattatttcctgcctaagaagaactgcttctgagcatttggtttcccctttttctaataaaatactctcagatcagttaaagtggtgatcaaagagttgtaccgaaaccaggcaaaataacaagccattcttttgatcaagaatattgctttaatgttcacataattcttaggttgtcaaatatagtaaagattccagactcggtgtagtggctcatgcctgtaatcccagcactttgggaggccgaggcaggtggattacctgaggtcaggagttctggaccagcctggccaacatggtaaaacaccgtctctactaaaaaacataacaaaaattagccgggcgtgtggtgacaggcacctgtaatcccagctacttggggggccgaggcaggagaatcacctgaacccaggaggcggaggttgcagtgagccaagatcatgccatcacactccagcctggggaacaagagtgagacttcatctcaaaaaaaaaataataataataatttttaaaaaaattccagaactctgggagagatttttcttgataaacatccagcactggttagaagatcaggagaccactagtcttggccattagtcgataaatacttaatgccctctctattttctcatctctagagctggactagaagacttctcaggactcttctggcactaacatttgagtcaactgatgtatctcaagtaaattaactttgcctatcatatactctcacaaatcaaacattacctggtctccatatcatgcatcagggctaagcccctcacttcacttaccccaggaaaggagagactagttgcacaagctcagcacgagagatcacctcctggttaaaaataacaagacagcgtaggaaattttcgtaggcttctgcactccgaagagcctttcggaccttatggagacaacgggaagaaaaacagtttttgtttttcttaaagtggggaactgaaaagggcctcgctctgtcgcccaggaggaggcgcagttgtgtaatctcagctcactgcagcctcccatcctcagcctcccaagtagctgggactacaggtgtgagccaccatgcctggctaatttctaaattttttgcagagacgaggtcatatattgcccagctgccctgccattagtttttaaaaactggggaaatttgtggctgggcgtggtggctcatgcctataatcccagcactttgggaggccaaggtgggtggatcactggaggccaggacttcgagcccagactggccaacatgctgaaaccccgtctctactaaaaatacaaaaattagccaggcatggtggcacacgcctgtaattccagctacttgggtggctgagtgaaacataagattatcacttgaaccctggaggcagacgttgcagtgagctgggataatgccactgtactccagcctgggtgacagagcaagactctgtctcataagtaaaaaaataaaataaaaacggggaaatttaaactgatatttgatgacactaaggaatcaacgttagtgtttttagatgtgataatgattatgtttgcaataaggagtttttttgttttgttttgttttttaaacgcagtccagcactgttgcccaggctgaagtgcagtggtgcgatctcagctcactgcaacctctgcctcctgggttcaagcaattctcctgcctcagcctcccaagtaggtgggattacaggcatgtgctactacacccggataatttttctatttttagtagagacgaggtttcaccgtattggctaggctagtctcaaactcctgaccacaagtgatccacccgccttggcctcccaaagtgctgggattacaggcgtttgagccactgtacccagccacaaaaaggagtcatttttaaaagaaacttactaaaatatgtatggatgaaataaggtatctgcgatttgtctccaaataaactgggatgggtgggaatatatatgaaacaagtaactggctagaattgggaaccgctaaagctggatggtaggtacgtgaggaatcattttactattctgtttatgtatgttcaaaattttccagctgggcgcagtggctcacgcctgtagtcccagcactttgggaggccgaggtgggtggatcacctgagatcgggagtttgagaccagcctggccaacatagtgaaaccccattctactaaagaaaaaaatacaaaaaaattagctaggcgtggtggtgggcacctgtagtcccagtgactcaggaggctgaggcaggagaatcgcttgaacccaggaggcagaggttgcagtgagccaagatcacgccactgtactccagcttgggcaataagagcgaaactccgtctcaaaaaaaaaataccataataacaatttaaaaactgagatctcggagtataccttctcatatgcttgattctccacaccatatcagagttactcaggtttttgttgcctctttttcttttttttttttgagaccgagtttcactattgttgtcctggctggagtgcaatggcgcgatctcagctcactgcaacctctgcctcccgggttcaagcgattctcctgcctcggcctcccgagtagctgggattataggcacctgccacaacgcccagctaatgttttttttgtatttttagtagagacggggtttcaccatgttggccaggctggtcttgaactcctgacttcaggtgatccacccacctcggcctctcaaagtgctgggattacaggcgtgagccactgcgtccggcctgttgcctctcttaacatgtttacagcaagaatctttgccaaggctgttttaaactctggtaatctggaataacgctctcttaagatagttctgtcctctgatctggtcttttttcttcctctatttacaatattgagcatcttaataccaaaaacccaaaaatgatcaatggcatagacaaagtaaaactagtctagctagattaccaatctggagtttcagttccaaaataagtatttagcactgtgatcctttggtgaagaccacagactgccaccaaaccaagtggcttatcagcaacccctgctccagacttccgtatgcttttcttaactattcatcagtagacactatatagaatctagacttttaaagctaaagataaaagaacactgtaccttttatactgtataccctatttacctttactttttattagcttttaaacatacacaaaagtagacagaagtataacgaacctatgtactcaccccaacctcaatgatctatagtaaattttgtttcatctatacttacttctcctaccactgcattttaaagcaaattccagacatttcatctagatatagtatatatgtttaagaaaaagtactaagaaaatgccattacaggactgggtgcagtggctcacgcttgtaatcccaacactttgggaggccaaggcaggcggatcacctgaggtcaggagttcgagacagcctggccaacatagtgaaaccctgtctctactaaacatacaaaaattagctgggtgtggtggtgggcgcctgtaatcccagctactcgggaggctgaggcaggaggattgcgtgaacccgggaggtggaggttacagtgagcccagatcacaccattgtaccccagcctcagcaatggagtgagactgtcccagaaaaaaaataaaaaaaaaacaaaaaaacaaaaacaaaaacaaaaaacccattactcttagaaattaacttattttcagaagactccttaaggcaaggcatggtggctcacacctgtaatctcaacactttggaaggcaaatgctgaggccgaaggaggaggattgcctgagcccaggagtctgagaccagccagggcaaaacattgagaccccctctctccaaaaaaattttaaaaattagctgagtgtggtggtctgtacctgcaagtcccagctactcaggagggtaagaaggatcacttgagcccatctcttaaataaaaaaggccaggtgtggtggctcacacctgtaatcccagcactttgggaggcgaaggagggctgatcacccgaggtcaggagttcaagaccagcctggccaacacagtgaaacctcatctctactaaaaatataaacattagccaggcgttgtggcggggcctgtaatcctagctactcaggaggctgaggcaggagaatcgcttgaacccaggagatggaggttgcactgagccaagatcacaccacttcactccagcctgggcaacaagagcgagactctgtctaaaaaaaaaaaaaaacccaaaaatgtaaaaaagattccttaatagcatctaatattgagtccgtgtcaagttcaattgtctaattaatgtcttaaaaattggctattggccaggtgtggtggctcacacctgtaatcccagcattttgggaggctgaggtggatcacctgaagccaggagttcaagaccagcctggccaacatggtgaaaccctgtctctactaaaaatgaaaaaattagctgggcacggtagtaggcgcctgtagtcccagctgtttgggaggctaaggctggagaatcgcttgagccagggaggcggaggttgcagtgagccaagattgcgccattgcactccaagctgggcaacagagtgaggctctgtctcaaaaataaaaataaaaataaaaataaatcagcttttaaattcagaatccaaagtctgcatgtcacatttggcttatatatttcttaattcttaatttataatagcttcccttccatacccttttcttgacatttattggttgtgatctagacttccacacttgtctaagagcaccaaccgcccaagcagactttggtaatgattcacatcagagctaaggactcaacactcttgcaggactctcctgcaaaaagctcacataggcacagcagacagaaagggatcaggagatactaatcacggagatgttaaatcatctgcccttctgcaaaacccaagaggcagaaaatagagtcaatcaccacagatcaatccaggttgattcctaccagtgagaagcccaacaggtgccagctaccctgatgaaagtttcctgctaatcatcaagttgactccgaggagcaaatcacacttaagtttatgtggccaaactaaggcaccacacaacatcatttatgccaataatctcaactctcgttgctcattagaatcagctgggtagctttgaaaacatgcaagtaaattagaattcccctgaatgctatgtatgtgtgtactacaaataactatcacagcaataagattacaagtcatcggccaggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggtgggcgcctgtagtcctagctactcgggaggctgaggcaggagaatggcgtgaaccccaggaggcggagcctgcagtgagccgagattgcgccactgcactccagcctgggcgacagcgagactccgtctcaaaaaaaaaaagattacaagtcatcttaaatcctcaaaaattggtacaggcactggtactgcctgccacacagacctggatatctacaatgggagctccaaacatctttcaagagaaacataatacattttctaaaaatctgtcttctgccccaaactgcttcataaaaccaaagcaaacaatgctaccatttttctagctatgctaatagtactagcagactcaaaggactcacaactgggaaactatgttaaaaaacagaaagtcctaattagcctgacacctttaaaacgaaaccttccagggggataagatgattttcttttggcattaacaggcactatcaaatctaactcatccattactcaccttatcaaaaaataacgattctgttccaccaccatgtttgctggcatctgccatagaagaatccttcagattgagcagtttgggtttcttctgcaaaagaaagatacaaacatgtgagattcaacgagtggttttctctgaattttatttttgtctgtattcaatggtttcatcactgaaaccactgctgattaataatttgaaacaaatgagagaactctaaccaactcactccataccctctaagatttcaactcatattttctatttcagtttgcctattaagtttctttctacaacagaggttcaaagatcattctacccccaaaatattttctccagaaatgatcatgacattactgtgacaaacttttagaatatccttactttttctaggggcccaaagtaacttcatgtagaatctaatgccactgttttgttctcctaccagctgagggagaaaaggctgtttgtaaaaagagctcacaaattgacagaaatcaatctttaaccctgaataatatttcaattaaaaatttacttaaaaagcataatttgctgggcatggtgactcatgcctgtaatcccagcactttgggaggccaaggtgggcagatcatgaggtcaagagattgagaccatcctggccaacatggtgaaaccccgtctctactaaaaatacaaaaaaattagctgggcgtggtagtgtgcgcctatggtcccagctactcaggaggctgagacagaagaatcgcttgaacccaggaggtggaggctgcagtgagccgagatcacgccactgcactccagcctgggcaacagagtgagactccatctcaaaaaaaaaaaaaaaaaaaaaaaaaaaaaggcacgccagcaatatccactcagactaatttaatattgttcttctaaagggaaccaacaggccatgatataatcctgtcaggcaagaagttacttttaaaatccaccacttactctctatgaagaaatgcacaaactttgtgagaagtagcacatttaccttggctatctcagagtatactttcttaagagccgcagcctctgcttacactgcctatggagaaagtaggcggagaattttaagcccccactatattcttgccacctgtaggtaatcaagagtgggcggacgtaaatccaagcatggagtgtatctactgagctgattcttgctacccatataactaattctctttattgaaatgaagaaatagaaaccattattatgttcaacttgatttcaaaagatttcaaaagaagaaaccatgacaaacactaatgaaaaggatacttcaaaagtgtcagtaacacctagtacgtcagaccttgtagtcagtcaatcactattcatcagccacctcttactattagaaattcccaaacttttgtcattatttaattctgcagacatatctgtctcttctatattacatactgctttgaaattcactgaagaattaaacattcaatacatacaactagccctctccctatcatagctgtgttacatcaaagaagggagcaagctaagttttctgcaggcagaccatcagtgttaactataacaaaaaacatcatgtaatggattactaagaggagtttaagacttccctctgctacagcccaaaggtcctgccttggagattaagatgatacacataagatctggtaacccaacaaagaactttgagcaggacagggttctagaccagagatctcaaaaaacacatgcactctactcacaagaggacctcagagaccacttatttctgaaataattctcaagctcaagaatgttctttcttaacacaaggcagatttaaagcatcaaagaagaaggggccaggcgcggtggctcacgcctgtaattccagcactttgggaggccgaggtgggtggatcacctgaggtcaggagttcaagaccagcctggccaacatggcgaaaccccatctctactaaaaatgcaaaaattagctgggcgtggtggcacacgcctgtagtcccagttactcaggaggctgcggcaggataattgcttgaacccgggaggcagaggttgtagtgagctgagatcacaccactgcactccagcctgggcgacagagcaagactccatctcaaaaaaaaaagaagggaaaaaaatttcaagtattggaaattcttagtagcaaccaaaacattaaagaaatgacagctcattgcaaaggagagataataaagaactcagaaaagtacagtaatccaagcaatcaatgttattctaatactcttttgcaaagccagataaactctgcactgagtttctgtgacacaatactaacttcctccaaatatctaggacccaaccgttaacacacttaagaacacatgactgccgggcacaggtaatcccagcactttgggaggccgaggcgggcagatcatgaggtcaggagatcgagaccatcctggctaacacggtgaaaccccgtctccactaaaaaaaaaaaaaaatcagcccggtatggtggcatgcgcctgtagtcccagctactcgggagggcgagacaggagaatcgcttgaacccgggaggcagaggttgcagtgagccgagatcgtgccactgcactccagcttgggcgacagagcgagactcggtctcaaaaaaacaaaaaaaaacaacaacaacaaaacacatgaccacctctagagtacctctccattagaaatacttgtgagtgtcaaaatgagcagctgctgcccattctcaccttaactggaggggtggttcctgtaggatgtctgcggatctggcagccattctggctgggcctctgcggcttgttgttcagttggggcttcttgacagtgcctccatgatcatttctcacagaatcaaccttctcagcagttgttttgcttaaaagctgattaagacacatgaatgagattaatgctcttatcaaagcaaacaaatatcatctaggaaaagtccccttctgagcacagttttccaactcatctaagataataatagtaaatagtgtaattcttattaaaaaaacataccacggagctgttggcatctggtaggaattgtccaaactctgacaacaaatcttcctggtttttaaagagacgagcaacctgggcatacacctcctgctctgtcaatgctggagtgtagtttcctccagcttccttggcatttctctgctctttctgaggaattgcaaatgaaaagagatcatttgggctactgttttgagtcactcatctttgcacgctttctggaatcactgttatctatttaggctgcatgtaagaagaaagtctatgttcttagcacccgttctgaccacagactttcaagttgagaaaaaaaaaaagttgaagatggtggatgacaattcctttcaaaactagggtagtaaatatttttgagacggagtttcactcttgttgctcaggctggagtgcacttgtctcggcctcccaaagtactgggattacaggcgtgagacaccatgcccggcctagggcaataaatattaatgcccaggggaccactaccaactgacaaaaccttagaaatttctcctcctcctactgtacattaactagactatataaatcaccatctaactgtcccagataaaactgagtttcatttcatgggacagtgactaacaatcctgactgaggccgggcacggtggctcatgcctgcaatcccagcactttgggaggccatggcgggtggatcacctgagaccagcctggccaacatgttgaaaccccgtctctactaaaaatacaagaaatcacttgaacccgggaggtagaggctgcagtgagccgacactgcactattgcactccagcctaggcaaaaagagcaaaactctgtctcaaaaaaaaaaaaaaaaatcctgactgaatgttgcagggcaatcaagtcaggcaaataaaactggctttatagcatgggggcggtggctcacgcctgcaatcccagcactttgggaggccaaggtgggcagatcacaaggtcaggagttcgagaccagcctagccaacatagtgaaatcccatttctactaacaatacaaaaaattagctgggcgtggtgggcggagcctgtaatcccagctactagggaggctaaggcaggagtatcacttgagcccgggaggcggagactgcagtgagctgagatcgtgccactacactccagcctgggtgacagtgcaagactccgtctcgaaaaacaaacaaacaaacaaactggctttaaaaacatgcatgatagtttctaactggttaatttccagtatgaattaatggacacaataatggttacttgttattggactagatgccctaagagggtgacctggttaagacaggctgaatgggcactccttacctgatatgtgtgcaaaatctccaggaatgctttgtagatgtctggttggccctgaaatctgttcttgatcttattaacatagttgatggcatgattaaactccacaggttgattgttctgcaaggatggggccgttcccaacgagattgtcactggtgtgtgaggctggaccggcggagaacgtggggatgcatacggtggaagtgggggagtctgctgactggccggagtatgtgcttgcagttgggagggctagaaagaaaagaaatctttattctcttcagatgcatagatgagttgatacaaggaaagttcaaactaaagagaaacaaggtgtcaacgtatatcctttatttactcactcaggccaggtcattttagtccaacacaaatcatactgggcagcagtgggagttgtaggcggttcaaacatgctgatacaaatatttcagtctcacattttctaaataaaaccttaaaactggagccatctccaattacagggaagaatttttcatatgcaatgttttagcttagtagctcaacaagtacacatagaaaaaatctcattctacatagccttttgatgtcaacaacaagacaactgttgcagtagctccacataaaaaagtcttctacgccaactctgtcctgtagaactgagatgatggaaatgtcctttatttgcactgtcttatacatagccaccagccacatgaggttactgagcacttgaaagctagtgcaaatgaaaaactgaatttaatttaaatagtcctatgtggctagtggctactgtgtcagacagtgtggttctagaccaagaacaccccatcttcatcaccatcactatcactattcattagatcttctacttagcttgatataatctagttagtgaaataactttcataaaataaccatgtgggcagcagcacaatttgaccaggataagacgatggtttctatctgtgctgtcaactactactacacaaagtcaccacctgttgggatgttcatggttttataagcagaaactgtaaaaagaaagaccttgaaagttgttgctgtgttgatttaaatagatacctaagtaagtgatgtgtaaatgtgaaccatgtcatagtgaagttttcatacagcatttttctatgacgaaatctttgtaactttgtttctcagtatctaagtcttatataaaggggaaacatcaaaggaaggtgctctctagggatgcattcatattgatgcaatattttccaagtgctcaccttgctgactttggcaggtgggggctgaggagctggctgggcaggagctggggctgactgggctgaaggctgggaaggatgttggggtggtggttgaggctgtggctggatgccatgggtgggaatctgatgaacctggccaggagttgtcacattcaccatgtcattggtttgcacctcaattttgtagccagggggcaagaaggtgttgaatcccattatcagatcggggtggcctttgaatagctgggacacacgactaatcactcctggggtgtcgatgctgataaaaaacaaaaagaaaagtgataaactgtaagcttaacaaacaccctgttaagaaaaaatttcatgtttttttttcttttgagacggagtctcactctgttgcccaggctggactgcaatggtgcaatcttggggtcttggctcactgcaacctccacctcccgagttcaagtgattctcctgcctcagcctcccaagtagctgggattacaggcatgcgccaccatacccggctaatttttgtatttttaggacaggtggggtttcaccatgttggccaggctggtctcgaactcctgacctcaggtgatccgcccaccttggcctcccaaagtgctgggattacaggcatgagccacctcactcaaaatttcactttctactaggttttctctaaacaggaaaacagatcatctacgcattttaaaattaacacacgaactctgaaattccaaagccatttagttttagactcaaagatacttggccacaatttgttttttttttttttgagacagagtctcattctgttgcccaggctggagtgcagtagcacaatctcggcacactgcagcctccgcctcctgggttcaagcaattctcctgcctcagcctcccaagtagctgggattacaggcacccgccaccatgcccggctaatttttggaatggtcaaaatttttaacagaatatatgttcattgtaataattctaccaagcagatactcagatgatatatataaagctacatatcccaaacaagattcactctttgatataccagtatacatcatttcagcacacatctacattgttcagatgagttacactcttacaacagtgaaccatgccagaatataagggtatctaaaccaattcagaaaccaagtagcctaaatcactaccagtgctacttccctgattgagacaaaacactggaaaaaatttagttaaggaaaatttaccaatagggataaaaaagtctagtggccataatttccatcaataaaggtatgcataaaataaaggcatgattttgaaaattcagctgcaaaaaggagcatcctttatcttccagtaaataaactatatcctcttccttccaaaatcaatatgccagatacaaagcttgagtacaatcacacatcttttacctctgagatttaaattccttcatgatgtcaaggaaatcattgtagacctgaggctgactaccaaactgcagcttcacctggtcaagataagatagcgcatcctccacctgaggcagggataaatatcaaggttataaaaagaaagtaagctcataattacaaaaaaaaaacaaaaacaaattatttatgcctaagtatgcttaatgcagtaaatgaagtaaaaatatattaaatatatacttaaaagttagtatggataccaataataaactcaagcttaaaataataatcaactcataaaatctgtagccttgccttggaaaattttgaacagaatgatcagtgaagaataattacaatgatatatcatttattaattcatttcacaagtatctactaaactgcaacataccaggcccaatgtgagtaccaaggattcaatgacaaataatttgtagcccctcgtctatagacatttgtttgtatgtagtcaggaatcataacacagtgggtaacccggtaatcactccatgcctggagatgacatgggaaggacacgtcttctccaccaaaaaaagtgaggcttccccaggaggtaatgtataaactgagacctaaagatgactataagctagcaaaagtgaagaccagtgaagaaaatcaaaagcggcagcacgggtaaaatcctagacaggatacgatatgggatatttagaaatctgaaaacagtttagtttggctggaggatctgtagtgaagaggaaggaaaagtaacaaaatgagacagaaaaaaaagcaggatctagattctgaaaggatttgtaaatcttgtgaaaaagcaatttagatttttatcatctgcattttcgtgtacgcaatttgactgcagtgttgagaaaaaattggcacaagagcagaaaagattgaaaggaggtaggaagaccaggtatgctacaggaataactggacaactcatgtgaaaacagtggcttgaattatagtactggcccagaacaacagagagaactgcatagataaaaaagctttttgggtagtagaagtgacaggattggggaactgactgaatagaggagctaagggagagccagcattcaaaagtgatccgccacggagcactgaggaagaacagtcaagagtgactctcggaccgatcaaagcccacatgccactgcatcccgcactcagcgcttacatccttccacatcaccaccacacccaagagaaagcctgaaggggatgctaaaggagatagagccaaggtgaagaacaacccagagaagatccgcaaggttgtatgctaaacctgctcctccaaagccagagcccaaccctaaaaaggatgcaggctgggcgcagtggctgacacctgcaatcccagcactttcagaggcagaggtgggaggatcatctgaggtcaggagttcgagaccagcctgaccaacacggagaaacccatctctactaaaaatacaaaaattagccaggcatggtggcgcatgtctgtaatgccagctactcgggaggctgaggcaggggaatcacttgaacccaggaggcggaggttgcggtgagtcgagatcatgccattgcacaccagcctgggcaacaagagtgaaactcggtctcaggaaaaaaaaaaaaaaaaaaaaagtcccctgcaaaggagagagaggaggtacccaaagggaaaaaggaaaatgctgacactggcagggaggggaataaccttgcaggaaatggagatgccaaaacagaccaggcacagaaagctgaaggtgctagagatgccaagtgaaacatgtgcatttttggtaactgtgtacttctggtgactgtaaagtttgaactataaagttatgaagtttgtaaattttgaaataccattgtttaaatcaagctttataaaaatgcagaattttgttttgctttttctaaagcagtgttgttatcgcacacagaacacttcattgttgttttggtgggaaggatcacaggtcactaatagaatgtctttgaagctggactgacgtggggaaaacacctttcccttctagttttgagagacttcctcttggcttatagaagaaattccctgactttatttacttatttatttagagacagagttttgctattgttgcccaggctggagtgcagtggtgcgatcttggctcactgtaacctctgcctccggggttcaagcgattctcttgcctcagcctcctgagtagctggggttacaggcacccgccagcatgcctggctaatttttgtatttttagtacagacaggatttcaccacattggccaggctggtctcaaactcctgaccacaagtgatctgccagcctcagcctcccaaagtcctgggattacaggcgtgagccaccacacccagcctagattccctgacttttaacacacatggccaccttggcacaaacaccttgtgggatggaaaaacaaattcatttttacatcctgttctccctccccaccttcacagacctaactcccttttacccagacacctgttgggacctaacccccaataactggttaccaatatgtcaggcagtcaaactttccagtgatgccactgaaatggcagccctcaaaagagcagtggttgctttttctagactgtggatcttcagataagtcctgccattttcatttcacttcctgaaagtcagggttggcttgtgaaaagttgttaaacaacatgctaaatgtgaagtgtcaaccttcactctaaactttccctgttcagagcatcaaatgagacttcactgggttttatagtggcttttttttttttggtagctcattgttaaggattgtccatgttctgcctgaaataccatgactgtttttggaaagtatctttaaagctggatacagtttggctgggggagaaaaaaaactgacctatcacaaagaagaacaggttggaaaggctaagctatgagtctgatttaggacagagacacccaaaagaaatccccactaggtgtttcctatttactctgagatacgttaagttttattttggtagtttaactgaagcctaaatatttaaaattatacaaaatatcaggtttaagaaatttcagaaataaacatttgatgtgatttaagccagtctttttcttttttttttttttgagatgggagtctcattttgtctcccaggctagagtgcaatggcgcaatctcgggtcactgcaacttctgcctcctgggttcaagtgatatctcctgcctcagcctcctgagtagctgggattccaggcgcatgtcaccacatccaactaatttttttgtatttttagtagagatgggatttcaccatgttggccaggctggtcttgaactcctgacctcaactgatccgcctgcctcagcctcccaatgtgctgggattacagatgtgagccaccacacctggccaggcatagatagtcttttgatttgttgcaaaatggaacatttacattcaagtcaatcattaactggtgctgtggtctgaaatgtgtcccacaaaattcttacatcgaaacttaatcaccgatatgatgatattaagaagtgaggccttcagaaagtgattgtggagccctcatgaatgggattagggaccttataaaagggctggagtgaaccagtgttagtcccttcggcccttctcccttccagtgtaaggacacacattcagggaccatctcgaaaaacagagttcaggccctcaccagacaccaaaccaactggcacctggattttattttattatttattttatttattattattattatttttttagatgaagtcttgctcttgtctcccaggctggagtgcaaaggcacgatctcagctcaatacaacctccgcctcccgggttcaagcgattctcctgcctcagcctcttgagtaactgggattataggcgcctgccaccacgcccagctaatttttgtatttttagtagagatggggtgtcaccatgttggccaggctggtctcaatctcctgacctcgtgatccgcccgcctcggcctcccaacgtgctgggattacaggcgtaagccactgcgtctggcctatttatttattttgagacatggtctcactctgtcacccaggctggagtgcagtggcacaaattcggctcactgcaacttccacctcctgagttcaagcgattctcgtgcctcagcctccagagtaactgggattacaggtgcatgccatcatgcctggctcatttttttgtatcttcggtagttttaccatgttggccaggctggtcttgaactcctgacttcaaatgatctgccctcctcagcctcccaaagtgctgggattataggcgtgagccaccgcacccggccagcaccttgattttagatttcccagcccccagaacttctccagaactgtgagaaataaactgctattatttagattatacagtctcaggtattttgttatagcagcactaatggattgagacaaatggccgcttttttgtttttgttttttttgagacagagtctcgctctatcgcccaggctggagtgcagtggcgctttcccggctcaccgcaagctctgcctcccgggttcacgccattctcctgcctcagcctcccaagtagctgggactacaggcgcccgccaccacggccggctaatttttttttctatttttagtagagacgggatttcactgtgttagccaggatggtctcgatctcctgacctcgtgatctgcccgcctcggcctcttaaagtgctaggattacaggcgtgagccaccgcacccggccccgagacaaatggctgtttaagagttcttcagacttccattacggccatggttaatcagtgtttcggtgttgctagaaatcagattgtatagttggtcaatacccacttgtttgatggttagtttttctatacaaatatcatgacaatttctgttgaaattcaatggactattttaattcatattctgaactttccatactaaaatgtttcattaatgaccaacttaagtgaacacaaaatatattaagtttgcaaaaggaaccaagactttggaagatatttaagaatagcatgcatcattacacaacaaaagaacagttatcaataagacatggtatggtataaggtaactactgcagagacggaaaaagtacagaaacccaaaagaaagcaattatgtgtgatatgtatatgtctgaaacaaaaaggtactgaaagtcacagcaaaccaagcaaaccactgtttaaaaattagttataggccaggtgtggtggctcatgcctgtaatcctagtactctgggaggccaaggagggtggatcccttgaggccaggagtttgagagcagcctggctaacatggaaaaaccccgtcctagtaaaaaaaaaaaaaaatacaaaaattaggcttggtggtgcatgcctgtaatcccagctatttgggagactgaggcataagaatcacttgaacccaggcaggggagggtgcagtgagttgagatggcgccactgcactacagcctgggcagcagagtgagactctgtctcaaaaaaacaaaaaagtaaaataaaagttatagaataatcctatgctttaaaaactctgcatgacactcacataataaataagacacctacatgtaaaaatagtgaggaaattctctcatcacctaaagcatagtccaactcttatataaactctctataaatgcatgtatacagttctaggtagcacaacttaaaaaaaaaacttggatgtagttatttagaagctacagatttaaggaagcacttggggagacccttagactctgctgataaagtttcttagctcacttcaacagggatttactattaaggccccgaatctcctgaagtctacaatcttgttgggagagaaaaacacaagcaactgtaaagataacctgctaaatatgtaccaaatatcactgctgctgacattcaataactaaataacaccaaacatgcctcaaatcgttcaaatcccttcttgtcaccaccaatctaccaaagacaaaaaacaaaaaaaaaagacaatgttgaggcttgaaataatgtgtaagcattctcactgaacatttctttttttttgtttgttttttctgagacggagtttcactcttgtcgcccagactcgagtgcagtggtatgatcttggcttactgcaatctctgcctcctgggttccaacgattctcctgcctcagcctcctgagtagctgggattattacaggcatgcgccaccatgcctggctcattttgtatttttagtagaggcatggtttcatcacatttgtcaggctggtcttgaactcctgacctcaggtgatccacccacctcggcctcccaaagtgctgggattacaggtgtaagccaccatgcccggcctacattattatagaatataaatgatttattgaagttgattcaaatgcttgtaatgcattttaagactgatccaaaaatgacaggcaatgtgggaatactgagttaaattacatggaggtacaagaagcattttacctctcctcatcagaaaggaaattcaacaagttattttatgcaggaatatagtcaagagcttgtgactaaaagaacacaacaagaaatcctaactctatctatgactcactctataaccccaaatccaaaacctttccttgtttccttgccagtttccataaagcaaacaaaacataatccatatacttataccaaagagtcctgtgaggaaggtgggtaaaaactggtgttgtgctttgatagggttgattgaaaaaggctatagaaatacatatgtttttgttagtttaataagcaagtttataagctattttgcaacattaaagtataactactgaatatacagtgttaatacagaattaaatcacgcacaaccaagttttaaaaaaaatattttcaggacttagtaaagtgctaagcccgcagcaataatacattttggtacacagccatcactctacaacagactgaaaatgttttaaaggaaacatcaatattccttatacacattttcccaaagacagaatccagagtgaagcttcaggcctaaaaaacctgtactctctttaaaaggctatgcattagtcaatactatgtaagccaatatagagagtaaattttacaaaattactctaaatcacatagctttgctgtactttataatatttatgtagcatttaatactcttaggccaatattaaacaagttcccaagaatccacaccaacgagggcagggatcaagaagaactaaagtaagtatcagggaaaacagaagaaacaactatttgctgcatatggatatgtccttagagggtttatttctcattcgtgcctgcaagcaacataagtaggttgcaataaccaaatgaagatttaacatctcttcagagttcctccatttattatttcctgaacttaattttatataaacgtaaaattagaaaaattgaaacctgaacacttgctgcaacaatcacatattttgaaaagtaacattcaagtggtcagagatacaaggttagctgggaacacaagcttcacttctccagggatgcctcatgaatttcaaagcactgaaaacgtaccacacatactcagcagaaaatatgaaaacactgataattcattcacagttacagttttccctgaactttataaagattccccccaaaaaggagcatgtgttttactaagaatggacttgatgatgtgagtcaattcagctattcataaacaggaataaaaagataaaggtaataagaacattacaggcatgagctgggcatagtggctcgcacctgtaatcccaacactttcgaaggccaagatgggagaatcacttgaggccagcagtttgagaccagcctggggaacacagtgagactcccatctctgaaactaaaaactaaaaaaaaaaatttttaagaatttaaaaagattgaactgtaagatatattactgggccaatttactgtactaacctgtagccaatcatatatgtgctcaatagagagttcaaaaggaagcagccaaaaaatgaattttaaggtttattttgtattaaaatggccccacaatcctgataacatttgaccgacatgcattcatacagtccacaaacatttgagtatattcttctctggatcaggcactgatgccaagataggaaacataagcaaatttcacaaaacaaaaacggtaaaacttgtgattcgacagctagtatctcaggttagaagttgtaccaccacaaccaacaagctgcaaccagtatttcctgctaaagataaattttttgacccaagaaaaagagctgaataccaccttcagcctctgaaattgctgctgtccctgcactggtgcaactggtggggctggatgagcatgactctggaccacctggcctccgtggggctgcaccgctgttgggtgatgatggctgctatgaactgctgctatagcgggcccatgactgccggagctctgtggcatggctgaaacctggggtgaacaaaatacagacaggaaacttcaaggcttgtacattcttccccaaatgagtctaaataactaacacaaatgcacaaagataattaattggaaacccaaatttctgctgggcgtgatggctcacacctatctcacctacataggaagatcgcctgaactcaggagttcaaggctgcagtgagctatgatcatgccactgcattccagcttgggccacagagtgagaccacgtctctaaaaagagaaaagaaagcctgggcaacatagtgacacccatctccacaaaaaataaaaacttggccaggcatggcaacatgcacctgtggtcccacctactccagaggctaaaggaggaggattgcttgagtccaggagttcaaggctgcagtgagctgtgatcacaccactgctctctagcccaggtgacagaatgagaccgtctctaaaaaaaaagaaagaaaagaaaaagaaagaaacccaaattttccacaaaaggaactggttaaataaattacagcccaccaaagttataacaaaattatttgtagctattaaaaattatatagccgggcacggtggctcatgcctgtaatcccagcactttgagaggccaatgcaggcggatcacgaggtcaggagatcgagaccatcctggctagcatggtgaaaccccgtctctactaaaaatacaaaaaattaaccaggcgtgttggcgggcacctacagtcccagctactcgggaggctgaggcaggagaatagcgtgaacccaggaggcggagcttgcagtgagccaagatcgtgccactgcaatccagcctgcacgacaaagcaagactccatctcaaaaacaaacaaacaaaaaaatatatatatagtttagctgggaacagtgtctcacacctgtaaccagcactttgggaggcccaggcagacagatcacttgagttcaggagcttgagaccagcctggccaacatggtaagaccctgtctctactgaaaataccaaaaaaaatagctggacgtggtaacacgcatctgtaatcccagctactgagaggctgaggcacggtaatcacttgaacctgggaggtggaggttgcagtgagctgagatcatgccactgcattccagcctagaaaacagagcaagactctgtctccaaaaagaagaaaaaaaattatatagtttatctcaaactgtctgtggtaaaggatgagtttttttcttaaaatttcaatccatcagggaccacaacttttataaaaatccaataaaaataaattactatgaaagtgaaataaaaaatacataaacccgccgggcgtggtggctcatgcctgtaatcccagcactttgggaggccgaggtgggcggatcacctgaggttgggagttctcgagaccagcctgaccaacatggagaaaccccatctctactgaaaatacaaaattagacaggcatggtggcgcatgcctgtaatcccagctattcgggaggctgaggcaggagaattgcttgaaccagggaggtggaagttgcggggagctgagatcacgccactgcactccagcctaggcaacaagagtgaaactccatctcaaaaaacaaaacaacaaaaatacataaacccgtaattttttttcttacctttttattgagacagggtcccgctctctcacccaggctggagtgcagtggtacaatcatggctcactgcagccttgacctccccaggctcagatgatcctcccaccccagcttcccgagtagctgggactacaggcatgtaccaccatgcctggttaattgtcgtactttttgtagaaacagggtttcaacatgttgcccaggctggtcttgaactcttgggtatggagtccacctgccttggcctcccaaagtgctggggttatagacgtaagccactgtgcccagcctgtaactttcattactggattttacaaataaaaaatgatcatgtccaattgctctaatagtttctaaacaatttctatacttatgccattacaaactagtaacaaaggatacagattagccatttttaagccacacttcaacaatgatatatatggatatatttgaatctgaaaaaaaagttcataatccacaagttgaacatattcatgtactgtatataaacttttaaatagttttttaaagcacattacactggctgacaaagaccctgtctcaaaaaaataataaaagcacattacaaagcagtatgataaaaagatttcaaaccttagacaactaatatatagcaaaatgttggcatttaatcttgtggttacagaattaaagatgactcttactttgtttctttttgtttttgaaacactctcgctctatcgcccaggctggagtgcagtagcacaatttcggctcactgcaacctgtgcctcccaggttcaagcgattctcctgccttagcctcctgagtagctgggattacaggtgcctgccaccatgcccagctaatttttgtatttttagtagagacagggtttcaccctggttagactggtgtcgaactcctgacctcaaatgatccacccgtcttgggctcccaaagtgctgggattacaggtgtgagccaccgcgcctggcctacttggcttattttgcttatcttgatttgctacgagcactgtatctaatgtaaaataaattttttccccctaattcttgatggtttggcctcaaacaaatgtcttttctattcttttatctcagtctttctcctgtcctcttacaagtttgaggaaataaaagccaaaactactttccttctatatctatttcaagaaatgctacaaaatttttttcagaacttttttcctttttcagaattgttgatcaccacagaagacaacaatctgtccaaatgcccaaatgccccatccccaaaataaggagactaaataacatgaaactttctttctctaaacaatgttaagttttataccacaatttaagagagaataaaactttttttcaaatcctcacttttataaaaattatcctggagggagatgaagaaatgagggagagggagaaaccaagcaactatgcataaatccacagaaacaaaacaaggtgtattaagagtaaaaagaaactatttagacaattctaaaagctctaatgtacctcaaagatgggctagtattctgagcttctgtattccaacatgcatgttttttacagggtttacaggctttcactagactgacttatacaaacacattatagtttccattcggaagaaatttaactatcccaaatgtagaaaacagtcattaacctgtttagataatgaaagtaatcacccaaggtaaacaagcaacttttttttcttccaagtcctaaaagatgccatctgttggcagtcttctgactgctgccccagccccacaggaagggattagacagcctcaaggggactcctgaggaagagtgacacctaaggaatcaccatttcctacttcagctgcatttcctcttctttatatttttatactaaattcctagaaatggaattgccaggtcaaaaactaacaaaaccatctgacacaaactgccaaattgctctcaaaaaagattacgtcagtttatattcccattaccagccgtacatttttaaggtcactaacaaatgaggttgaaggcctccccagaccagttatatgctgaagtagaaagatatccactatatattaaatgaaaagagcaaacagcacaatagtatgtaatgtatgatccacattgtacaaaaagaaaagcagaaagggcggacgaggtggctcatgcctgtaatcctagcagtttgggaggccgagtcgggcagatcacttgagtccaagagttcaagaccagcctgggaaacatggtgaaactctgtctctatagaaaaaatacaaaaattagccaggtgtggtggcatgcacctgtagtcccaactacttgggagactgaggtgctaggattgcttgagcccaggaggtgaagggtgcagtgagctgagatcatgccacagccttccagcctgggcgagagtgtgactctgtctcaaaaaaaaaagtaaatttagatagctagacaggttgatatagatgagcttgtatatgcatataaaactggatacccaagaaattcaccagtgggagaaaatctgaggtgtgacagaaaaaaagtcattttatatcctttttttaaaaaaaaatcaaagtgtggcagggtgcagtggctcacacctgtaatcccagcactttgggaggtcaaggcaggcagatcacttaaaaccaggagtttaagaccagcctgcccaacatggcaaaaccctgtctctactaaaaatacaaaaattagccgggcatggtggcttgcgcctgtaatcccagcgactcaagaggctggggcatgagaatcacttgaacctggaagccagaggttgcagtgagccaagatcacgccactgcactccagctggggcgacagagcgagacaccatctcaaaaaaataaaataaggccgggtgcagtggctcacgcctgtaatcccagcactttggaaggcagacaggcggatcacctgaggtcaagaccagcctggccagcacagcgaaaccccatctccactaaaaatacaaaaattagctgggcgtggtggtgcacgcctgtaatcccagctactcgggaggctgaggcaagagaatcgcttcaacctagaaggcagaggctgcactgagccaagactgaaccattgcactccagcctgggcaacagacagagagtctgtctcaaaaataaataaataaataaataaaataggctaggcgtggtggctcacacctgtaatcccggtactttggaaggccaagaggggcagatcacctgaggtcaggagttcgagaccagtctggcccacatggcgaaaccccatctctactaaaaacacaaaaaattagccaggcatggcagcaggtgcacgtaatcccagctactcgggaggctgaggcaggagaatcacttgagcccgggaggcagaggttgcagtgggccgagatcgcaccactgcactccagcctgggtgataagagcgaaactccatctcaaaataaataaataaataaataaataaatgaataaaataaaaaataaaaaaaccaaagtgatacattactttcataataaaaaagggcaaaaaccaaatttcttcacttctacaaaacagagtaacagatgaatgatcagtgttggtcaggacatagaacaggaatatacaatgcttgggggaacttgctaaagatgcatataccctgtgacacagcaatccctttcataggtacttgacaaactcttgtatgtcctcaaacctgctgactggtttccaacaggttaaggagtttgcaccacaatgtaaaccaacgatggtagacccttgaataacacgggtttttgttttgtttttaaggagacagggtcttgcactgttgtccagtctgaagtacagttgcttgatcacagctcactgcagccttgacttcctgggcttgagcaatcctctcacctcagtctcccgggtagctaggactacagatgcacaccactatgcctggctaattttttatttattttttcaaattaattaattaattctttctttttgagacaagttcacactctgtcacccacgctgggtgcggaagcatattcactggagcctcaacctcccaggctcaaatgatcctctcacctcagcctcccaagtagctaggaacacaagtgtgcaccattacgccctgctaatctttatttttaggagagacggggcttgctatgttgcccaggctgatctcaaactcctgggctcaggcaatcctcatgcttccaacttcgccaactgttgggattatgggtgcgagccactgcactcagcaacaacacaagtccacttatacatggattttctcccacctctgccaaccctgagatggccagactaacccttcatcttctttctccctcctcctcagcctcctcaatgtgaagacaaggatgaagacctttatgatgatccacttccacttaataaatggtagatatattttctcttccttatgattttcttagtattttgtttcttctagattattttaagaatatagtatatgacaaatatacaaaatacatgctaatcaaccatttatgttatcggtaaagcttctggacaataggctatttgtatttaagttttaggggagtcaaaaattatacattggccagacgcagtggctcagacttgtaatcccagctctttgggaggctggctgggggaggatagctttgggccaagagtttaggaccagcctgagcaacacagcaacacctcatctctacaaaaatcataaaaattagccaggcatggtggtgtgcacctgtagtcctagctactagggaggctagggcacgggaggactgcttgagcccaagagtttgaggctgcagtgagtcatgatcgcaccactacaccccaacaggggccacagagcaagacactatctcctaaaaaaagaaaaaggaaaaaagttatacatgtatttttgactgcatggggggaagtcagtgcctcaacccccacactgtccaagagtcagccatatttcactacaatgatgtttaattcagctgtcttttttaaaaataaatagcaaaactgtcttaataagtgcgttgatttaaattctggcacaagcttcttattttgtcatgaattgccactgagtgcactaagacaatatcacaatgttcacagcagcacctttgtaaaagcaaaaacctggaaacagcccaatagtccaacagtagaattgacaaataaattgagtatatgcatgtaatttacactacagtgaaaatggtggaattacagcgatctataaaaatatggggtttttaaaacaaagtgagtcaaagaagaaaatgtttccatttatataaaagttcaaaaataccgaaactaaacaattatgttagtttttttaagtaaataaagtcaagggaatgataaatacaaagtttagatcagtggctacctctgaagggagggaaaagaagggagcagagtgggatacgcagggaacttcaaaggtcatgacaacattctttttttaaaaacttgtatggtgagtacacagttatttttttttttaccttacacatactcaacaatttttaatatctaacacagtattaaaaaaagttttataattgcctaaaaccactatttctcttccctcattctagtcccttggttggctccagcttacctggtagctgggtgttacagagtactgaattcccgtagctgactgcatggtctcagacactgcttcatacacaggaggggcaggggcaagcacccggtgctggtgaggaaaagcctctgtgctgccagggatccgacgctgctgggctgcatacaccggtgactcctggtcatccaaacgccgcttcattctgtgctcatgctcagggatgcactacaaaacctgcagaaaccaaaagcaatagcatgcaagtcaattctcactccagtatgatgtacgccacttaggaccagtcacccaagtttagtaaaagcttgactcccagaactgatcatctatttcatcttagtgatgaagtttaagtgcatgtgggcataccaccccccaacacagtgaacaagttataactgaaaaagacaaatatttaaataacataattttaattaatttggtattatgaagttgaaaaatacgctccaatttaaaaatataaacacaaccttgtttccctttattctctagttttctcctcaaatgctatcactcctaatattaattacatatctacatgctgcaaaaatattcaagtgcttcttctttttttttttgagacggagtctcactctgttgcccaggctgagtgcagtggtgccatctcggctcactgcaagatccacctcccgggttcacgccattctcctgcctcagcctcccgagtagctgggactacaggcacccgccaccacacccggctactttttttgcattcttagtagagacggggtttcaccgagttacccaggatggtctcgatctcctgaccttgtgatccatccgcctcagcctcccaaagtgctgggattacaggcgtgagccaccgcgcccggcctcaagtgcttcttcttaaatcctctcaaaacctactactataattgtggtctaatttaaaatttgtttcaacaattataatggtatcatggaaagaataccgtgccaggaatgggaagacaaagattctagacttgccaatttaagatgctacgtaacttcaacaagttcctcattctatgtgaatttcagtttctccaactataaaataagaaaagttggaacagatcactcctaaattttcttctggttttaacagttataagaagagattctcttagcttaataatacctccgtgggagacaatttcattcctgcaggacacagtaatctacttggcccagtaatctacttgggtcttcagagcttttccatatcagtatcactaacacaagcataacacaccatcagtgagaaagaatgaatcagccatccaaagaaaaaaggccccaccacttttccagtcccaaaaaaatctcttaaataagataccactgctatggaaagaagataaaatttacagtaatagtgggagatttggcaagccaccccctcatctgaaatacggttaagttaaaaaaaaaaaaaatctttacctaattcataagtctacccaagatcttttctttatcctctgggagcacacaagccctgaagggaaagtagtctttacaaggactctccatggctgtttcaccttttctttgtcctcactatagtcctcaatctgcctgccactctaatccttagctctgaaatcctgtctcaggtttttctcacatttcacatacctaagtgggaccctgacacagcagcacaacccattaatttgcaagctggctacttttatctatttgtaaactcaagccacaaatatgctctctgtggcctatataacttcagactaagtctctcagctttgtgtgtgataatatgtggaactcagttaaatggagttgagaacgtttctgacagctgctgaggacaaataatttaaaatgtcttagctagttatgctttcctatgtttttctagcatgaaatagcatgtttagcttagtattcaaaaaccttttagacatattaagaggttgagtatatagatttatgcatgttatttgccactaatcaactacgaacactaaacctcagcgtgttttgggatgaggaactgagtctaatcacaggtagagtaaaatgtctttttagctatttcttatatacgttcatgactttcagtggtttggtcttgggttctgttggtttaaaactgatgcttaactcatcggagattaacctctgtaaccaaaaatgaagtcaatactttattggccggatgcagtggctcacacctgtaatcccagcactttgggaggctgaggcaggcagatcacctaaggtcgggagtttgggaccagcctggccaacatggtgaaaccctgtctccagtaaaaatacaaaaattagccaggtgtgatggcgcacacctgtaaaacctgctacttgggaggctgaggcatgagaatcgctagaatccaggaggcagaggttgcatgaggggaggtcccaccactgcactccagcctgggcaacagactgagactctgtctcaaaaaaaaaaaaaaaaaaaaattatagaaatgttatgatagggcagcactgggtttaaaaaacaaaaacttcataggctggtcacagtggctcacacccgtaatcccagcactttggaaggccgaggtgggtggatcacctgaagtcaggagttcgagaccagccaggccaacatggtgaaacccagtctctactaaaaatacaaaattagctgggcatgatggcacgcatctgtaatcccagctacttgggacgctgagacgggagaatcgcttgaacctgggaggcggaggttgcagtgagcaaattcgcaccactgcaccccaggctgggggacagcgcgactgtctcaaaaaataacaacaacaaaaaaaaactttataaataataagccaaaatcagatgtgaagagcacggcacgactatagaaaaaacactagagtaccttttaagaactggattctgttggatgggagaatgtttgagggcaaaaaataaaaacaaacaaaaaagaactggattctactccaaactctatctaccatgaagctttctaattttggccctgttttcaaacaggggcaaaaggaggggatcagcctacattagtgatttccaaatgctggtttatgaaccagtctataaggaaaaagaagattgtagtgagcttttcatacattaagtattacagtactatggtttattctgatatcatactctatcttttggctgttaaaatatcgtttcttttattaagtgattgggatttcatatggtacttaacttcatccacctccagagtttgctttccataccacctctacaacactacagaggctgaactttctctgaaccatactttattcctttaacaattaccactcataggccgggcgtggtggctcacgagatcaggagatcgagaccatcctggctaacatggtgaaaccccgtctctactaaaaatacaaaaaattagccaggcgtagtggcgggcacctgtagtcctagctactcgggaggctgaggcaggagaatggcgtggaccgggaggcagagcttgcagtgagccgagatcatgccactgcactccagcctgggcgacagagcaagactccatctcaaaaacaacaacaacaaacaaacaaacaaacaattaccactcaaagttctattcctaactctctctcaaataaattgcttccgctctaatcatacctcctggtttcaggccctgatcatccttcacaacaaccttataagcaaggtgttctctaatttatgaatgaggaaactgaaaaacaaagattaagtaaactgcccaaggttgcacagctagtaagaggcaaagctgtgatataaatccaggaaatctgtctccagagcctggctcttaactacttcactaccttacctctcacagaagagaagaagtgaaggaagaatccctttacttatttaaggcacacatgcagggagcaagttcagctttttttaacctttcacacacttagctaactcatccttcttcagcctaaacctaataaagcagaaatgctttagtagcattcattcattaaaagcaaatgttcagtgagtagatatgaagttggtagatgatttcagcccttgccctctaaaaccatatatagcctcactagtaataaaaaacgtgtaaagtaggccgggcgcggtggctcatgcctgtaatcccagcgctttgggaggccgaggcaggcggatcacttgaggtcaggagttcaagaccagaccggccaacatggtgaaaccctccctctactaaaaatacaaaaattagccgggtgtggttgtgggcgcctgtaatcccagctactcaggaggctgaggcacgagaatcacttgaacctgggaggtggaggttgcagtgagccgaaatcgcgccactgcactccagcctgggcaatagagtggaactgtctcaaaaaaaaaaaaaataaaaggtcaggcgccgtggctcacacttgcaatcctaacactttggttcgccgaggcgagtggatcacctgacgtcgggagtttgagaccagcctgatcaacatggagaaactctgtctctactaaaaacacaaaattagccgggcatggtggtgcatgcctgtaatcccagctactcgagaggctgaggcaggaaaatcgcttgaacctgggaggcagaggctgcagtgagccgagatcgcgccactgcactccagcctgggcaacaagagcaaaactccgcctcaagaaaaaaaaaagtaatttactccaaagcaatttaaaaaaaaaaaagatgacagtgtgggtaaggatacagggaaacactgatggaggaggctttaattggtacagcctatttagctggcaacttgtaggtatttattaaaattttaaatgtgcatacccatcccatgcatattatggaaaactatgtaagaatcagatcaaagtttatccacgagtataagaaatgaactctaaaacatactagattttggaatactgaaactatcaattccactttcaggcctgtatcctacacatctgctgagtatatttattgcagcaaaatatgaaaatctaaatatctatcagctaaataaatgtgatcatgcatattatggaaaactatgtaggaatcagaaagatcagggtttatccacaagtacaaagaatgaactctaagacatattaagtgaaaacagcaggctaggccggatgcagtggcttacgcttataatcccagcactttgggaggccgaggcgggtggatcacctgagtttgggagttcgagaccaacctgaccaacatggagaaaccctgtctctactaaaaacacaaatattagctgggcgtggtggcgcatgcctgtaatcccagttactcaggaggctgaggcaggagaatcactcgaacccaggaggtagaggttgaggtgagccaagatggcgccactgcactccagcctgggcaacaagagtgaaactacgtctcaaaaaaaaaaaaaaaaagaagaagaaaacagtaagctatagaatacatacagcatgatctcatgtatgtatatatacacatacaaaatgtactaaagatttgtacatttcattgtatgtaaaatttgcattgaaagaaaaatgtgcctgggcacagtgattcatgcctgtaatcccaacactttgggaagctgaggctcaaggatggcttgagcccaggagctggagaccagcctgggcaacaatgggatgaccctgtctctacaaaataaagaaacaattagctggaagtggtggcgcacaactatggtactagctactccagtgactgaagtggaaggatctcttgacctcagaagttgaggctgcaaggttgtagtgagcagtgataacgtcactgcactccggcctgggcaacagagtgagactctgtctcaaaaaaaaaacaaaaaaaacaaaaaagaaaaagacaaagaaaaaacatgctagccacgcacaatggctcacaaagtgcctgtaatcccagcactttgggaggccgaggcaggcggacctcttgagcacaggagttcaagaccagcctgggcaacatggcgagactccatctctacaaaaaatacaaaattagccatgcatggtggcatgtacctgtaatcccagctatttaggaggctgacgtgggaggatcatgtgagtccaggagacagaggctgaggtgagctgagatctcgctactgcactcgagcctggacaaaaaagaaaaatgctataaacaatattaaactctagataatgataaacatgctcaagtgcttagatgaagtatactaatgtctgcaatttattttgaaatacatcaaaaaatcagattcattgatggagcgatggatagatggacaggcatatgttaaacctagtagtagaaaaatgataatggtaaaatctaggtagtgtgtatatgggtgttcattatatttactaaaattctatcaactttgttgtgtatttggaaattttcttgataaagtcttggaaaaaaacatccacaggttctgaggattaggaaaaaaaaaaacaggaagaaaagccaacaatacaaaccagctcttgagtggaaaaaataagtactataaattgggaaagggatacagacaggtacacttgggaagactctataaaggtaaatattcagctacatcttgaaaattagagatgaattagaacacaggggtatagagcatgaaattaaaatagtaagtttagacttgcaggcaatagttatttacaatctttgccaagtcattcatcccacaaataattagcaagtgcttaagacatgcctggccctgtgcggagggttagaagtccagcactgagccagagatttcctccccgacaacagccaagtcttccatgtatgactgctatcagctgatgtcctcctcgcaacaatcctgtcagataggcagtcccagaaccctttttttttttttgcaatagcataccattatgtccaccaggctggagtgcagcagggctatcacggctcaccgcatccccaacctcctgggctcaagtaatcctcccacctcagcctcccaagtagctgggacataggcagcgccaccatatctaacttttgtattttttgtagagacagggtctcgatatgctgcccaggctggtctccaactcctggcctcaaacaatcctcctgtcttggcctcccaaagtgctgagattataggcatgagccactgcgcccagccagacccctctttttttgagggaaactgatactcaaattaaatgacttattcaaggtcacatacctgactaaaagagcaagaggttaaattcttcctccttggaatatgaacaatctaaagtagaaacattggacaagactgtaaaaccacgcttgcagaggggtacagtgtaattctagaatataaagaaagccaaacgatggaaccacaaagtcagccacaaaagtactgtcaagtcccgcttcagccaacatggttgatctccatctgtttcaaatttggagtttatagtactatcagaactctagtctaggaagacattataaaaagaaaaaaaaagcactttgacgtatagaaactatggagagaagactaaataatggcagcagaacatttaaaggtcacctggtgggcacagtggcttgcacctgtaattccagcactctgggtgactgaggaggaaggatcatttgaggccaggaggtggaggttagattaagcaagattgcaccactgcactccagcctgagcgacagaggaagatcccaaatacacacacacaaaaaaaacacctacaggtcctaaaagtcacctggccatgtgttataataaaactgggcgcggtggttcacacctgtaatcctagcactgtgggaggctgaggcaggcggatcacttgaggtcaggagttcaaaaccagcctggccaacatggcgaaactctgtctttactaaagcacgaaaaacaaattagccgggtgtggttgtgggtgcctgtaatcccagctactcaggaagctgagacacaagaatcgcttgaacccagggtgcggagggtgcagtgagctgagatcgcgccaccgcattccagcctggttgacagaacaaggctctccgtctcaaaaaacaaaacaaacaaaaaaaaaacgggtgggatgctgggtgtagcagctcacatttgtaatcctagcactttgggaggccgtggtgggaggattgcttgaggccaggagtttgagatgagcctgggcaacaaagtgagacaccgtctctacaaaaaaattttattaaaaattagctgggcatggtagtgagcacctgtagtccttgctgcttaggaggctgaggtgggaggatcatttgagcctgggaggttgaggctacagtgagctgtgattatgccactgcactccagcatgggtgatggaataagaccctgtctcaaaaaaacaaaagtctatcctggtcagtttgtttaaatgcatactcttagaacaaaaaataaaataaataaatgcatactcttttttgcttatttttaaatgcatattcttgaaacaatggaaagtttctcttcaaaagcaaacttccatcgcagtattaagtcaatgtaaacttcaacccagtgcaattttgagtagtctaattcaaaatttgtccaaaagtccacctctggttttaaatctgctaagaaagaatctattacagaatgaaaggcactctatttagatttcatatattgattagaattattgcttggaaaaattaacaaccagctcttctcaaaagacaccattagatctaatatccaagcctcctttgaactcagtttttatattcttctaatgcagtggtcctcaactaggggagattctgcctcccaagggcacatgtagtaatgatggaagacatttttggttgtcacaactcgggaagatggaatgctactgatatctcacagatagagtaaaaggatgttgtcaaacatcctacaatgcacacgacagtctcctcacaacaaattatttggcccaaaatgtcaacagtgtgtgaagactgagaaacctaagtttaatcataaccccaactgtcacatatcttttttttttttttgagacagagtcttgctctgtcacccaggctggagcgcagtggcgtgatcttggctcactgcaagctccgcctcccaggttcatgccattcttcggcctcagcctcccaagtaactgggactacaggcgcctgccaccacgcctggctaattttttttttgtattttttagtagagatggggtttcactgtgttagccaggatggtctcgatctcctgacctcgtgatccgcccacctcagcctcccaaagtgctgggattacaggcgtgagccaccgcacccggccatcaatgcttcttttacggcatatgatacacctttaacccgcattataccattacgcattggccagacactctgacctaaagttttttagaactcttatctttttttacgcctggtctcctttcgtccctctcttaggcttgatctgtaaaactcttctgactcaaaattttagagcttttctgataccataatgctcattaaatctgtaaaaattaaaaataacgccaagtgtggtggctcacgcctgtaatctcagcactttgggaggctgaggcgggcggatcacctgaggtcaggagttcaagaccagcctggtcaacatggtgaaaccccgtctctactaaaaacacaaaaattagctgggcgtggtagcgggcgcctgtaatcccagcaactttggaggctgaggcaggagaattgcttgaacctgggaggcggaggttgcagtgagccaagatcacgccaatgcactccagcctgggcaacagagcgagactccctctcaaaaataaataaataaataaataactttaaaaaaaccccatatcgttattacttactattttaacaagaatgtaagtagcaaatttgtttttttttttgagacacagtcttactttgtcacccaggctggagtgcagtggtgcaatctcaactcactgcaacctctgcctcccaggttcaagcaattcctgtgcctcagcctcccaaagcagctggaattacaggtgtgtgccactacacctggctaatttttgtatttttagtagaaaaggggttttgccatgttggccaggctgttctcaaactcctgacctcaagtgatctgcccgcttcagccacccaaagtgctgggattacaggtgtgagccaccatgcccagccttaagtagcaaatctaaatttttattccgtactttcctggacactgggagatataaatatccaaaatgtgcaacatcctttaaaatgcaaccaagtactcatcaaatgtcatgcatgaacttggaacacagccattctataaattttttgtttcttttaagaaacaaggggtcgggcgcggtggctcatgcctgtaatcccagcactttggaaggccaaggcaggcggattacgaggtcaggagatcgagaccatcctggctaacaaggtgaagccccgtctttaccaaaaatacaaaaaattagccaggcgtggtggcaggcgcctgtagtcccagctgctcgggaggctgaggcaggagaatggcgtgaacctggaaggcagagcttgcagtgagctgagatcgcgccactgcactccagcctgggtgacagagcgaagactctgtctcaaaaaaaaaaaaaaaaaaaagaacaagaaaaagaaacagggttggccaggtgcagtggctcacgcctgtaatctcagtactttgggaggccaagtcgggtagatcacgtgaggtgaggagctcaagaccagcctagccaacatggtgaaaccccatctctactaaaaatacaaaaaaattagccgggcatggtggcgtgtgcctataatcccagctactcaggaagctgagtcagtagaattgcttgaacttgggaggtggaggttgaccgagatctcgccactacactccagcgtgggcaacagagccagactccgtctcaaaaaaacaaaaaacaaaataaaaaaaaaacagggtcttgctctattgcccaggctagagtacagtggcatgatcatagctcattacagactgctgggctcaaacaatcctcccacctcagcttcctaagtagctgggactacagagtggctaataagaaaaaaattttttttagagacagggtctccctacattgcacaggccggtcttgaactcctggccacaagcgatcctcctgcctcagcctcccgagtagctggtgtataccactacacttggcttccactctgtaaacaggtacacaccaccacgcttggcttccattttgtaaattttgattccaggtttcaggtacagctctagtaaggttctagcttatcacctctgggtctttttttccctttctgcccatcaaatgaaatactttgaaaactcacttcataattttgttggagagaacagtcatcttctttgctccataatcataagcattctcatttttagactaataaatgtcaatcagaatgaacaatccaggctgagcgtgtggctcttgcctctaatcccagcactctcagaggccgaggcgggtggatcacgaggtcaggagattgagaccatcctggctaaaacggtgaaaccccatctgtaccaaaactacaaaaaattagctgggtgcagtggcacgcacccgtagtcccagctactcgggaggctgaggcaggagaatcgcttgaacccaggaggcagaggttgcagtgagcaaagaccatgccactgcactccagcctgggtaacaagagtgagactctgtctcaaaaaaaaaaaaaaaaaaaaaaaaaaaaaaaaactgattttttttttcatttttacataatttttccttctaaccatctttatacatatacgtaactttggcacctgtccacttacaaactgcatcaactaagttttggtgtacaaatatcttgaaagatgaaagaatactatcatacatctttttggcaaagtgcagtggttttgattgtttttttttttcatttcttaaaaatagaaatggggtctcactatgttgcccaggctggtctcgaacgtctgggctcaagcgatcctcccacctcagcctcccaagaaggtgggattgcaggcatatgccactgcacccagcccagttctgattcttataaaaagaaaatcacattctagctggatgcctatagtgccagttacttgggggaactgaagcaggagaacagcttgagctcaggaatttaaatccagcctgggcaacatagtgagatagatcccatctttaaaaaaaaaaaaaaaaaaaaaaaaattcaccgctgggcatggtggctcacgactgtaatcccagcactttgggaggccaaggcaggtggatcacctgaggttgggagttcaagaccagcctgaccaacatggagaaaccccatcttttactaaaaatacaaaaaattagccaggcatggtggtacatgcctgtaatcccagctacttgggaggctaaggcaggagaatcccttgaacccaggaggcggaggttgcggtgagccgagattgtgccatggcactctagcctgggcaataagagcaaaactctgtctcaaaaaaaaaaaaaaaaaaaaaatcacattctaaactcatctagggtacagtcacatatgtatatgggtggagacagaatcttgctatgttgcccagcctggttttgaagtactgggctcaagtgatcctcccatctcagcctcccgagatgctaggattacaggtgcacgccaccatgcctggctgaagactcttattttacaacttggtttatataactttaccgtcatcctaacagtctagagtactactgtcacacagcattcatctactagttcctctgaaatgtcttctgtagtcagttttcttctctttgccattataggaggaagatgaaaaactatggatttttaaatatgtccaatgaaagcttaaaagttgaaaaatagtataaaaattaccatgtactccttcacctagattctccaaatgttaacatcttacataatgtttaagatggtatctcccaacttcttttatactttcttgaaagatgctgtaggctgggcatgctggctcatgcctggaatcccagcactttgggaggctaaggtgggtggattgtttgagcccaggagttcgagactagcctagacaacatggcgaaacgttctctctacaaaaaaaatacaaaaattagccaggtgtggtggcacatgcctgtagtcccagctacttggagggctgaggtgagattgcttgagtctgggaggcgaaggttgcagtgaactgagattgcgccactgcactccagcctgggtgacagagtgagaccctgtatccaaaaagaaaaaaaaagttgctgtaagttttgggaaaagcaataagaaaactgaagggctgcggtgcacacctatagtcccagctaccgaggatgcttaggagggatgatcacttgagcccagaagtttgaggctgcagagagctatgatcataccactgcccttcggcctgggcaacaaagcgaggccccatctctaaaaactgaagtgtaaaactaatgatttatttcactactgcatatccttttaagcaattctataattctccctttgtcatattattttagtcctctttagcatatttgagaattgatgagtaatgatgaaataattcctaggatgatgaaataccaaaacatttcaatatacaggaaaaataagatcagtaaaactccacaacattgtttcgatgtacaagtggtaatagctaaaatgagtttattcctttggaaaaaaaataaattttcaggctgggcatggtgactcatgcctgtaatcgcagcacttcgagagataagaagtttgaggccagcctggccaatatggtgaaaccccatttctactaaaaatacaaaaattagctgggtatggtggtacacacctgtaatcccagctactcgggaggttgaggcaggagaaccagttgaacccaggaggcggaggttgcagtgagccaagatcgcgctactgcactccagcctggggatggaacaagaccgcatctcaaaaataaaattaaaaataaaaataaattttctctttgctgttttgaagacctccaataaataaaagtcatgaaatatacatctttacaagtagttagtactgctttaaaaaaaaaaagcaaaactcaaaaactaaaattgagtccagaccaggtgcagtggctcaggcctgtaatcccagcactttgggaggccgaggtgggcagactgcttgagcccaggagtttgagaccaatctgggcaatacagacttcggtgacactgatgttacccagacatttcttactactgtaggtagaaaatgaacagaaatttagttaaattcaaaatgtattaataattgttatcaatgttgattttctgatttgatcactgtattgtggttttaaaagatgcacttggggaatctaggtgaagattatagggctattatttgtattatttttgcaactctctttgaagtctaaaattatttccaaagaaaaagttttttaaaaattaagtattaggccaggcatggtggctaacacctgtaatctcagcactttgggtgtctgaggcaggtggattgcttgagtccaggaagaccagcctgagcaacatggtaagaccctatctctatttaatataagaaatataatctttcaaaatatctataaggccaggtgcagtggctcatgcctgtaatcccagcacttcgggaggccaaggcaggtggattgcctgaggccaggagttcaagacaaggctggtcaacgtggtaaaaccctgtctctactaaaaatacaaaaaattagccaggcatggtggtggcgcctgtgatcccagctactcaggaggctgagacaggagaactgcttgaacctgggaaggggagattgcagtgagctgagatcgcgctactgtactccagcctgggcgacagagcgagacactgtctcaaaaaaaaaaaaaaaaaaaaaaaaattagccaggcatggtggtgggtgcctgtaatcccagctactcgggaggctaaggcagaagaatcacttgaacccaggaggtggaggttgcagtgagctgagattgtgccaagccgagattgcaccactgcactccagcctgggagacagagcaaaactccgtctcaaaataaataaataaataaataaatagctgggtgtagtggcgcatgcctgtaatcccagctgctcgggaggctgaggcaggagaatcacttgaagctgggtgtgtgtatgtgtgtgtgtgcaatgagccgagatagtaccactgcactctagcctgggcaacacagtgagaccttgtctcaaaaaaaagaaaaaaaaaaaaaaaaaagaaagaaagaaaagaaaatagagcattacaaagaatagaacttgagatagttcttgaaaggacaggtggaagtgtcactcacatctcacactgcttttatcacattagctcttctgctcccacacaaacatgggcacataacatctttaaccatctatgtatcctctaccatgctcagcatactgctttgtcttgtctgtggtggaaaccaaatcattcattcatgtatacattctctaatatctactgagcacatactatgcaccaggtgttttaggagctggagatacaacggtaaacaaaaatctcttccctcaagaagcttatattttagtgaaagatgacacaatagacaaagtataatatttagaatagtaggcagtgacaggtatcaagaacaaaaggcaaggaagagtttttgaaattgtagataagaatggtcagataatacctactgataaggtaacttctgagtaaaggaagtgagggagctagtcatgcagaaattagtggaggaagccttctaggcagaggggacagcaaccgcaaagaccctcatgtctttgtgagggctcacatgtgcttgacatgttccaaaacagcatgaaggctgggtagctgaagaaaaacgaaagaaggactagtcagaaatgtagtcagagaggtactaggataagggtggcaggcagagggtacatcagatttgttcttacaggtgtttttttattttttgacacagggtctcattttgtcgtcaaggctggggtgcagtggcacagtcatggctcactgcagcctcaagctcctgagctcaagcaatcctcctgcctcagcctctcaagtaactgggactacaggcacgcgccagcatgcttggctaatttttaatttttttatagagacagggtcttgttatgatgcccaagctggtctcaaactcctggactcaaacgatcctcccacttgagctcccaaaatggtgaaattacagacatatccttttttttttcttttgagacagtctcgctctgtcgcccaggctagagtgcagtggcacgatcttggctcactgcaagctccacctcccgggttcacaccattctcctgcctcaacctcccgagtagctgggactacaggtgcgtgtgccaccatgcccggctaactcttttgtattttttttagtggagaccatgttagccaggatggtctcaatctcctgacctcgtgatccgcctgcctcagcctcccaaagtgctggtattacaggcatgggccaccgcgcccagctcattacagacatatctaaataaggactcaggtttaatactcagactgaaatggaaagccactggatggttttaagcagagaagtgacacggtatgacttaggtttcaaaagaatcacttgggttgctatgttgagaacacatttaagagccgcagtaacaaaacaaggagaatagaatccaagctagagatgcacaggcactgactagggcagtggagatgcagatcctaagtggtctaattctggatagtattttgaatataaagcagtaaaatttactgatggaccacatatgaaaaagacacagaagagtcaacaatgtctcttagttatccaagaggagacatcgagtggagaccttgagtgggccactaaacatattagtctatggtagagggagagatccccgttagagtcatcagcattgtttggattttagaaaggtaatatggtacatatactgtatcatctctctctcccagctagggctgagtagctccccataatcaagcagtcacatttctgcatcatgcaggatagcccaggtcaggctgtaccccaaaactagttgtggaactagacttaccaaaaaacaaaaactcttgcatttcagaactgcaaataaaggatgtggacctgcatatcctccaatagcccatatgtcagcaagcctagccctggaggacaccaagaagactcatgaagggtccactgtcatgctgagaaatatgggtaacatacaagcatacaagacaaaaagtgggtagggaaaacaaaagcaaaaggggcaaataagaaatacatcaggtagaaattgccacccatgaccgggcacggtgactcacgtcttaatcctagcacttttgagaggctgaggcagaaggacctcttgagcccaggagttcgagaccagcctgggcaacacagcaggacttcacctctataaaaatataaaaaaaattagccaggtgcgtggtggcacacacctgtagtcccagctacatgggaggctaaggtaggagggtcgcttaagtccagaagatcaacactgcagtgagctgtgatcatgccactgcactccagcctggtgacagagcgagacttcgtctaaaaaaaaaaaaaaaaagacatgagaaaaaaagacattatgcggccgggtgcagtggatcatgcctgtaatcccagtactttgggaggctgaggcgggcggatcacgaggtcaggagtctgcgaccaacctgatcaacatggtgaaaccctgcctctaccaaaagtacaaaacttagccaggcgtgtggtggcgccccagcttcttcttcgtggaggctgaggcaggacaatcgctagaacccgggaggcggaagttgcagtgagctgagattgcaccactgcactccagcctgggagacagagcaggactccatctcaaaaaaaaaaaaaagtctagtgcctaacacagtatctgtgacacagtaagtgctcaataaatatcagcttttatttttcaaggggcgaggaaggtgtattttgaaaaagcatatactatttatttttttaaaggcctacagaaagtaaagcttaacaaactcttggctggtggattgcccagaaaagagagaaagccatgaaaagcactatgctaaactactgaatgccagggatataacctcttaattccagttaaaattcccaggtactaacatctgccatgcacagctctccagtgtcttgtctgctcccactgaagatgtaaaaagaattatacttcaccaggaatcttgtcaaattactacacacctccttccttaaaaaagaaaaaaagtctttctctgtatgtaaattattaaaaccctcttaattacgaagtgccaatctttctaagctatttatctctgaacaaaattatagtatataaaataattatctggagattatgaagcatttatgaaaatgttcctaatacagcaaaaccaggttcttacttgaatccttatagactcttctgtgttccccagtatacagcactgcaaatcatgggaactatatatgtagcccaaattttcctcaatggtcaatcgttctccactatctctctcagtttatggcatcagaaaaaaccacctggattttttgtctccccaccaattctattacagccatcatttgctaaactaaaatgctattgcttttgcaacttccttagcagagaaggtaggacccacctacccttttcacataaatatagcacagggtaccactcaggccctactaaccaaagcacaaatctagaatttcacttcagataattaaccagaggctcatttagacattactgcataaataaacattggttccatgtttatttttctcatgaaaaatgtgaaaaacattgaaataatttctctcaataggaaaagataatgtatcaagtgaaagcaaaaacctcatctaatgtggttctgctatctaaatctgaaatgccctaaggcaactctccaatacaggctggagggcaacgctacagaagtcacatacagaaggctaccctgatccacaattccaccctcctctgaaataaaaagggcaacaacactgtactatgtagagtataaatagaaagtggtctagatggtctaacataagtacataaaataaaaaagaaaagacttttcacctatagttacctaaatagcaaattctttaggaaaccaagtttttttggttgttttttgaggcggagttttgctcctgtcgcccaggctacagtgcaatggcaccatctcggctcactgcaccctcgcctcccgggttcaagtgattctcctgcctcagcctccccagtagctgggattacaggcgcttgccaccacgcccagcttttttttgtatttttagtagaaacagggtttcgccatgtaagcctggctggtctcgaactcctgacctcaagtgatccacctgcctcggcctcccaaagtgctaggattacaggcatgagccaccgcgcccgtccaggaaactaagtttatatagcagaaccatgtgcacaatgaaagcattcaaaaatacaactgtcagagatatcggagtattttattcaaagtctgagttcttaaaaaaaaaaaacaaaccctactttataaacagaccagttttgagattaaaatgtaaatccaaactttcctgttataaatctcagccttgtaaagaggaggagcttccactgccttttcaaggctaacttcgtttaaagtcctaacgcaccgaaacagacgccaagtctactacccaccacccattggctcaaaggaagccccgccccgtacagccacggtaactgaacatcaagggaaccccagggaaggttttccctccgccacatttctagtctctgatgactccctgcccctcccctaccatcaccaccgcggatctagggttccagcaccagccacgcacgctcctacaagaggaccttgggcacttcgccccaatagttacaaccaagaggggagtgggggtgaccatgctcccactctcctggctgcacggtgccagacacgctgcatggagcaaagcggagaaagcagctccggcacagggcccttgtgcccccaggcagaaggcatgacccagccacaagagtaagtcctgacacctccacagctcccagtcggcgggtgcccctccctccccacggagacatagggcggggcagatctaggcgccgagactcccagccagacccgacagcgggctttccctagcacctcctcattgccaaggaggcggaaacccggggcctgggcggggtgcagggggggacggccaaggggagtggcatcacggatcagtacggcccctccggccaaccggatcccaagaaggcggaggaactcagacttcacgccccctccctgccgcgccctgaatctacacgcgggagacccccccctacccctccccgaccccagcaggccagagcgcggccgccagcccgaggccccgcccaccccaggaggaggggagggggtggtcggccgcaaactgcactcagcgcgaagccggccccgcccctttctccacaatcgcacgcgcgcgccggccccgcctctgagcggcggcgcgagagcccgcccccctccgcgcgcaccgggactacgctctcctccccctcccgcgcggagagctaccccgctccgccccccacccccctcacacaaccacacacctcccgcccgtctgctctacgggaagccgaggaggtcagccccccccccccaaaatacacaccctcgagtccggcgttacccgccaccaggctcccgcccggcccccggcccagcgtgctctcaccgcaaagctgcttcggccgctcgtcactgcgtgtccctctcagcgtgagccgcgagctcagcagggaggccccgagaacggcgcggggcacaggcccgccgaagcggactgccagctacctctccactaacgaagcggtcacaggctccggtgcccagactgggaaggagggagggagggagggagggaaactccgaggggggaaggggaggggggaagatggagaaaccgtctccgccgcctctaccgccgcggccgcttctctgttacccgggaaatcccgcccactcccccgaccccgccccgcagagggaagactcagct

SEQ ID NO: 923 - DNA, 12837 bp, Homo sapiens
gttcccgatccaaggatttattccacaagaaaagactgatccctgctttaggctggggaagcagaaattaggagtccccagagccttctacaaacaaaaccccagccccagggactcagtgtggcggaggctgaagcacgagcaacagggacagcacttggaagggagaaaaggtgagcttcaggcggttgtcccgaagggtcaagtggccagcagggtctggtcgctccaagagatcgcagctggagaacaggaggggccatgaaggctctgcgagggcgagactcgacccccgccccaatcccacaccgccactcacaggatggcctcctgaaccggcagcgacaagtgcagccagcagtccacgtggctgccgtgggcctcatacagcctcaggaccagcgagcggcgctgggggctgctctccgcctgcagaggaacacgtctggtgggaggggccgagggcaggcccagttcggaaccccgtccccagcacgtcccaccccttgcctgcttgacggtctccaatacgaccgcgggtgaagacacggaaaacgcactccaggaggtggcgggcgctgggctgggggctggcagagccaacagggggaagtttaggctgtaggcagcttggataacgccagcatcctggaaagagcctggggtacgaccaggaaacaatgctggtggagaatgggggctaccctcccctgtccctagaaggggcaggaagccaggttgctggggtttgggctcagggaagggcagagaggtgtctagggctgcaggaaggccccaccgtccccagcactcacccttgtgcggcatcagtgcataggtgaactcgtggcgccccgtgtcagcagtagcgtccggggctttaggcgcccgcaagctggggtgaggagggcgcgtaggggccacgctgaagctgttggagttgtggtcgggaagacccatttctccatgccagctcccaggcctggtgggtaccccacttacagcgagaggctgaggatgctgcctcgcactgacgcgccatacttgcagtcgttgagcagggccagcccaaagccgtgttctgacagatccatccagcgatgggcccacacctggagggcagatccaagacccacttggtggccctgtgcccctctttgtgctcccagactccagagctcctgtcactaggccgagcacaagctctagaaccacacaactgaactccagctcccactgtacggggccctgggcatgccacccaacctgcctaagcctcagtttccttatctgtgaaacgggaataaataatagtactcaccccatcgaatgatcatgagtatcaaattaaatgtaaaactttgtttttttcacacaggatctcagtctgtcacccaggctggagtgcagtggcttgatctcggctcactgcaacctccgccctccaggattcaagtgattctcctgcctcagcctcccaagtagctgggataacaggacatgtgccaccacgcccggctttttttttttttttgagatggagtctcactctgttgccaggctggagtgcagtggcacaatctcagctcactgcaacctccgcctaaagggttcaagcgattctcctgcctcagcctcccgagtagctgggataacaggacatgtgccaccacgcctggctaatttttctgtatttttagtagagatgggggttcaccatgttgtctatgatggtctcgatctcttgacctcgtgatccgcccacctcggccttccaaagtgctgggattataggcctgagaacactgcgcctggccaatttttgtattttttttttttttttttttgagacagagtctcgctctgtcgcccaggctggagtgcagtggcacgatcttggctcactgcaagctctgcctcccagattcacgccattctcctgcctcagcctcccaagtagctgggactacaggcgcccaccaccacacccggctaaatttttgtatttttagtagagacagggtttcatcgtgttagccaggatggtctcgatctcttgacctcgtgatccacccacctcagcctcccaaactgctgggattacaggcgtgagtcaccacgcccggcccaatttttgtatttttagtagagatggcgtttcaccatgttggccaggctggtcttgaactcctgacctcaggtgatccacccacctcggcctcccaaagtgctggaattacaggcgtgagccactgtgccttgccaatgtaaagcatttagtgcaatgcctggcacacacgttaggaagcagcaaatgttgattatcctcttcctccccagcctgttccacacaagcagtctccccagccagggaggagtccaaggccactcccaccctgccatgtcagacctcaaatcgagcccagtcccaagaggtattgtagtgggtaggtcgctgcaggtgcccaaactggatctcataggtggcctgggaactccgcacgcgagcagggaactccaccttcaggaacttgtgggcctcatgccagtgtacctgggagtgggaaggagggtgggagtcagggaaggaagagacacaccaaggcctggggctggcccctccttaccaagcacacttggggaaaacagccaccccctaccccccgactacctcggtgtggaagcggacataggggcagccaacgtccagcacaacctcctggctaagccgactgttggggctgatctgtagcaagaaccaggcgctgccccgcaggccgccctcggtgcccactgccagggtccctgcctggcccagcacaggcttcctatgggacaggggtggacatactgatccagagcagcctgtgttcccaccacctccaccatccccacatgctgcccagcctataccgtgtctccaggtggtagtccatgacgtcccatgcatcccagtacaaggggacatcatcaaatagcacaaactggttccccacggcgccctcagcaatggcctccctggaaggacatgggattggtgctgtacaaccaactgacctcgctgtctccagctgctcttggtggggtagggtggagtgagtagacccagtggacaggggactactgcccagcctgccctgctccatgtgtgggttccagcccagagccactggtgggctgctgtgggcagtgttgtggcaaggggagagaggaaatggcctggggtctacttgccaggcactgggaaagggcaatgaggatttggcacctgccagaggccaccaggaccaaggacgtcaggcgaccagttgggtccagcttcactcggatgatgccattgtccagagtcacggagccatcagtctttgtgggaggaggccttgaggctgagtctgtaggggcttcccacaccaaaagtcttcccaccccaaccccagccccgcctcaccacttgctccagacaggggagctcaggaccctcagttgtaagaaagtatcccagcacagttcctgccccccagggcatgcaggactcacctcttgcactacgaacacaggctgctggggcagcaggggctgcagtgaggtggggggaggaacaggagcatagcccatgctgggcactgtcaccagggctgggggtgaggcctgggcatcagtgcagccttcctgacctttcaggaagcttgcgcaggtggggatgggttggtggaagatgtgctactactctccagtcaggggcacccagatccctcggggtatcccaggcctgatctgtctggcctccatccttcctgctgcagtagcaacccttcccctcagctcgtacctaggctgtgggccccgcccggtttgggcagggccatcacttcgatccgcttccagggcagtgtgttgacgatgaggaggccctcaggacctggctccccagcacacagggctgcggctgcagcgctgagcagtgtattgccatgggaacggatgtctgaggaaagactggctggtcataggtgggcaacaggtctggaatgtgcccatgggtatcccacaggggacactctgggctcagccctggggttggagagagcaggcaggactattgtgagcctaaccttcataatggcacatggcttcctctgccaccatctggatgcagcttccagtcaccacatcatggaactggttcagaagaaggagcctgcaggggccaagggcagggatgggaaggctgggaggggcaggcacagaggtaactgcagtgagcagtcaggtggatggcagggacagaactgggctgacctccagaggtgctgcagctgggctgctgggtataggaactgggcactgcgggccagggccaggctactgagcagctccacgtcgtgcaggatccgctcacattcccggttccccttcttgatctgagcccaggatgggaagattagtctggagcctgcttagctgtcccaggacaccttccaaagccctcccttgctcagaatccctgaggactcaccaagggcctcgtggagaaggcctctggcgggtgacctgccttaaatgccttccctcttctccccgcagcccaaacccttctttcttcaggggtttctgcctccttcaagctttcttgaccaacccaggtcttgaacttctctcctccaaacttctcttcccctagatctggcctgggctctgtcccctgctgccttctctgaccctctgcagatcaagggcacaccctccctgcacagccctgcaacctccccctgacctgggcatgggtggtgtatgtgccattgtgcagctccaagaagagctccccaacccacgtgcacagctgctctgagtcactctccagtgctgagaagagctgtcttggagaagatagctgcaccctgaggagaccacaagcctaggtctcccagccttggagaccacatggctcacccttcttccacaccaaagcaaaggatccagctcctacagagaggagccactccagaaagctccccgttcacagatggccagccctggacgccctaggagagcctctctctctgatgggctggagcccttaccagcttcagcttctcccccacccacccccagggtggaagtttggaggaacccgtggtctaggattgggacaggacaaggtccagaggaggggttgggcccaatgtctgagggaaggcagggctcatggcaagggcccagggtggggctaaaggagagccaaggcctggcctgacctgggcagcccatccgtattgctcaggcgcttcaggcggtccagcatggtctgggtggggccaccacccccatccccaaagccaaagaggaaggcactgtggttggcccgccccttgtcccggttgttggccacggtcttcagcacctagacaggtgagggcaggccagcatggatcagcctggaacaagccagccctctccagcctgcccctaccccaccaccctaggtgacccctcacctcctccacgctgccctgcatcccataggagtcgccaggtgggaagtggaccagtacacgggagccatccaggccctcccagaaaaatgtatggtgctaccagcagggaaacagaagcagggcagagaggccagagtcagggctgaggcagagccaggccttccagacttggtcctgcccctgcctgctatgtgaccctggcagaggcagagtgagggtttggtggtctgtctaggaccccacaataagggggagaggcaaatgggccaggcgggactgaggcccactctgaccctgaccccccgggggcctgcttactgggaaggagttcaccaaattccagctcaatttctgggtgagaaagcgcctgatgccacagccgtgcatgatctgggggagctgtgctgagtagccaaaggtgtccggcagccagaactgtggagaaagaggatcctggagtgcaggaaccagagctccaggcggactcaccccagcctcagcccctcagcactccaagtcgagcgccagccccactcgcccacagcctggtgtagcagctctcagcctacctcagagcacatcttcccaaactcctgcagaaagaagttctggccctgcaaaaactgcctcaccatggcctctccactgggcaggttcccatcctggcagtgaaggaagtgggaggcagcccaggtcagcgctggacggggagcaggcaggcgctcaggccaacccaatccctgcaggagaagccagggctgctcaaacatgggagttacagccagaactcaggaagggcccctgtccttcaggcctgactgtccatctgcctgagggggtgcccaggactaggccatgcaacttgtcacagcgctggaggctctcctcccccttgaagtcccaggccttgagatcccagggactaatgagccagccctgccacacagcggggatgagtggcccgtggaaactcaccagcaaagccgggagggcggggctacctgagggaaggctgttgtcatacagttcaaggctgaggagtgcccagtgcacttaccatctccacccaggtgccccccacaggcacaaactgcccacggcacgcaaactcctggatgcgggagtacaggccagggtagcggctcttcacccattccagctgctgcgcctgtgggcaggttgaagggagctgggaccagagtgacaagggccccacccaggactgagcatatgggactcagtgtgtggctgagggtgaggagcagccctgaccccaggcctgggaagccttcagggcctgtggagctccagggagggccacgtgcttccctcctccctcacagctgtccctctgacctgggagcaggcaaagatgaactcagggttccgctccatgagctgcagggcggtcacccagctccgggcacatttcctcacagtctctttgaagggccaaagccaggctatacggggagtgaggtggaggacagagggagcagcaaggctgaccaggcctgggctgggactccagagggtcacctagcccccctcccatcccaggcccttcaccctggaaagccctgtggtgtccctcctaagtggtcacttcacttcactccagcgaggtgggaggaggggctggggaaaggaggcggcagtgctatgaggccaattatacaggtcaggaaatggaggctccaggccccagaatagcctcagtcctcttggggaattagacatcccctagaggatcctacgagaagtagcagggactaccctgcccctgcacaaacttgatgtatacctgggaacagaggcatggctcccaggatggagccagctgtcctaccagaggtgctacagcctctcctgactcccaggctgcagttcctcccttaccagcccagaacctctcacaccttaccctacatcttggcacagcagagaaagcccttgttctgtgatcccaaaacttcggctgcatcagaatcaataccttcaggagcttgttaaaaatgtggatttcccgtaaaactcagacactgcaaacttgtccaggaagcctctctggaatcccccaacccagctggagtaagtacctctcctgtgctctccagtgcctcagactccccaccattgtgacaccaactctgcctgctgaatctgtctctgtaatcctaccctcaatatctagcatgggccccatgaggcatcagattttgttgaaagaataaatgaggctgggcacggtgggtcatgcctgtaatcccagcactttgggaggccaaggcaggcggatcacctgaggtcaggagtttgagaccagcctggccaacgtggtgaaaccccgtctctactaaaaatacaaaaattaaccaggcattgtggtgggtgcctgtaatcccagctactaaggaggctgaggcaagagaatcgcctgaacccgggaggcagaggttgcagtgagccgagatcacaccattgcactccaccctgggtgacaagagtgagactccgtctcaaaaaaaaaaaaagtgaatccaaagcaagcagagcccacagtccagccccccggccccgttttacagacggggaaaacgcaggtccaagaggagcaagaacttgctgagcatcacacagtgcttctagggcacatccaggtcttcaagggcactcctgcttccccagccagcccaaccagctgctgtcctacctgtatcaatgtggcagtgccctgtggcatgaatggtgtgttggctttcacccccatgttggccaaagaacctggaggccagggcctgggccactgggaaggtctcgggctgggcagggtcacacacgttcaccatctgattggctgtgtacagggcctggaagctgcgctggttgtccttcccgaggccctgcagcagggttctgccccttaatccctttttcaagcacagcttccagacctaggctccactgatctcagggctctcagcagagctcccctgacccccaaccctttttccctgctggtccccctgctcagcaccgtctccctcctccccttcacataggaaaattctctcaaccctcaagcaggtggaaaccctcgtcctactctggattcccagagtcccatttatctgacccaaagaacaaccttcttggagcagggctctagagggtagcagggggtacagggggtgtcaagtaccttggctatgcccagcagcagctccagatccaccaggagcatgtggacatcccggtggaacacagctagctcagcccggctcagctggaacatcttctcagggtcaggggctgcaatcatgcttcccttcccggcccccaggagcccattgcaggctacttccacatagagagtgaggctacaaagatggggagacagcctcaggctaagggactggcacagtactccggggacttggggaaggggcacccaggaggcatccagctgagcccaacctgtctgcttccaggatccactacccagaggatcccacagtgtgacaagagtgcatgtgggagggttgtggtacaaacaccagatggatcccatgtcttgctgtcagagagaataagtagcaaagtttggaaccatgtaaagtacgctgctgtttagtcttatatttccaaagttgtctttgcaaagcactgccttggtcttggaaccctctttgcatattaaaatcatgttcggatctcccaggctcaaacttttagacccaagatctaaaaccaacacggccaacatgggcgggccattcattggagaacaggctgggctgtggtgatgccatacttaggcttcagagagcaaacacgacttccttagggaggccttcctgactccacttcgctgctaagtctagagcaaattcctcagtggagtacccaggatttccttccagagccctcagttttgtaattatatgagtgaatctgtctccctttgttggcaagggctattttattcaccaccatactcccagtgtctgaaagcatctgaaacagtgtcaatctatataaaatacattcataatgtctaagaagtgtttttaatggtgtcataaaatgtccatgttataacatggaatgtaagaagtcaggatacaatcttaactagtaaaaactataccgggatgagccgggcacggtggctcattcctgtaatcccagcactttgggagactcaggcaagtggatagcctgaggtcagcagtttgagaccagcctggccaacagagtcaaaccccgtctctactaaaaatacaaaaaattagctgggcatggtggtgggcacctgtaatctcagctagtagggaggctgaggcaggagaattgcttgaacctgggaggcggcggtcgcagtgagccgagatcgtgccattgcactccagcctgggtaacaaaagcgaaactccgtctcaaaaaaatccaaaaaaacccccccgaaaaaacaaaaaaaactatgccggaaagatacaccaagaacatgaatactgggccaggtgcggtggctcacgcctgtaattccagcattttgggaagctgagaggggcggataacctgaggtcaagaatttgagagtagcctggccaacacggtgaaaccctttctctaccaaaaataaaaaaaaaatagctggacgtggtggcacacacctgtaatccctgctactcgggaagctgaggcatgagaatcgcttgaacctgggaggcagaaggtacagtgagctgcgatcgtgctactgtactccagcatcggcgacagagggagacttcgtctcaaaaaaaagaacatgaatgctgagatgttaataatgttcatctctattctagggagtggaataacggtagttatttacttctttgtgctttcctgtatttaccacaggcaaacattgctattatttttgagacaaggtctcactctgttgcccaggctgcagtgcagcggtgtgatcatggctcactgcagcctcatcctcctgggctcaggtgatcctcccactcagcctcccagggtagtgtgggtcactgcacccagcccattatttttatggttaggaaaaaatcatgcttttaaaagcaaacaatgagatgtgaggatgattgtgctagagcagaggcgggcttatgagatcactctgggcctcagctcctccttgctcactggtactccctccctgacagcactggtcaaccagggcacagggactcaccttcgggggtctctttcccccagcctgtcagtcaggacatagctggtcttctcaccctctttggttaaaccctagtagggaggggagtgagagagacaaggcttgaggcttttggacagttcaggtaaagtgtaagccatggggagtcaggcccctccatctggttcccagctctgggtcctctctcccaagcagggccaagattggcaaatcagggacccttggcagtagatgccccaactcccatggcagccagcaccatgaccgtcaaatagcccctgtttaccagtggcaaacccatggtcttatgggaagggccctgggaaggggttaggcagcctgagtgtggattctggtggcctctgcacccctaaataaataccgggaaagaaactccgtgaagtcaggggcaggtttgcctcattccctgctacaccctagtgcttaagggtatggcccagaatggacaccaggagatatttgctgagccagtgaagggaggaagggatggtctctgccttcttgtagccaggaagaacagtcttaaccccagattgagagtcagtccaatttgaaatagaagctgtgtgaacctgagtgagtcaactacacatctgtttcttaatttgtaaatgggtataaagacctactagataggagtataaggactaaacctgataagggtggagcatgaataagacacttaacagtggttatagctggggaatgggatgggtgataaggagagatccattactttatctagaactgtttgaaatgttttcctataagtttgtattatacacaataaaaactaaggaccaattgcacagatgcccaagtggcaacttccctagtcctgaaatcctgataccaccctgtgggcagagcaactcagctgtggcttctccagagtccacagaagaagggctgtagtcatttcagggctgaaatgtggccatacctggccctaggacagggttcctcacctggacaggttctccatcacgccacaccagaccttctccatcactttcccagcaaaggtgaacttcctggcccacccatgcctctgggatggtcagctccacccggaaccagcaggtccaccatctgcaagagagctgttgtgataggcctagaggtagaagtcctatcctgatatccttccttggataaagtgtcggcaggggcttgaaactctccaagcatctgcagtgtcacaaggtactcagctttgagtcacaagaaaggagcaacaaggtgagaagcaagatgagggaaacaggcagaggcgtcaaaggttcgtgatccctagggtgcccttcctaagggatgtccagaggcggccacgtgggaatgaaaaccatcccctgaagacccagggaccagagagctgttcccagcagagggtgctgctcccagcagagggtgctgctcgatcccacgtagttgtctacggcagagggcagacaacgaaggtgtggctgggagctgggttgggacttcccctaggcctgtggccccgcccacccgctgggcgttacctacgtgggtccgaagctgtcgccgacctgcgcggggcggaagtcccgctggactgcctcctggtagggaagtctctccggcgtcaggaagctggagagcacagccacagggcagctggccccaaaaagcctgcgtgggacgggccggtgggcacatgctggaggccgccccgtttccgcctgggggccagctggccggtggggccgcactttccctggatcctccgccaagagggctgcctggccgctccgcggcacagtccattccctaccccctcctccccggcccctgccctgcccgcggcgggcactttgtcccgcggcccgggtggctgcagcttaggtttctccccggaaggaaagcttgaggcgcacggttgcggtcggccggctgcgggggaccaggggccacacctgccgcggaggttacagtcggtaaagtagagcggcgacacgaacttctccacccgctccagcgtggtgcgccagtgcttcaaggccggcgcagccgccatcgccgggctctcgctcctctttccggaaggcccctggcgctacc

SEQ ID NO: 924 - DNA, 82208 bp, Homo sapiens
attagccctgatattttaatggaaatactgaccaagtttacaacatttcaaatgcagatcacacggaaaggtgactaagtacagaataacaaatgtgatttaaaacaaagataacctgctgctgcatataatacaggttgggtttagagcttggagctcagatgtcagacagcaggaggaataaaaatgctacttgtgaaaacccaggctgtaggtaaaacttactcttttgttggttgcactggtgggttgggactttctcctgaactggccttgaaatcctatcctgacctgcaggcaagtgctctggacaaaacactgcaggggcagcaacagctggggctgaccctgatcacaccccaccaatttcccctatggttccaggtcaacatgacctttcttgagggaacacggggataggtgaattatttgagaaaacctcaagatctttcccctaaatcagtacacatgaccaccgccaagtcagacactgccccagctttgccctaaaatctcatcccacaaagctctttttggcaccctacactttggctcacagtctcttctccccagtacaaaaaaagcctaaaatcaggccagggtggctcacacctgtaatctcagcactttgcgaggccgaggtgggaggacagcttgaggccaggagtttgagaccaacctgggcagcatagcaagaccctgtctctacaaaaagttaaaaaattagctgggcgtggtggcatgcagctactcaggaggccgaggtgggaggactgcttgagcctgggaggtcaagcctgcagtgagctatgatcgtggcactgcactccagtgtgggtcataaagcgagacactgtctttaaacaataaaagcctaaaatcagagaggtctaccatgtgttttgaaaatccaggagccaaaaaattttgtttttctttttggtggtggtggtgatttttaactaaaaagcaaacataaaacacacagaacattgctggttacaactaagacttgcgtaatggttgctgaagaaaaatccaccagagtactgggaggggctcagttggtctttgttcagaaagtccaggttaaccacatagaaaaatcctaatcattcatgtttaaatgtctgctagtttaaatttatgtaattaaaaaaataggtatcccatttcaaattctctccctcccaactccatttataaggtataccacatgccttatgcacacttttttttcaaacactggtttggtatttaagttgctcacccccatccatcaccaatgtgaataagaaaaaatatatagaaatacaaactacatagcttgacaacttacccaaatataaaatattttcagattatttgaacaagggaaaaaaacacgtactaaaagacttaagtattctaagattttggaatattttgatttgggacaagtaacaagtattttaagcaaaatcctgtttctaccctggataaggaactgaagtcaaaatccctgcttcacagtattttctggtgaggacaagggacgtgggttgagagtttattccttaagtaagaaccaagctttatttatttacaaaaaaaaaaaaaaaaaagttgggggcaaaggggaagacaagttttacacaaaagtactacaatggtaactccctttggtaaaaagtgtaataaatgtcttgtacatctgttcataggtactaaatctgaagccacagtactatggtacacaagaagctagagcagttatgctagcacatcaaagcatatttcttttaataaaaaattgacagtatgtacattatgtacaaaaaaacaagttaaaattgtgtgtgtgtgtgcgtgtgtgtgtcagagagtaaagctggtggatggcactaaggtagactagtaaagaggcagatacaaaacagttccacgggagctaaaaaggacaactgatttgaactcgttgaggttgagaaccagaggagagaaaagggtaggcagcaagggaatcgtcaggaataaaatccacaagatgatcaatcccaaagccaaactgcaggtcccagataaaacctaatgggtgatcttagatgtgctcgagtgaccagaaaaaaaaaatcaaatccagcttttttttccttttgtggggaggggagaggagcagtgaccatgatagttccaatccatctgagtattaagtccttctccagtctgttttgtaaatgcatctccatccagtcaaagtgtgaacagcatccggttccctcattgaaagttaggccacaggagactccagtcttagctctgctggtgtgtgcaagcaaactgcatgtctttgcttgcatggacttccttcccctccagggcaggctatacccaaaaccctttgggaaaagttccagcttcagctttgtaaggtattcatgttcctaacaggtagcccacttggtgccaggctgcaccagccacacacaggtcaggtggccatgtcccagagaggcccagtgaggcttgaaaggcatcttccttgtttcttcagtgtgtgagtgcataggcccacacacacatccccacacacaccccaagttatctgctctggctttgcagttaaggggctttgaatactgtgccgtatttgacacgatacttgttaatgctcacaaaatgcagggtctctgtatcacaggtggtggtacagggcaccaggccctccagcccctcacccatgagccacttgctggtctctgctgccatttcacggggcacatgctccttggtccatttatctacccaggcctggaatctctgatgtagacgcttgcttacacgctcatgggactgcaaaacagaaaaaaaaaattttattaaatgaagcagaaccaaaaaagagcccttcaaatacaaagcctaattttcttctaaaggagcaaaggaaagatgtgggctcaagtcttagataccactgtttttttcttaaaagaaaaaaaaaaggattctctgtttaaagagaagttaaagaggtaagaacatagaacatgtgagggcatgaaaatccataaagcctccaaagaaatgcgaacacaggctctgggctgaaaaagctcgctgttctcaattttagcatgcgttagtataaccgagggaatgtgttaaaaaatacacatttctgaccaggtgcagtgactcatgcctgtaatcctagtactctgggaggctgaggcaggcagttcgcttgagctcaggagtttgagaccagcctgggcaacatggcaaaaccccatctctacaaaaatacaaataataactgggcgtggtggcacacacctgtagtcccagctacttggtaggctgaagtgggaggatcgcttgagccaggaggtggaggctgcagtgagccaagatcgcaccaccgcaccccagcctagatgacagagccaaaccctgtctccaaaaaaaaaaaaaaaaaaaacccaaaacccccaaaacccacatttccttggtttaccaatgtgcattttaaaccagcaatccagctgattctaatgtatcctgggtaggacccagtgagccattgatcacttctatcagcatggagatccacctctaagccagacagtgcaaagcaaagggcttaaaaccactctccctccactgtgttaccccaccctgggaagcagagtccaggcttggcagatgttctgcagggggttctgttcccaccaacacattcaataaaaatttattggtgtccacatgcaaggatactagaagagatacaaagacaaaactggtgttgcccagtgtcccaaataatgtgaatcagagacaggcagacacacaacacatagcaaaaaaaatgagccaggtgtggtggtgcacgcccgtaatcccagctactcgagaggctgagacaagagaatctcttgaacccgggaagtggaggatgcagtgagctgaaatcatgccactgcgcttccctcagtgccatgagagaagtagagcagactcttgaacaacacagctttgaacagcgcagggccactgataggcaagttttcttccacctctgccaaccctgagacagcaaaaacaacccctcccttcctcctccctcttcagcctactcaacaagatgagaataaggaccctttatgatgagccacaaccacttaatgaagagtaaatgtatcttctcttgcttatgacttaacattttcttttctctaacttactttattgtaagaatatacagtataggctgggcacagtggctcacgcctgtaatcccagcactttaggaggctgaaatgggtgggttgtttgaacccttgagtttgagaccagccctgggcaacgtaaggagaccccgtgtctattttcattaaaaaaaaaaaaaagaaagaaaaaaagaatgcagtatatataatacatacaacatacaaaatatgttgtttatcagtaagccttccagtcagtagtagactatcagtagttccattttgggggagtcaaaaattatacacagatttgactgtgcaggggccagtgccccaaaccccttgtcgttaaagggttaattatacattaaactgtctgctcaacatctcccatttgaaagttttgtagtcctttcaaacttaaaacagcacttcatctgtctcccaaacctcataaccctttcctattaacaggtgagcccctaaaatctccacttaagcaaaacaaaacaaaccaaaaaaccccaaaactaatcaggcaccatccttgatgtccttcttttgcttacccccacatttgatccaacaccatctcttgtcaattaaatatctaaataatatctacatctgggcgtggtggctcacgcctgtaatcccagtactttgggaggctgaggagggtggatcacttgaggtcaggttcgagaccagcctggccaacatggtgaaatcccatctctactaaaaatacaaaaaatcagccaggcatggtttgagacacagcgaaactctgtctcaaaaataaatgcataaagtctacaatgtaattcttgcaattccactgccaccctagtagtacgggtggcccccacatctcatttggacaagggcacccttttgagtggtctctgctcttccaactttatatatacccatctccactgtcctcacagaactccaagctatctttgtcaaatgtcccagtgcatctcaaacaaattacaaaccatggcctatcattagacaaagtgatgtggcctctgcctacccttctaacttcatgcaaccttgagccacaatggtgtttgtaatttcttgaatatgccaagtcctttcctcccagccttgtactagctcttttgtctagaaaacacccatcctctactcttcaccaggctaattccttgtcattattcaggcctcaagcatcacctcctttgagaagcctcctccagtgaaagcaaggcctgtatgctagttacccttgatcacttcacctgatttgtttccctggtagtgcatatcatcgcattacttcatctgctctacttcatggctgtagtcccagggcctggcataacaccctatacgcagctgcaccaggaaggtttcacaattgagacagaatgtaaagacaggtaggattcatacaagcaaaagatcagatactacttgagatgtaaatactgggagtaaattcaccaaaaaggtgccaccgggtatttacgtgctcttacaggctgaactgtattctccttaaaattcttatgttggccgggcatggtggctcacgcctgtaatgctagcactttgagaggctgtgtcaggtgagactctgtctcaaacaaacaaacaaaaaatcatacattgaagtcctagcccccagtacttccgaatgtgacctcatctggaggcagacacacacacacaggtaggaacaccatatgaagatgaaggcagggatctacaagcccaggaatgccaaagattgccagcaaagaaccagaagctaggagaggcctagaagagattgtccctcacagtcctcaaaaggaaccaacactgctgacacttgactttggacttctagtctccacaacttttgtcatttaagccacagtctgtggtactttgtcacagcatccttagcaaccaacatacgtacttcctcagttaagtctcagctccaagaacaggtttgcataaacaaagaaaaacaatcagaagactctgggcctcccctggtcctagctagggtgggagatgtgtacagaaatttcagttactggttctcacctgatgagcccggagcagggcggtcctccgatacatatagtcctctgatttgatcacatacaccatcttgtaggaattcagcttgaatctacactccagcttatccagactatccacattctccatggtcttcttgctgtttccttccttcccttccttttcctgctgctctcgaccacgttgacacttccggatccgccgtagattcctattgcagaaaagccccggaggatgagagctcgtccagatgcagattcccgtgacttccccaaagtgagttttctttattatatgcttgcatagtactcatcccaatttgttaaatacatacacaaatgttcagttgtttcactgcaaaaaaaatttcaactgcaaaggtacacagaataaaaagcagaaatcttcacccatcccctacttgacttagcagatgtagccagttaagagttttaatgagaaacttctaggcctctgtctgtaaatttacacatgtaattaccagctacagttctgctttgggatttgtttttaagacaaaataggatcatactatatattttgtcctcaacttttcacttactgtcatgaatattttttcatttcatgatagatttgtcttattctctttaactgctgcagaaaaatgtaccccaatttaccattccttaacagtttctttcaactgaggttcctcatctgaaccacataacaaaaatttatttgaatgactatttttaaaaattcccccagatgatataaactagtgccattctacatacacaagaaagaagataattcacatgaatggatgccctgaggggtggtaggcttgctaaatctcaacatccagtgaaaaaagttatcagctagacaattatattgtttctcataacttgctattaaaaacactgcttcaggttggccactgtggctcatgcctataatcccagcactttgggaggcaggtggattgcttgagctcaggagtttgagactagcctgggcaacatggcaaaaaccccttctctacaaaaaaaaaaaaaaaattaggcaggtgtggtgacgtgtgcctagagtctcagctacttgggaggctgaggtgggaagatcgtttgagcccagaaggcggaggttgcagaaagccaagatcccaccactgtactatagcctgggacacagagccagacactgtcttaaaaaaaaaaaaaaaaaaaaaaaaccaaccagcccaaaatattgcttcagtgagaatctttgtatacaagtatttctgtagacagcagttctttgtccaaagggtcccaggaccctttcaggagatctgtgagatcaaaactattctcataataatactaaaacattatttcccttttttgctgtgttgacatctgcactggcaccattaaagtaatggtgaacaaaaatgctggtggtggcgccaaactgtatttgcaatatcgaacaaattgttaccaaattccaatatcaatttgtacatcactgagcttttcatacagttgtcaaactctgttggtttatcttgtaccatcaatgaatccattttacttccatgattttgcaccttcatgcgactgcaattcaagtctttgaacttcacactgaccatacaatgacattaagtgaaaaaagccagtttcacttaagaatgtttctgatgggccagtcacagtggctcatgcttgtaatcccagcactctgggaggctgaggcaggcagatcacttgaggtcaggagtttgagactagcctggccaacatggggagacctcatctctaataaaagtacaaaaattagccgggagtggtggcgcgcacctgtaatcccagctattcgggagggtgagacaggagaatcacttgaacctggctggtggaggctgcagtaagccaagatcgcgccactgcactccagcttgggcaacagagtgagactctgcctcaaaaaaaaaaaaagaaaaaaaaagtttctgatgaagcagtaacattttctattaaatcccaacccctcaatttacatctttttaacatgctgtgtgataaaatgggaactacacataaagcacctttgtgtgctaaagtacaatggtattcttatagaaaagcacttgagcaattgcttgagttgtaagtggatcatcatttttacccgaaagaacaactgactaaatatagtcaatctcagccaagtatttggcagatgttttctcaaaaatgaacaagggagcctatcacttcaaggaaaacaatgttgccaatggtaagactggaattttcaagcaaaactatgaattttggtgaactggtatcagccaccctgagcttgacagcttcccaatacttaaagatgtgtttgatgacctagcgatagcgatattaaatcaatgtgatttcttttggagacactgtaaaatatatcaacatttagtaggtgtgtataacttattttccaaatagccaattgcgtaaagttacaaaatcatagaggaaaaaaagattcattcatgatacaaaataaatcaatggatttttacaactgcatgaaaagcccactgatgtataaattgatattccaactaacctttaagaaactatcactggggccgggtgcagtggctcacacccgtaatcacagcactttgggaggccgaggtgggaggatcacctgaggtcaggagttcaagaccagccagaccaacatggagaaatcccatctctactaaaaatacagaatcagccgggcgtggtggcacatgcctgtaatcccagctactcgggaggctgaggcaggagaatcacttaaacctgggaggcaggggttgcagtgagctgagatcacaccattgcactccagcctgggcaacaagagcgaaattccgtctcaaaaaagaaaaacaaaaacaaaaactatcactggtagttttgttgtcatatcaaagaatatccagttatctgaaggatctgaaaatattcctttttccagctacacatttgcgtgaggccagattttcttcacatatttcaatcaaacaacatacataatgcaacagattgaatatagaagcagacatgagaatccagctgttcttctggtaagccagacactaaacaaatttataaaatataagcaatgccactctattcactaatttttgttttgaattagcttttcattaaaaaatattatttaagaaaatataatagggatatatatatatatatatatattttatttttgaggcagagtctcactcggtcacccaggctggagtgccgtggtgcgatctccactcactgcaacctccgccttccggttcaagcaattctcctgcctcagcctcccgagtagcttggactacaggcgcctgccaccatgcccagctaattttctgtatttttagtagagacagggtttcactgtgttagccaggatggtctcgatctcctgatctcgtgatccacagcctcggcctcccaaagtgctggagttacaggcgtgagccactgcgcccagcccaatattgttatttttcaaatgaattaaagattgaaaacatttctttgtttttatttctaacttggtaaatattactagtataatccatataaacaaaagctttttggagtactcatgctctaagagtgtaaggggtctcaaggccaataagatgagccccttagctgtcagacaaatcattagaaactgaaattctggagggaagattccatacacttcaactaccctgccaccagaacgattatatcaatttccttttcctcacagtacataaatgtgcctccttcctcatatcatggtgagagacacatgatgacaggtttattgtagtatgttattagcatggagcctgttttgttgagaggaacctgacacagagcaactgctcaaatgtgttaaatgattcaatgaatggagaacccggcagggccctttttgctggtatctcttttcccatgttctcattaggactcaataagtctaataacactgggatgatactttcttggaaacctaagacataagatttcaattcaaaacttttaggaaggaagaaagccattctacccattttatacttcttaaactgttttcatatacttggaggatcagtatcacaatctgcctatacacagagggaacatttttaaaattctgtgcagaaaagagttaatgtagcaggcctaagattgctattctttgaaaagcctgcttataaaagttggcccttggctgggggctgggatcttggattttgggcaatgttctaccattccttaactcatataagtgtctcactgtacctaaactatttgtacaaactctatagcttatgctgaaaatgtgctttctttctgagagtttgggattttggtacatgctaggcatacagtgcctagatgactacatctcaataaaaatcctggcacagagtctctaatgagctgccctggtagacagcattttgcatgtgttgtcacattcattgttggaagaattaagagtgtcctgtgtgactccactgggagaggattctaggaagcttgagcctggcttcctccagctttgccacaggcaccttttcgctttgctgattctgctttgcatcttctcgctgtactaaatcagtctgactatatgcagagtcctgtgagtcctcttccatcgaaccatggagactctgacacacattcccatccaaagtacggaggttattgttgattctctacaactctcacctcccagatgctttgacacatgctccaggtaagctcatgttgtgacagccatataaaaccttgaattagcatccccagcagatagaacaaatgaataaaatatgtgaaggccaagaacgtgaaagtcatttaactctccattcctcaatcatgcacagtatggactgctgacagatgacatggctcactcacctggggagaaatactggtttctgtgctagatgttcacgaagctcaggcgaggtagtatctgaattcatgtatcgctccacgtagtctgaccagcgctaagatggcaaacacaaaatacaggtggaaggaaatcacaaaaacagctcctaatgcattgggcactctagtaaattctatgattacaatgccccgaattcataaatttcaagatcaaaaaagtccctttctataaagacatgattgttagtaggtattggaacacggattaaaaattctgttagccagcaatactgctaagtttctgaggtgctaaggttatgagaagtcataaacaggtagaagctggctcactgacaagtttcatttccccacagagcattttgttaaagaacaaaatttatagtggcaaatgtgtgaaagtttccttcacattacaatctagatttctgacatcgcttaaaaaaaaaaaaaaaaaaaaagatctgccaacaagccaacattcccaccaaaacaagtcatcccacacgaccccccccaacatcatacatatggcctgcatctcctgtgtacattatctgccataaccaactatgataatcacacctgtctattcaggggttgaaaactctggactttatcagtccaataaaaagtaaacatgacacaaagaatcaagatgacatgagaaagacctcatttgttgttttttatactttaggaaaaaacaggaaagctgccaaccataagacttccttagaggagatagctttactaagtgcaagatgaggttaacatctataaccaggcagcccgtctcttcagctgaagacatggctggattgacttgtactttaagcatccaggtcctgacccttaaacaggcctgaggtgccttggccttttggcagacagggtcactggacagactctcaaggcacgccagctctgcttggcacctggggtctgtgatgtacttgctcatacctctgcttccacagggtcatccgaattctcctcttctgtgtccagaagctcaatagtcagctggacctggccttggctctgaataaacataagctgcaaataagaaacctaagcgtaaacaaaagaccgtctctgtagctgtaatctatcttctcaaggaatgagaggtgcagaggcaataaacttagtaaactttgctccaactgaagagatgaggaagatactagatcttgggtggccagtgataaaggcaaaagtctacacttactacaagtaaaatgaaatatattaaagcaaaaggtactatttcatgtttcaaacttctagaattcgctaaaataataatcaatgtcagtaagaatgttttacaaaacaaatattttgtcagaaagaaatatggcacatgtagccagaaccacaaaatgtcaatgctctgtccattggtaatcccacttctaggacgtaatagaggaggtaactatcagaatcacatggagaaggtcagagcctggaaggaaacctgagaattttttatttcaaccttcttcattttacacagagacaaaactgaaattcagaagagttctggtttctcaaggcacaccactaatcaatatacatgcagagccagaagctagatctagctcagtgttcttttaaagctttaaaaattgctctctgctagtaaagcttacaacctgacaataacataatatatacacacacaaatacagttatttccaaaatagatttcggggtgggggcagaccctgcattttcacaatttataatttaagaattgcaaaatctgtctccagtattcataacaggatgtcattaaccagtccccatagtgggttggacgtctaggatgtttccaactatttgcttttataattatccattataatggtgaaaaattggaaacaacctaaatgtccaccaatacaggcattaattctctaaaaagtgaatatcaaatagccataaaaaagacaataaagacccagaagtgttgttaattgagcaaaaatacattaaagaccatttccggtcagatgcagtggctcacacctgtaatcccagcactttgggaggctaaggcgggcagatcacttgaggccaggagtttgagacaagcctgcccaacatggtgaaaccacatctctactaaaaatacaaaaattagaccgggtgcagtggctcatgcctgtaatcccagcactttgggaggccaaggagggcagatcacctgagctcaggagttcaagaccagcctgaccaacatggtgaaaccctgtctctactaaacacacacacccacacaagctggccatggtggcacgtgtctgtaatcccagctactcaggaggccgaggcaggagaactgcttgaacccaggaggcggaggttgcagtgagctgaaatagcaccactgcactccaagcctggacaacctggacaacctggacaacaagagtgagcctccatctcgggaaaaaaaaaaaaattagctggacatagtggtacatgactgtaatcccagctactagggtggctgacgtgtgagaatcacttgaactcaggaggcagaggttgcagtgaaccaagattgcgccactgcactccagcctgggcaacagtgtgtgtccctgtcttaaaaaaaaaaaaaaaaaagttaaagaccattttgtccagtataaactctttcaaaatatatactcaagcatagagaagtttagaatcatagagatgtcatcaatgataatttcaggaaagaattctaaggtgactttttttggttatctgcattttattttcatttttttgggacagagtcttgctctgtcacccaggctggggtgcagtgacgcgatcaggcctcactgcagcctcgacctcccaggctcaagcaatcctttttttttttttttgagacggagtctcgctctgtctcccaggctggagtgcagtggcgcgatctcagcttactgcaagctccgcctcccgggttcacgccattctcctgactcagcctccagagtagctgggactacagacgcccaccactacgcccggctaattttttgtatttttagtagagacgggggcaatccttctacctcattctcctgagtagctgagactacaggtgcacgctaccatgccgggctaatttttgtattcttgtatttcttgcagagatggggttttgccatgttgcccaagctggtctcaagtgatccgcccacctcggcctcccagtgtgctgagattacaagtgtgagccatgtgtgctgggcctatgttttcttttctataatgatcatgaccatggatttcatgtaccaacatttttctaacaataatatttacaaagcatactatgaaaaatgttcagagaaaaagaatacaaaattgtaaaaatcatatataactagttttttttttttctttaaaggcaggaaagaaacaaagtagattgtccaggaagacaattacttccactttgtagttctctggtgaactcattaaaaggtccaggagtagaatcacaggtcaaagtaccccggctttaacttctggttcagagaatcctaacaactgacattgtcaccagcaaggtcttcgactacctgaccaactctcaccttaaagcaattctcatctgacattagctgctcagctttccgctgatacgttgactccaggaggctccttgagttctgtgtgttcagctggcctccggtggccccattattattttctgccaggtaaaggtcagtcacctgcacacagatctcatcactcacgatatgctgcagctggaagcaaacaaaggcaagcttttagtgaacacagaaaacatttctccattatacagtcaacgttcctttgatgtagtcattcaactccaaaaaggtttttctttttttgggggggtgggggggtgctggcaattttagaaaattaatcacacaaaccactgtatcattttcttggagaataatcaagccaggattttcaaccatatcagtggtccatggtaaaactttcctatctatttaaaataagaaccatagagaactcaggataatcgtactatttaaaattctaagcatctttaaataattttctataggtcatatctttattgcattttaaaatcatttacaattggctctcatacatattctttctcatttgatcttcacaactgccctgggaaggcaagctagacagagagttggggccagttaggagacaaatttacacaatgcatcagaaaggtggctcacgcctgtaatcccagcactttgggaggccgaggtgggccaatcacctgaggtcaggtgttcaaaaccagcctggctaacatggcgaaaccccatctctactaaaaatacacaaatagccgggcgtggtggcaggagcctgtaatcccagctacttgggaggctggggcaggagaatcgcttgaacctgggagatggaggttgcagtgagccgagactgcaccactgcaaagctcaccgtgagctggggtgaggaagggagccttggagaatcatgaatgcagtatctatgtctatattcccaggccaactacaaagcctgaaactcattaagtatttaagaaatagctgctgaattattgcccaggggtgctcagctgaagaaggagggttgggactaaaagtcaaggttcctgactcctagcccaatacttttccaaacacatcacctatttttctgtatctgatagaaagtatagggcttaagttgtacataaagttaactcactttccatacaggccaatcatgattgactatcagtagcttttgtgacaatcttaggaaactaatgactagaaagttgaacgtttcagagttcccattctcatgtcatgctatttctattttgaaataaaaatccttccaaatgaaactttatcatcaaaatgacagaagtgaaaaatagatacaagaagaaagcaaaacgttaatttcaatattgatttgtctgtttaaaaaactttaagatgatcataaccaccaagccattctatttttaggaagacacattctttttaagtgttaggaaccatgataactatttattcttaagtcctaaatgaccagtatgtgtattagtagataactggacacagtgaaaggtcagaacggtgactgagtgtggcagaaagggcagtatctccagcaactacagatggataaataaatcacaatgagtccagataaaggattctgatacaaccattaaaataatgcttatgagtacctgatatcatgaggaagattaagatacagtgttttaggagaaaaaagaaaaggtggaaaaaaacagatggaaagcatgacttcaatcatacatacagatgcttccactttctactttctttttgagacagagtctcgctctgtcgcccaggctggagtgcagtggcatcgtgatcttggctcagtgcagcctcaacttcctgggctcaagcaaccctcccatacctcagcctcttaagtagctgggtctacaggcatgtgccaccacgcccagctaacttttttgtattttcagaagagacggggttttgccatgttgcccagtctgatctcaaacttctgagctcaagtgatccacccgccttggcctcccaaactgctgggattacaggcgtgagccaccgcctctactttatactttcttgttgaagtagactgtattactgattccccacccatactctctttttggatatctggcccctcctcgagtcttcagaaaagacagcactacaaatccagagacagctacggaactcccacccccactgctaagcagatcagattctctatcttgctaattggagatgacagagagggtgttcaatagattttttgaggaggagcatctgtatggaaaggtctagtaacactgggaccaggggtactgggagggcaagccaaagcctcagaggctggaggagcctggagcacatgccgtatgttcatctgcagagcaaagcacaagcatggagcagaagtccagagtgaaggcatgcaggagagaaaaatcacctcccagcccaatccttccatggtgtggtcctattttgagttctgtacttggatgtctgtgaggttgcctattgtattcttaatacaaatccctcttaagccagcctacaataggtaagataaatgtaatggcttcacttggctggaatgcagtggtgcaatcacggctcactgcagcctcaacttcctgggttcagatgatcctcccaccttagcctcctgagtagctgggactacaggcatgtgccaccatgcccagctaattttttgtatttttaatacaaatagtgtttccccatgttgcccaggctggtctccaactcctggactcaatatatctgcccgccttggactcccaaagtgctggtattagaggcatgagccaccatgaccagccttgactttgaaatatatgttgtacattcagtcagcagtggaatctgagggaacaccaaatatgaggagaatgagagaagagatacctccagttaaaggagttgagaagcttgaaaatgttttaaaaagtcactgtaggctgggcacagtggctcatgcccgtaatcgcagcgctttgggaggctgaagtaggtgaattgcttgagcccataagtttgaggccagcctggacaacatggcaaaactccatctctacaaaaaatacaataaattagccggtgtggtggcccctttggtcccagctacttgggaggctgaggtaggaggtcaaggctacagtgagctgatcacaccactgcactccagcctgggcaatagagtgagaccctgggttggaaaaaaaaaaaaaaaaaaagtcactgttttggggttttctggatgaaacctgtttccattaaaaaaaaaaaaaaaaagcggggggtgggtggagatagtatttattactgattcaaaatcataaccagatacagtaaataattgtaactattgtttcgaaaaccaacctcagaattattaaaagttagttttattggattttttttttaagctgtgctggtggtatgaaagacttcgttcctagctgaagcagcagcaagcctgtaatcagcaacataagcacagggtaactggagtctgtattttatataaatttcagggaagttaaggaagattagtctgaaaaagtatgactatgggtgactatgtatccatctaatgatttctgccagttaccatccagacctcttatgggaaggcctaacaacttcttcaacttattggaaacaactatctgacaactttcccccagatgttaaggttcatttatatgaagggctcttcctcaatcctgtgtagatactgtgggaggagtacagaggcatgcacccttccaaaaccaaggcaaaagcatgggtactttgcaaagaattcaatattttagcccaagagaacattaagcaacaagctctttccttctacagtggcagtgtggattctagaattagaaattgctttttacaagttttcacttaagtacttcaccgcctttctgctgagctattctatggaagagggctgtaggtagccacggtacccaggtggaacagcatgatcctaaagccctacttccacaaggaatcgcagtggcccatggccacgtggttcaaccagccagcccagaagatctgcagatgcaagcaaaagtataccacattgacctgcaccctgcatctggacccatctgacccatggtaagctgccccacagtgaggtaccacaccaaagtacaagctggcaggggcttcagcttagaagagttaagggtgaccagcatccacaagagggtggcattagtacaccatgtccctgtgggccaatgttcagcacctgaaggagttaagactccaagctcaacctcttctccaggaagctcttagcccccaagaagggagacagttctgaaaaactcaaatcagccacccagctgacaggaccaataatgcccatatagtacgtctataagaaggagaaagctggaatcatcactaagaactttaaggtatttgccagtcttcacacagcccacatcaattttcagctctttggcatatgggcaaaaagggccaagggagccacagaacaggatgctgaaaaggaaaaatgaagccctgctggggacttgcagtcaatcagcagtagagctgggtctccagaaaaagaaaaaagcagttaaccaacaatctctctgggagttcagaactcaagtccaagaagtagaaatgtgactatctgttacaagctattttttatatcattgttgtaaagaacaacatgtttacaagttcccagggtgccacaggaagaacacacaaaaccaaccagaaacctaacttagagggaaccgcagatgagtgaggtgggcagagtattataaaagatgttatgtgaaccctttcttataaaaagaatttcaaatattaaacaatgcaagtacataagagttaccaacaccttgaccaggcgcagtggctcgtgtctataatcccagcgctttaagaggccaagacaggaggatcacttgagaccagaagttcaagaccagcctgggcaaaacagtgacaccctgtctctatttaaggaaaaaaaaaaaaaacttaccaacacctatggaagacgcaatgttccacactgtgtgcttacccatggcagacaaggtaagagatagacaagttgtgcaggaagctggggtcaggaccactgcactctacaggtggccagcaagaaaggatatggggtaggcaggctcatacactgcaactttgttaacatgagaaatcaggcatcacattaacctcccctcctctcttcagaaccctacgttcataaacactgttatatgaaaaagttgcctttccttttccttgcgtggcccatctctaggtaaggatttcttcccttactcaccctagcctcctccatgccctcacctgtctgacaatgctctggatcagtttgtccatggtaaaggcaatgtaggcatgaatggtgaacatctctctcagtgaatcttcatactgtgatgagtctatgttgccatccagcaggctccgcaccatgtccaggaaagctgggtaataatcttctacatcaacatccactgtgggagagatgggattggtgaggccttaccttgctaagaaaagactagggatagagtacagggcaaatcccacagctggcctaaatggcatttgaaagtatgaacactaggtattcaaaatatactcactcattccaatgtaaacagagatgaattccgacaggtgactacaatcaccagcactatcagagtgactctgcaactttaacagtggcttctaatattctgactaccatgctagaaagatacttctttatggtactgctgggccactttcagagaggaaaatatcctagggaagccagtccttcaaagagctgttggctcccctgctgagagaggaacctactctcccagcctgcacaagagcattcctcacatgggtcacttgctcataaagctatttcaatgaagcataaagtacagatgaggaaaggcagacacagccatactccagcactgggaaacctcttgggaacacaaaaataggagtgcaaattaaatcctttatgaataatgaagtaatctgcatttgtcaaagtccttttgtttaaaaatggattcgctacgttgtatttcacaaattgcattaaatcatctgtagttgctgcacatgaatcatttcaatcactagctagaataaatctcatcagttgttaaagacatttggcaactagcagagggcacaaggagtattaaagagtgctgcctttagcttactaaagacccatttatataaagttcaaaaatagacaaatctaatctctagtgttagaaatcaacaaagtggaaaaaggactggttatcagagtactggttatgtttcgtttcttgaacataggtacgtctagtctgtaaaaattcactgagctgcacaattctgatttgtatacttttctatatatacatgccgtaccttatatgtatttttttgtagagatggggtctcacttattaaccaggctggtctcaaactcctggcctcaagtgatcctcccacatcggcctcccaaagtgctgggattacaggtgtaagccactgcacccggcctatacattgcacttcaacaaaaagttgactaaaatgaaaaaagttacaaaacgaactatttgtcactgactaattggttacttgctagttgtgtttgtgctggagaaaaaaggctaggagcaaaaccaagttgtctccatttatctgaagtctgacgaattcattaaaaaacaggcaaaacaggacaaatactgtttaaaagaggcaactggcttgagtttcatcacagactatcacattctttagctccatagaataggtataggctatagactccaaaatataccactgctatgaaaactgcttttatgccagaataaagttttgagtccaaaccacagatttgtccaaacaagctgtggtaagtgtgagggttggcattatcagacaagacaacattatgtaagcctcaaaccaggttaagtcagtggccaagccaggaataggccatttaatttctaatttctacccaagtagatggaatcaccacaatgagatctaaaatttatctctttcgagctaggactagtctagataaaagctttcagaattatttttcagtgtcattagctcctcaacagatagaaagctagggccatatctgggcttcctacatcagcaacacataaaaaaaaaaaaaaagaagaagaagatacactcctcaggttggctatttccttaagagcccagaagaaatgcttcatgaaaaagcttttggctcacagctcaagtacctaatttatgacgtgaactggaagcaggcagcacaaaattacataaagcacatgacagcgtcctgaaccctcacttactttccttttcctgagttctacatctttatccctgtcctgcctgttctccatgtctcatatcaccttttgagttccagtctcctttccataaactatttctacatattaagaatgagccataaaccccactggttaaacagaagtcctgctcaaaaatatgagaaaattctgttttaagcactaggaatttatgttctgtcatggattgaaattggctgtgacagtttagtctctatctgtactttgaaacagatggcagtaacccagaaatctgccatttgagaaattaactgtgatacccccttcccaggtgcgtccacagtaccaaccactgaccaagtgtccatgatctaagccctgcataggatactttgcacaaagcaacaccacaagcaactagagcctccatttttcagataaacaggttcagagagtttaactacacagactctaatgcctgtgctctattaataaaagaagcagtcccaagtctaggtggctctaaggtcctcaacctcacacatcctctgtaaatcagaggtctcggcactcactaggttctttgagacgtagctgaatggcagggctgtcactcttgtctcgctttatgcccagcacttcccgttcccattctctctctcggttttcttcttcaatttgccgttcggcttgggaacaaatccgtagcagcctcaggcagagaatctggtgcagtcgcataaaaatataccagttgttgttgacatagaagaggttgtatacttcatccattcctcttaatttttgagctgctgtgttactaaacagtaacttggacttagggggactgcccccaacaccattgtgcttcttaactgcccctgtggcttcatctacatccatctcttcttcttcctcttcctccacatctgagagatcacctctttgggcaaagagcaaatctggaataaaatgatgcatgatttgttttatcttatatttgtcctccttctgaatgcctgtctgcctcttcacatggtggataatcagagcagcagcatcttccagtatttgtttgtcttcatacgcaagtgagaggtgtgggccaacaggtacaccagcattctcctccgtagcctgctcttgcctctgatgggacagagacacaaaagtattctgtgagatgtctacagcgacaacatgtctacaagaccacatcagccatacatcccattatcaaccacagtgtctatatttttctaatcaaaaacttaggacctgggactgggagcggtggctcacgtctataatcccagcactttggtaggccgaggagggtgatcacttgaggtcaggagtttgagatcagcctggccaatatggtgaaaccccgcctctactaaaaataacaaaattagctgaacatggtggtaggtgcctgtaatcccagcccttgggatgctaaggcaagagaatcacttgaacccgtgaggcaaaggttgcagtgagccgagatcgtactactgcactccagcctgggcaacagagtgagactctgtctcaaaacaaaacttaggacctgactataacaataatttttgtccctcttccagaaacaaataggtaatgacagagacgtggtttgatgtcaaaatacaggtaccttctacacactgatgacttacagggagagtaggacagaattggaaccatctttctttcttttttttggcagggtcttgctctgtcacccaggctggagtgcagtggagcaatcttggctcattgtaacctccgtctcccgggttcaagccattcttatgcttcagcctcctgagtagctgggattaagaagtgcaccaccatgccaggctaattttgtatttttagtagagatgaggtttcaccatgtcggccaggctggtttcgaacttctggcctcaagttatctgtccacctcagcctcccaaagtgatgggattacaggcgtgagccactgtgcccagtgggactatctttcaaaattctggattagtatctatataaaggatatgatatgagatctgtgatttactttacttctggggtgggggtatggagggtgacaaagtaacatcagcaaaatatggaggattaagtttatttattttattgattttgagacggaatcttgctctgtcacccagactggagtgcagtggcatgttctcagctcactgcatcctccacctcccaggttcaagccattctcccacctcattctgccgagtagctgggactacaggtgcacaccaccacgcctggctaatttttgtatttttagtaaagacggggtttcgtcatgttggctgggctggtctctaactcctgacctcaggtgatctgcccgcctcagcctcccaaagtgctgggattacaggcatgagccactgtgcccggcctgattaagttcacataagagctcattttactatttttaaagttcaggatcaccccactccaggaattcccaattgcactgcatttatgtttctatccatctcctaaaactgagcccacggaaaccaggatttattgcttattcatctctgatcctagctcctagtactatttatagtcctggtaggcatgctgaataagcaaggattacaaagagtttggtggtcaatgacaaattttgaagctgtaagtaaggagagatgggactatatggatacaaggtattattgtttgaaggaaacaggtagtcggagaagtggaaaatggaggcaggaggtataagttgaaaccaggacagtaaactaggaaactagtcaaacagcttaggtataaaggtatagtttagatttaaaatggtagaatgaggaatagaaaaggctatgacagctatcaagcaagaatcaacaggtcttagagagtctcacctgcatttaacaaaggtaatttccagaaatcaaagctgtgctaaatatagactagagtcctctcacagatgcagaaaccccccgctcacctcatcatagatactctcaatctcattgagtaagctcttagacctcaggaccttggtgtcattctgtttaaagttgatcccctggtggtccagagacttcaagtagtatttctcattttgttctcgccatactttgttaaagcctctctgagcttctcgccattcttcctctttcatcttcaacctagtgaagcgggaagggatggaaacaacacatgggaattcagagggtttagaagaaagaaatttgccaggcttactttagttaaagaaaggtgcaaagctatattaggtctctcaaaattactggcaacttgggatgctatcaaaccagtcttgaactctgtttcatgagggaattactcatccaagacttactttgaggaaatgatttatctcaaagtcaaataatttacctagaatggttacttaaaaacagcattccagggaatatctttcaggtataagtattccttgaaaaaaagagttcttgtttctttgctataggactttgcaaaacgttcacaatgctaatagaaacacagaagtccaagacaagagaacttgcacagttatgttcctctggatacagtcaggaaagttctgatcagaactgattctaataacccagaagagaacagactaagacaaaaaaaagcactaaaactgaagaataacctgtatctcaaaagccagaagttaaatgctacaggcaagaagaagaaaccatcaatctgtgccagctcttgaggggaagatgagggagaagaaaccatcaatctgtgccagctcttgaggggaagatgagggaggacaaatcaaatctgggtatttgtgaactgtgcagcaaataagaattaatttttaccagatgatactgagagagaaccaagctcctaacaaaggattcacagtgtggtcaataatgacatggggctgggtgtggtgtggcttgtgcctgtaatgccagcactttggggaggccaaggcaggaggattgcttgagcccaggagttagaggccagcctgggaaatatagcaagacctcatctctattaaaaaaaataaaataaaaattagctgggtgtggtggcacattcctgtagtcccagctattcgggaggctgaggtgggaggatcacctgagcctgggaagttgaggctgcagtgagctgtgttcacactactgcactccagcctgggtgaaagagtgagatcttgtctcaaaacaaaacaaaacaaaaacaaacaaaccacaaagatgttaacaacagttagtcctgagtgtggcaggaacatgggtggtaattatcttcttttcttttctgtattttaaaatactcccccaaacatacacacagagccttccaccatgaacttacaagatttgttctctaatgttggttacacaggacccccaaaagaagttccattctgcacctgaattccaacaaccagggttggggagaaagagaggtctcatgggacaaccaggttgaaaatgagagccttatttaatgagacactgaaccggtagtgaagtacactaaagcactaagggcacatttgctcatgtaccttttaaggacaattggaacagcaatggagggattctttctcagaccatcaatgatgtcagctgctttatcagcatatatcctctggagtgcttttctatggatgacttctgatgtgcccccaagggtgttgtccaagcgaaatttggcttgttcttcagcagacaagcgggaaagcttcttctgtattgcttccagaacccggattgttgccagattggtctctaaaactacatcaagctgaagaggaagacaaagaagggtatgctcaggacccaaatcaaaatagaatagagtagtgtttagaagaataaggtagggagtcaaactccttggatttgaatcctggttctgccctactagctacataagactgtttctttatcagcaaaatagggataacagcacctattactctcacaaccctgtgtctggattaaatgatacaatccacataaagtatttagcacaatacctggcacataagaaccacaggatgaagttggataaatggtagttattaccaccaccgtcgctgctgccgccaccaccaccgtgtgctttgcttaggactactgattttagaccagaggaaccaaacaggagatgactttactgaaacgtttccctgaactttcctgaattgctaagatccattatgaacaaacaataacaatcaaaacaatcccaaaagaccgctttgtcttgagagttttttggtttaacttgaaatatttaaatatattcaaatacttaaatattcaatagccttgttccacatccagtaataataagagcagtgactatcataacttaaggagttcactgttgtagctgcgggtaaccatttaaattcttattggactcctggcaacctttgagtctactttttccctagcttaaaataaggttctctaaatgagaaacagaaaatgaagtaaatgagcagtctcaacggtctacaaccaactgtttgcagaagtgttccctaagttttcttgttttgggaatgtggtagtcatttggtcaatatttctggcccctcttgctctccaattatgaacaaaaaatggactaaacttcctggctcccttatgattggatagggccatgtaactagttttgaccaatgagttgttatgagatgagtagaagtaatgtttattacttctaggctgcagcatttaaaggtgtgagatcattccaagctctcttttcctcctagtgactagcaacattcataatggcagcaatcccttggcctgaatccccaagtaattctgatatgccaaatcccctgctaaacatcaatgtacatgtagaatgattagaaattaaacccattggttttacaagtcactcagatgtgggagttgtctgtactgaggcattactaacctatcttgattggtaacgcacattccttcaaactagctcatcccaccaaatcttaaacacatgcacaccccacttctttcatgtttgcccttgtagtcacaaatgggaaatgaagttgcctctcatttggaggcataccagctgagagaggataggaacactctgtcaaaaacaaatgccaagctctgctaaactcatcagttaaccttactaaacgtaagtaacaaagaaatgccttctttagcttgataacactccctatggaagttaacatctgtcttgatttagctttctgcaaataggtgcaactccttataaatgctggggcaaagatggccaaccacctgccagtggccaggcagcatgtggttctcaattaaaaacacaccagaaactgctgaaccaagtgtgaggcgggaaaactggcaaagagctaaaagagtaccaaaacaaacaaacaaacaaacaaaaaccagcaagatacctatccacacaagtaagcacagccagtcaatttaatgtaacagatacactaaataggatacgtatcattttacatctttagacaaaccagacttccctttttaaaaatgataatgtaaaccagacatataaacacactgaggattgagcccactttcagtagtccctctcctgatataggtggtatggggccttctaccacctcatttattcactccactcttcccttcctaattacttcaaaataaagctcctgggacaggcgcagtggctcacacttgtaatcccagcactttggaaggccaagacgggtgggtcacttgaggtcaggagttcaagaccagcctggtcaacatggtgaaacccatctccactaaaaatacaaaaaaaattagccgggtgtagcggcatacacctgtagtcccagatacttgggaggctgaggcaggataatggcttaaactcgtgaggcagaggttgcagtgagccgagatcacaccactgcactccagcctggttgacagagcaatactctgtctttaaaaagaaaggggtccctaatttagccttctttcaaaaggagccaatcaggccaggtatggtggctcatgtgtgtaatcccagcactttgggaggccagggtgggatgatcgcttggacccaagagtttgagaccagcctgggtaatgtagtaaaacactgtttctataaaaaacaaaaaattagccacagggggtaggaggcaaggggagggagagcattaggacaaatacctaatgcatgtggggcttaaaacctagatgatgagttgataggtgcagcaaaccaccaaagcacatgtatatctatgtaacaaacctgcacgttctgcacatgtatcccagaatttaaagtttaaaaaaaaaaaaaaaaaatttacccaggcatggtagcacatgcctgtagtcccagccactcggtggcgggtaggggtgggggtctgaggtgggaggatcacacttgagtctggaaggttgaggctgcaatgaactgtgattgtgccactgcactgcagcctgggcaatagaatgagaccctgtctcaaaaaaacaaaacaaaacaaagcaatcagctgggcgcagtggctcacacctgtaatcctagcactttgggaggccgagacgggtggatcacgaggtcaggagatcgagaccatcctggctaacacggtgaaactccgtctctaataaaaatacaaaaaattagccggacgtgttggcgggcgcctgtagtcccagctactcgggaggctgaggcaggagaatggcatgaacctgggaggcagagcttgcagtgagccgagattgcgccactgcactccagcctgggagacagagcgagactccgtctcaaaaaaacaaaacaaaacaaacaaacaaacaaacaaaaaacaacaaagcaatcaataccagaaacatgaaagaaaaatgccagttctcagagctggtttgctaaccatggcaagatacttgctaagggtaacaatacacacagatcttaaataatttaaaaacagcttcaagaaagtactataaaccttaggatactgattttcttcaccatgcaaaacataataatcttaaaatgccatgcaaaatcaaaagaactattatttagtcatcaatggacaatttcagttaaaagggctaaagtggcctagataagtcacatttgccataaagcatgtactaatatatacatttgaccaatgcataaagcatggaaagtaccacaacaagcacttaccatagaagaatgtgagcctttggctcttccatcttaataaccctcagagacaggtactgatagtctcactgagcatctcccatttcccccaacttcaaatgccaaacaagcttgtacctcaaagcgttcatcttcacaacgataaatatgttcttcatattgagtcttcttggaactcacaaaggtagagtcctcagaccacgaagggaaggaaacccaggtatcatttaaaacctttgggtagaagaagagagactgaaacaaaagcctaaaaaagctttctggtgattaagcattctgaatgaaaagacaaaactctagcagagaaataggcaactaatattacttcacaaatttcacctttagcaagtttacaaaaagctattagtaagaaaagggtgctgaatataagcggaaatataattccagtgctttgggaggacgaagcaggaagatcacctgagcccaggaggagtgacccaatctttacaaaactaaaaacttttatttttatatttttagctgggtgtgaaggcatgtgtaagtcccaggtacttgggaggatcatttgagcccaggaggttgaggcactatgagccgtgatcacatcactgcactacagcctgggtgacaaaacgaaaccctgtctcaaaaacaaacaaaaaagtagaaaacattttctttttaaaaaggattaaaagggttcttaatttcatcattcatataaattctcaatccttggtaccaccactcccttctggaaaaagctgaggacccagggctgatctttgctagggaaggccttacctctttacagagaggagtccgtcctgtacacttgggctgctggtaactctttggtaaggctcgatagctggagcccaatcgtttacaagaagcataatctatctccatagcaatgccctctgtggctcgctcctttggataagtttccagatgtacagactccttatagcccagaaagtttttaaaccaattaaacaactcagggaatttcctgaagaatcaaaccaaaaagtgacaagcaattaggggcaggatgcagttatcctgaggtatgactactaccatctggttttggatcagaaatctgctaccagggatgaattatttcctgcctaagaagaactgcttctgagcatttggtttcccctttttctaataaaatactctcagatcagttaaagtggtgatcaaagagttgtaccgaaaccaggcaaaataacaagccattcttttgatcaagaatattgctttaatgttcacataattcttaggttgtcaaatatagtaaagattccagactcggtgtagtggctcatgcctgtaatcccagcactttgggaggccgaggcaggtggattacctgaggtcaggagttctggaccagcctggccaacatggtaaaacaccgtctctactaaaaaacataacaaaaattagccgggcgtgtggtgacaggcacctgtaatcccagctacttggggggccgaggcaggagaatcacctgaacccaggaggcggaggttgcagtgagccaagatcatgccatcacactccagcctggggaacaagagtgagacttcatctcaaaaaaaaaataataataataatttttaaaaaaattccagaactctgggagagatttttcttgataaacatccagcactggttagaagatcaggagaccactagtcttggccattagtcgataaatacttaatgccctctctattttctcatctctagagctggactagaagacttctcaggactcttctggcactaacatttgagtcaactgatgtatctcaagtaaattaactttgcctatcatatactctcacaaatcaaacattacctggtctccatatcatgcatcagggctaagcccctcacttcacttaccccaggaaaggagagactagttgcacaagctcagcacgagagatcacctcctggttaaaaataacaagacagcgtaggaaattttcgtaggcttctgcactccgaagagcctttcggaccttatggagacaacgggaagaaaaacagtttttgtttttcttaaagtggggaactgaaaagggcctcgctctgtcgcccaggaggaggcgcagttgtgtaatctcagctcactgcagcctcccatcctcagcctcccaagtagctgggactacaggtgtgagccaccatgcctggctaatttctaaattttttgcagagacgaggtcatatattgcccagctgccctgccattagtttttaaaaactggggaaatttgtggctgggcgtggtggctcatgcctataatcccagcactttgggaggccaaggtgggtggatcactggaggccaggacttcgagcccagactggccaacatgctgaaaccccgtctctactaaaaatacaaaaattagccaggcatggtggcacacgcctgtaattccagctacttgggtggctgagtgaaacataagattatcacttgaaccctggaggcagacgttgcagtgagctgggataatgccactgtactccagcctgggtgacagagcaagactctgtctcataagtaaaaaaataaaataaaaacggggaaatttaaactgatatttgatgacactaaggaatcaacgttagtgtttttagatgtgataatgattatgtttgcaataaggagtttttttgttttgttttgttttttaaacgcagtccagcactgttgcccaggctgaagtgcagtggtgcgatctcagctcactgcaacctctgcctcctgggttcaagcaattctcctgcctcagcctcccaagtaggtgggattacaggcatgtgctactacacccggataatttttctatttttagtagagacgaggtttcaccgtattggctaggctagtctcaaactcctgaccacaagtgatccacccgccttggcctcccaaagtgctgggattacaggcgtttgagccactgtacccagccacaaaaaggagtcatttttaaaagaaacttactaaaatatgtatggatgaaataaggtatctgcgatttgtctccaaataaactgggatgggtgggaatatatatgaaacaagtaactggctagaattgggaaccgctaaagctggatggtaggtacgtgaggaatcattttactattctgtttatgtatgttcaaaattttccagctgggcgcagtggctcacgcctgtagtcccagcactttgggaggccgaggtgggtggatcacctgagatcgggagtttgagaccagcctggccaacatagtgaaaccccattctactaaagaaaaaaatacaaaaaaattagctaggcgtggtggtgggcacctgtagtcccagtgactcaggaggctgaggcaggagaatcgcttgaacccaggaggcagaggttgcagtgagccaagatcacgccactgtactccagcttgggcaataagagcgaaactccgtctcaaaaaaaaaataccataataacaatttaaaaactgagatctcggagtataccttctcatatgcttgattctccacaccatatcagagttactcaggtttttgttgcctctttttcttttttttttttgagaccgagtttcactattgttgtcctggctggagtgcaatggcgcgatctcagctcactgcaacctctgcctcccgggttcaagcgattctcctgcctcggcctcccgagtagctgggattataggcacctgccacaacgcccagctaatgttttttttgtatttttagtagagacggggtttcaccatgttggccaggctggtcttgaactcctgacttcaggtgatccacccacctcggcctctcaaagtgctgggattacaggcgtgagccactgcgtccggcctgttgcctctcttaacatgtttacagcaagaatctttgccaaggctgttttaaactctggtaatctggaataacgctctcttaagatagttctgtcctctgatctggtcttttttcttcctctatttacaatattgagcatcttaataccaaaaacccaaaaatgatcaatggcatagacaaagtaaaactagtctagctagattaccaatctggagtttcagttccaaaataagtatttagcactgtgatcctttggtgaagaccacagactgccaccaaaccaagtggcttatcagcaacccctgctccagacttccgtatgcttttcttaactattcatcagtagacactatatagaatctagacttttaaagctaaagataaaagaacactgtaccttttatactgtataccctatttacctttactttttattagcttttaaacatacacaaaagtagacagaagtataacgaacctatgtactcaccccaacctcaatgatctatagtaaattttgtttcatctatacttacttctcctaccactgcattttaaagcaaattccagacatttcatctagatatagtatatatgtttaagaaaaagtactaagaaaatgccattacaggactgggtgcagtggctcacgcttgtaatcccaacactttgggaggccaaggcaggcggatcacctgaggtcaggagttcgagacagcctggccaacatagtgaaaccctgtctctactaaacatacaaaaattagctgggtgtggtggtgggcgcctgtaatcccagctactcgggaggctgaggcaggaggattgcgtgaacccgggaggtggaggttacagtgagcccagatcacaccattgtaccccagcctcagcaatggagtgagactgtcccagaaaaaaaataaaaaaaaaacaaaaaaacaaaaacaaaaacaaaaaacccattactcttagaaattaacttattttcagaagactccttaaggcaaggcatggtggctcacacctgtaatctcaacactttggaaggcaaatgctgaggccgaaggaggaggattgcctgagcccaggagtctgagaccagccagggcaaaacattgagaccccctctctccaaaaaaattttaaaaattagctgagtgtggtggtctgtacctgcaagtcccagctactcaggagggtaagaaggatcacttgagcccatctcttaaataaaaaaggccaggtgtggtggctcacacctgtaatcccagcactttgggaggcgaaggagggctgatcacccgaggtcaggagttcaagaccagcctggccaacacagtgaaacctcatctctactaaaaatataaacattagccaggcgttgtggcggggcctgtaatcctagctactcaggaggctgaggcaggagaatcgcttgaacccaggagatggaggttgcactgagccaagatcacaccacttcactccagcctgggcaacaagagcgagactctgtctaaaaaaaaaaaaaaacccaaaaatgtaaaaaagattccttaatagcatctaatattgagtccgtgtcaagttcaattgtctaattaatgtcttaaaaattggctattggccaggtgtggtggctcacacctgtaatcccagcattttgggaggctgaggtggatcacctgaagccaggagttcaagaccagcctggccaacatggtgaaaccctgtctctactaaaaatgaaaaaattagctgggcacggtagtaggcgcctgtagtcccagctgtttgggaggctaaggctggagaatcgcttgagccagggaggcggaggttgcagtgagccaagattgcgccattgcactccaagctgggcaacagagtgaggctctgtctcaaaaataaaaataaaaataaaaataaatcagcttttaaattcagaatccaaagtctgcatgtcacatttggcttatatatttcttaattcttaatttataatagcttcccttccatacccttttcttgacatttattggttgtgatctagacttccacacttgtctaagagcaccaaccgcccaagcagactttggtaatgattcacatcagagctaaggactcaacactcttgcaggactctcctgcaaaaagctcacataggcacagcagacagaaagggatcaggagatactaatcacggagatgttaaatcatctgcccttctgcaaaacccaagaggcagaaaatagagtcaatcaccacagatcaatccaggttgattcctaccagtgagaagcccaacaggtgccagctaccctgatgaaagtttcctgctaatcatcaagttgactccgaggagcaaatcacacttaagtttatgtggccaaactaaggcaccacacaacatcatttatgccaataatctcaactctcgttgctcattagaatcagctgggtagctttgaaaacatgcaagtaaattagaattcccctgaatgctatgtatgtgtgtactacaaataactatcacagcaataagattacaagtcatcggccaggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggtgggcgcctgtagtcctagctactcgggaggctgaggcaggagaatggcgtgaaccccaggaggcggagcctgcagtgagccgagattgcgccactgcactccagcctgggcgacagcgagactccgtctcaaaaaaaaaaagattacaagtcatcttaaatcctcaaaaattggtacaggcactggtactgcctgccacacagacctggatatctacaatgggagctccaaacatctttcaagagaaacataatacattttctaaaaatctgtcttctgccccaaactgcttcataaaaccaaagcaaacaatgctaccatttttctagctatgctaatagtactagcagactcaaaggactcacaactgggaaactatgttaaaaaacagaaagtcctaattagcctgacacctttaaaacgaaaccttccagggggataagatgattttcttttggcattaacaggcactatcaaatctaactcatccattactcaccttatcaaaaaataacgattctgttccaccaccatgtttgctggcatctgccatagaagaatccttcagattgagcagtttgggtttcttctgcaaaagaaagatacaaacatgtgagattcaacgagtggttttctctgaattttatttttgtctgtattcaatggtttcatcactgaaaccactgctgattaataatttgaaacaaatgagagaactctaaccaactcactccataccctctaagatttcaactcatattttctatttcagtttgcctattaagtttctttctacaacagaggttcaaagatcattctacccccaaaatattttctccagaaatgatcatgacattactgtgacaaacttttagaatatccttactttttctaggggcccaaagtaacttcatgtagaatctaatgccactgttttgttctcctaccagctgagggagaaaaggctgtttgtaaaaagagctcacaaattgacagaaatcaatctttaaccctgaataatatttcaattaaaaatttacttaaaaagcataatttgctgggcatggtgactcatgcctgtaatcccagcactttgggaggccaaggtgggcagatcatgaggtcaagagattgagaccatcctggccaacatggtgaaaccccgtctctactaaaaatacaaaaaaattagctgggcgtggtagtgtgcgcctatggtcccagctactcaggaggctgagacagaagaatcgcttgaacccaggaggtggaggctgcagtgagccgagatcacgccactgcactccagcctgggcaacagagtgagactccatctcaaaaaaaaaaaaaaaaaaaaaaaaaaaaaggcacgccagcaatatccactcagactaatttaatattgttcttctaaagggaaccaacaggccatgatataatcctgtcaggcaagaagttacttttaaaatccaccacttactctctatgaagaaatgcacaaactttgtgagaagtagcacatttaccttggctatctcagagtatactttcttaagagccgcagcctctgcttacactgcctatggagaaagtaggcggagaattttaagcccccactatattcttgccacctgtaggtaatcaagagtgggcggacgtaaatccaagcatggagtgtatctactgagctgattcttgctacccatataactaattctctttattgaaatgaagaaatagaaaccattattatgttcaacttgatttcaaaagatttcaaaagaagaaaccatgacaaacactaatgaaaaggatacttcaaaagtgtcagtaacacctagtacgtcagaccttgtagtcagtcaatcactattcatcagccacctcttactattagaaattcccaaacttttgtcattatttaattctgcagacatatctgtctcttctatattacatactgctttgaaattcactgaagaattaaacattcaatacatacaactagccctctccctatcatagctgtgttacatcaaagaagggagcaagctaagttttctgcaggcagaccatcagtgttaactataacaaaaaacatcatgtaatggattactaagaggagtttaagacttccctctgctacagcccaaaggtcctgccttggagattaagatgatacacataagatctggtaacccaacaaagaactttgagcaggacagggttctagaccagagatctcaaaaaacacatgcactctactcacaagaggacctcagagaccacttatttctgaaataattctcaagctcaagaatgttctttcttaacacaaggcagatttaaagcatcaaagaagaaggggccaggcgcggtggctcacgcctgtaattccagcactttgggaggccgaggtgggtggatcacctgaggtcaggagttcaagaccagcctggccaacatggcgaaaccccatctctactaaaaatgcaaaaattagctgggcgtggtggcacacgcctgtagtcccagttactcaggaggctgcggcaggataattgcttgaacccgggaggcagaggttgtagtgagctgagatcacaccactgcactccagcctgggcgacagagcaagactccatctcaaaaaaaaaagaagggaaaaaaatttcaagtattggaaattcttagtagcaaccaaaacattaaagaaatgacagctcattgcaaaggagagataataaagaactcagaaaagtacagtaatccaagcaatcaatgttattctaatactcttttgcaaagccagataaactctgcactgagtttctgtgacacaatactaacttcctccaaatatctaggacccaaccgttaacacacttaagaacacatgactgccgggcacaggtaatcccagcactttgggaggccgaggcgggcagatcatgaggtcaggagatcgagaccatcctggctaacacggtgaaaccccgtctccactaaaaaaaaaaaaaaatcagcccggtatggtggcatgcgcctgtagtcccagctactcgggagggcgagacaggagaatcgcttgaacccgggaggcagaggttgcagtgagccgagatcgtgccactgcactccagcttgggcgacagagcgagactcggtctcaaaaaaacaaaaaaaaacaacaacaacaaaacacatgaccacctctagagtacctctccattagaaatacttgtgagtgtcaaaatgagcagctgctgcccattctcaccttaactggaggggtggttcctgtaggatgtctgcggatctggcagccattctggctgggcctctgcggcttgttgttcagttggggcttcttgacagtgcctccatgatcatttctcacagaatcaaccttctcagcagttgttttgcttaaaagctgattaagacacatgaatgagattaatgctcttatcaaagcaaacaaatatcatctaggaaaagtccccttctgagcacagttttccaactcatctaagataataatagtaaatagtgtaattcttattaaaaaaacataccacggagctgttggcatctggtaggaattgtccaaactctgacaacaaatcttcctggtttttaaagagacgagcaacctgggcatacacctcctgctctgtcaatgctggagtgtagtttcctccagcttccttggcatttctctgctctttctgaggaattgcaaatgaaaagagatcatttgggctactgttttgagtcactcatctttgcacgctttctggaatcactgttatctatttaggctgcatgtaagaagaaagtctatgttcttagcacccgttctgaccacagactttcaagttgagaaaaaaaaaaagttgaagatggtggatgacaattcctttcaaaactagggtagtaaatatttttgagacggagtttcactcttgttgctcaggctggagtgcacttgtctcggcctcccaaagtactgggattacaggcgtgagacaccatgcccggcctagggcaataaatattaatgcccaggggaccactaccaactgacaaaaccttagaaatttctcctcctcctactgtacattaactagactatataaatcaccatctaactgtcccagataaaactgagtttcatttcatgggacagtgactaacaatcctgactgaggccgggcacggtggctcatgcctgcaatcccagcactttgggaggccatggcgggtggatcacctgagaccagcctggccaacatgttgaaaccccgtctctactaaaaatacaagaaatcacttgaacccgggaggtagaggctgcagtgagccgacactgcactattgcactccagcctaggcaaaaagagcaaaactctgtctcaaaaaaaaaaaaaaaaatcctgactgaatgttgcagggcaatcaagtcaggcaaataaaactggctttatagcatgggggcggtggctcacgcctgcaatcccagcactttgggaggccaaggtgggcagatcacaaggtcaggagttcgagaccagcctagccaacatagtgaaatcccatttctactaacaatacaaaaaattagctgggcgtggtgggcggagcctgtaatcccagctactagggaggctaaggcaggagtatcacttgagcccgggaggcggagactgcagtgagctgagatcgtgccactacactccagcctgggtgacagtgcaagactccgtctcgaaaaacaaacaaacaaacaaactggctttaaaaacatgcatgatagtttctaactggttaatttccagtatgaattaatggacacaataatggttacttgttattggactagatgccctaagagggtgacctggttaagacaggctgaatgggcactccttacctgatatgtgtgcaaaatctccaggaatgctttgtagatgtctggttggccctgaaatctgttcttgatcttattaacatagttgatggcatgattaaactccacaggttgattgttctgcaaggatggggccgttcccaacgagattgtcactggtgtgtgaggctggaccggcggagaacgtggggatgcatacggtggaagtgggggagtctgctgactggccggagtatgtgcttgcagttgggagggctagaaagaaaagaaatctttattctcttcagatgcatagatgagttgatacaaggaaagttcaaactaaagagaaacaaggtgtcaacgtatatcctttatttactcactcaggccaggtcattttagtccaacacaaatcatactgggcagcagtgggagttgtaggcggttcaaacatgctgatacaaatatttcagtctcacattttctaaataaaaccttaaaactggagccatctccaattacagggaagaatttttcatatgcaatgttttagcttagtagctcaacaagtacacatagaaaaaatctcattctacatagccttttgatgtcaacaacaagacaactgttgcagtagctccacataaaaaagtcttctacgccaactctgtcctgtagaactgagatgatggaaatgtcctttatttgcactgtcttatacatagccaccagccacatgaggttactgagcacttgaaagctagtgcaaatgaaaaactgaatttaatttaaatagtcctatgtggctagtggctactgtgtcagacagtgtggttctagaccaagaacaccccatcttcatcaccatcactatcactattcattagatcttctacttagcttgatataatctagttagtgaaataactttcataaaataaccatgtgggcagcagcacaatttgaccaggataagacgatggtttctatctgtgctgtcaactactactacacaaagtcaccacctgttgggatgttcatggttttataagcagaaactgtaaaaagaaagaccttgaaagttgttgctgtgttgatttaaatagatacctaagtaagtgatgtgtaaatgtgaaccatgtcatagtgaagttttcatacagcatttttctatgacgaaatctttgtaactttgtttctcagtatctaagtcttatataaaggggaaacatcaaaggaaggtgctctctagggatgcattcatattgatgcaatattttccaagtgctcaccttgctgactttggcaggtgggggctgaggagctggctgggcaggagctggggctgactgggctgaaggctgggaaggatgttggggtggtggttgaggctgtggctggatgccatgggtgggaatctgatgaacctggccaggagttgtcacattcaccatgtcattggtttgcacctcaattttgtagccagggggcaagaaggtgttgaatcccattatcagatcggggtggcctttgaatagctgggacacacgactaatcactcctggggtgtcgatgctgataaaaaacaaaaagaaaagtgataaactgtaagcttaacaaacaccctgttaagaaaaaatttcatgtttttttttcttttgagacggagtctcactctgttgcccaggctggactgcaatggtgcaatcttggggtcttggctcactgcaacctccacctcccgagttcaagtgattctcctgcctcagcctcccaagtagctgggattacaggcatgcgccaccatacccggctaatttttgtatttttaggacaggtggggtttcaccatgttggccaggctggtctcgaactcctgacctcaggtgatccgcccaccttggcctcccaaagtgctgggattacaggcatgagccacctcactcaaaatttcactttctactaggttttctctaaacaggaaaacagatcatctacgcattttaaaattaacacacgaactctgaaattccaaagccatttagttttagactcaaagatacttggccacaatttgttttttttttttttgagacagagtctcattctgttgcccaggctggagtgcagtagcacaatctcggcacactgcagcctccgcctcctgggttcaagcaattctcctgcctcagcctcccaagtagctgggattacaggcacccgccaccatgcccggctaatttttggaatggtcaaaatttttaacagaatatatgttcattgtaataattctaccaagcagatactcagatgatatatataaagctacatatcccaaacaagattcactctttgatataccagtatacatcatttcagcacacatctacattgttcagatgagttacactcttacaacagtgaaccatgccagaatataagggtatctaaaccaattcagaaaccaagtagcctaaatcactaccagtgctacttccctgattgagacaaaacactggaaaaaatttagttaaggaaaatttaccaatagggataaaaaagtctagtggccataatttccatcaataaaggtatgcataaaataaaggcatgattttgaaaattcagctgcaaaaaggagcatcctttatcttccagtaaataaactatatcctcttccttccaaaatcaatatgccagatacaaagcttgagtacaatcacacatcttttacctctgagatttaaattccttcatgatgtcaaggaaatcattgtagacctgaggctgactaccaaactgcagcttcacctggtcaagataagatagcgcatcctccacctgaggcagggataaatatcaaggttataaaaagaaagtaagctcataattacaaaaaaaaaacaaaaacaaattatttatgcctaagtatgcttaatgcagtaaatgaagtaaaaatatattaaatatatacttaaaagttagtatggataccaataataaactcaagcttaaaataataatcaactcataaaatctgtagccttgccttggaaaattttgaacagaatgatcagtgaagaataattacaatgatatatcatttattaattcatttcacaagtatctactaaactgcaacataccaggcccaatgtgagtaccaaggattcaatgacaaataatttgtagcccctcgtctatagacatttgtttgtatgtagtcaggaatcataacacagtgggtaacccggtaatcactccatgcctggagatgacatgggaaggacacgtcttctccaccaaaaaaagtgaggcttccccaggaggtaatgtataaactgagacctaaagatgactataagctagcaaaagtgaagaccagtgaagaaaatcaaaagcggcagcacgggtaaaatcctagacaggatacgatatgggatatttagaaatctgaaaacagtttagtttggctggaggatctgtagtgaagaggaaggaaaagtaacaaaatgagacagaaaaaaaagcaggatctagattctgaaaggatttgtaaatcttgtgaaaaagcaatttagatttttatcatctgcattttcgtgtacgcaatttgactgcagtgttgagaaaaaattggcacaagagcagaaaagattgaaaggaggtaggaagaccaggtatgctacaggaataactggacaactcatgtgaaaacagtggcttgaattatagtactggcccagaacaacagagagaactgcatagataaaaaagctttttgggtagtagaagtgacaggattggggaactgactgaatagaggagctaagggagagccagcattcaaaagtgatccgccacggagcactgaggaagaacagtcaagagtgactctcggaccgatcaaagcccacatgccactgcatcccgcactcagcgcttacatccttccacatcaccaccacacccaagagaaagcctgaaggggatgctaaaggagatagagccaaggtgaagaacaacccagagaagatccgcaaggttgtatgctaaacctgctcctccaaagccagagcccaaccctaaaaaggatgcaggctgggcgcagtggctgacacctgcaatcccagcactttcagaggcagaggtgggaggatcatctgaggtcaggagttcgagaccagcctgaccaacacggagaaacccatctctactaaaaatacaaaaattagccaggcatggtggcgcatgtctgtaatgccagctactcgggaggctgaggcaggggaatcacttgaacccaggaggcggaggttgcggtgagtcgagatcatgccattgcacaccagcctgggcaacaagagtgaaactcggtctcaggaaaaaaaaaaaaaaaaaaaaagtcccctgcaaaggagagagaggaggtacccaaagggaaaaaggaaaatgctgacactggcagggaggggaataaccttgcaggaaatggagatgccaaaacagaccaggcacagaaagctgaaggtgctagagatgccaagtgaaacatgtgcatttttggtaactgtgtacttctggtgactgtaaagtttgaactataaagttatgaagtttgtaaattttgaaataccattgtttaaatcaagctttataaaaatgcagaattttgttttgctttttctaaagcagtgttgttatcgcacacagaacacttcattgttgttttggtgggaaggatcacaggtcactaatagaatgtctttgaagctggactgacgtggggaaaacacctttcccttctagttttgagagacttcctcttggcttatagaagaaattccctgactttatttacttatttatttagagacagagttttgctattgttgcccaggctggagtgcagtggtgcgatcttggctcactgtaacctctgcctccggggttcaagcgattctcttgcctcagcctcctgagtagctggggttacaggcacccgccagcatgcctggctaatttttgtatttttagtacagacaggatttcaccacattggccaggctggtctcaaactcctgaccacaagtgatctgccagcctcagcctcccaaagtcctgggattacaggcgtgagccaccacacccagcctagattccctgacttttaacacacatggccaccttggcacaaacaccttgtgggatggaaaaacaaattcatttttacatcctgttctccctccccaccttcacagacctaactcccttttacccagacacctgttgggacctaacccccaataactggttaccaatatgtcaggcagtcaaactttccagtgatgccactgaaatggcagccctcaaaagagcagtggttgctttttctagactgtggatcttcagataagtcctgccattttcatttcacttcctgaaagtcagggttggcttgtgaaaagttgttaaacaacatgctaaatgtgaagtgtcaaccttcactctaaactttccctgttcagagcatcaaatgagacttcactgggttttatagtggcttttttttttttggtagctcattgttaaggattgtccatgttctgcctgaaataccatgactgtttttggaaagtatctttaaagctggatacagtttggctgggggagaaaaaaaactgacctatcacaaagaagaacaggttggaaaggctaagctatgagtctgatttaggacagagacacccaaaagaaatccccactaggtgtttcctatttactctgagatacgttaagttttattttggtagtttaactgaagcctaaatatttaaaattatacaaaatatcaggtttaagaaatttcagaaataaacatttgatgtgatttaagccagtctttttcttttttttttttttgagatgggagtctcattttgtctcccaggctagagtgcaatggcgcaatctcgggtcactgcaacttctgcctcctgggttcaagtgatatctcctgcctcagcctcctgagtagctgggattccaggcgcatgtcaccacatccaactaatttttttgtatttttagtagagatgggatttcaccatgttggccaggctggtcttgaactcctgacctcaactgatccgcctgcctcagcctcccaatgtgctgggattacagatgtgagccaccacacctggccaggcatagatagtcttttgatttgttgcaaaatggaacatttacattcaagtcaatcattaactggtgctgtggtctgaaatgtgtcccacaaaattcttacatcgaaacttaatcaccgatatgatgatattaagaagtgaggccttcagaaagtgattgtggagccctcatgaatgggattagggaccttataaaagggctggagtgaaccagtgttagtcccttcggcccttctcccttccagtgtaaggacacacattcagggaccatctcgaaaaacagagttcaggccctcaccagacaccaaaccaactggcacctggattttattttattatttattttatttattattattattatttttttagatgaagtcttgctcttgtctcccaggctggagtgcaaaggcacgatctcagctcaatacaacctccgcctcccgggttcaagcgattctcctgcctcagcctcttgagtaactgggattataggcgcctgccaccacgcccagctaatttttgtatttttagtagagatggggtgtcaccatgttggccaggctggtctcaatctcctgacctcgtgatccgcccgcctcggcctcccaacgtgctgggattacaggcgtaagccactgcgtctggcctatttatttattttgagacatggtctcactctgtcacccaggctggagtgcagtggcacaaattcggctcactgcaacttccacctcctgagttcaagcgattctcgtgcctcagcctccagagtaactgggattacaggtgcatgccatcatgcctggctcatttttttgtatcttcggtagttttaccatgttggccaggctggtcttgaactcctgacttcaaatgatctgccctcctcagcctcccaaagtgctgggattataggcgtgagccaccgcacccggccagcaccttgattttagatttcccagcccccagaacttctccagaactgtgagaaataaactgctattatttagattatacagtctcaggtattttgttatagcagcactaatggattgagacaaatggccgcttttttgtttttgttttttttgagacagagtctcgctctatcgcccaggctggagtgcagtggcgctttcccggctcaccgcaagctctgcctcccgggttcacgccattctcctgcctcagcctcccaagtagctgggactacaggcgcccgccaccacggccggctaatttttttttctatttttagtagagacgggatttcactgtgttagccaggatggtctcgatctcctgacctcgtgatctgcccgcctcggcctcttaaagtgctaggattacaggcgtgagccaccgcacccggccccgagacaaatggctgtttaagagttcttcagacttccattacggccatggttaatcagtgtttcggtgttgctagaaatcagattgtatagttggtcaatacccacttgtttgatggttagtttttctatacaaatatcatgacaatttctgttgaaattcaatggactattttaattcatattctgaactttccatactaaaatgtttcattaatgaccaacttaagtgaacacaaaatatattaagtttgcaaaaggaaccaagactttggaagatatttaagaatagcatgcatcattacacaacaaaagaacagttatcaataagacatggtatggtataaggtaactactgcagagacggaaaaagtacagaaacccaaaagaaagcaattatgtgtgatatgtatatgtctgaaacaaaaaggtactgaaagtcacagcaaaccaagcaaaccactgtttaaaaattagttataggccaggtgtggtggctcatgcctgtaatcctagtactctgggaggccaaggagggtggatcccttgaggccaggagtttgagagcagcctggctaacatggaaaaaccccgtcctagtaaaaaaaaaaaaaaatacaaaaattaggcttggtggtgcatgcctgtaatcccagctatttgggagactgaggcataagaatcacttgaacccaggcaggggagggtgcagtgagttgagatggcgccactgcactacagcctgggcagcagagtgagactctgtctcaaaaaaacaaaaaagtaaaataaaagttatagaataatcctatgctttaaaaactctgcatgacactcacataataaataagacacctacatgtaaaaatagtgaggaaattctctcatcacctaaagcatagtccaactcttatataaactctctataaatgcatgtatacagttctaggtagcacaacttaaaaaaaaaacttggatgtagttatttagaagctacagatttaaggaagcacttggggagacccttagactctgctgataaagtttcttagctcacttcaacagggatttactattaaggccccgaatctcctgaagtctacaatcttgttgggagagaaaaacacaagcaactgtaaagataacctgctaaatatgtaccaaatatcactgctgctgacattcaataactaaataacaccaaacatgcctcaaatcgttcaaatcccttcttgtcaccaccaatctaccaaagacaaaaaacaaaaaaaaaagacaatgttgaggcttgaaataatgtgtaagcattctcactgaacatttctttttttttgtttgttttttctgagacggagtttcactcttgtcgcccagactcgagtgcagtggtatgatcttggcttactgcaatctctgcctcctgggttccaacgattctcctgcctcagcctcctgagtagctgggattattacaggcatgcgccaccatgcctggctcattttgtatttttagtagaggcatggtttcatcacatttgtcaggctggtcttgaactcctgacctcaggtgatccacccacctcggcctcccaaagtgctgggattacaggtgtaagccaccatgcccggcctacattattatagaatataaatgatttattgaagttgattcaaatgcttgtaatgcattttaagactgatccaaaaatgacaggcaatgtgggaatactgagttaaattacatggaggtacaagaagcattttacctctcctcatcagaaaggaaattcaacaagttattttatgcaggaatatagtcaagagcttgtgactaaaagaacacaacaagaaatcctaactctatctatgactcactctataaccccaaatccaaaacctttccttgtttccttgccagtttccataaagcaaacaaaacataatccatatacttataccaaagagtcctgtgaggaaggtgggtaaaaactggtgttgtgctttgatagggttgattgaaaaaggctatagaaatacatatgtttttgttagtttaataagcaagtttataagctattttgcaacattaaagtataactactgaatatacagtgttaatacagaattaaatcacgcacaaccaagttttaaaaaaaatattttcaggacttagtaaagtgctaagcccgcagcaataatacattttggtacacagccatcactctacaacagactgaaaatgttttaaaggaaacatcaatattccttatacacattttcccaaagacagaatccagagtgaagcttcaggcctaaaaaacctgtactctctttaaaaggctatgcattagtcaatactatgtaagccaatatagagagtaaattttacaaaattactctaaatcacatagctttgctgtactttataatatttatgtagcatttaatactcttaggccaatattaaacaagttcccaagaatccacaccaacgagggcagggatcaagaagaactaaagtaagtatcagggaaaacagaagaaacaactatttgctgcatatggatatgtccttagagggtttatttctcattcgtgcctgcaagcaacataagtaggttgcaataaccaaatgaagatttaacatctcttcagagttcctccatttattatttcctgaacttaattttatataaacgtaaaattagaaaaattgaaacctgaacacttgctgcaacaatcacatattttgaaaagtaacattcaagtggtcagagatacaaggttagctgggaacacaagcttcacttctccagggatgcctcatgaatttcaaagcactgaaaacgtaccacacatactcagcagaaaatatgaaaacactgataattcattcacagttacagttttccctgaactttataaagattccccccaaaaaggagcatgtgttttactaagaatggacttgatgatgtgagtcaattcagctattcataaacaggaataaaaagataaaggtaataagaacattacaggcatgagctgggcatagtggctcgcacctgtaatcccaacactttcgaaggccaagatgggagaatcacttgaggccagcagtttgagaccagcctggggaacacagtgagactcccatctctgaaactaaaaactaaaaaaaaaaatttttaagaatttaaaaagattgaactgtaagatatattactgggccaatttactgtactaacctgtagccaatcatatatgtgctcaatagagagttcaaaaggaagcagccaaaaaatgaattttaaggtttattttgtattaaaatggccccacaatcctgataacatttgaccgacatgcattcatacagtccacaaacatttgagtatattcttctctggatcaggcactgatgccaagataggaaacataagcaaatttcacaaaacaaaaacggtaaaacttgtgattcgacagctagtatctcaggttagaagttgtaccaccacaaccaacaagctgcaaccagtatttcctgctaaagataaattttttgacccaagaaaaagagctgaataccaccttcagcctctgaaattgctgctgtccctgcactggtgcaactggtggggctggatgagcatgactctggaccacctggcctccgtggggctgcaccgctgttgggtgatgatggctgctatgaactgctgctatagcgggcccatgactgccggagctctgtggcatggctgaaacctggggtgaacaaaatacagacaggaaacttcaaggcttgtacattcttccccaaatgagtctaaataactaacacaaatgcacaaagataattaattggaaacccaaatttctgctgggcgtgatggctcacacctatctcacctacataggaagatcgcctgaactcaggagttcaaggctgcagtgagctatgatcatgccactgcattccagcttgggccacagagtgagaccacgtctctaaaaagagaaaagaaagcctgggcaacatagtgacacccatctccacaaaaaataaaaacttggccaggcatggcaacatgcacctgtggtcccacctactccagaggctaaaggaggaggattgcttgagtccaggagttcaaggctgcagtgagctgtgatcacaccactgctctctagcccaggtgacagaatgagaccgtctctaaaaaaaaagaaagaaaagaaaaagaaagaaacccaaattttccacaaaaggaactggttaaataaattacagcccaccaaagttataacaaaattatttgtagctattaaaaattatatagccgggcacggtggctcatgcctgtaatcccagcactttgagaggccaatgcaggcggatcacgaggtcaggagatcgagaccatcctggctagcatggtgaaaccccgtctctactaaaaatacaaaaaattaaccaggcgtgttggcgggcacctacagtcccagctactcgggaggctgaggcaggagaatagcgtgaacccaggaggcggagcttgcagtgagccaagatcgtgccactgcaatccagcctgcacgacaaagcaagactccatctcaaaaacaaacaaacaaaaaaatatatatatagtttagctgggaacagtgtctcacacctgtaaccagcactttgggaggcccaggcagacagatcacttgagttcaggagcttgagaccagcctggccaacatggtaagaccctgtctctactgaaaataccaaaaaaaatagctggacgtggtaacacgcatctgtaatcccagctactgagaggctgaggcacggtaatcacttgaacctgggaggtggaggttgcagtgagctgagatcatgccactgcattccagcctagaaaacagagcaagactctgtctccaaaaagaagaaaaaaaattatatagtttatctcaaactgtctgtggtaaaggatgagtttttttcttaaaatttcaatccatcagggaccacaacttttataaaaatccaataaaaataaattactatgaaagtgaaataaaaaatacataaacccgccgggcgtggtggctcatgcctgtaatcccagcactttgggaggccgaggtgggcggatcacctgaggttgggagttctcgagaccagcctgaccaacatggagaaaccccatctctactgaaaatacaaaattagacaggcatggtggcgcatgcctgtaatcccagctattcgggaggctgaggcaggagaattgcttgaaccagggaggtggaagttgcggggagctgagatcacgccactgcactccagcctaggcaacaagagtgaaactccatctcaaaaaacaaaacaacaaaaatacataaacccgtaattttttttcttacctttttattgagacagggtcccgctctctcacccaggctggagtgcagtggtacaatcatggctcactgcagccttgacctccccaggctcagatgatcctcccaccccagcttcccgagtagctgggactacaggcatgtaccaccatgcctggttaattgtcgtactttttgtagaaacagggtttcaacatgttgcccaggctggtcttgaactcttgggtatggagtccacctgccttggcctcccaaagtgctggggttatagacgtaagccactgtgcccagcctgtaactttcattactggattttacaaataaaaaatgatcatgtccaattgctctaatagtttctaaacaatttctatacttatgccattacaaactagtaacaaaggatacagattagccatttttaagccacacttcaacaatgatatatatggatatatttgaatctgaaaaaaaagttcataatccacaagttgaacatattcatgtactgtatataaacttttaaatagttttttaaagcacattacactggctgacaaagaccctgtctcaaaaaaataataaaagcacattacaaagcagtatgataaaaagatttcaaaccttagacaactaatatatagcaaaatgttggcatttaatcttgtggttacagaattaaagatgactcttactttgtttctttttgtttttgaaacactctcgctctatcgcccaggctggagtgcagtagcacaatttcggctcactgcaacctgtgcctcccaggttcaagcgattctcctgccttagcctcctgagtagctgggattacaggtgcctgccaccatgcccagctaatttttgtatttttagtagagacagggtttcaccctggttagactggtgtcgaactcctgacctcaaatgatccacccgtcttgggctcccaaagtgctgggattacaggtgtgagccaccgcgcctggcctacttggcttattttgcttatcttgatttgctacgagcactgtatctaatgtaaaataaattttttccccctaattcttgatggtttggcctcaaacaaatgtcttttctattcttttatctcagtctttctcctgtcctcttacaagtttgaggaaataaaagccaaaactactttccttctatatctatttcaagaaatgctacaaaatttttttcagaacttttttcctttttcagaattgttgatcaccacagaagacaacaatctgtccaaatgcccaaatgccccatccccaaaataaggagactaaataacatgaaactttctttctctaaacaatgttaagttttataccacaatttaagagagaataaaactttttttcaaatcctcacttttataaaaattatcctggagggagatgaagaaatgagggagagggagaaaccaagcaactatgcataaatccacagaaacaaaacaaggtgtattaagagtaaaaagaaactatttagacaattctaaaagctctaatgtacctcaaagatgggctagtattctgagcttctgtattccaacatgcatgttttttacagggtttacaggctttcactagactgacttatacaaacacattatagtttccattcggaagaaatttaactatcccaaatgtagaaaacagtcattaacctgtttagataatgaaagtaatcacccaaggtaaacaagcaacttttttttcttccaagtcctaaaagatgccatctgttggcagtcttctgactgctgccccagccccacaggaagggattagacagcctcaaggggactcctgaggaagagtgacacctaaggaatcaccatttcctacttcagctgcatttcctcttctttatatttttatactaaattcctagaaatggaattgccaggtcaaaaactaacaaaaccatctgacacaaactgccaaattgctctcaaaaaagattacgtcagtttatattcccattaccagccgtacatttttaaggtcactaacaaatgaggttgaaggcctccccagaccagttatatgctgaagtagaaagatatccactatatattaaatgaaaagagcaaacagcacaatagtatgtaatgtatgatccacattgtacaaaaagaaaagcagaaagggcggacgaggtggctcatgcctgtaatcctagcagtttgggaggccgagtcgggcagatcacttgagtccaagagttcaagaccagcctgggaaacatggtgaaactctgtctctatagaaaaaatacaaaaattagccaggtgtggtggcatgcacctgtagtcccaactacttgggagactgaggtgctaggattgcttgagcccaggaggtgaagggtgcagtgagctgagatcatgccacagccttccagcctgggcgagagtgtgactctgtctcaaaaaaaaaagtaaatttagatagctagacaggttgatatagatgagcttgtatatgcatataaaactggatacccaagaaattcaccagtgggagaaaatctgaggtgtgacagaaaaaaagtcattttatatcctttttttaaaaaaaaatcaaagtgtggcagggtgcagtggctcacacctgtaatcccagcactttgggaggtcaaggcaggcagatcacttaaaaccaggagtttaagaccagcctgcccaacatggcaaaaccctgtctctactaaaaatacaaaaattagccgggcatggtggcttgcgcctgtaatcccagcgactcaagaggctggggcatgagaatcacttgaacctggaagccagaggttgcagtgagccaagatcacgccactgcactccagctggggcgacagagcgagacaccatctcaaaaaaataaaataaggccgggtgcagtggctcacgcctgtaatcccagcactttggaaggcagacaggcggatcacctgaggtcaagaccagcctggccagcacagcgaaaccccatctccactaaaaatacaaaaattagctgggcgtggtggtgcacgcctgtaatcccagctactcgggaggctgaggcaagagaatcgcttcaacctagaaggcagaggctgcactgagccaagactgaaccattgcactccagcctgggcaacagacagagagtctgtctcaaaaataaataaataaataaataaaataggctaggcgtggtggctcacacctgtaatcccggtactttggaaggccaagaggggcagatcacctgaggtcaggagttcgagaccagtctggcccacatggcgaaaccccatctctactaaaaacacaaaaaattagccaggcatggcagcaggtgcacgtaatcccagctactcgggaggctgaggcaggagaatcacttgagcccgggaggcagaggttgcagtgggccgagatcgcaccactgcactccagcctgggtgataagagcgaaactccatctcaaaataaataaataaataaataaataaatgaataaaataaaaaataaaaaaaccaaagtgatacattactttcataataaaaaagggcaaaaaccaaatttcttcacttctacaaaacagagtaacagatgaatgatcagtgttggtcaggacatagaacaggaatatacaatgcttgggggaacttgctaaagatgcatataccctgtgacacagcaatccctttcataggtacttgacaaactcttgtatgtcctcaaacctgctgactggtttccaacaggttaaggagtttgcaccacaatgtaaaccaacgatggtagacccttgaataacacgggtttttgttttgtttttaaggagacagggtcttgcactgttgtccagtctgaagtacagttgcttgatcacagctcactgcagccttgacttcctgggcttgagcaatcctctcacctcagtctcccgggtagctaggactacagatgcacaccactatgcctggctaattttttatttattttttcaaattaattaattaattctttctttttgagacaagttcacactctgtcacccacgctgggtgcggaagcatattcactggagcctcaacctcccaggctcaaatgatcctctcacctcagcctcccaagtagctaggaacacaagtgtgcaccattacgccctgctaatctttatttttaggagagacggggcttgctatgttgcccaggctgatctcaaactcctgggctcaggcaatcctcatgcttccaacttcgccaactgttgggattatgggtgcgagccactgcactcagcaacaacacaagtccacttatacatggattttctcccacctctgccaaccctgagatggccagactaacccttcatcttctttctccctcctcctcagcctcctcaatgtgaagacaaggatgaagacctttatgatgatccacttccacttaataaatggtagatatattttctcttccttatgattttcttagtattttgtttcttctagattattttaagaatatagtatatgacaaatatacaaaatacatgctaatcaaccatttatgttatcggtaaagcttctggacaataggctatttgtatttaagttttaggggagtcaaaaattatacattggccagacgcagtggctcagacttgtaatcccagctctttgggaggctggctgggggaggatagctttgggccaagagtttaggaccagcctgagcaacacagcaacacctcatctctacaaaaatcataaaaattagccaggcatggtggtgtgcacctgtagtcctagctactagggaggctagggcacgggaggactgcttgagcccaagagtttgaggctgcagtgagtcatgatcgcaccactacaccccaacaggggccacagagcaagacactatctcctaaaaaaagaaaaaggaaaaaagttatacatgtatttttgactgcatggggggaagtcagtgcctcaacccccacactgtccaagagtcagccatatttcactacaatgatgtttaattcagctgtcttttttaaaaataaatagcaaaactgtcttaataagtgcgttgatttaaattctggcacaagcttcttattttgtcatgaattgccactgagtgcactaagacaatatcacaatgttcacagcagcacctttgtaaaagcaaaaacctggaaacagcccaatagtccaacagtagaattgacaaataaattgagtatatgcatgtaatttacactacagtgaaaatggtggaattacagcgatctataaaaatatggggtttttaaaacaaagtgagtcaaagaagaaaatgtttccatttatataaaagttcaaaaataccgaaactaaacaattatgttagtttttttaagtaaataaagtcaagggaatgataaatacaaagtttagatcagtggctacctctgaagggagggaaaagaagggagcagagtgggatacgcagggaacttcaaaggtcatgacaacattctttttttaaaaacttgtatggtgagtacacagttatttttttttttaccttacacatactcaacaatttttaatatctaacacagtattaaaaaaagttttataattgcctaaaaccactatttctcttccctcattctagtcccttggttggctccagcttacctggtagctgggtgttacagagtactgaattcccgtagctgactgcatggtctcagacactgcttcatacacaggaggggcaggggcaagcacccggtgctggtgaggaaaagcctctgtgctgccagggatccgacgctgctgggctgcatacaccggtgactcctggtcatccaaacgccgcttcattctgtgctcatgctcagggatgcactacaaaacctgcagaaaccaaaagcaatagcatgcaagtcaattctcactccagtatgatgtacgccacttaggaccagtcacccaagtttagtaaaagcttgactcccagaactgatcatctatttcatcttagtgatgaagtttaagtgcatgtgggcataccaccccccaacacagtgaacaagttataactgaaaaagacaaatatttaaataacataattttaattaatttggtattatgaagttgaaaaatacgctccaatttaaaaatataaacacaaccttgtttccctttattctctagttttctcctcaaatgctatcactcctaatattaattacatatctacatgctgcaaaaatattcaagtgcttcttctttttttttttgagacggagtctcactctgttgcccaggctgagtgcagtggtgccatctcggctcactgcaagatccacctcccgggttcacgccattctcctgcctcagcctcccgagtagctgggactacaggcacccgccaccacacccggctactttttttgcattcttagtagagacggggtttcaccgagttacccaggatggtctcgatctcctgaccttgtgatccatccgcctcagcctcccaaagtgctgggattacaggcgtgagccaccgcgcccggcctcaagtgcttcttcttaaatcctctcaaaacctactactataattgtggtctaatttaaaatttgtttcaacaattataatggtatcatggaaagaataccgtgccaggaatgggaagacaaagattctagacttgccaatttaagatgctacgtaacttcaacaagttcctcattctatgtgaatttcagtttctccaactataaaataagaaaagttggaacagatcactcctaaattttcttctggttttaacagttataagaagagattctcttagcttaataatacctccgtgggagacaatttcattcctgcaggacacagtaatctacttggcccagtaatctacttgggtcttcagagcttttccatatcagtatcactaacacaagcataacacaccatcagtgagaaagaatgaatcagccatccaaagaaaaaaggccccaccacttttccagtcccaaaaaaatctcttaaataagataccactgctatggaaagaagataaaatttacagtaatagtgggagatttggcaagccaccccctcatctgaaatacggttaagttaaaaaaaaaaaaaatctttacctaattcataagtctacccaagatcttttctttatcctctgggagcacacaagccctgaagggaaagtagtctttacaaggactctccatggctgtttcaccttttctttgtcctcactatagtcctcaatctgcctgccactctaatccttagctctgaaatcctgtctcaggtttttctcacatttcacatacctaagtgggaccctgacacagcagcacaacccattaatttgcaagctggctacttttatctatttgtaaactcaagccacaaatatgctctctgtggcctatataacttcagactaagtctctcagctttgtgtgtgataatatgtggaactcagttaaatggagttgagaacgtttctgacagctgctgaggacaaataatttaaaatgtcttagctagttatgctttcctatgtttttctagcatgaaatagcatgtttagcttagtattcaaaaaccttttagacatattaagaggttgagtatatagatttatgcatgttatttgccactaatcaactacgaacactaaacctcagcgtgttttgggatgaggaactgagtctaatcacaggtagagtaaaatgtctttttagctatttcttatatacgttcatgactttcagtggtttggtcttgggttctgttggtttaaaactgatgcttaactcatcggagattaacctctgtaaccaaaaatgaagtcaatactttattggccggatgcagtggctcacacctgtaatcccagcactttgggaggctgaggcaggcagatcacctaaggtcgggagtttgggaccagcctggccaacatggtgaaaccctgtctccagtaaaaatacaaaaattagccaggtgtgatggcgcacacctgtaaaacctgctacttgggaggctgaggcatgagaatcgctagaatccaggaggcagaggttgcatgaggggaggtcccaccactgcactccagcctgggcaacagactgagactctgtctcaaaaaaaaaaaaaaaaaaaaattatagaaatgttatgatagggcagcactgggtttaaaaaacaaaaacttcataggctggtcacagtggctcacacccgtaatcccagcactttggaaggccgaggtgggtggatcacctgaagtcaggagttcgagaccagccaggccaacatggtgaaacccagtctctactaaaaatacaaaattagctgggcatgatggcacgcatctgtaatcccagctacttgggacgctgagacgggagaatcgcttgaacctgggaggcggaggttgcagtgagcaaattcgcaccactgcaccccaggctgggggacagcgcgactgtctcaaaaaataacaacaacaaaaaaaaactttataaataataagccaaaatcagatgtgaagagcacggcacgactatagaaaaaacactagagtaccttttaagaactggattctgttggatgggagaatgtttgagggcaaaaaataaaaacaaacaaaaaagaactggattctactccaaactctatctaccatgaagctttctaattttggccctgttttcaaacaggggcaaaaggaggggatcagcctacattagtgatttccaaatgctggtttatgaaccagtctataaggaaaaagaagattgtagtgagcttttcatacattaagtattacagtactatggtttattctgatatcatactctatcttttggctgttaaaatatcgtttcttttattaagtgattgggatttcatatggtacttaacttcatccacctccagagtttgctttccataccacctctacaacactacagaggctgaactttctctgaaccatactttattcctttaacaattaccactcataggccgggcgtggtggctcacgagatcaggagatcgagaccatcctggctaacatggtgaaaccccgtctctactaaaaatacaaaaaattagccaggcgtagtggcgggcacctgtagtcctagctactcgggaggctgaggcaggagaatggcgtggaccgggaggcagagcttgcagtgagccgagatcatgccactgcactccagcctgggcgacagagcaagactccatctcaaaaacaacaacaacaaacaaacaaacaaacaattaccactcaaagttctattcctaactctctctcaaataaattgcttccgctctaatcatacctcctggtttcaggccctgatcatccttcacaacaaccttataagcaaggtgttctctaatttatgaatgaggaaactgaaaaacaaagattaagtaaactgcccaaggttgcacagctagtaagaggcaaagctgtgatataaatccaggaaatctgtctccagagcctggctcttaactacttcactaccttacctctcacagaagagaagaagtgaaggaagaatccctttacttatttaaggcacacatgcagggagcaagttcagctttttttaacctttcacacacttagctaactcatccttcttcagcctaaacctaataaagcagaaatgctttagtagcattcattcattaaaagcaaatgttcagtgagtagatatgaagttggtagatgatttcagcccttgccctctaaaaccatatatagcctcactagtaataaaaaacgtgtaaagtaggccgggcgcggtggctcatgcctgtaatcccagcgctttgggaggccgaggcaggcggatcacttgaggtcaggagttcaagaccagaccggccaacatggtgaaaccctccctctactaaaaatacaaaaattagccgggtgtggttgtgggcgcctgtaatcccagctactcaggaggctgaggcacgagaatcacttgaacctgggaggtggaggttgcagtgagccgaaatcgcgccactgcactccagcctgggcaatagagtggaactgtctcaaaaaaaaaaaaaataaaaggtcaggcgccgtggctcacacttgcaatcctaacactttggttcgccgaggcgagtggatcacctgacgtcgggagtttgagaccagcctgatcaacatggagaaactctgtctctactaaaaacacaaaattagccgggcatggtggtgcatgcctgtaatcccagctactcgagaggctgaggcaggaaaatcgcttgaacctgggaggcagaggctgcagtgagccgagatcgcgccactgcactccagcctgggcaacaagagcaaaactccgcctcaagaaaaaaaaaagtaatttactccaaagcaatttaaaaaaaaaaaagatgacagtgtgggtaaggatacagggaaacactgatggaggaggctttaattggtacagcctatttagctggcaacttgtaggtatttattaaaattttaaatgtgcatacccatcccatgcatattatggaaaactatgtaagaatcagatcaaagtttatccacgagtataagaaatgaactctaaaacatactagattttggaatactgaaactatcaattccactttcaggcctgtatcctacacatctgctgagtatatttattgcagcaaaatatgaaaatctaaatatctatcagctaaataaatgtgatcatgcatattatggaaaactatgtaggaatcagaaagatcagggtttatccacaagtacaaagaatgaactctaagacatattaagtgaaaacagcaggctaggccggatgcagtggcttacgcttataatcccagcactttgggaggccgaggcgggtggatcacctgagtttgggagttcgagaccaacctgaccaacatggagaaaccctgtctctactaaaaacacaaatattagctgggcgtggtggcgcatgcctgtaatcccagttactcaggaggctgaggcaggagaatcactcgaacccaggaggtagaggttgaggtgagccaagatggcgccactgcactccagcctgggcaacaagagtgaaactacgtctcaaaaaaaaaaaaaaaaagaagaagaaaacagtaagctatagaatacatacagcatgatctcatgtatgtatatatacacatacaaaatgtactaaagatttgtacatttcattgtatgtaaaatttgcattgaaagaaaaatgtgcctgggcacagtgattcatgcctgtaatcccaacactttgggaagctgaggctcaaggatggcttgagcccaggagctggagaccagcctgggcaacaatgggatgaccctgtctctacaaaataaagaaacaattagctggaagtggtggcgcacaactatggtactagctactccagtgactgaagtggaaggatctcttgacctcagaagttgaggctgcaaggttgtagtgagcagtgataacgtcactgcactccggcctgggcaacagagtgagactctgtctcaaaaaaaaaacaaaaaaaacaaaaaagaaaaagacaaagaaaaaacatgctagccacgcacaatggctcacaaagtgcctgtaatcccagcactttgggaggccgaggcaggcggacctcttgagcacaggagttcaagaccagcctgggcaacatggcgagactccatctctacaaaaaatacaaaattagccatgcatggtggcatgtacctgtaatcccagctatttaggaggctgacgtgggaggatcatgtgagtccaggagacagaggctgaggtgagctgagatctcgctactgcactcgagcctggacaaaaaagaaaaatgctataaacaatattaaactctagataatgataaacatgctcaagtgcttagatgaagtatactaatgtctgcaatttattttgaaatacatcaaaaaatcagattcattgatggagcgatggatagatggacaggcatatgttaaacctagtagtagaaaaatgataatggtaaaatctaggtagtgtgtatatgggtgttcattatatttactaaaattctatcaactttgttgtgtatttggaaattttcttgataaagtcttggaaaaaaacatccacaggttctgaggattaggaaaaaaaaaaacaggaagaaaagccaacaatacaaaccagctcttgagtggaaaaaataagtactataaattgggaaagggatacagacaggtacacttgggaagactctataaaggtaaatattcagctacatcttgaaaattagagatgaattagaacacaggggtatagagcatgaaattaaaatagtaagtttagacttgcaggcaatagttatttacaatctttgccaagtcattcatcccacaaataattagcaagtgcttaagacatgcctggccctgtgcggagggttagaagtccagcactgagccagagatttcctccccgacaacagccaagtcttccatgtatgactgctatcagctgatgtcctcctcgcaacaatcctgtcagataggcagtcccagaaccctttttttttttttgcaatagcataccattatgtccaccaggctggagtgcagcagggctatcacggctcaccgcatccccaacctcctgggctcaagtaatcctcccacctcagcctcccaagtagctgggacataggcagcgccaccatatctaacttttgtattttttgtagagacagggtctcgatatgctgcccaggctggtctccaactcctggcctcaaacaatcctcctgtcttggcctcccaaagtgctgagattataggcatgagccactgcgcccagccagacccctctttttttgagggaaactgatactcaaattaaatgacttattcaaggtcacatacctgactaaaagagcaagaggttaaattcttcctccttggaatatgaacaatctaaagtagaaacattggacaagactgtaaaaccacgcttgcagaggggtacagtgtaattctagaatataaagaaagccaaacgatggaaccacaaagtcagccacaaaagtactgtcaagtcccgcttcagccaacatggttgatctccatctgtttcaaatttggagtttatagtactatcagaactctagtctaggaagacattataaaaagaaaaaaaaagcactttgacgtatagaaactatggagagaagactaaataatggcagcagaacatttaaaggtcacctggtgggcacagtggcttgcacctgtaattccagcactctgggtgactgaggaggaaggatcatttgaggccaggaggtggaggttagattaagcaagattgcaccactgcactccagcctgagcgacagaggaagatcccaaatacacacacacaaaaaaaacacctacaggtcctaaaagtcacctggccatgtgttataataaaactgggcgcggtggttcacacctgtaatcctagcactgtgggaggctgaggcaggcggatcacttgaggtcaggagttcaaaaccagcctggccaacatggcgaaactctgtctttactaaagcacgaaaaacaaattagccgggtgtggttgtgggtgcctgtaatcccagctactcaggaagctgagacacaagaatcgcttgaacccagggtgcggagggtgcagtgagctgagatcgcgccaccgcattccagcctggttgacagaacaaggctctccgtctcaaaaaacaaaacaaacaaaaaaaaaacgggtgggatgctgggtgtagcagctcacatttgtaatcctagcactttgggaggccgtggtgggaggattgcttgaggccaggagtttgagatgagcctgggcaacaaagtgagacaccgtctctacaaaaaaattttattaaaaattagctgggcatggtagtgagcacctgtagtccttgctgcttaggaggctgaggtgggaggatcatttgagcctgggaggttgaggctacagtgagctgtgattatgccactgcactccagcatgggtgatggaataagaccctgtctcaaaaaaacaaaagtctatcctggtcagtttgtttaaatgcatactcttagaacaaaaaataaaataaataaatgcatactcttttttgcttatttttaaatgcatattcttgaaacaatggaaagtttctcttcaaaagcaaacttccatcgcagtattaagtcaatgtaaacttcaacccagtgcaattttgagtagtctaattcaaaatttgtccaaaagtccacctctggttttaaatctgctaagaaagaatctattacagaatgaaaggcactctatttagatttcatatattgattagaattattgcttggaaaaattaacaaccagctcttctcaaaagacaccattagatctaatatccaagcctcctttgaactcagtttttatattcttctaatgcagtggtcctcaactaggggagattctgcctcccaagggcacatgtagtaatgatggaagacatttttggttgtcacaactcgggaagatggaatgctactgatatctcacagatagagtaaaaggatgttgtcaaacatcctacaatgcacacgacagtctcctcacaacaaattatttggcccaaaatgtcaacagtgtgtgaagactgagaaacctaagtttaatcataaccccaactgtcacatatcttttttttttttttgagacagagtcttgctctgtcacccaggctggagcgcagtggcgtgatcttggctcactgcaagctccgcctcccaggttcatgccattcttcggcctcagcctcccaagtaactgggactacaggcgcctgccaccacgcctggctaattttttttttgtattttttagtagagatggggtttcactgtgttagccaggatggtctcgatctcctgacctcgtgatccgcccacctcagcctcccaaagtgctgggattacaggcgtgagccaccgcacccggccatcaatgcttcttttacggcatatgatacacctttaacccgcattataccattacgcattggccagacactctgacctaaagttttttagaactcttatctttttttacgcctggtctcctttcgtccctctcttaggcttgatctgtaaaactcttctgactcaaaattttagagcttttctgataccataatgctcattaaatctgtaaaaattaaaaataacgccaagtgtggtggctcacgcctgtaatctcagcactttgggaggctgaggcgggcggatcacctgaggtcaggagttcaagaccagcctggtcaacatggtgaaaccccgtctctactaaaaacacaaaaattagctgggcgtggtagcgggcgcctgtaatcccagcaactttggaggctgaggcaggagaattgcttgaacctgggaggcggaggttgcagtgagccaagatcacgccaatgcactccagcctgggcaacagagcgagactccctctcaaaaataaataaataaataaataactttaaaaaaaccccatatcgttattacttactattttaacaagaatgtaagtagcaaatttgtttttttttttgagacacagtcttactttgtcacccaggctggagtgcagtggtgcaatctcaactcactgcaacctctgcctcccaggttcaagcaattcctgtgcctcagcctcccaaagcagctggaattacaggtgtgtgccactacacctggctaatttttgtatttttagtagaaaaggggttttgccatgttggccaggctgttctcaaactcctgacctcaagtgatctgcccgcttcagccacccaaagtgctgggattacaggtgtgagccaccatgcccagccttaagtagcaaatctaaatttttattccgtactttcctggacactgggagatataaatatccaaaatgtgcaacatcctttaaaatgcaaccaagtactcatcaaatgtcatgcatgaacttggaacacagccattctataaattttttgtttcttttaagaaacaaggggtcgggcgcggtggctcatgcctgtaatcccagcactttggaaggccaaggcaggcggattacgaggtcaggagatcgagaccatcctggctaacaaggtgaagccccgtctttaccaaaaatacaaaaaattagccaggcgtggtggcaggcgcctgtagtcccagctgctcgggaggctgaggcaggagaatggcgtgaacctggaaggcagagcttgcagtgagctgagatcgcgccactgcactccagcctgggtgacagagcgaagactctgtctcaaaaaaaaaaaaaaaaaaaagaacaagaaaaagaaacagggttggccaggtgcagtggctcacgcctgtaatctcagtactttgggaggccaagtcgggtagatcacgtgaggtgaggagctcaagaccagcctagccaacatggtgaaaccccatctctactaaaaatacaaaaaaattagccgggcatggtggcgtgtgcctataatcccagctactcaggaagctgagtcagtagaattgcttgaacttgggaggtggaggttgaccgagatctcgccactacactccagcgtgggcaacagagccagactccgtctcaaaaaaacaaaaaacaaaataaaaaaaaaacagggtcttgctctattgcccaggctagagtacagtggcatgatcatagctcattacagactgctgggctcaaacaatcctcccacctcagcttcctaagtagctgggactacagagtggctaataagaaaaaaattttttttagagacagggtctccctacattgcacaggccggtcttgaactcctggccacaagcgatcctcctgcctcagcctcccgagtagctggtgtataccactacacttggcttccactctgtaaacaggtacacaccaccacgcttggcttccattttgtaaattttgattccaggtttcaggtacagctctagtaaggttctagcttatcacctctgggtctttttttccctttctgcccatcaaatgaaatactttgaaaactcacttcataattttgttggagagaacagtcatcttctttgctccataatcataagcattctcatttttagactaataaatgtcaatcagaatgaacaatccaggctgagcgtgtggctcttgcctctaatcccagcactctcagaggccgaggcgggtggatcacgaggtcaggagattgagaccatcctggctaaaacggtgaaaccccatctgtaccaaaactacaaaaaattagctgggtgcagtggcacgcacccgtagtcccagctactcgggaggctgaggcaggagaatcgcttgaacccaggaggcagaggttgcagtgagcaaagaccatgccactgcactccagcctgggtaacaagagtgagactctgtctcaaaaaaaaaaaaaaaaaaaaaaaaaaaaaaaaactgattttttttttcatttttacataatttttccttctaaccatctttatacatatacgtaactttggcacctgtccacttacaaactgcatcaactaagttttggtgtacaaatatcttgaaagatgaaagaatactatcatacatctttttggcaaagtgcagtggttttgattgtttttttttttcatttcttaaaaatagaaatggggtctcactatgttgcccaggctggtctcgaacgtctgggctcaagcgatcctcccacctcagcctcccaagaaggtgggattgcaggcatatgccactgcacccagcccagttctgattcttataaaaagaaaatcacattctagctggatgcctatagtgccagttacttgggggaactgaagcaggagaacagcttgagctcaggaatttaaatccagcctgggcaacatagtgagatagatcccatctttaaaaaaaaaaaaaaaaaaaaaaaaattcaccgctgggcatggtggctcacgactgtaatcccagcactttgggaggccaaggcaggtggatcacctgaggttgggagttcaagaccagcctgaccaacatggagaaaccccatcttttactaaaaatacaaaaaattagccaggcatggtggtacatgcctgtaatcccagctacttgggaggctaaggcaggagaatcccttgaacccaggaggcggaggttgcggtgagccgagattgtgccatggcactctagcctgggcaataagagcaaaactctgtctcaaaaaaaaaaaaaaaaaaaaaatcacattctaaactcatctagggtacagtcacatatgtatatgggtggagacagaatcttgctatgttgcccagcctggttttgaagtactgggctcaagtgatcctcccatctcagcctcccgagatgctaggattacaggtgcacgccaccatgcctggctgaagactcttattttacaacttggtttatataactttaccgtcatcctaacagtctagagtactactgtcacacagcattcatctactagttcctctgaaatgtcttctgtagtcagttttcttctctttgccattataggaggaagatgaaaaactatggatttttaaatatgtccaatgaaagcttaaaagttgaaaaatagtataaaaattaccatgtactccttcacctagattctccaaatgttaacatcttacataatgtttaagatggtatctcccaacttcttttatactttcttgaaagatgctgtaggctgggcatgctggctcatgcctggaatcccagcactttgggaggctaaggtgggtggattgtttgagcccaggagttcgagactagcctagacaacatggcgaaacgttctctctacaaaaaaaatacaaaaattagccaggtgtggtggcacatgcctgtagtcccagctacttggagggctgaggtgagattgcttgagtctgggaggcgaaggttgcagtgaactgagattgcgccactgcactccagcctgggtgacagagtgagaccctgtatccaaaaagaaaaaaaaagttgctgtaagttttgggaaaagcaataagaaaactgaagggctgcggtgcacacctatagtcccagctaccgaggatgcttaggagggatgatcacttgagcccagaagtttgaggctgcagagagctatgatcataccactgcccttcggcctgggcaacaaagcgaggccccatctctaaaaactgaagtgtaaaactaatgatttatttcactactgcatatccttttaagcaattctataattctccctttgtcatattattttagtcctctttagcatatttgagaattgatgagtaatgatgaaataattcctaggatgatgaaataccaaaacatttcaatatacaggaaaaataagatcagtaaaactccacaacattgtttcgatgtacaagtggtaatagctaaaatgagtttattcctttggaaaaaaaataaattttcaggctgggcatggtgactcatgcctgtaatcgcagcacttcgagagataagaagtttgaggccagcctggccaatatggtgaaaccccatttctactaaaaatacaaaaattagctgggtatggtggtacacacctgtaatcccagctactcgggaggttgaggcaggagaaccagttgaacccaggaggcggaggttgcagtgagccaagatcgcgctactgcactccagcctggggatggaacaagaccgcatctcaaaaataaaattaaaaataaaaataaattttctctttgctgttttgaagacctccaataaataaaagtcatgaaatatacatctttacaagtagttagtactgctttaaaaaaaaaaagcaaaactcaaaaactaaaattgagtccagaccaggtgcagtggctcaggcctgtaatcccagcactttgggaggccgaggtgggcagactgcttgagcccaggagtttgagaccaatctgggcaatacagacttcggtgacactgatgttacccagacatttcttactactgtaggtagaaaatgaacagaaatttagttaaattcaaaatgtattaataattgttatcaatgttgattttctgatttgatcactgtattgtggttttaaaagatgcacttggggaatctaggtgaagattatagggctattatttgtattatttttgcaactctctttgaagtctaaaattatttccaaagaaaaagttttttaaaaattaagtattaggccaggcatggtggctaacacctgtaatctcagcactttgggtgtctgaggcaggtggattgcttgagtccaggaagaccagcctgagcaacatggtaagaccctatctctatttaatataagaaatataatctttcaaaatatctataaggccaggtgcagtggctcatgcctgtaatcccagcacttcgggaggccaaggcaggtggattgcctgaggccaggagttcaagacaaggctggtcaacgtggtaaaaccctgtctctactaaaaatacaaaaaattagccaggcatggtggtggcgcctgtgatcccagctactcaggaggctgagacaggagaactgcttgaacctgggaaggggagattgcagtgagctgagatcgcgctactgtactccagcctgggcgacagagcgagacactgtctcaaaaaaaaaaaaaaaaaaaaaaaaattagccaggcatggtggtgggtgcctgtaatcccagctactcgggaggctaaggcagaagaatcacttgaacccaggaggtggaggttgcagtgagctgagattgtgccaagccgagattgcaccactgcactccagcctgggagacagagcaaaactccgtctcaaaataaataaataaataaataaatagctgggtgtagtggcgcatgcctgtaatcccagctgctcgggaggctgaggcaggagaatcacttgaagctgggtgtgtgtatgtgtgtgtgtgcaatgagccgagatagtaccactgcactctagcctgggcaacacagtgagaccttgtctcaaaaaaaagaaaaaaaaaaaaaaaaaagaaagaaagaaaagaaaatagagcattacaaagaatagaacttgagatagttcttgaaaggacaggtggaagtgtcactcacatctcacactgcttttatcacattagctcttctgctcccacacaaacatgggcacataacatctttaaccatctatgtatcctctaccatgctcagcatactgctttgtcttgtctgtggtggaaaccaaatcattcattcatgtatacattctctaatatctactgagcacatactatgcaccaggtgttttaggagctggagatacaacggtaaacaaaaatctcttccctcaagaagcttatattttagtgaaagatgacacaatagacaaagtataatatttagaatagtaggcagtgacaggtatcaagaacaaaaggcaaggaagagtttttgaaattgtagataagaatggtcagataatacctactgataaggtaacttctgagtaaaggaagtgagggagctagtcatgcagaaattagtggaggaagccttctaggcagaggggacagcaaccgcaaagaccctcatgtctttgtgagggctcacatgtgcttgacatgttccaaaacagcatgaaggctgggtagctgaagaaaaacgaaagaaggactagtcagaaatgtagtcagagaggtactaggataagggtggcaggcagagggtacatcagatttgttcttacaggtgtttttttattttttgacacagggtctcattttgtcgtcaaggctggggtgcagtggcacagtcatggctcactgcagcctcaagctcctgagctcaagcaatcctcctgcctcagcctctcaagtaactgggactacaggcacgcgccagcatgcttggctaatttttaatttttttatagagacagggtcttgttatgatgcccaagctggtctcaaactcctggactcaaacgatcctcccacttgagctcccaaaatggtgaaattacagacatatccttttttttttcttttgagacagtctcgctctgtcgcccaggctagagtgcagtggcacgatcttggctcactgcaagctccacctcccgggttcacaccattctcctgcctcaacctcccgagtagctgggactacaggtgcgtgtgccaccatgcccggctaactcttttgtattttttttagtggagaccatgttagccaggatggtctcaatctcctgacctcgtgatccgcctgcctcagcctcccaaagtgctggtattacaggcatgggccaccgcgcccagctcattacagacatatctaaataaggactcaggtttaatactcagactgaaatggaaagccactggatggttttaagcagagaagtgacacggtatgacttaggtttcaaaagaatcacttgggttgctatgttgagaacacatttaagagccgcagtaacaaaacaaggagaatagaatccaagctagagatgcacaggcactgactagggcagtggagatgcagatcctaagtggtctaattctggatagtattttgaatataaagcagtaaaatttactgatggaccacatatgaaaaagacacagaagagtcaacaatgtctcttagttatccaagaggagacatcgagtggagaccttgagtgggccactaaacatattagtctatggtagagggagagatccccgttagagtcatcagcattgtttggattttagaaaggtaatatggtacatatactgtatcatctctctctcccagctagggctgagtagctccccataatcaagcagtcacatttctgcatcatgcaggatagcccaggtcaggctgtaccccaaaactagttgtggaactagacttaccaaaaaacaaaaactcttgcatttcagaactgcaaataaaggatgtggacctgcatatcctccaatagcccatatgtcagcaagcctagccctggaggacaccaagaagactcatgaagggtccactgtcatgctgagaaatatgggtaacatacaagcatacaagacaaaaagtgggtagggaaaacaaaagcaaaaggggcaaataagaaatacatcaggtagaaattgccacccatgaccgggcacggtgactcacgtcttaatcctagcacttttgagaggctgaggcagaaggacctcttgagcccaggagttcgagaccagcctgggcaacacagcaggacttcacctctataaaaatataaaaaaaattagccaggtgcgtggtggcacacacctgtagtcccagctacatgggaggctaaggtaggagggtcgcttaagtccagaagatcaacactgcagtgagctgtgatcatgccactgcactccagcctggtgacagagcgagacttcgtctaaaaaaaaaaaaaaaaagacatgagaaaaaaagacattatgcggccgggtgcagtggatcatgcctgtaatcccagtactttgggaggctgaggcgggcggatcacgaggtcaggagtctgcgaccaacctgatcaacatggtgaaaccctgcctctaccaaaagtacaaaacttagccaggcgtgtggtggcgccccagcttcttcttcgtggaggctgaggcaggacaatcgctagaacccgggaggcggaagttgcagtgagctgagattgcaccactgcactccagcctgggagacagagcaggactccatctcaaaaaaaaaaaaaagtctagtgcctaacacagtatctgtgacacagtaagtgctcaataaatatcagcttttatttttcaaggggcgaggaaggtgtattttgaaaaagcatatactatttatttttttaaaggcctacagaaagtaaagcttaacaaactcttggctggtggattgcccagaaaagagagaaagccatgaaaagcactatgctaaactactgaatgccagggatataacctcttaattccagttaaaattcccaggtactaacatctgccatgcacagctctccagtgtcttgtctgctcccactgaagatgtaaaaagaattatacttcaccaggaatcttgtcaaattactacacacctccttccttaaaaaagaaaaaaagtctttctctgtatgtaaattattaaaaccctcttaattacgaagtgccaatctttctaagctatttatctctgaacaaaattatagtatataaaataattatctggagattatgaagcatttatgaaaatgttcctaatacagcaaaaccaggttcttacttgaatccttatagactcttctgtgttccccagtatacagcactgcaaatcatgggaactatatatgtagcccaaattttcctcaatggtcaatcgttctccactatctctctcagtttatggcatcagaaaaaaccacctggattttttgtctccccaccaattctattacagccatcatttgctaaactaaaatgctattgcttttgcaacttccttagcagagaaggtaggacccacctacccttttcacataaatatagcacagggtaccactcaggccctactaaccaaagcacaaatctagaatttcacttcagataattaaccagaggctcatttagacattactgcataaataaacattggttccatgtttatttttctcatgaaaaatgtgaaaaacattgaaataatttctctcaataggaaaagataatgtatcaagtgaaagcaaaaacctcatctaatgtggttctgctatctaaatctgaaatgccctaaggcaactctccaatacaggctggagggcaacgctacagaagtcacatacagaaggctaccctgatccacaattccaccctcctctgaaataaaaagggcaacaacactgtactatgtagagtataaatagaaagtggtctagatggtctaacataagtacataaaataaaaaagaaaagacttttcacctatagttacctaaatagcaaattctttaggaaaccaagtttttttggttgttttttgaggcggagttttgctcctgtcgcccaggctacagtgcaatggcaccatctcggctcactgcaccctcgcctcccgggttcaagtgattctcctgcctcagcctccccagtagctgggattacaggcgcttgccaccacgcccagcttttttttgtatttttagtagaaacagggtttcgccatgtaagcctggctggtctcgaactcctgacctcaagtgatccacctgcctcggcctcccaaagtgctaggattacaggcatgagccaccgcgcccgtccaggaaactaagtttatatagcagaaccatgtgcacaatgaaagcattcaaaaatacaactgtcagagatatcggagtattttattcaaagtctgagttcttaaaaaaaaaaaacaaaccctactttataaacagaccagttttgagattaaaatgtaaatccaaactttcctgttataaatctcagccttgtaaagaggaggagcttccactgccttttcaaggctaacttcgtttaaagtcctaacgcaccgaaacagacgccaagtctactacccaccacccattggctcaaaggaagccccgccccgtacagccacggtaactgaacatcaagggaaccccagggaaggttttccctccgccacatttctagtctctgatgactccctgcccctcccctaccatcaccaccgcggatctagggttccagcaccagccacgcacgctcctacaagaggaccttgggcacttcgccccaatagttacaaccaagaggggagtgggggtgaccatgctcccactctcctggctgcacggtgccagacacgctgcatggagcaaagcggagaaagcagctccggcacagggcccttgtgcccccaggcagaaggcatgacccagccacaagagtaagtcctgacacctccacagctcccagtcggcgggtgcccctccctccccacggagacatagggcggggcagatctaggcgccgagactcccagccagacccgacagcgggctttccctagcacctcctcattgccaaggaggcggaaacccggggcctgggcggggtgcagggggggacggccaaggggagtggcatcacggatcagtacggcccctccggccaaccggatcccaagaaggcggaggaactcagacttcacgccccctccctgccgcgccctgaatctacacgcgggagacccccccctacccctccccgaccccagcaggccagagcgcggccgccagcccgaggccccgcccaccccaggaggaggggagggggtggtcggccgcaaactgcactcagcgcgaagccggccccgcccctttctccacaatcgcacgcgcgcgccggccccgcctctgagcggcggcgcgagagcccgcccccctccgcgcgcaccgggactacgctctcctccccctcccgcgcggagagctaccccgctccgccccccacccccctcacacaaccacacacctcccgcccgtctgctctacgggaagccgaggaggtcagccccccccccccaaaatacacaccctcgagtccggcgttacccgccaccaggctcccgcccggcccccggcccagcgtgctctcaccgcaaagctgcttcggccgctcgtcactgcgtgtccctctcagcgtgagccgcgagctcagcagggaggccccgagaacggcgcggggcacaggcccgccgaagcggactgccagctacctctccactaacgaagcggtcacaggctccggtgcccagactgg

SEQ ID NO: 925 - DNA, 12837 bp, Homo sapiens; identical to SEQ ID NO: 923

SEQ ID NO: 926 - DNA, 12837 bp, Homo sapiens; identical to SEQ ID NO: 923

SEQ ID NO: 927 - DNA, 12837 bp, Homo sapiens; identical to SEQ ID NO: 923

SEQ ID NO: 928 - DNA, 1240 bp, Homo sapiens
attaaaaagttgcacttacaaagcagttggggcatttattgacatttaaacaagggaggagatcctgaacactagtctcgctcagtttataaaaacttgaggccaaactctccatcatctgtacacagcttaaccacggccaggagcaagaattcgagttaaacgaattgaaccagtccaaccacaagacgataaagggaaacagggcgtggggatttccagtttttccttttacattacaaagtttccaacacaagaagccaacaataccccagtgctgcaccaagttacttcccactgtttcccaaggcacagtcaattaataatcagtagtccaagttctaagaacattccctggaaaacaaggacgcacctcccgtggctctatgcatggcctgccactgatgaatcaaattcttaagaacctacgaccgtctgatacccttgaggagagcaccctcatagaatctccagcatcaggcctcagttttcccatctgtaaaagacagccatgcaaagtgggagatccgctaggcttccagatcgaagtcatcgcgctcctcattgtactctagcacgtgccgcttgatcttggacgagtccacccaagtgacaaagtcctccatgctgcgcgtgacaaggaaggcggggtcggtaaccacgtcagggcccacgcgtacgtgcccttgctccacaaaggccacggcagcctgaaggtgctgcgccatgcgcagcttgaggagcacggtggggaggcggcggcggcagaaggacgaggccgtgacgaagtcgcagagctccagcgaaccgcgcgtgggcaccaagccgagagcatacagcttgtccagcagcgcggccgaagcgcgcacgcggaactggtcgcgttcgggcaggtcgcgcaggcgccgcgccagctcacgcacggcacggctcagctggttgtagcgcgtgtagtcctcccgccgctgcagccggtaacgccgcagcacgcgcagctcgtgcaggttgtggtcggtgacctcccagttcaggaagtccacctgcttcagcagcttctgctcgtggaacttaagcttccgcaccatgatggcggcagccgcagccgcaggacccgaagctgagagcgcgttctggcatccgcgcgatttccgccgcggcgccccaagacctggacggcctgggaccctgggccaatgaaagaaagacttaaagtcacgccctcacttcccattggccaggg

SEQ ID NO: 929 - DNA, 38528 bp, Homo sapiens
atctagggtggggagcatttattttaatttttgtcttgcagctctttgtagaggacctagcctttctctactgaactgaaggggtttggtcccatcacccgaagactggcccacctgcccacacaggtgggggcacaggaggtctgggaggccccaggaggtggaagttcagaggcctgcctggccctgtccatcccactggctgaggccaggccggagggccgaccccaggggccctctgtatgcaagccgacgcagacaagggcccagtgcatagttaagacacaaacaccacacagctgtccagagcctccaaagcactgtttatccaggctccatggaaccaagtgcccccagctgcctgccctagtcctcaggggggcactggcaccgcagtggcctcggcctgagaccctcgatgagccccagcctaacctgctccaaagccactgacacatgcatgtttagcccttggcccatcaagatggggccctgggaatgaactggctgcagaccctcctccatcccacacccccaggggctccatcagtcctggctagctcagcaccatgttaaatagcttccttgcaatctcccttaaataaacccatccccagagcaacctacccaccctgcaccctgaatatattatcctattggcttatgccttctagactggaggcgctctctcctcttgccctctactccaggggataccatctccctaaaaaaccaggggaggaagtttttttctcaactctggggcagagacaaagggtggcctgggttggagtggaaaagccaggaatagcttcctctgtcccttccctccccagggtacttccttctccttgccctcttagcagcctgggtcaggcgcgacttacccaaggtcacagacccaggacccagagtcatgacccatgtaggaggttaccctggttttgacagcccaaaccagctccagggcaggaggactgaacttaagcctgcctccaccttggcccctgcagttctccaggctcggagtgagctgagggaggttccagctcttgactccactctgtcccggacccctgggactatctcccaggaccctccacccctggtgtctccaggtctctcttgctctggggatactcagacagcaccaggcatggaagcaatggggcccgggacatgggcaagcctgtccctggcccgatcagcatctgggcccaggccaggcctcacacccagtactggccattcttaagggcagggttgggtgtccggcagaactgcagcagctctgggtcaggctggcctcctggagggggcccctggccaggcacagctgtgagcgggatggcctggcctggctccaccttgcgaaaggtctcggtgtcaccagccaggccgttgcggggcttggcagtcaggacctggacgtcatgcttgcccgtcttgttgcgttttcggaggtagaagagcaggggcaggatgagcgccaggagcagaagtaccaggcacatggggatgatgacgctgaacatgttggcctcaaggaagctcaggaagcctcccttggccacagcgggctcagggctggatgccatggggcctggctcgcctgtgggggtgctgctctctggcttccctgcttccgtccgggcggcctcggggacactgagcagggccacgctgtagggccgggcagcattgtaaggctcagtggcaaagtccagggaggccacagcaggcgggacgccctgtgcccacagctccagagtgagactgtcacctgcggggccgggggccctcccctctggcctgcccacctccagccccagcctcccgtcctcaaggtcctgctgagtgaactgctccaccagctggctgcccccgggctccgtcctggctcggggcacgcggaccacgcggccatgccggggtccctccaggaggcggaagcgcggcacactgcctgtgcggttggccagctcgccagcatctaggacggtggggtccaggcgcagggtggcaccctggggccatggcccacctgcccacacatgcagcagagccctcacagtgacgttcactacggctgatgcattgacacccctagccagtgccaggactctgaagtggtcatgagaggaggagaagttggtgaaggcaaagaccacctcgccctggtctatctggaattggctgaaggccgaggtgggccgcccgcccaccaggagatgcccatactggggtccctggatgaggcggtatgctgcctctggctcctcccgatctgaaaccacccggagctgctgctggctcagtgaggagcgccccaaagcttggggcacctccaggggtgcccgcagctgcacctcgatggcggatggtaggatgtccacagccagggacatgggcaggggtgggctggccccatcagacatgctcagctggaagatgcctgccacgctgctcccgttggccacgaaggccagccgccctgaatccacatcggcttgcgtgaagcgggtcacgggccccaggccaccacccaccaggctgaggaagccgttgtggggtgcccgctggacctcgtactcaatctccccaggagctgagtctgggtccaccacactcagctgggcccgggagatgggggcacgagagcctcgggtgagccggagtgggacagaggcctgtggctgagggggccgctcatttacatccctcaccgtgatggcaaaggcctctgaggtttggggtccagccacggaggcccctgctggcccctggaggtgggcacgaaagtggaagccatcctgctgggtgcccccaccgccgtgggcatacactagctgccctgcagccagctgggactgcaggaagtggggctgcccagcatggaggggctcctcggacaccaacagctggccccggctggggaactgtgtgacctggaagagcacatcatgctctgagcgctggggtgatggaacgctggccaagagattggaggcatccagagcagccacggtgatcctggcccgctggccctcggggacccagagacctgggggtgggacataggctatgagggtccagcccactgaggggagagtgatggaccctcagctgggggtgcctcagggcaaggatgtgcctccccccaaccatcaagccaggtcctccagggtggggctcagggttcccaggaggataaggactatgtccccgctgtgatgtcaaagcttccccactcaccctccctgtgacttcccaggtcctgggggctgagacaggagctgctgaccctggcctcgtgtcccctcctcctgggcctctcccattgtccctccccacaatcttgccagcttatcatgctgttcacctttgttcttccagaggtggctggggcgctggggacaggcagcctcaaaagacacagccacagcaagggtggcggccacgtcccgggcaggcggcgaggacagctggagctctagggtatcatgggcctcccaaaagggctcggggggcatctcatgctcatacagaatattcccagcgtagacctaggggagacaccatcgtggggtgagaggcaggtccagcctgtgttgtccagacactgagcacttttgtctcctcaggccccactctgggctctcctgggtgtgcccaggtctgtgcgtgtgacccgctgtctccctcactaactcactgggtcacatcaggcaatgcagtgcagagctgggctctggagccggagcctgggctcaaaccccaactctgccaccctggggaaatcgcctaatttctctgacctctggggaatgcaatgatctgtctgtgctgctctctaaagcgagtacttcctcttgtgcacaggatcctatcccctcttgccttctgaagacaccacttctactgtctcttggctttctcctatggtgtcagttccccccagatgcatcattcccttcattatgcaactatgctattcttttgtctcacttacattaaagctatttaattaattattattattattattttgagacagggtcttgctctgttgcccagactggactgcagtggcgtgatcatggctcactgcagcctcgacctccagggctcaagcgatcctcccacctcagcttcccaagtagcggggactgcaggcacatgccaccacacccagctatttttttttattgtttgttgagacagggtctcactatgttgcccaggctggtcttgaacttctgggctcaagcggtccacttgcctcggcctcccagagtgctaggattacaggcaggaggcactgcacctggccagaaaaaactattcttgacttcacattttccaccagcttcacccctgcccctttgcttctctttgcagcaaaacttcaaaaagcatagtccacgctctcccccaggcattcttgggtctctctacccaggattttgctcccccatcgccacatctccttttgccaagggcaccagaggcctccgtgttgttggatccagcggtcggctctcagcctcctcttaactgctcagtggcactggtgccgccaagcaacccttcctccaagagagccacaggctctgggatacttcactctggggttcctcctacctcacagactctcctggctggtcctcctcttctccccaacatcttatggccaggtctccaggctcttttctgtctacaggcactctccatgagtccttattcagtctcctggcctcaaatgccagctgtgctgagacccccttatttgtagctccagcctagcctgctctcccctgaaccccagactcatgtttccagctacctctgccgatatctaatagacacctcaaactcaacctgccccggctgcactcccgatcggcccccacctcctacagtcatcctgcttcagagactatagctccgttttcaagggctcaggccacacccttggaaccacccttgcatcctctctttccctcaaaccaccgcatctctcacctggattatcgtaacagcttcctgtgtcccagctgcagtcccccgcccattacattttgttcctaacacagcagccagagtgagccttttgaaagggaagattatggggctctttggctcacatagtgcagtgtctccccatctgaccactaaggcctggctgtgaccatatcacccctgcgacctcaactcccctcacctccactccagacacacctgctgttctatggtgctgcctgcagttcaacaccaaagaatattcttcgctccaggaagaaaaacggttttctccacctccaatcacaatgtgttcttttggcctatcttttgctccccacccacccttttttttgagacggagtcttgctctgtcgcccaggctggaatgcagtggcacgatcttggctcactgcaacctccacctccacctcccgggttcaagcgattcccctgcctcagcctcctgagtagctgggactataaatgcgtgccaccacgcccagctcattttttgtattttagtagagatggggtttcaccatgttagccaggatagtttcgatctcttgacctcgtgatccacccgccttggcctcccaaagtgctgggattacagctgtgagccaccgcgcccggccttattttccccttttaggaaacactgggaactattttcttctcagagaaaaacaggacttgcccaatagtaacatggaaacttaacagggtcttaacctgtgaagactctaggagcagaacccggagtaagggggagcaggggccggagtaaggggagcagggccccgtctaagatggggcagggcctgggctaagggagagcagggccgggctaaggggaggcagggcccagtctgaggtgggggcagggcctggtctaaggggagcagagcctgggctaaagggcagctgagcccagtctgaaggagagccgagctatctgaataggggctagcacctgttctaaaggaagtggctgctcccctgctttcgctgtaagagggaacacaggccttttaagaaaatgggaatcaagttttttgtttaatttcccaaaggttatatgttgacaattaacttcaaagtattagctgctttttgtaggccaaataaacacgtctgtgggccagatctggcccaggactagagttgccagtggcaacttctggcccaggctgaatggtgggcaggaaggaaatggagcccccaggagtgggagtgggagctgatgcctgggtacgggagctctgtgggtgggagtgagacaaaaaacagggtcttgagctctggggagcaagcagtgtcctccagtgaaggaaatcctggactcgcaggcagaagttttgcctcttactcgccatgtgctctgaataaagttacctgccctccacgagcctgtttccttatctgaaaaatggggacacctgaccccttccctgcccagtttagtgttgtgggacagggctgctgtcaagacaatacccagtcctgccctcctcccagagtgggccagggtagcccacgtagcctcttccctgctttcctgggtggcactgccagcctgaccccctggtgtccattcagtctagtccttcatatttctggggcacggggaagctctgagtaacgtgggactataaagtgcaagagggttgctgatggcctggtcccgtgccctctccattcctgggcattcttgacaaaggctcccagcaactgagggtacgcagcagctgcagacaccagcctgacaaatatctcattgtggggagggggccatagcaggagtggggagccagggaaatacagaacctgggactgggaggtgttgatgtgagaagcccaagaaacttcattccacctgtcaaagccacctccttccagatgcccaaatctgagccacttgctgggcagggactttgcctttgcacttgctgaataccatctgcacctctcaggagggagagtgccaggctcaggagtccctgccgagctaggaaagggggctggggtgggctctgccattttttgaaggctggcagggggacccctcaggaggtacttggggcagtaccatatgctgtggctcctgagtgagagtcagctctgcgccccacaagaccactccctacccagaattcactgtcatcatgtgctgggtccagatgcccatgcagcctcctggcgggagcatcacatgtgccgcctgcctgggatggcccatggaagagtctgccccgctctgccctgctatggaacaactcctgttctgtcttcagcgagtggtgttcatttaagtgatgactgggctggcccccatggcacagttatcacagagagtctgctgctacccatggctgagagctctaattcttcctggtggtctctgaagccaccaggacggatgaacagcagcttcaccctcttggctgactcagctgcctttcatcagctcatctgcccctaggatccactctgcctctggctggcacttgacctgagccccaggctcacacctctgcccacaggcccagccgctgcttcacgtccaactccatcccccaccaagcactgcccctcatcagctactggggtaccactagtgcccccacatggtgccccctctccagaccctcgggtccggctgtagcttccttctggaagctataccccaagaccccagccctgctctagggccctgtatccccgactttctgcatccttctccctccttctgggaacatgaacttgccctgccagcctggcggctcctggaggacaggacactagcgcctggacaatggcaggcccgggaacgtctgctgccagtgatgctggagctggcatccatgtccacatgatgtccatggcacagcggccacctgaggctgggggcatctgagtggtggctgcaaagttgggcccttacctctgcctgagtgaagttcaccagggcctcccctgtgctgtcctgctgggcgtggaacagccggcctagctgggggccccgcaccacacggtagagcaggagctgggggtcagtgcctgcgctggagctggccctgagggtctgactgctgagtggctggacggaccctgccagaggcaaaaggggatatcagattttgactgggagccaggtccaggcctgtgtttgcaaagaggcagcgtgaccctggcatgccaccctcagctccgccccagctcctggcacccaggaatgcccatgatcagcacacccacctgggcagacagtcagtgtctggctgcccttcagcgagaggagcacttgcttctgggccgtcactcggaagaagtgtccgggggaagtgtgctcgccgtcagagaggcggaagcggaagcctccatccagggttcctggggacaggggcattgggtccagctggcccgagccggctccccatctcagggcacccccgtgggcagcaggaacccgaggcccggccctcagcacccacctctgtgtgagaacagcacgagcccgccgtccagctgggcctgcgtgaagctgcgcacctcagtgcccggcgccccccgcagcactacccgcccgttgctgggctgctcgatggtgtagaccagatcctcagacccagagtcgccgtccgtgctcctcagagcctccgcagggatgggcgcagtggccccctcccacatctgggaacacaggcctgtgaaggttctgccttgccgcactcacccaccccttcctccccggccctgggctgccaccagggctccagtcctgctgcggctcagcccctcgggtggcatcgaggctggcgccactctggctcccctgcacaaagggcctcccgcattcaccttccctgtcaccccagggaaggccccagggaaggtcaccctccaggcccagcctccctgctctccatctgccctagtcctgtgtgtccctcaaggccagcttatgtcccctacccaggaaggccccagctcttaccctcaccaagttctcactcccagaaacccccagcgctgaccaacagtgctccctaatctgtctcactggtgggacaggggtctcctttcagagcctccgtgtgtgcctggccggggccgggcacaggtgggaatggtgattttagaaatgggccctccttccagctgagggaggggtgcgtggcgcagagagtggggggctgatggttggcactgttctgcagcacagaatcagcgtgggatgggcccaggtgcttccagagcagttaggggccctccttatgttgggcaaaggggacccctttttcaggcctcccacttgcaagcagagcaggtgcctgttcctgaggtcctggtaccagtcttgctgggtcaattacttgcgggcagagctgcagtgggactcacatgcccggaaaacagagccttctggcattcctgggcttcctcccccggccccagggagccctcaggcccagccctggcaggaggggccataatgttgcggggcaggaccccagcactaggcttctggagcaaacacaggtagatggcaccacctggtggctgtgctgccacacagccgtcctggcctgtggttccagagcactgtgtcccactctttggcggcttccgcaccaccaggccacccgctacgggcacatcctagaccaccaaggccccgcccccacccccgccccaggcaccccatgccagagacagcccaagtcagccctttatggaaacttcagtggctcctgctgaccggggaggatgcaccccagaagctggggttcaaagccctgccatgtgggctttgtaaagccatgccctttctgttccaccagaactacttttgcaaccatggagaagttccatcccacgtctgggcctcaacttccacctgcagagtggggcccttacctctgcctgagcgaagttcaccagggccttccctgcactgtcctgctgggcgtggaacagccttgtgcaggagtttggggagccaagccatggccttcacttgctgggtgaaggtgggaaacttaacagcttccgccctgatgcctgcccttaagggcttgtaagtgattctgtcagatgttctggtccttagccacagaagaaggaacagcagagccacccgtggccgctcagaagtctgcctaccatacttgcaaacatccaataaaaaaacttcccacctgtgttctatttcagcacaatctcacttctctccttccaacaaccccgtgaggcatgtggcagcgtccccattttgcagaggaggaaactgaggatcagagctgggggagctctgagccgcgaagtaggggacgctggcctctttctcgaagcagacatgggggtgttcccagggatgctctcacctgcaggcctgtgtttgtagtgaggatggggggttggtcattgacaggcaggacagtgacagtgaaggccacaggatggctctggcgatccatctcggaggcattagccatcaggacaaaactgtctgtcagtgtctcgctcccgtcatgcacgtagcggatcagctgctcttccacctaggggcaggcccagggctggcagtcaggccccagcagcacccttcatgccctgcctttgggtgcaggaggagactgactcttttagggcttcattttccattggtagaaaatggggaccataagttctggctccgaggagttgtgaggaagaaaagatatatggtatttaaagcataggtgcttctgaaatgtgactccccgtctcctctctgtgtataacccccagactgggagtccccagggctccctccactctgcccccagagctgggctgcagcccctgggcctctctcacagccataccattctccaggagaaggcgctgagggtcctggcttgaggtccgtcctccttctgcagggctccatgctggggtggctccagcacctgcaggctgaggcccaggagagtggggaagtagggcccggagacacggagcagtggaggggccagggtgaggctgccaccctcagggacgctgaagttttgcgcctctagtgggatggcagcgggcagcacctccagctccacaaggacgccctcgaggggagcacccaggcctgaggccacatccagcgagaaggcatcgctccaggcctcagggcgggagtgcaggtacaggaccctgcctgtgtccactgcctcctgggagaagctctgcacagggtccaggctgggtggctcatctgccaaggcgccacgcgacaccatcaccaggtagccggcactcggtgggctcttcactgagaatacgatgtctgcaggtggcactgcctcctgggctgcctggttaacagaggtcacaaggactcacagggggccacagagggggtctcagaggggtccactgtggccctaagaagccggaacaggcttgatcttgccccacttattcctctagataccactgctcatttagacacacaaacacacacgtgggttcacacacacagcagccagacatgcagctggtcacattttttgttttttgagacagggtctcactctgtcacccaggctggagtgcagtggtacaatcacagttccttgaagcctcaacttcccaggctcaagggatcctcctacctcagcctcccaagtagctgggaccacaggcatgtgccaccaggcccggctaatttttaaattttttgtgtagagatggggtttcactgggttgccccggctgctggtcacatgttaatgcccaccccacacacggttgcagggggtcggtcacacagcttgagatgcactccctcagggaggtgcataatcacatgtccccagactcagtgacacagacacacgagttcatcatatgctgacgcagtcacacatgtacacatgcgtgtgtgcacacacacacacacaggcccccctgctcaggatccgttcaggcctgtggctggtttgcaggcagcacctccccagcccctgctattaccacccaggaccatcagagggcgccccgccccacccctcctggaggcacagccgccttcagctcaggccctacagagctcacgccccaaaggccacacgggctccctcacctgatgggccagccacaagaggccaaaccaccccccaaactcacattcctgttctatgcatttgcccggaatgttccttctgcctggaataccactccccattctctgctcctgatggcctgtgctcttcagagcccggcccaaacgctgcctcctcccgcgaggccttcctgactccagatctgctggcttgctgtcggccccaagctccagacatgcagaccagaagggtctccgaaatgagcagtgtaggagagtaaggccaagagcgggcaaggactggcctgaggtcacagggcaagtcagtgagcctgctggagggcccgtggttgctctgtggggttcctgggtgggcagaagccacccaggtctgggctctgagaaaagagtgggggacatgagggtctgaggagtagcggcctgtctccacggtcagcaatccccaaagctcaggacccgtgatgtcctcccagggaactgactgcaatggagattctcgggctccacgtcagagattctgtagggctgggtggggtccaggaatctgcatgctcagccatgtcatacacatgagtggacacaacctctggaggcgcacacaactcccaggaggatgggtgtatagcaagctccccagaaactcctgggagcacaacatatacgggagcacatctgaggcacgtgcacacatgtaacctggagccaccacagccacagcccaagtcacgtgtgttcctggcatggaggctgggagaaggccctctacctggcccacacccctgctcaccacctccaactcctcacctccagctggtcccttctgatctcagctgcctctccctggaagacgtagatcttcttgtgccggaccagcttcagtggggccagtgggccctctagggcaatggtcacttgtagggtggcatccgtgtgcactggccctgcttccacggagaaggccatggtgtcgcgggggctgaggctgccattgtggctatagagaacggccccatccagcaggtcctgctgggagaaggctgtggctggctgaccagcccggactagctgtccccagcgagggccagctgtgacgtggtagtggacctcatccccactgcggatgtcgaggttggtgtccaggtggagcacggccgtgtcgatggtgccctggcctccttgagggaccacaaggctggagccgttggccacacggaggtagggttccgaggcctgcacctccagcagcgcagtggcctggtgttgcccgtcggacacctgcagctggatccagccacggtcagcccctgagtgcacgaacagtactcgcctcttcctgaggtcctcctgggtgaagcggtagatgggccgcgtgggctcatctacggccacgatactgccaaagaggaggtccttgcgggtaagcaccagctgggcgtcagcaaagcccgagtcagcatcgctgaaggccacgtcgtctgtagtcagcagccgccgcccaccccgggccacatggaagatccggctgatggtctgcacaggggcgtggtcattcacgggctggatggccactcggaagacaccccgtacctcctcccaggccatgtcaccactgctctcgccctggcgggtagcaacaaatgggatatcatcttctgtggtctcggagtcatcatgctggtagaccagccggccacgcaacaggtcttcattggtgaaggatgtcaccatagtggtcttgtcctgtgtcccacgccaagccaacctcccatggcggggccgctccatgacctcatagaggtagctggcactgttgagactcttgacaaagaggtggtcagcagagaggacaccctcaccaccctcaggcaccacgaggaggacattggtgaggacaggcgcatctgggtcaccaccaatgtggatggggaaggtatagagtggggagaaatatggtggagctgtgacacggaaacggaaggtgtcctcgactgcctctgaggcacgtgctgtggccccataggtcacccggccagcctgtatgtcatcctgggtgaagccctggccatctgacagccttgtgccctgtagttgaaggttgcctttcctgggagcctgaaccacctcataatggaaggttggggggcttgggcctgcctcctccagggtggcctccaggtgggctgtggtgagggtctcctgctgggtgttctgagtgtgcagtggctccagccgcagcatccacacagtggctctctggatggtcactgggaaggacagattgctcaggatctcctggcccacctgcacctccagggccaggttctccacggtgtcgtaagcgtggtgctgtgggtcagtgctcaggtacctcacgcggccctgctccacatcccgctggtggaacgcctgtgtggcccaccactcagcaccctccaccccacctgccccctgcttctgcagctccccaaactgcagggccccagtgacgcggaacagcacgctcacatcctgccccacggcattggtctccaccgacaggttggcgggcaagatgggcatggcagagccttgggccagtcgcaaccctgtgctgcggtggatctgtatggccggccggatggccaccaccttcagcgtggccggggggctggcctgcagtccatcgctgacccggaacgtcaagtcctgtgcaggaccaccgcggtggacatagactaggctgccggcctccaactcccggcaggagaactcggtcgccggctccccaggctggtctcggcgctccacggggaggccagaggaggtgccaaggacctggaaggtgaggccctcacaggcagagtccgggtcataggcctggaaaacctcaggccccagcggcttctgcgtgtgttccaggatcaccatgaggctgccatgtgggaagatgatgtggggtgggtcattgacagggttgacctggatgggcaggaggtatgtttggcccctccgaaggcatgagggcatgggcacccgagccgtcaccgacacctccagcaccagctggtcggaggtgtcctcagagccatcgtggatgaagcgggccttgcggttcaccacgtccaggagggtgaacatttttcgtgcctgggctcccgggatgtccagctcgagctcgccatggcgtgcccctcgggtcacgctgaacagcacctgggatttgcgcagctcagcctccatcaggtccagcgtgggctgcacatgcctccactcaagccaggctgtgcccccctcggccaccaccagtgggctgatagtcagcagctgggtgaaattggcaaagacaggaggcagccctggctcaggcacgcatggctcaggcagctccatggctggccaagcctcaggggccagggtggagaaagcttcataatgtccataggcatcgtcctcatactcctcctcctccagcctgcagccggctgccatgttgcgcgtcagcaaagcttcccgcagcccccgcctctggccattgacactgaggtcttccatgcagcccagcagggaggcattggtggcctctggtgtcaggcccaggcggtgttcctggaggtgacgagaggcctctgcatccagccccccgagaaggagactgccccgtggctccaggtagctgaggactcctcggttcgaagtatgcgtagggtactggtccacggagatttccagccggtgagcattgatgtggacactgacctcatggggctgcccatcggccacaggcacactgttgtggagcaatacggtaccctggcccttctccaccacggcccgcaggtggccctcaaatatgtccacatagatgaagtccccacgccggccccctgcctggaaggccaagggtgcctgccggctctgtgtggtgagtgtaaactctagggttccttcgtcctgagtgccccaggcagggaaggcagccagagagtggggcccagagaagcccagggccacatcatcactggcagaaaactcttcagcacagccctcatgcacatcgggggtcagaggccggaggaggctgcggccattgagggtggctgcatggaggcaacccctcaggggtcggctggttcccctcaggtagggcaggccaagggtcccagtgcccccaacaaagagcccataggggacctctaggggggctcctgggactgctgaggaggcgttcagaaacccatcgactgacaacgtggcccagccctctacgacagtcagcaccacagtgtgggggatggagtcactcagcagcgtctctgctggagtctgcagcctcagctcctcctggcccagaacaagtctgacctgaagagagatggggagtgggagatagtggacagcactttggatccatcatttcccttataaaagcatagagccgggcgtgattgcagtggtggctcatgcctgtaatcctagcactttgggaggccaaggcaggcggatcacctgaggttaggagtttgagaccagcctggccaacatggagaaaccctgtctctactaaaaacacaaaattagctgggcatggtggcgcatgcctgtaatcccagctactttggaggctgtggcaggagaattgcttgaactcgggaggtggaggttgcagtgagctgagatcatgccattgcactccagcctgggcagcaagagcgaaactctgtctcaaaaaacaaacaaaaaaaaagcatagtgagttccccacacttggggccccagagtggaaaacctaggacaagagcctctggtgccactcctcttgccgtcctgccatctctttattcatcctccaaacactcaccaaaggaaactctgggccagggctggatgggctctggggaccctgatatgaatcagatgtggtcctcgcccacaaggaactgacatacagcaagatgctctcctagaaatccaacctgtgtttttaaattcttcccctctttccttgagtgagaggtgccagaaatattgtcttggaatctggatttcaactttggaataatgggtaactgggaatcccttgatcagtccccttcaacagagcaaagtttcttggggtcattgaaggcagccaggctcactgttcaggaataggctaatttttaaattaaaatttaaatactctgtgttctgaaaaaaagctccctgacctggggtggaaggagatcttggggagagatgaaggacatagttctgtctccatgacattgacagcagaaatggctctggtacggtgctcccagatggtagaatgggaggtggcagagtatggtaactgcagaaccagggcactaagaactataattttggagtcctggtatggagcatctctgtaggggtgtggcatcattgtacctacagaactggacagccatcagcaccagcctgcaccacgctggtgtttaacagtgaaagcagcagactgaccaagccctagtcctctccccatggggtgtggaaggagatggctgccccaaatttgtttttttttgagacggagtttggttcttgttgcccaggctgaagtgcaatggtgcggtctcggctcactgcaacctccttctcctgggttcaagtgattctcttgcctcagcctcctgagtagctgggattacaggcatgtgtcaccatgcccggctaatttttttgtatttttattagagacacggtttcaccatgttggccaggctggtctcgaactcctgacctcaggtgatccacccgcctcagcctcccaaagtgctgggattacaggcatgagccaccgcgtccggttatttttttcttttaaaaatagagatggggactcattgtgtggcttaggccagacttgaactcctaggctcgagtgatcttctcaccttggcctcccaaagtggtgggattataggcatgagccactgcacccagcctggcacaaattcggaataagaccctgggttcttaaactcttcatggtttaggggaagactcaaaaaagccacaagactccttgctaacaaagcttgtggtgtcttgaaggatgaaatggaaaaatgaggaagctgaggcagtactggtgctgttactgtcgtggacagaccatggtgctgcagagaaattggtgcagtgccaccgggatgcacaggggtcatgggggctcaggagggggcctagcccaggaggaggggatgcccacactgagacttcaaggagaggctggagttaggcatgtgcagggaacgggagaggcgcacacctggcagaaggagtgtgcatcaagagcctggcagcaagcgactgtaagatggccaggaactgaaagcagttcagggctgtcagagcacaaagggccagcgaggggttgtggcgggaaacatggttggagggagccagtgggcagagccagttcatgaaggatttaccatttctgggctgctgctgcccatcccacagtggagaacttaagaccccaagataaaagtgacttacacaaggtcacacagccagctggggttcactcaaagctagagaaggaatcccaccccgaatcccgcccagatctcagggggacgtcactcacctgcaggcgtccagagtagagctgcagcaggaggtggtcagctgggcctgctgccaggagaaggagggcttcgggctgggacgtggagaactgcagctgcaggtctatgtcggtcagagccgtggccacaggcacctccaggtggttctcaccgaagaaggaagctgtgtgagagagggagctgtggtcaaggctcagactcttgcctggaggaggcgaggtgccgcaaagagggacgggtgggttgcagaaaggggtccgtgctggcgcaccctcatggttctgctgtatggtgctgcctctgagcactgcccgggtcccagcatcttcttggtcctggcaccagaaggcacaggctcaccttgtgtccagcccagatcttgtatttacaggaggtcagacccagaaattcccagcaactcaggtctcctccttggaggttcctggagccagaggcctccgccagctctgactcgcctcccctgggccccagaggagtctccctcgtgggtctggctcctggacccagcccaaagggaaccgcaactggcctgaccatctggcttggtggtcacagccccaaggaatggagtttctggagaatcacccccagtccagactgatccctgctcagattccttctcctaagtgcccttgtgcttgggctcctgtgcagcgcctgctgtgccatgccccgcctccatgggttggctgaggccacgactgggatctgggggtggtgtcagcatggcccacctatccccgcttctctctcaggccattcttccagctgccattgagcgtcggggcaggagcttattggcctgagtctgccaaggagcaaaggctctgaggccagatggggaccatgtgcagtgtcaaaccaaagtgggcccacacttcctccattacccttgctattgcttcctgctggagagctattcacagtccccgatgagcagtcagatccggccccattgtttccaccgtggccaaggaaccagggatgagaacagctgagttcctaacttccccaggccaccacgcaggctgaggctgaagacagggcttgggaggggctgagggtctgctgggcaggccaaagagggcctccccaggcagaaggccatgtctgggcttgcctggggttagtggttcctatgcagggcccgttctgtcccatactgggactcctcctcttttgaattgctgcttcctccagtcagtttccccagattagcctccctgacttccaacccgctgccacaatttctggtccatgccttttgtggtgataagagccaaatataactttgactttgcctgcagatgtccagggctggggggtagagaaacacgggttaaaaacggtgattcattcctgttgggcttccctcaaacccgagagcgagcacaggctgacggccttgatagggataatccggcaccagccccatgtgctggtccctggccagcctgagccagctgccatccgcctgagtaagcagcttcagccgttggaggagtcggagacttgtacaccctaagggcagccagccccactgggagggatgtccaagaaagatcccgtaagaaccccttgggctgagttaaatcccctctagttatctcctcctgccagcactgctggcaataccagcaccttgtctgggaagctacgggaatcaagggagccctgcagaccatctgcgcgggggcggcccagctggttcagcagagcttggcgccagcaagggacagaccagggaactgcaggtggcggccacctaccggggtgccttatctgcaaagacattgattcctaagagcaaaacacagcacactaaagtgagggaggccatagcacaaggggtgggggcacatggccctgcaggatagagccaccaccgtcacctgctggagcggctgacagcagctgccaggagtctactgttgaattttcaggaattttgagagccaggtgatactgcccacagtgagaacatttataccaggaaaagaggcaaatactgcaaatcagggttccccctccccaagaaagcccattgctaaacatttacctatccagcacccacagagaagggggcacatgtccctgcccctacccacccttgcactaaaggtatatgtagacccgccaagtcatggtcaacatcagggctctgggccaggcaggaactgaactagatggttggccctaaccactgaaccacctgcctgcagccccctcccagcagaggagagtagagcctgtttggccagagtgggagggtggcaggaagtagaggtactttccagagcgctggggtctgaatgggtccattgaggggctgggccctgctgcttcctgtggggctgagcgggaggggctcacacaggctgtcttgtgctgctggagcgcgtggccaggcagccccccaccccaacagaggcctctgaggccttgctggccagggctctggaaactctgacagcgccactccctccacctcctggtctccttttttctgcccctcttacactctctgaggggcttcagttgcaagaactcagaatccctgtcttggaggtggtgggggggcagttgaagaggggcttcaaatggagagggtgtgcagaattaagatgtaataagctaggagtcaatccagaggacttcctggaggaggtcacggtggtgtacagacacagagagggaggaataggcagtctcagaggacagcagcaaggccgagtgagactggcaggaagtacacaggtcccctttgggtggggctaggagggtttctgctccatcacccgctaaagcctctggctaacttgaaggaagagaagtagagggaaaagtagaatgggtcaagctaggctcggctgcgtgactggggcggggggatggaggaggttgtggggagacattggcacaggctggatcagacctgccgttgattctcctgggtcaagaggacccatgattcatcaaaacagcagaccaaacctgtagcagccccatgggctgccctctgagccaggagaaggggcccacttcaggcctcagtgtcaccattctgtaaaatgggcacagtccctcccaccccttccccctcctgactgtggggattagtcctgggggtctctccctgatctaggagtttgctgtccatatggatgtggggaaggttaatggcatggggtgcctggaggtgccaagccttgggcatgagaggagcaggatgccccacaggtctgggggcccgtgggaggggcaggaagagtgctgcgtgtatgggtttctctctctggaaggcgcgtcagtgggcgtccagggctgtatattaatagatgtgtatttgtgtgtgcgcaagcatgtgggtggctgctgggggtgtgctttgggtttgcgtaaggctgtgtgtttgtgtgtgtgtgcgcgtgtgtgggccgggagctgccaggacagagcaatgattgtgcccgggcctgtcctgcccttcggtgcccgcctgccattacttggctgggcctggctccatgaaaggggctgtgtgttcttggagggttcctgcccctcctgctcagcgcccatagagaggtttgctaaaggtgggtacatcctcaggcttcccacccttcctccccataaacagggcactgctgtctgggcctgagggtggggtggctccatccttcttcctgagatctaggcctgggggcacagaaaaagcctgtttccttccctgccaagtcccttctcaggggctagaggaaacctcggtcaaggtccccagcaagccccctctgtcagggcaagggctgcgctggcatctccgggctccccggaggcactactaggaggagtgtggatgggcccctgaggcttccagcctgacacccagccctctgtctgacaccaggctccggggacaaggagtcgctgtgaggggaacatctctgcccatcaggcccgcctcccccggccagggccccaccttccccagccaggccagggccgggtctcaggcacagatgcctcttccaggctgagggctgctgtgggctctgttccttctgagtcctcagaaggctgcctgtgtccctgtatctgccccatctctccttcgcctccggccatccctgctgccaggctctgcctctgctccccctggtctccccctagctctttggctccctcttccctctgccccatcctggctgtccctgggcacatcaccctttgctctaggacagtctggagggccccggcctggggccccaccctccatgggtgctgagtcccacagcatcagcattctctgtagctcaagcctgctgcagggcactcagcttccaccttccagacagacaaactgaggctccagaggagaagcgatttgacgaagagaagcagaaagagatccagcaggtcccagcaccacccgtgtgagccctacccacccaggcacccccactgtaccccactctctggcaatggatccctgtgtgccccactcccgccatgttcctggttgcctgggggcagccccacagccaggctgcgtcatgggagcagcagcattcctgggtgtctgctgctgcctgactttataagggagaaattctgggagcccggagctgctggcccgtggggagtgcctgggcccgtagttgagggtgagggcaggagacctggacatctgtatgtgggggagggacacccagtgccacagagacagagcaggaggtgagaggtggaatgcgtaatagagacccattcattcattcactcaatcacaaatacagcaatacagtgatgggaatggaagaagacagctaacatgggagaaagttattaaaactgagaaggagaaatcaagatgccctcctccataaagactggattcacatacagaccaaggcctgaggaaggagacggaggaggaaaactcgagggagacagagaaggcgggatgttggcagcaagcctgctgctgtgcacaggagtgaggaggggatgcccagccagcctgctggggagggagggccctgctccaagacgaagccagacttctccatcaccgcccctcggggtttggcaccacggcgggagatcctggctccaggtctgggcaggcaggggtgagggagtctgagggggctgtgggatggggtattctgggagggccaaggccgggatgaagggctctctgtctcccctcataggtgtgtatgtggtggggcggggggtggtcgtggcccacctgggggctgaatgccggctctgtgagagcatggacgggccaggtgtgcttccccagcagcggaccctccctgaggtcacctggccctctagacctcaggtcagttcccctcccctccccttgcacctccaagggactccccgattttacttccgccaccaatctacttccaaccaagcaggcagggcatgggtgagtgtgtgcaggaatgtgggtcagtgtcacatgtacacacgtgtgtggcggcaaggcaggcgaggaaggggtgcgctgggtccctggtctggccccactgtgggccctggataccgagacataactgggggtcccctccccagcacattggtctccctgggctcctcaggcaagggagaagctgtctggtgtgcctactcaggggtgagcccctctcaaacctcctcccagcagactccccaaggctcagccacccacactgagctatcaccttcacccaaccctgttactctgagggtaacaagggggtaggttacaggggagacttaaggtcagactaaggggagcgacctgcccagtgatgacactggggtcaccagggcccaggcctagaaggctcatcactggccagggtgggctgcctgggagacgctcacacacctgcagacccctcagggctcactgctctttagcaactcttcctggctgcttccagactgggattccaccacccagggccatccccgcggcccaaggactgcctgctcctctcctgtcccgtgagctaccgaaatgcggacaacagtaggttagttccaaatcccatggagcttacaacagcagccatcatctcaggagacactgctttatcccagtggggtgctggagtgctaggcacctgctcaggtgactgcctccacgtctaaatgctgcagagacctctgtcggggtcagggcagcaccaaaaactcttgagccaagagacacacactcaggtcagctgaccttctgtttagttgcctttctggtcccttgcaaggccaagggggccagggaggaaaacagtttcctcagctattggctgggccctgaccctggtcactggcctcagctaccatcctctaaccaagcgctttgagtcacccacgtagaggggcatgtgctggggaacatttccagttgagggaacccgtctggaagatgagtggaagcaggggcaggtggggtgggagaagctgagcttggtccacagaggctgataggggctgcaccctgggctcccagccacatgtcccaaccctggggccttgtggagcacagaggaagcaggaggggaaatgagaggttttgagggaagaagcagcccagagtccacccaggcgggagggctgggccgggggaggaggaagcggggcctcaatggtgtctttgtggaagtcttgctgctccccaggcctcaggcgaggagggtggggtggctgcggtggggagcggttccaagaggcttttccctgccttataatcttccctcttggacagggagatgggtgggtttccaggctccatccgtaccctcctttcccccactttcctggccctagaggacctgggaccctcacctcagtggacccaggctggggtagggtttctggcagggaagagaagagtgaaggaccctcacttggcactgggcctgcacagccccccagccctagcagggctcctgggaggcatctcccatgttacaggtgaggaaactgaggctcagagagggcagtcctccgtgctagcctgtggagcagcggcagggctgggacttaagctcctgtgggtgtggctccagagctaggggctgtgggtgtcagcagggcacatgcaccgtgtgtgcacccagagaggcgtggtgggtttgcttgctgcctgtgaatcggaagtggagcatctgccaatggccccagtgggaggagggtgtgagagctggaccccagcctggggaacacacactctttcccttcctgtcccctgggactcttctgtcagggccgggtggagggggcagcgaggagggggggacagcgaggaggggagggaagcatctgctctccttgggcggtttggcagcccctcctctgtggctctggggctggccgaatcgggagggcccttctgcaggggctggcgggggatgactaggtccagaagccagtgataagtgccagccctgcccactggtgacttggaggtctgggaggagggtggagagacaggggtctgggtgggagctgcccccaggaggctgagggccaggctctctcctgggctgtgtccaggaccaggcagcccatggctcatctctgagttccccttggctctggcagcagaaactgctgaagacagggctgctggggcggcgtctcggggcttccccagcctggcgggctgggtctggagatagtgagtgtgtgagttgggatgggggaagaacagaggaaatggtgactgtgggtctggacggctgcctggacctgaaatctggtggcacaacttgtgcacagtagccttgtgtgcctcctcctcagttcccccatctgaatacagagggtgggctcaccccacagacagaagtccatgtccagggcagaagcctgggtcagggctcacacccccagcacacacacagggctcagagccatgtgcttccatgctttccctggcctcagtgtccccatctgtaaaaggggacctggatagagggactgacacacatctggcctctgaccagcccagcagactggcaagaggtgtggccactaccgtgggtacagtagagccacctctggcctaaatggccacaggtctagccagactggaagctcttgaggacaggaccagggcccacatctccttcccagggcatctgtgcagcaagaaggccatggacctgtgatgagggaggtgatgtcagcatctaagggaacgaaaggatcaaatgagatggcatttgtcccgtgtgagggtttttctatcaggcagagctgtcccaccacagcaagtcccagcactggtggtgctccagtgggagggcgttgccggggggtgcaccaggaaacctcagtgtccttgctagtgaagctctgggctacccaggcccatcagagatcccgagactgagacctctcttcctgggcaggcctgactcctcctggaataggttcctgcctagcacccccacctgccaactgcctggaagcctgcagcctgtgggccccccctggagctgtgcccaccgccaccacactccctctggccctccttttctctcccggcctcaggcccagcctctgctaatgcaccacgtctctctcactggcaccaactctccagggctccaggcccactgccagtgtccctcagatgtccatggcaggaacacccacaggaacccccaagcccaaccccacccaaagcaaggaggactcagtgtactctcccctacagctggctcgccagccccgtgaaggcccgactgtccacctgttgctgagtagacatctgagggtcgcactgaactctcctcctcctccctccccacagccactgctgattaatactcaggttccatccatccagtccccaaattctccttcaacttcatcttcctctcttgctccctggtccatccataaggcggctggccaccgtcctcggtctggcttaatcaatctcctgactccctttgctaatagcagccccagttaacccaaactgaaagccactccctcagcctcccttgcctttggtggctcccattgccccagggtcaggcccccacccccgggtggcactgaaggccagggtgccctcaactctgcctgcagggtctcttgctctcttccaaggacactccacgcctccgtctcactagactctgcactgactccgtgcacacctagcagggccgacctgctgccttcgctcaggctgggcctgctgctgggccagctcttctctcctgtccacctgtgaaatgtcctcatgctctttcaggaaaaaagcccaaagcaccttctgtgtccttggggtgcaaagacactcgctgcggcccagggggctgtgctgttgtcacctctctccatttacactgtgagccttggggacaagactgaccttgcttggggacaggacgtgggaggaaaggagggaggggcccaccagggcatgagggccatgggcccagtgggaggggctgcctctgggagctcgccccagccctccccaccttgtcttacctccagtctcctttccaggcctcctctgccctccagagccccagggctcagaggcaggggactggacactatggcctgggagggctcgagggactgccagagccagagactgcttttctgggcctgtggtgacagagtctggtgcttgtttttaaagaaaatagaatccgagcccctatttatagccggaggccacagccacagacagaagacggatggggtttgaggcttacaggcccctgctctagcatggactgggaggtggggccattcccaggcccccctgcccgcctttgtcaacccccaaggaagtgcctgtgggatcctgacactccctgggacaggatgtagcctgcactttggggcacgggaggacctggtgaggggagcggaacatttctcaggattggtccctggggcccagagtcccttgtgggaatgggaggaggtgagggtctgttatgtctactgagaaggcagagagggccctggggacgggtggggtgctggcggcagggagcacttctgactgccgtggaacccggtaaaggagaagggaaggagaacagagcaggactggagagatgggcagacagacagagagacagggtaggaaagacagacagaaagagatggaggaaccacagccaggggtgggaaaggacagagagatggagagagcgggatggggggatggactgagagatcgggggtgctctgcagcccgggtgaccctgcgcaggggcagacagaagccgtgaggggagactgaagtgtggcttccgtcccatagagtcttcatggtgctccaggcagcgtggtcagagtccgggtggagccggtgaggagggaggaagcaggcgtctctgtggcctcgcccacccccagcctccagggtctaggggctggagaccctccgttcccggcagtctccacggggaaggcccaggcctgttggaggcaacgcaatgcggtggggcagagcccagattgaccttgtcaccaagatccccaagggctgtcttgggcacggccgggaccttgagggacaggtctggtctctggcttgttatggagtgagttccctaggcctggagggctcacaagctaaggctatggcctggactcacacctgctgccagcctctacgcagacccctcccttggctgcgcttgtaggggctgtggggtaaccgtagcctggggcatgtgtcatggagccacaagcagtgactcagacagttaaaaaaggagcagctctgagtggtgactcaattggctctggaggggctgggtgggtctggctggtacaagatggggtggtctgggtttatttttggcagggcggggctggggccagggggtggaagatgggagccgggggtggagaggagccgctgctctcatcccggggggagccccagggctccatgccaacttaggaaagtggctttccaatgccagggagtcctggcaggctgggctgcttctcagccccattccaggcctagcctgccttgctgcttggcccaggacaagcagctggctctctctagatagaggcagaggcccctgtcctgttcccaagaggctcaagctcagaatttagagctgacctaggagactgaagattccacccagaggcccagatagggccaggggtctccccaaggccacatagcagggccaggtagcccaagggctgtggcaccatcagccagctggctcaggcctctacaatatctcgctggccccagggctgtccacggttggagggacagcccccgtctgagtacccacccctggaggggctcagccaggctccagatgggtggccagaagcacacgggccccagatgcccagagatggaaccttggccaggggcagccacctggattccattaaaacatgtgggtggggggcctggccgggccctgtccaggggtctgtggagaagagtcacctctacgtgggtgaaggcagtgggggcctgcacaatgggatcttgccctgagggctcaggcacaggcctgcccttgtccggggtccctccagtgtccctgccccgagctgtgcaccccactctgcagtcacctcagtcacctccccacacctccccctactctgagctcacatacacccataccactgaggggtcctagcagcccagagcggagagggctgtcccctccctcagtccggatttctgctcctcgtgatgcagccaccactgcttatatcatgagtggtggtaacagccccatggtgactctggcaggtgagctgtcccacgtccctgggccctggcctccagcccccacctccagagagggactcgcgaggggttggtagagagcagggaaaagacaggcttctagggtccccgtcccataaaaggtcttggggcctgctcattctcttctcctcactcacctgctctggggacagggggttcctgctgtgccccggcccagtgagccccatcctaggggctgttaggcttgggagaaacaggccctggggagggccaggcaggggctgtccccacttcttctagcactgagagaggggtgtgggcctcagcccagttagccacagagatgcagacccccaccccctcccaccttctgaagggtcctgggctggcaggcagccgctggctgataccctctccagagcccacctctccttttccatgtcacttagtcccacacagactcacggggccacctcctctaggcctttgcctcggaatcttccttaaacactcctaagcagaagtccccatgttgccgggccactccaccctgggaagaagatgctaatagcagagtgactgcagcttcaggagcagatgtccaccgagcattgattccaggcaaagtgtcttgcttaatccttacaacacgtaagaggttggaattatttatccccattttagagaggagaaaactgaggctcagaaagacagagtcacttgcccaaggtcatgcatagagcgtcagggctggaattcaacctgagctctctaatgccgtgtttcaccaccatgtgcctggcctcctgcttccctgtgtgggttcccacagctcaggactcagaggagggagagatggggcctgggtcagggctgaggggcaggggaggggctccctctcagctgctcgcagactcccaaaaagggtgatttgctcctccttgaccagggtgggaagtaaaagtgtgtgtgtgtatctgtgtctgtatgtgtctgtgtgcatatgtgtgtgtctgtgcctgtgtgtatatgtctgtgtgcgtgtgtgtgtgcgtatgtgtgtctgtgtgcatgtgtctgtgtctgtatgtctgtgtgtatctatgtctgtgtgtgcctgtgtgcgtatgtctgtgtctctgtgtgtgtgtggctaggcctcaggcctgcctggctggactctagctgcaggagagctggtctggccccagcaactgtgcacagggaaggggcagggagaagcgggtgtcgtgggaatcagtgtcctggtcccactggtatttatagctgccccttcctgaaatgtgggtgggggaaggggctgctcttaggtgggaacggaagttcgtctcctctccccagccccctctgtctccccagagagtggactggcccaggccagagggcctgccctggcgggggaacgaggcactgtgtcctgattttgggggttttccctggggctgctggctcggggcaggacactctccttgcctactgagcaatactgcgtgtgtgtgagtgtgtatgtgtgagtgtatgtatgtgtgtgtgaatgtgtatgtgtgtgtgtgagtgtgtgtgtgcacacacacgcatgtgcacttactgggtgtcaggctgaagaaggtcatgaaccggggacagaggccaggtgagggtaggggaagaaaggcctgtaaccccacagagatggagggcagggccccaggagaggggccatccaggtcatgggtctcagagcaatctgtggttagaacaggctcctgggggtggcgatactggagctgagccttggaggatgggggaaaagggaaggcctgttgcatggagcagcttgagtagaagtggaaaggtgccagcggttgtggattattatctgatggcctagttctatctgatcagccagtccgtgggacacaggatcaccttgaccagggaggatgatatatttggggagagaaggacatagcacagcacagttgagcatccctaatctgaaaattcaaaatccaaatgcccctaaatccaaaattttttgagtgccaataggataccaccagtggaaaatctcacacataagaactttttttttttttttttttagatgaaccctcactgactctgtcacccaggctggagtgcagtgacgcgatcttagctcactgcaacatctgcctcccaggttcaagcgattctcatgcctcagtatcctgagtagctgggattacaggtgtcgccagcacgcccagctaatttttgtatttttagtagagacagggtttcaccatgttggccaggctggtctcgaactcctgagctcaggtgacctgcctgcctcagcctcccaaagtgctgggattacaggcgtgagccaccgcgcctggcctccacacataagaacttaacataaatttctctcaggcacaaaatttctttaaaaaaatctataatgttaccttcagcctatgtgtataaggtgtatatgaaacataaatcaatttcatgtttagacttgggtcccatcttcaaaatatctcactatatataacaaatattccaaaagccaaaaaattccaaaatctgaaacacttcaggtccccaacatttcagataagggacactcagccagtgtggagtgagggccagcaggcagtgggcaggagtgggaagctggggcaggagaggccacacagccccaggcctgctgtgaggaagctgggaccaccttctgctcccggcctccaggctcccagacttggggaaggacatcttccaagggcccttagtaccaatcttcatggaacccaatctataaacaggtttgtggagtggctctgcatgaattggggtggggcaggcgtcccatattcccaagctcagctgcctccaggccggctcagctggagagccctggggtgcgctggagtgcagtcagaaaatccctggttggctcagtgatctctacacccctctgggggccaggctgtgagccctacaatgggggagacccctgagcaaagcaggtgggatgtgtgctcccggggagctgctggtcctgagggtgaagctaccccccaaaccagggccaaagagtagggagccctccccctaatctcctgaggactcactgtgtgactctgaacaagcaggctcctctgtctgagcccgggtttccccaggatccatggggggctggtctggggtcaggggtttctgcagtaagttccgggaagggaggcagcgtcactgacacacctcaaccttaggccgcaggagagccacacactgaagtgttgaagcaggagcgatggctggaggcctggctaacgcatgcatgccagggctggcagagccagcggcctcctccacaggctgggagccggcctgggtgtgggaaggagctgagcgagaggcaggaatgctcaacaggacaggcactgtccctgatggggcccacccctgccaccaggccaccttgacagcagccctacagctatcaccctacatcagagacaaaagtggcttcattggcaaccctagctttggggggagagggttttttgaaggggatttgcttaggctgtgagaaagtggggagggtttggaaagggagagaacgctggctggtgggggatggggagacagaacaaacatctggagtcctcagcgagctgtctgtccctgcagacctctctctttcccctgctggggcctgagcccactggtgggtggttgtccacctggcctgatgtggggaaactcgctgctgttggggtgagtgagaacaccacggcctgtgtgcccaaagagagacctgaggcagtccctgcttttctctgagcctcagtttcctcatctgtaaaataggactgttggacaggtatggtggttcacacctgtaatcccagcactttgggagtcccaggtgggaggcttgcttgagcccaggagttcgagaccagcctgggcaacatagtgagacctcgtctctacaaaaaataattaccctggtgtggtggcacatgcttgaagtcccagctactcaggaggctgaggtggggagatcgcttgagcctgggaggttgaggctgcagtgactgtttcctgacctgcagggctgctgtggggctgcaggactaacaacatggttagtgcacactatggggtgtccctgaaggtaagagcacagcaataagacagctctgtcctctcctgtttggagttacggaccctcctgagaagcggagagagctaggaacccttgccccacggaggagccaagtacaaaattgttcatacaaattcagttcattcaaaaattcctcatacaaactcagtaggaatggtaatacagtaaatctgaaacctgccctaagcctgcagctggaggaagagccttaactctggaaggctctattgaactgacatatgctggggcggagggcatgttggaggcaagaggagagctggatggggcgggagtcagggggaaaggcagtgaaggagcagagggaccagggagggaccaggcctcagtcccatgcccacaggccccttgttcatttgcccctggccttgaatagaagacacacctcaggtggcacccctgtccccatcctgtgctcacttccttccccgcaagtgccactggcccagatctttaaggtaggggacttggagacagaggcagtagccacctcgtccaggtctgtgagagtggccgtgtgcaagtgtgtgtgcccacatctgtgtgcgccagtaagtgcggacgtcaaggctatttccaactccccctcccctgcccgcccctcctgggcagcacgcccagttcccagacacagcctatacacttcctctgagagctccacacgcaccctactcccctcctgccgtcatcgacagccgcctggcccacctggcatggcccaccccaggccccccaggcgggcagcactaaaaggcccttcttgtcctgcccgggcgggcaggcgtagggagggaggctccgttacacttgctctagaacagtttttctcgagtccgggtgggctgggccaagggctctggcccctgggccctgccctgctccggaggcctggggtggcacacaaggtgcacacaaggctcagtgcctgtcccgagcaccatcggtccccccaagccatcctcagaggcagcaggatctaccctgcttcaatttcttgtacctggtgtccctgtggccctgctcactaagatacccccatcagttctgagtccccacccaggtaacacacaagccctccctgccaggtactccccaacctgggtcccacttcaacccctcacattctgcctttcagtcagtgatgccagggaagaggtgtgggagccaccacccctgcctgccctgtgctcactgtgaccccccgactagaatgtcacctccttccttctctgcctgtccttccagtatcagctcaaatccaatctcccccaatgcttggctctctgctggggcctcccatacagctcagaaggagctggacaccgcatctgtcacccacactgtctcagtggcccaagcctaggccccgacgcaggctgggagcaccctcgaagcagggctgggggctcttcctgggctgctggggttcttggtggaactcagagtacttttcttcctctctggggcctcagtttccctctctatacaagtggaagattggcccagatggcctctagggtgctgactgccaggccccctgacctggatgcctcaaatgttgatgagtagagggagagcctcccagcacgcctcattcggatacgggaggacgagggcctttgcagccaggggcatccaggaggggtgggagggacgccttcctcaggcaggggctgcccctactgcagaaatcagggcaggcagctggaccaggagtggtgacagagatgggttgctggacgggagctctcacagcccctcctcatttccgagtcctcctaaaggcaggggatggtgtaactttataaaaccccacagcaccatgctgctctcttgccctaaaacccttgtggcatctcctttgccaacagggcataaggccgtgggcttcattttgccatttaaggcttctgtgccccagcccagtggttctccctggcctgtgctcgaaatacgcctcccagccaggctgctggccttcctgtctcaacacccctctgcttacgcccaccttggtgcctctgagtcagcgcccctgcctggaggactgactcccttcccatccaccaaggcttggtttgaggcccaccctgtgtcctgccccagcttgcccctgcttttctcccctctgtacttttcatccagatttttgctgtttgagatttaatttgcctttctgcctcctgaatgagtctcagttcagcctctcaatttcccgtgcccctgcgagcctagcaccatgcctgcatgctgtcagggctaagaaggtatttgagaatggctctcagttgaagcccaaggaggtgggggtactggaatccctccttggctggaggctggggcctgaatgagctgaccaccctggtcaccttggatgctcccttcccatctccctggcggcccagcccatccctcaggccctgagatcttaggggatctggtccctgcaggaacagggagcctggagatccagccctgattcaccccgcgggggtcctcccttgactcacttcccttctgggaaccatgtgatgccctcttttagagctggcttctccatctgaaggagagaagggtgtggcctgggcccttgtgaaggaggctcaggccctgcctttgctccatgttgctcttgggaatgatctcgaaggtgtagctgaagcactgaatcacacgtgggtagtgatgatggatgggccctaaggccacagttcttatggcataactagagctgccttcgctgaaggaagaatgctgtcatgttggggtttctggcatcgggacagagaggggatatatcccagcacttctcggaaagcgaacttccattcagcctctgctgggtcaggcatcagtgctgggatgaggaggtgtggcagggggtggtccagagctatctgtaggacaagccccgctgaggggcaccagctctccctctaggaggctgagagtgggtagtgggtggggggtcctgcctgtcaccaacaggaggagggagaggagagaatgaagaggggaggtggcagatagacggatctgcaaggaagcaaggggaggaaagaaggggcagagctggggggcagctggaggggtgtgggggtgctcctcacaggggagggcagggtggctcattcctcgtttcccaccttgtagcactccccattcctggcccagggcatctgaagctggaggacccacttctcactgtcgccgggtccctttggaccccaacatactcaccccaaacttgcctggcaaacaaagctcggccagcattggggtggccccactggtgtctcagacaatccaaacgggcaaagccacgccctaggcaatccatgcctggggcgcctgctcccgcccctaactggacagccttggctagctagaaaccccataacctgagatagcggggtcccgtgtccgccccaggattgaacccctggcgaccccagctagtggtgggagaagcgcagcctgcttgactcccgatctgggggccacttctggctcctcctgtcccttttccctcccggaggaacccctctagttccgccaggctgggtcggggtctcaggcccctcactcacccgcggatgcaagtctggccaacatagtcagggtcaaagccaaggccaggccgggggctggaagtgggggccgcggcccggactgcatcccggcgggctgggcggcaggacttgcgaggagccagcggagtcctgggagctgggagctgagtggagcgagcgcggctctgctcctgggcgc

SEQ ID NO: 930 - DNA, 9622 bp, Homo sapiens
cattcagctgcgagtgcattcttggactgccttgtgagcatccccggtctgggcaggaccctctccttcccatctttctataccacccagcccagccatggcactgaaaggccgagccctctatgactttcacagtgagaacaaggaggaaatcagcatccagcaggatgaggacctggtcatctttagcgagacctcactggatggctggctgcagggccagaacagccgtggggagacagggctctttcctgcctcttatgtggagatcgtccgttctggcatcagcaccaaccatgctgactactccagcagccctgcaggctctcccggagcccaggtgagcttgtacaacagccccagtgtggccagcccagctaggagtggtgggggcagtggcttcctctcaaaccagggtagctttgaggaggatgatgatgatgactgggatgactgggacgacggatgcacagtggtggaggagccacgggctggtgggctgggcaccaacgggcaccctcccctcaacctctcctaccctggtgcctaccccagccagcacatggccttccggcccaagccaccactggagcggcaggacagcctggcatctgccaagcgaggcagtgtggtgggccgtaacctcaaccgtttctcatgctttgtgcgttctggagtggaggccttcatcctgggtgatgtgcccatgatggccaagatcgctgagacatactccattgaaatgggccctcgtggcccccagtggaaggccaatccccacccatttgcctgctctgtggaggaccccacaaaacagaccaaattcaagggcatcaaaagctacatctcctacaagctcacacccacccatgctgcctcacccgtctaccggcgctacaaacactttgactggctctataaccgcctgctacacaagttcactgtcatctcggtgccccacctgcctgagaagcaggccactggccgcttcgaggaggacttcatcgaaaagcggaagcggagactcatcctctggatggaccacatgaccagccaccctgtgctctcccagtacgaaggcttccagcatttcctcagctgcctggatgacaagcagtggaagatgggcaaacgccgggcggagaaggatgagatggtgggtgccagcttcctgctcaccttccagatccccaccgagcaccaggacttgcaggacgtggaagatcgcgtggacactttcaaggccttcagtaagaagatggacgacagcgtcctgcagctcagcactgtggcatcagagctggtgcgtaaacatgtggggggcttccgcaaggaattccagaagctgggcagtgccttccaggccatcagtcattccttccagatggacccccccttttgctctgaggccctcaacagtgccatttctcacacgggccgtacctatgaagccatcggggagatgtttgctgagcagcccaagaatgacctcttccagatgctggacacactgtctctctaccagggcctgctctccaacttccctgacatcatccatctacaaaaaggtaaggcccagtgcaggcaggaaactcgtcctgagtctggctctctgctgggccctggggagatggggatggcctggatagaatggagcaacttgtctttatttctctgtctcaatcattcatttaacaaatgtgttgggctgggcacggtggcttacgcttgtaatctcagcactttgggaggttgaagtaggaggatcacttgggcccaggaggttgagactacagtgagcccgattgtgccactgcactccagcctgggtgacagagtgagaccctgtctctaaaacaaacaaacaaacaaacaaacaaacaaatgtgttgaatatcaactctgtgtctgtggcaaatgtgcttctaggtgcagggatattgttgtgcacaggcccggtctctgtcctcatggagcttgatatttaccttcttgtcagttcattcattttctctgtttgcatctcgtttacccatcatgcatggtgtcatgctgggttctgagaacacatagatgaccaggccccaggccttgcccttgaggagccggtaggcccttgggagacacagacccaacccagataacaagagctcagagtgggggcctgtcttgtgctccttgcaagttaacctccccacctttgcagctttggaagctactctcaccactgtgtattctctttatgagcgtcttgtctgtgtgcaggaagatccctgtccccattttgcagatgaaggagctagtgtccacagaagagtggttgcacagcctgtggcccggctgggactgtcccttcctcctgccacctccccaaggacacgtccatgttggccacttcccaagcctagccatgttttcagttctcatgaccccctctgtgggggagggacaggatgggcctctgcctgttactgctggggctgtccatgaactgccggggaaatgactcatcctgggtcacacaggggcactctggctgggccaggggtgcagaatcaggggtccagggcactgtccacatggcctatccaactcctgcttcccaagcctggcttctcttcttgcctgaggagagagccagtggctgccccagcaggtgcctgagtcctgggcacagctgggagggcagatgtcaggagagaggtgtgatcctccctggggctgcttggtaactcgtctgcagggcgtggagctggctccctggcccttgggccctgaggttagacctggcttggtggggagtttgactctgggtggggccagggggcagacctctgcactgagcctggggaacaggaaacatgtcacccaccaccaccagggagggcctggggtaagctggccttgctttcctttaccaagaggttgacttctataacttctccagctcccagcctcctttctccccttgctatatcctcttcctcttcctttctttctgtttttttttttttttctctcatctctacctttcttcctcctcctctgaactccaggaaacacaaacctgagtgctagtcttggctctgcccctagattgctgtgcgtccccggggagtgcctttgcccctctgggccttagtttcctgatctgtaaaacaagggaatggggtcccagtgagccatcaggccttcaagggagtgggtgggaagggactcctggggagggtatggctcagaaacagaatgacaccttagctctggctctgagcactggggcaggagtagggcaggggaggtggccaggcctgctgggggcccactggggcaggtgtctccctgagcacaagtgggaaggctggttcaaccagctccttagatggcttgttcctgtgcaggcagcaggagggggaatgcaatgattaaacagatgctcccatgcagtggctggggaccccccacccagagcagagctgaggacattagggcagccccacacctaggaaggacaccagggcctcccaggctggggggaagccagaccagcctttctgaccctgggcagagagacagagctgagataggccatttctgagtttctacttgaggtgtttctaagagtcagaggccactgtcctctgtgctggtgcatttgacctgaaacagaggccagcccactgccttccctccccgggaggacccctcccaatgggccaagccctctctggcttactctaagttctgggctctgcactgctcctcccaggcctgtggtgtggggcaagttagggagggggtactgagacagaactggacaggctttggggaccacagcccaatgggagtgataaggagggggtcctaatgctggccttaggggtggagcccttctcaaagaaaagagaagaacagttgggtcctgggcccccaggattctgtccagcctgtctggacatctgaatgggtggtgagtgtgtgggaggaaggacagtggaggcctaggtgggagtcaggagaccaggatttggacaaactttgcatctgacatgactttgggagagatttctcccctcagtctctaggtgagtaaaatgggacccgagggtcttcatttccttaggagggctccatgtcatgtgaaacttacattaaacaaatttgtatgcttttcagaaaaataataaaatgaaataaaatgggacataaaccctggctggagctgagaggagcctggtcctcccacgggcctagtccctgtagcccaatccaggggtctcctaagagaagggtaaccatataattaaccagggcagtttggggcataaaagggggccctagcaatagtgatcccgggacaacaggggaaagtaactgtccagggcaagctgggacgtatggacccccaacttgacagccagcaagagcggggctggtcctaaggctcacgacaggtcaggagggcgatgtggtcacttccgttttacagacgaggtgcagcgatgcagatgagcctcagagcaggagctggagtccagtgtgtctggctccgcagcccaggctgtttccactgtgccctcccagatgggggaggggatccccagggatggagagctgagccagaaggcgaaagaggagggaggaaggcttgggtgctccttcactggtcctgtgggctagagagaggcccaggaccacagagcttccatggaggggccatagggacagcgtggccaaggcaaagtggcgactgtagggacaagttcttgcctgggggatgggtgggttcagcctctgggttctgagccatcatctagccttccctctaccgctcatcctgtaatctcagcactttgggaggccgaagtgggcggatcacaggagttcgacaccagcctggctaacatagtgaaaccctgtctctactaaaaatacaaaaaaatagccaggcatggtggcaggtgcctgtaatcccagctacttggaaggctgaggcagaagaattgcttgaacccagcaggcggaggttgcagtgagccgagatcaagccactgcactccagcttgggcagcagaacaagactccatctcaaattaaaaaaaaaaaaaaaaaagaaaagaaaagcagttttcaagccataacatgtagcatctggagcttctattgtatctcaggtgcgctcctttgaactgtgtacatattagttcagttaagcctcaactatactatagggcaggtactattattatcccattttacagatgtggaaactccttaaagcactataccgtgtgagaggttgtcaacagcatcacatctagtgcaacctgtcccactgggcagtggggagacctggagcccaggcaagagcagtggcttgctggagaggatacagctaggactaggactcagacctcctgctccctcctgcccccaacctggggtggatgttaactgtctccaagaggcaggggcaagatggattgaggtgggagcttagggaatatccctgggacttgcagctggtgggctccaaccctcctttctgcatttttgggacccagcctgtaagaggagtgctgaggcaggaggtccccctgggtcctcagctctcaggttaagtcttaagtagaatgtcggggggatgctggacaggcctgagccctgactcccagcctgtggggtggggtgcattagcattagctggtcctggccccagagctgagtcacagggtggaggggtaacggagaacagggtggggcctctgtttccccccgacctctgcagcctttgctccccatccctggcctcctgcctgtctgtggatacctaaccattgcaatgggttcattcttactctttgggctcctcatcagcaaaagaggcctttccttcctctaaggccatggacaggaaaagtctatagatgcacttccactgtgccaactttctcggcaggtggaatccaggctagttcagtatctcctctttagctaggttccttctgcggaagtttaactccagtttcttcaccctgctgttttctacctttcttcttacggttcttcctactccttgggaccttcttgaatccctgtgtccaacgtctgggggccccacacatatgcctgaaggacctggcatgggctccctgcagcagaagtggtgtccgacccccagctgtggaggaccaggcaggaaagaggctgggagtcctgggcaagttcctgcccctcagggccttggcctcctctgtacagtagtaggatggaggtggaatcgagggttggacacctgatcttttgggcctttctagctctgaagtctcttactgggtcctatcctgggccttggggtgatcccccttctgctgcccagggctgggctgttgagatggtgcaggaggtggtccagggaaggtggcagaaggactgagtgggctgggagctggggaatgcagatttcttttgggcgctgtgtgagcagccctggagactctctgaacttgagtctgtttgcctgaaatgctactattagccgattagccatgcacttatcaactaacatggatgttgccccttctaaaggcatccagagttattcccagcatgtagagccctgggcctgatatacagtaagtgctcaatgaatgcatttagaatgcactggacaatttgagccagggagtgaagagaatattatctagacagccctcaagagccctccttaaaggagaagtgggaaagcatgggtattgagcatgctatctgtgtgtagtgggtgcgtttgcagtgctcaggggtgtgctgtcctctatgccaacccttccctgctcctaatcttctttgtatggtggattctctgcagccctcggcgactgagtgccaggcacaggcaaacttccttctcttcccagcaactgtccccactggcttaaaggcagaattcgtcaagtcccttttaattcagaactgaaattcattcaccagctgcttgttcattcattcagattcttctaaattgggtcctctgcccaggttcatctccaccccccatctgtcacctggttattacacaacctcctcgagttccctgggggctgggatgaggagggaacagggcgtgcatgtctgggagatacaccaggtggcctttgaagagttgttttagaatcagcagtgtgatgggggtgggggtggggagccagggcacaggtgacatgggagagacattctgtcaggggaactgggagaggctccagtgtagaagtggcacctgatcggggccatgaattatgaataggaatccagggggcagaggtaggaaggtaggaaagagccaggtgagtttgacgaacatgggggtcagtgtggaatgcgtgcaggggccaactcccagaggtgagggccccccaggccaggcagattggtgtggaccttgatctgtaggtagtggagagctaggaaaggtgcccagcttgggatacctctttagatgctgcagagaacctgtcagaggctggggcggagggcagggagacgtggcggggctgttgtagcagtccagtgagggacagggttgaatcagttcagcaggcctatatcaggatctgctgtgggccaggccttgttctgggtaccagagacacagagaggttgaggacaggctctatcctcattgaattcatagtccatcaagcagggctgtgactggtcacatgtgggctactggtggcactgcacatttggagagaagatgatgtgcttggtttaggaggtgctgagggtgatggcttgggtaacatcctggcagagacacccaggtggctggaatgtgggtctggggctcaggaatgacgtccgagttgagctgatgagggtgctgtctgccctcaagggtacagggagcacatggagatcagagccctcacacgctgtcctctgctctgcctatgccaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaa

SEQ ID NO: 931 - DNA, 5996 bp, Homo sapiens
ataggatttctgaacaatatctttatttagctcaggtagttgttcttacacatttttggatacctgggttagaattttccctattacattaaatcaatggttcttaagctcttatgcaagcatgcaagctcaatgcaggctagaatagaaggattgttgtgtacaaacattaaaaatagacattttattacaagagtgtagagaagggagaccaatagaaggtaattgaaatacccccccctcactccagccctagtcctggtgcctggatatgtgcactccctgtgcgctctgatccccgcagacacaagtccccagcccctccaggacagcaataagggtcttacaaggccagaaggcagccctgtttgttcctgcctgcaggaagggcagaggaatgtgatgttcccaggaactgtgtcctagacccatagggtcagattgctcagcctagttcaagcagtgagactacctctgtgccagtatcctgggctgtctcttcccttcactcttggcagctcccaattgtcaaagattggacagggtcctggtttggctagttctaacttgctgaagccagtcagcaccctcacagagccagctaggtactgggcccaggggcttccagagagttcttcagagcttctcagaggcctaaggacctcctaaccctagcaggcctcctggctcaagcacaacttgggaaggctccatcagcatctatgtggccctgttttacctgttgtctctggagggtgtgcagaggcaagtccagggtaggggcaggcaggatcccttaggcttgcccacagcccagatagcaaaactgcagccagatcagtgtctatgagtttcaggctgaaccttagaccacataggccagcctgctggtctggctgcccaaccagaccaggtagacagagtctaggcctcagggctctcaagcacctaagagcgcagctgcatttggaagtgctcacagcaggcatgcttcatggttagcccatagatgggggtcatgtccaccttcacgcccagtggcacgctgaattccacccgttgcagcaggatagccaggaagagaaagacctcccagcgggcaatggtctcaccgatacacttccgcttgcccatgccaaagataatcaccttctcacttaacaccttgtcgatagcaccatcaggggtgagaaaccgttcaggtaggaactcagatgggttgacccatagcttcctgtaaccagagggagacagctgaagtggcagttcagggctcagaagtgtcaagtgagtggagctccagccccaaaggatagaggacaggcaagcagcccatggacaggaggatcaatgcaatgattgtattaatcatatataagagcttaagagggtggacccagcctttcctctgcatctctgaacttactggtcatggttgatctgccactggtttacaaagacacaacgccccttggggatgtaaaagcctttcaaacttgtgtctcttgttgtgctagggagaaaggaagctcagtcaggctcagggcaacaggcaaatctccctgtctcccatgccgtgtccctcccactaaccctaatcaggtatgtggtccggagtaagatcagtaacagacagcagtggctccatggggccttacctgtgggggatggtgaaggggacgaaggaagagtgtcggaaggtctccaggatgaaggcctccatatagggcagatgggatctgtcagagagccggggccgccgtgacctgccaatcactgtgtctgcagaacacagggacaagatggatgcaggggctgcctagacctggccagacccctggcactgacccctttgaagggagccactacctacctagctcctcttggatctttctctgtaccctggggttcatcaccaaatacatgaggctccaggagatagcagttgtgactgtgtcaaaccctggacagggtagaacagaagaagttaggcaggcagcagcaggtcagggcacttgagcacaggaaggacacaatggggtaaccataccagctccaaagaggtccaagacgatgttaatgatcttctcatctgacagctggacattggcgttctcatccagctgcttctcctgacagtgctcaatcaggctgtctgtgatgtcccggatgtggcccttaggtagggaaagtccacaggtgagcaagatctcaaacccagagctacctctccatccaggtctggtccttcactattcctagcacatttgttctggaggtgatgccccctgaggctgttgtcccagcttctctctgcctctgcaaggctctctcctactaccttagaatgctgctagccccaactcatgggacatttgacacacagcgtcttgtactgttatcatctggatgtgctctttatcttctttctattatgaggccaggagatgaactctttaactcttcctggctccctcagcaactgccccagggtcctgcatgtaatgactcttcagtggctattgctgtctgtggaagcatggaagggttagtcaagataaagttctatttccctgccaaggaagaagactattccacaactggcttcaagatcccaggttgaagccttcctgagaacttgccaagccccatgcagttcctcttacctttgacctcccaggccctgatgccatctgcttcccaccacccacctgcctttccccagactgtaccttctcaaaggttttgtagtgctccttgaccatcttctgcatgaagctgtagaacttctcattcaggtccttgaaggcattcagggaagggttgggtaggtagcgaagaatagggatgaagtcagctgggtttccagagccaaccacctccccgaaattattattcaggttgactaggctaagcagttcttggtggttgtggtcatagcgccggccaaagcaaatggcacagatgacattggtcactgataccaccacatacctgtaggggttaaagtgcccaggccctgccatcagctcctgcaacgtgcttatcaggacctcagcctccttgctcacatgctcttccaggtagcaggaggttgaggaggctgggtcagaggcaatggagaaacttttcaggccattctgggccaggcgccggcgggcagcccacactggtccagagtctgggctgaaggacatgctctgaccattactgatgagggtgaaggtgtagaggtcgggccggcccttgaaatcatcgccctgccgcaccagggcctgccggatggtgtccaggccgctcagcaccaccacgggtgtggagccaattcggatctgcagcacgtccccatactgctggctcatccttgacagtgccaggtgcgggttctttcccagggtcagcatgtgcccaatcagaggccagccccatggccctggtggattcttcaggcctttggggacctgaggtcttgaggccctgattacccagaataccagacagaagatgacagaggccagaagaaactccgtggccgacatggagattgggaaaagcatgatcagtgtagggatcttggaggtggctgctgagagaaggtgcaggaagaaaaaaagtcaagccgtcagattgggggatgagaaaagccaatatctagagtgtcagggaaaggggaaacctttccaccagaactgcttactgggcatgaagaagagggtgaggtggggagaagttgttgaactaccactgtgggctaagaatttcacagtccttcttcattcagccctggccacaaatctatgaagtagcctgcaatgaggctcagagaaggtaagtaacttgcccaaggtcacacagccagaaagtgttggatgcagactcccaagccaagttgcctaattccagaacgctttctcttaactgctgtaccaatctaaactgacatcttccaatgtcaatctgtgatttccacatagtaccagtactgttatttacttcacattttcctaaaatcaactttaaatctacctacatatcatcataaacaatatctatgtgaaagtacaagtttgatttttcccctaacacattaaaataaacacataatcaaggtgtatcaccccgagtcctacccaccacacttaggaaaatcatgttctcaggggaattagggatcatctgatcctttagcctcatttaacatttgggggaagcagcgctgacttgtccaaagtcccccagcaatcagtgacagagccaggactcagactccttagggacacttccctggaaatttccagctgctgtcacatgtacctccttttgaagagtggtcagatcaatgaaggaattttcccagaaccctcagttctctgctgctcaatcccaggatgcaggaaatcccaccagaccccaggacagactgaggaagagataggggacaggatggccacttcccaaaccacattgctttcagccccagctctctgagttcaactgatccacagtttaaaggcagctggagaccagctagattgagctctttagtcagagaaatccaggccagggtttttttttggctcaattctcaatgaatgaacagtttggacctcccccttttgcaggttaccagagagcagagaataaatggaaggttcccactaggctgtaagaaaaccccagactggaatcagggaaatcaggaatggatctaaactgaaaggaaactgaggcaatactttctctgtaagcttgacctaaaaagggtgtttaaattcataaaccactctctccaacatatcaggcatctctgcctgttaccctggactagaggtcagtagacccaacattctagtcaaagtgatcttggactgcacattttacttttctggggtccaatttcaacatctgagagagggtaagacaagatctctcagttcagagtacccagctggatccagagggaagagaaaacccagatctgctgtggggaacctgacagtcttaccagttaggctccccacaggagaacctcacaagacagggagatggatggttcctaccacaagtattatagtggagggaggcttcctggaggggctaaatatcaaagcacactagatccctgagtcaacaggggacagtgccaggctttggtgtgctatggtgtccccttctgcacagtgggtatcccaaggacctgcagcctttgtaagatggtaggaggccaagggagatgtgactggtgagtttttagggactggtatttccagctccctgcagttggcaatctgtcaccctgattgtctcccagcaaaggacaaagaagatggtcaatgagataggaaaggcctgggactcctgcacagatctgcctctattgtcccagctgtctaggacatctcagcactgacaagccacccttaggagggtaaaatctgccaggggtagcttcttaggctagggcagggtacagctggtaagaacccagcccaccccctccatccaccctgtccacccaaggagaagcccctgtcatcagaaagcctgagggaggggctgcacatattccagcctgccaggtggccttgatggggaagccccagggtaggcagggagacactcactaggggatggagctggagcctgggtcctgaagtcctgaatgagatgccatctgtatctagaggtctggtaccagctgtgggaccatgggcaagtcctcctcttcccctggcctcagtttccccactagggggctagactgcctggtcactaaaaacactctgagcctccctttttggaggtgctagacaggtagctacctaagaagtcctggaggcaccaaaatgttccttttattgggagagaaagggcaagccagaagtcccccagcaactcacctgaggtactgagctgagctgggaagggtggactcttggagcctgggatcacaaggatcagggaaggttccaaggaactgtcaccttcagggtgag

SEQ ID NO: 932 - DNA, 140061 bp, Homo sapiens
gcaaaattcaccaaaacaatttttatttccagtgtttaattgggtatgcacacaggcatgacacaggtttggattcattaagtcctcatgcagaattatattcttctcgataaagaagccagttccatccaggatccactatctacacacctatgttacaacattatatcaaatctggtatctgaagaaaagatacacatttaatatgttcatttaagttacgtattttacagaaagattaaaaattcaagtcacacaaaactcaaaaactgtattaaaagtttgaatataaaactcagatccacctggaatgactaaagaatggaagttctgtatccacctgtgttaaaactggtaaatgtaatgatatctgttaccaataaaacgcattcgtttattcaatgtaagtaagttatctaattttaacaatatggcaccctaaaaaccaactgtatttttatgatgaggcacttttgttagtgatgaaaccaaaagaacaaatttgctgcacactgatgccagcgattttcttcagtgattttgggtatatgctatgtagtaagttgcaacaaataccttgctcatttgtatacaactatccgatatatttttaaatatatatatatatatatatgttcttctggctgtagtaatgcactgtaaagctatttcacagtgcaaaatgatgaaaccagcccaaatgaaggctgcataataacaattctgatacaagaaaatattgacagagttactggaacgtgtaacagtagtttttttacttgctagagtggacatacccccagtttaaagacagggatgaaactctgctttactgcctggggtttcagacagtttatgaggttgggcattcgctgcagaactagcatttttgctcacgttctggaagctttctccgtttatttggtcaggtgactgtggtggtatggaaagaaggggcctgtttgttgaagccaaggtgctggaagaactgcctgtgttgcaatgaagagacaaaggtgtgtcggtcgtggctatttctcgtgtgcttgggttctctgtctggggatctccgatttctcctctgctaaggtcagaggtactggtgcgtaggcgttccctggccagccagtctgagatggaaaggtcctgggctgagcattttggttttaaccggtttacagctgaaagttcagattctctctccccgctctgctcatgcactttccaaaaattcaaaacgctgatttcggtagcatctctgtgccctcctagtgtatgtctgcgccggatgcttttccttttagcagtctcggcattcactttgtgattccctactccaaacatgtcatccgcaggggctctgggtctcagttttaaccgatctgctattttcgttttccatgtgggttcctgtttttcggattcgcctctggtgggtgtcagtaaactcccagttgactttccttttttcataacatcaaacactttagttaacgaaggtgcttctttctcattcttggcatctcctagacttccactatctgacttgaatctagctgattttttcctggaaagagtatcacattcgatgagtttatgggaactgaagagctgtctccggctatctaaacttgatgttaaacttccctcggtgcaacttaattcacttccttcagaatttctccggctgctcttagtcacttcttgcagttttcctcggaaaagcctctctgaagtcaaggctgtggggaacacgggaaactcgctctcgctgtcggtttccacaggccgcccttcactgatgagttcgcttctctcgtcatctgcctcgtcccccttgctctctgccacggattgcacctcagggctcagtcgactggagtccaggctagtcaagtatgtagcagacgatgtggtggaataatctgaggtgatggtgctgacgttggccaaaaactcgctatgtttcgtttctggactggttgatttcttcatggaaaaccttgccagggaggcctgggaagacgtgctgagcaaagtgccagagtcagagcctgtctcttcaaggtgggaggacttctgtgccagaagtgacctggggctctctttcaggatggcaaagcgacagctgagagttggtgacttgttgtgttttgagttgtgtggtggtgagggttcttcagaaggcgtgctctcttttcctagtgatatcttttcatcttttgtcgtgctggggtctttcctagtgctgttttctttggcaatgatgatcttctgttttctgcccagtgtctcactttcttttttggactcctctttagtatcattgtgacactgttccacattttctttcttaaaaaatacattgtccagttcatcttctgagctgctaggctgtgctttttctttcggcttcttcctcttgcgactagcagctgcaaagatggaggacacaagcagttccctgctatactgatcctttccagatccccaagaaccctgggaagcaagagagaagaaagactctgagcataagaatgcagctgagttcattttctgacaagcttgtctcccaaatatttcttatcaaattatatctactaaagctctggaagcattaacagtgcaattagctttttttttaatacctctttttaccttgaaccaaagtcaaatttttatttaatgagtccaatttcttgcctcgtggtatttaactgccaagccacagctcatacacatctgcctttcaggaaaatagtctgtgcttagtgctgattcctatcaaaatcccccaaacacctgaccttccctccttccacagtgcccaggcattcttcacttccttcatttggaatagaggcatgggataggtaaaacaatattgtgacacggtcaaacatcatattctgatataggttattaaacatcacattctgatataggttattaaatgtttatgactgactttgatttttctaattacaggtaccacatgatatagatactgtatcagataagctcattgagataagggaactctggtcttccattagttcattcaggcaggatcttcaaggatctgccttaagtaaatcaggttggtaatgtcttcatttatctcaaggtaacaatggaattagaatattcaaaaaacaggccaggtgtggtggctcatgcctgtaatcccagcactttgggaggctgaggcgggcagattgctcgagcccagaagttcgagatcagcctagggaacatggtgaaggcctgtctctacaaaaaattaagtgggcatggtggcacgcacctgtggtcctggctacttgggaggccgaggtcagaggatcacctgagcctggggaagtcaaggctgcagtgagcatgagggtaccattgcactccagcctgggtgacagagtgagaacccaccccaggaaggtagaaaggaaagatcaattaacataagtacaattaaatccttaccacagaaacactgtagtgcagtgttattgggaaagttatttgctatgtataataggttcttttaaaaaaaattttttaagatggagtttcaccatgttgcccaggctggtctagaagccttagtctcaagctatcctcccacctcagcctcccaaagtgccaggatttacaggcatgagccactgcatctagatataataggttcttgattgcaactattagtttcttcctaaatatctgctggtttaccacacactttttaagacaagcaggtaggcaggaggtatgctgagtaatagaaacagacagtatatttctctattgcctgcaaatcttagacaagttaaaactgctctatttaaagtcttaaagtaaaaatttaggctgttctatcaaagaatttaggctgttctatcaaaaattcgctaagatgaaatcacagatgaacagaactttgtttttacaagttataaagactttcataattatccagcacatttctaatggttatttacatttccccacattgtgctgaagactgtaggggataatggttgtgactgggctctcaattgggagaccttgatgtccatcctctctagcttgctgggtacgagcaagggattcacttttaaacatctcagttccgtggcgagaagcaattagattatactgtctttcagatttccttaaggttctctttacaattctatgatcatatatgtgttgaggcaaattactctacttttctacagagactgtttgttagaagtagttaatcatgtcattgggatatccactatattacaggcatagcataacaccactatggataagatgaaaaggctactgtaataacaggttaagaaaaatgcatctagagaagggaaaagcagggatttcaaacaggtctctctggtttaaaatctcatctgctggcaacagagttaaggaaactgttctagattaaagaagtctaaagagatttgacaaagaaatgcaaggaatgatccttgactgcattctgtataaggaagtaaagaatattactgggacaatctgtataaaaactgcacattagataataatgtgttgtacttacctcagtttcctgagtatgaaaattacactgtaattatataggagaatgccccagttctctggtgatacatgctgaagtatttaggagtagtgttatctctacaagtaactatcaaatgattcagaacaaaagtgtgaatttacaattgatgaatctagggtaaaggatttgggtgctattattttagcagctttagggtaaaggatttgggtgctattattttagcagcttttctgtaggtttaacatttttcaagataaaaagctgggcaaaaagataaacatcacaagtaatagagacatgataaagcatttttgtaagaattataatttaatcatatggagtcctgttatgatatttaaacatgatatgtaaaattcatgtctcattacaaaatataacaatgttttaagaagtctgacaattccagttgctactgcctcaacagtgcaaaatttagatccactgacttgacaaaaaactttctaagaactataaatgtcccacaaactactcaaaaagttgtgtaattgagggaacacagattgtgtaaaaatattatttaaaaaattagtgatttcactgaaaaggcaagactatactgtctgtaaaaatgcataacaaaaaattggtatttctgaaatatttacagatgatatgatgcttgggatttgtgtaaagatggtcctagagggagggaagcaggtggcgtacagagcaaacggagtcggccgagtgctgataattactggagatgaagatgggtgcagggaggcttctcattttattattcacttctgtatatgttaggacctaattttcacattaaagaatggcctagttctttgtattatgctaaaactgcacaatgagaagaatatgaacttttgagttcttattccaactcaaaatctagtattcttcttatcatatattgttttaggaattaattttttgattatactttgttgctctgtctcattagacatagagaggaatgcatttgtgtatcaaccataacaatcagccgaaaaacaattcccccctaaaatatttcaaattgtatgaaacaatttaccttagattttgttgagtcactagtagctgaatctgtgaaaaattaaataaaacatggtcagtattagccaatctttactgctttccacaaacaatgcaaaacttatggaaagacaggcacagaacaaaatgtgaaagcaaaactcaaaacaatagaacacagtggatagtcagagctcacaaagatgcaagctgcaccacagaaagccaccgccatgaaaggatgctgtgaattgtaggcagaaccagctcaatgatagaaatggcaaaggagccctgtgctaaacaaaaacagaaacactcgtgtttattagactttctaaatattaaatctagcaataaagaagcttcaggacagtgtaataattttcttttttaatgtaccacatcctgtatctgagactgatacacaatgtagaactttgaagagtgttggccgccctagctacaattgagacactcatactggcatgtttatgttgatttttgtcagacttaaattttctgagcattatgctgtatgcgtatggatgcaaaagaggcattaagataatcttgcttccaggtcactttggttttacattaaataatgtttatctttgtgcttcagaccccagttccatagcagtgcagttgagggatccttttgactagtttggttaaattgctaccagttttgcaattatctattaacaaatgctgttatggaaatggaaaaatggagaccataattttactgtctggcaaaaactcagattatacaattataaagagggtaggaaggggctagcaatattcaggataataccaattttgaagtttcatctttcaacattagggaaattggttttcagaattaatgagctgagccccatgccacgccccttttaacacatggctaaatgctttatgactttaagaactggtagaccataccatgctatttctcctcagggtctgcttcagaaataacaagaaacagcagaaaaacttttaagaaagtagtattgatctgtttacaataatcttatgagaaactttacaccacagatcaactatgtttgcatttacaagaatcggggatttctgcagacaaggcagctacagtgtggacaacagtcctccttcttcctacagttccagctgtccatcagggacatcacagaatccactagtgacattaccgtgtgatagactcctcccacttcgcctgttcaacatcagtatagatttgcctgtgtcagtaagagctgaaaaaaccctttaggactaaaacaagaactagagacaaagggagaacattgtgtaaaacaacatgctagattagtgcaacagtttggcaggagaaagttttcatcaaaagagcctagaagaactaatacttaaccaagcattagggtggcaacaggaaacagaagaaaataaatgtcaaataggctggctttttactgtgacaaataatacactgtatttatgaaaatgtatttatgaaaatggtgcccattaccagttcaacagatttaacttgctgcttttaaacagaactcctggctcaagaataagaactacttatacagcccagatcatactttctgccatcacagcaaccacatactcagtagcatatatctgttttaccttgtgatgactattacatggaaactgtgaattaaaaaaaaaaaaaaaaaaaagaacaaaacagtggtttgcatgctcatttccctcatagttccattctgacaaacattacaactgcatgcactgccaatggcattagagtcactggaagataattcagatcaattggaaaaggaagattaaggttttttattagtagaaaggaagagaaaaagaaaaaaatcataagtaacaattcactatgattgatttgctctttcatattgtaagaatgtagctttcagcctagaggtcaagactgcccaggcaagagttacctgatacatctcctggggagactcctgtccttccaatgttggtgagtaaatgatctatgtttggcactggctgggagtctactgtgctttcctcctgcactgttgtctatggttaataaacaaagatctcttcatcatctcttcaaagatactttctttaaaatttaaacaacatttagtaaaagacacattactaagtaaagcacctgtgcttaatgtgtttacattgtttacgcataattaactgcaaaataagcaccgtacttgtatattcattagatcagaaactgagctagagacctgcttccggggcgcaaagcggacaatagcaaagcaggaagttgacattgttggcgcgccaggatcttgtgtcccaaatgaaactactgagtacaaatgctgacagacaatacttacaagaggctcttcagcaccttcttctgtgaaaaaccagtcatgctaaaatttaaaaaaggtgagaagagaaattaaacaagcctttaaatatactgagatcttggaggatagtatagaaaaagggtaattttcttagggaaagatattacaaccaacctctgtctgaccaaatagcggctgcccgtgaaaatgaattttcttgcagagatgaagcatgaacttacagagatgaagcatgaacttacgtgctggatgagcgtttctacaatcttgtactggtcaggcatgtgggtgaccatgtgggtcatgttgtcttctgatgttcgaacaagggtgggaccaaacactattgctaggtttcttggttccatctgaaagaaaggatgatactgggaaataccagaatttttcttaaggaagtaggctgaaattgccattgtaggatttttgatgaaaaagaataaacagaaaaatagctttgatgtagattaaaaaaataatgctttctagcaagatttttttttttttttttttttttttctgagacagggtctcacgttcacccaggctgcagtgcagtggcatgatcacagcttactgcactctcgatagaatcttattatgttgccaaggcaggtctcgaaatcgtggactcaagcagttctccagcctcaagtgtcagccaccacaagtggcctagttaggattttcaaagcaaatgtgtacaaaacgttttttctgcattaatgataatgtgcaatgcataattagcattcatttttttccaagaagactttgattgaaaacaactgatttggttcaaaacgagggttaccaaagctggattaactgataaaaatgttaaaatcaaaggaaaaaaaaacttgcagaagattacaggcacacctgtagtcccagcactttgggggaccgagtcaggtggactgcttgagcccaggagttcaagacctcatctctactaaaaataaattagtcaggcacgatggtgtgtgcatgcagtcccagctactccggaggctgaggtgggaggaggtcgaggttgcagcctgggcgacagagtaagatcctgtttgaagaaaaaaagaaaaaaaaaacaaaaaactccctccccttcagaaatgaaaagtggaagaagtgctgaaaaatacatgaaaggttatagatttttccctctagtacatcaaaatcactaatgtgtaaacacccagtgtctggaaatattatttctgaccaatttttacttgaaaccaatcttctgaagctacattaatttccatatttggtattccttgtataataattatcagattgtcaaaggtatggatcttttgttttccttcattaaatcttatagtatctgatatattttgaattcagtatttgattaaaataactttaatcaaccctaataacatcccaggggggtaaaaaccactgccaaactcaaaaagccaaaatggaaaaaaaagaaaagcaactgctgcacacctaacatgttaactagtagtgtagcacacatacaacgacaccatcagtgcagaggaagaagaagaaattgtgttgaagtcaggattcttctagagagttggcttggtagaaagaaactatgtgtgggaaaggtgtacttaaaactgggcacccagaaatgtttctggtctccctctagaatatgtactcatcctcctcttaaatctgtgctggtgctggtggctcaaaaaacagaagtctaccatctcaaatgccttatgtaaaatttttactagactcttgactatgatttatgtttttagactaatgataacaaacattaatatttatatgtatacaccgtaatattttatctgggtaaacagtttcagctggttcctacataaaactggtaaaatagtctacagcttattcataaatttaaaaattgtatttttcttgaaagatattccataaaataccataccccatcttcaagattcagtgtaattaaagacacaaaaaattcttcagtaaagacctatgctaaagattaattcagtactttctaaattaactagaccaacagtactcctaacattcagcaaaactgatgaatgatgtaatagatttcagaaaatactgaaattaattagagactatttcagctataattatattgaaaactctttggctcctacagtatgaatttctggcaacagtctaggctttcacttcctttctctctttttttttttctaaccattttgtagccctatcaatcactatggaggaaattgagcacctaaaggaagtaagcttcttgatttgcaggtaatagaggttgacactcttctcataatcaatccttacaacttccagaacatgcacagtcactaaactgatctatctttcttaaactgatctttctctaccttaaggaaaaatcactcagaaaagactgtcagcaatattcctgagcttgtggtattcttttattttcttctccagaaattaaaacgactgcttcagtactttaagaagtaatgcccttgagttagaaaatcatcattttaaaatctctgatgatataatggatttaggcaataatcatcaaaaaactaagttaagactacaacctgtcaaccaaataccatgtgtagaccttgtttggatattgacttaagcaaataaccctacaaagacacttttacaatcaagaaaaactgaatggggctgcgcatggtggctcatgcctataatcccagcactttgggaggcaggtgaattgcttgagcccagaagtttgagactagcctgggcaacatggtgagaccctgtctctaatataatttaaaaaaaagaaaaactgaatgtgaactgaatattagacaatataaagaatatattttgttgtgtttgacaaagaaaatgtggtggtgttaaaaggaatgaaaatgacttatctgtttatgtctgttttccctgtattctatttggccttttgactgttgtagcgtatgcatatgttacctcttcaaaatattgatatacagctaaaaaatgagagaagtaaaatttctgactttttcatttttcttactgaataaccataaaagaaatcttttaaaatatccttttaaaatggtgacaactggtattttgggatcttttgcttttaaaaacaattttaagaaggacttacccagtttgatgttgaattacaaaccttttattgactatttggcatgaagtaatgaagcatatcttttaaactaaagccactaaaagtacatttcttcaataagcattttacataccttatttttttctgaattttctgccactgtcttcagatgagctgaaaggaacttaagtgtttcataatgatgttcaggcaaatcgtgaatctgaaacagattattttcacaatggattcagaggctgaattttagttgtatcccccaaaatataaaataatacctactagtctttttaatgttttcagacgatctagaggatcttctttacgattggcttcaataaaatcagcatatttatctgacgacaagaacaataaaacaaatttatcttaaattgcctaggtgaattgtaatctagtttccctttaaggatcaattttaaaccacaacataggaaagagttctaatagttttgaaatgtaaatttctaaaatgtaagttccctgcaggaaccatcctatatttacacagcctgtccattcctcccccaccctccaacaacatctagtaaagtgtcttacatggcacttaaatacttggcttgactgaaaaaacatttttctactcattgtaccttatgatgtcagaagccatttgactggaaacaataatattaatttggctgcaaacatgtatgaacaagataatacatatttcactgaacctaaataacttttatgtttttaatatatgagggagaactaaataaagcctcctgcttcctttgaccaagacattttgtccttgttcaatttaatattctatggttttccaattgtaacttgaaccatttcatctggtatctttcacgggagttaactcaccatttgtgaagagaggctcagggagttttctgaagaaggattttagtaaactgcttatcacattcaaatctcgccatttctaggtgtacaaaatagaaatatagtattttcatatccagttccaccaaagggggaaaaaaaaggatcagttattcaaataagcaaacttacatcatcttgtatatcaatatcagccattcccttgttgagttcttcttgcatacttgagatggctgcattatttccaggaactctataaatacctgtatattcaagacctctttcttcaactaatttgcaacatatgtcaactattaatggaatatactgcaaaacaagaaataaacattttatttaatgcagcacaaatgtttagtagttgtatatcacagctaaaatgcccctttcatccaaaaggaaacataaattgctgttatgtaatataaagaatacagacattatagatctgggaatagataaaacctgcaagagatatttgagacagtaagaagagaacaaagagactgaaagaaagagagggacccccagagagataacattctaaaaaggaagtaacaacaggtaaagagaatgtggaaaccgttccgctgaataaagagtcaagaaaagaggaggagagagtaatatcaattcatgatacgaatcctagcatgggtgttttaaatatatgcacatacatttacatgtattatactttcttaatcaggtccttgttctcatccttgttttaaaatgctaaaagcagaaacacacgatttgaagacgaattcttacagaccatttcagacaaattcctaatggttgaataattattcaatttcggagtcaatacattagaaaaaaagcattacaggtcagaaatacttagggaaactaaggtctgctatgaaaaggaaaacagattgacagtctctgttgtctgaaaggctatatactcagatcccattataatcaaaactgaattaatgacttgaggaaatccggtgggctggtgtctcctacccgattagtatgagctggtgggcagtcatctagtcggacgccgaaagttcctgtagcagttggctttttctcaaatgtctttctcatgatacttggaatgccttttctccatgtgcctttgtcttttgggggactggtatcatcttttgattgccagtcaaaataaaacaacataataaaatggaaatgagtgtctaaatcatgactttaaaaacactttatcaatgtttacataaatccaagtcctgtaatataaataatacatcctatatttaacaaaaatatgttctcttccatataacttttacttcattcttttataatgcgtgctataattttctttaaaacagcaaaaaaaaaaactacatagaatcagtgtgtcatctttatagtgagacttcaacaaagggaaaagtaatagttttatttcaaaatgataggacctgaatcctcggagtcatttaaatttgtaatgtctctgatttaagtattgtttgtattttccctcactttcgctttataatgaagctggtgtcttgggcctcacaaagggaaaggcccaatgagcccagaccaagcctactatgaattttgagctagttgacatggggcctggtcagtagaaatggtacagaaaacataaacgtacctcaacgatgccaattttaaatcattatatttatttgttagaaagctaacatcaatacctttactgagaagtttcctttccgactcttccttcggagagtgtgggctttgagtctttggctctgatttagcaccaagcaaagtttgcctgatgctgagactctggcgaggtgtttttggcaactgttctgctttgctgttgaaggaaatgacatttgttaacaattacagtaatccccctctatctatggtttcagttacccgtggtgagccatggtctgaaaatattaactggaaaattcttggaataaacaattcataagctttcaattttgtagtcctgcccagaataagaatcatcctttcatcccgagtagccacactgtatacactacccgcccattactatatgggaaaaaatatagcgtagagaggatttggtactatctgcggtttcaagcatccactgggggtcttggaatgtatccttgcaaataagggggatgactgtactgattttatatccaaattaactgcaggcaaggtgggattctcacctcatcagattgttgtattcttttattcttcgactaattagatccctgttagtgactccagtgtcctacagaataaagtaaaattagaaaatcaattctaaacataaataagtgatccttacttttttgaggctttctattgtactgctttgcttatttaacacaaacactactatcatctgttctcagtggagctgtttcaaagcttctattcaacatcactgtgtgaaagattttccaagtgcctcccaacattgccaaagggttttgcttcttttctgtatccatgcgatacctaggatagtaccagcaagtaacatgtgttcaatacttattgaattgatccgtccatttaaaataaatgactaggaagcagccagtgttttctctaataccagaaagaatgatcagcatttaagaaatatacgtgtaagtgatttttcttcaaaaagaaaaacaaataatataggtggataaaagatgaaaacagactgccagaatttgttagtgactgactaatttttaaggatagtgaaaccaaggatcaactagtatcacaagcggcagttacattatcagaagataagagaaaagctcaaaatttgcatgatttttttttaacctctgtgagttaccttgtatgaaatgctatatggtaaacccagagttgaccataaagtgatcctttttttcctattcattccaattatacattgatattgactggggttctcaattttttttaacttgcctcattttgatgatagtgaatgatgatacagtttacaaagaatacagtctttaaatacgggagtaagttatcttgaatttaaatagactcttccaacttatcagctgagagatcatatgattaagatctagaataagactgcctggatttaaatcctacccctgatgcttaagtcactgtgtgaccttagggaaattatttagcctctctttgccactgtttccttatttttagaatggtggtgatgataataggacacattcatatggttgctgagattaatgcatgtagtatgtttaaaatagtatctgccatatggtatgtgctcagtgaattattgttttctcatctataaaactggggaaaatacttgtgtacctgtgtcttaagattagatggtgatgctaatagctcacattaagtaaatgtttattacttggcaggcattcttcacatgcattatctcattcaatcctccaaacagccactatgtgtcacagaacaagtcatctgaaggagttttaacaatgacagtctactgcctgagagaatgcctgacacatagtaggtgcctgttacacagaactcctctgaactattacttaaagctgaaatccacatctaagttcttattctccctgtttattttgcaaaaattcaggtctgatgccctctgtatagcgggtagttgtacaacataggttgcactgataaagatctggtgttatttttaaccacaaacaaggcagagtgtaaactaccaaaggaaaaaaagcacacttttcctatggtgtaacgttttaatactttgaattggatataatggaaatgactaaattagaacataatttgcataagtttacatttaatgtaggcattcctgagtattaaaagagaacttcgtgccccttttttggttataataaataggcatgaaaagtgagaacacagtgaagaaaaaactgtgttaatgataagaaaatacttgagcaactgctacttcatcattgctagatttgcttgataaagtttatagttatacatactttaaaaactatctttactattgaaattcctactgtgaaaataccttgatgatcataagctgtaaattctcaaatccctaaacactgttctgcatgaaaaagaaatgctgggccgggcgcggtggctcacgcctgtaatgccagcactttgggaggccgaggcgggcagatcacaaggtcaggagatagagaccatcctggctaacacggtgaaaccccatcactactaaaaatacaaaaaattagccgggcatggtgacggctgcctgtcatcccagctacaggggaagctaaggcaggagaatggtgtgaacccgggaggcagggcttgcagtgagccaagatcgcgccactgcactccagcctgggcaacagagcaggacttcgtttcaaaaaaaaaaaaaaaaaagctgacttatgatttttgaaaatgcaagttttcttagaaactaactattgtgtgacagtaggctattccatattcttgactgtatagttctcttaacaaaaatcatcagtatcactctgcatttatatagttatttatactggtaagtatttttactgtaacttaagccctacaacaatcctgtctttgaaagatggaaatggatctggaataacttggtcacaaacaaccaggactaggaatgtagttcattgcttctgagaaggtatacagcatatataaataacctatttttctagttcagtgatggtgattttccaatgtgtgaaaataatataaaacaggtatgtttgagttttccttttcatcaactgttttacatgaaaatagcacattataatttttttataaaaatgatatatcatattccttagatctttgtaagaaagtgttgtgaaagggtcagatttctccagcattcctttgaacacccacctcttcgtttaggttgctgctctcctggatcgtcttgatccaagctagcatatcatctctgtcttcagcctgaaacaggcattcacagtcggacgtggtgagtcgaaacacatttttcctcttggtctcactgtaagagatgtctatcaagcaagcattaacactgatgggctgctcttcctcagacggagtcgtctgctctcttttatctttgtacaggtaaagtgaatgaccccgaaggacaacatacatctgtttccatggccgaatacttccaccaactcgctagaaaacatgcgacagttctttaatagtcaatatttggctaaatctttgtgacaggataagcacattaagcaacacccttcctctgcatttacatataactagtgtagcaggtggcagatttagctcactacattatttgtgaggagaggaaggataaaaattgtggagcataaactgagttaggcagtgtattcatatcaaagtcaaggactgtgaaatcccaactttagttgggaaggcaatatgaacaaagctaatcaaataaaataaatgtagcaaaacatatcaaaaacagtaacggaatagaaaatttaaaaatcggtccaaaaaacctgttgagtgaaagacttacgtcttagagcacacaaatgacagatactgcaggagttctccaacaattgtatacataactaattaacagagttcatcaactttatatggctaagcaactctatccacatccaaagtgagctttcttaaaatttttaaactcttctgacagcattaaaatgttcttatatataagctgtccaaatattatagaaaatttttatggcaaagtctttttctgttgaaatctactggatgcatatattgatatttttatatttgtttaacttaatatttttaaaataaaatgaaacaaagttataaaggtaatttaaaataaactaagaaaagagacataaaaatttaaaactgatttgccacttcctaaaggacaacggaataacccattgctaataaactaataagaaaagcagagttcctttttaaatacttagatttcctttttacattgccaaaacgtaagacaatatattctacatgtagctgatacacaggacaaaaagtaccaaattaatgcaataattagaatttttttaaggaatactttttttaatgtagaaaaatctatttataaatggttttttttttcactctttaatctggatatcatgccattttatgtatacaggctttatggtttatttgtcagggtctgcatttctgacactcagggtggcttagaaaacacactaccttgcccttatcggtgacaaggggtcggaaatgaagccacccttccttggcagcatcactgaagacctctgaggaagaatcttttctggacccagagtcttctgatgacttttggctgtctgcgatctatagaaaagaccaagaaaacagtaaaatgtcagcattttcctttataaatatttgcacatggaaactgctttgtggaaaactttatttaatgtttcaagtgaagggctatttttgaaaaatcctaactttatctttttaaaaatttctagtctcatttaaaaaatgtgaattatcattttttaaccattaaaaataacaaatgacgtaattttcctgttcttattagttcacattttagtgaaaaatgagaaaatgatccgtttgtgatttatgttatttgaagaatgaaaacggcaagatgcaataacgaatggctgagaagcagctagaacctggtgatgaggtggcagggctactctgaagaaataatattttgttgaaatttggaggaaaaataaggagccagccataaaaggtcagagggaagagagtttgatgagaatgtacagctactgactgtatatcatcattatcactttaaatgttcgctgattaatgtgatcaataaacagctaattctaggtcattaagggtcttctaggccatggtaggaagtgtgaaagaagcattaagtgatgaatcgggggagtaactgatcacccagttcaaagctcactctgagtactctgtcaagagtggattctaaagggacacgcgtgaaaagagctgtgactataggaatccaggtgaaagatgacggcagcttggatttaagtagtataggtgaagacgggaagattcagggtagtctggaattgatatgggggaaagtgaaaaagaagaaacaaggctagttctgaaatacttggcttcatcaagaaggtgaatggaagtgaacttaatgagatggggaaaactaagggataaggaagtctgggggtaactgcggtctaatcatcacgtaaaccttgagttgctgattaaacatccaagtgacggcagctgacaccagctgcagttcaggaaggaggtcaaggatagccatgtaaactttgggagacctctgcataagatcactgaggaaatcggggtagataaagaagggtcagaacaactctaggcattccaacatttaaatatcaggtggagcaaaagagcctgcagaggggatggagaagtagtctttcagttagaaggaagagcaagaaagtgtggcaagatggaagccagcagaagaaagtgtttcaggaagggagccagaaattgtgttgaataccagcgagggctctaggaagttaaaaaccaaggttaaccattagttttggaacctgaatgtcagtgttgttctgatgtgtgtgggctgagaagaagtagaaactatagttttttcaaggggttctgctgtgaaaaggagtagtgaataaagcaggatgtggattccaggaaggtttctattttaatgtaggaaatagaacatgggtgcagacaacagtgagtgaatgagtcactggaaaaatggtgactgtgcagaagggcaccgaggaagtgagaggcaagagaatccgaagaagtgtgggggttggtttttaataggataatggtacaagcacagcaatatttatggtaagaataaggaaggcagcaagtgtgggtataaaggcaggggactggctggggatggtggctcacacctgtaatcccagcactttgggaggccaaggcgggcagatcacctgaggtcaggagttcgagaccagcctggccaacatggcaaaaccccatctctactaaaaatacaaaaattagccaggcatggcaggcgcctgtaatctcaagctacttgggaggctgaggcaggagaatcgcttgaacccgggaggtggaggttgaaaaaggcaggaaactgatatttttggggatgataaataaggaaattcctgtctaatagtttctatgttttcagggaagtatgaggggagggagaagaaagagaacaggggtggggtggggggtgttggggggaagccacaaaataatttccaggatagaaaagcatacaacaaaatacaaaaagggctgctgggcagttaggactgctgggccttgaactgataaagtcagaaaaatcagcacaatgtgtatcaagtattacatacttacagaataaaagattataatatttaaatattaaatgtctactgggtaaaagaagtacttctctatgaagagataaactaaggtaagtagaaacactctaataccaaccttgattcccttcagactagatacgtgcttaaaggacctgttggggaaaaaatatataaatattttcaattagtgcaaaaaaaatcttaaagatgtaagaataatttgaatattacaattactctttcaataataatctgacatttcatcattatcatgttaaatgtccactattcaatggaagagaaaaaaagctaattttataaaaaatgttccacctaataattaaaactttcttaattgatctggtaaattaaaattgtttctgcttgaagtgtgggattttcttttttttatcaaagaaaaagctactcaggctgaacactgggttttatgttattagttaactgtagctgcaatgctatattaaggatttccatgatgttaattatgatcagtaagcagttgccattagcagccagcttcagggagatgctccctgtcatctccactcatcctgctggtggataccctgaactggaaatgtggcagggagggcacagttacagacagtcctggcccttcactcttctactctaaccacattatgactgctttcaaaaagaaggacaactgttgccactgaacaggcttagagcttcaggagacaggttcatgttaaagtaatcgaaaataatttaacttttattaagggacaataaactttttttaaactcaaaattcatttaagaaacttagagttttaagatgttactaaaggtgtcactgttttctcctctcagaaacctccccctcaaacaacaatgtaatcagaaagatatgcaaactcaatcttcaaccatatcagaagacactgtaactctgaactataccatacaaagaagggtggctaactgcagtgaagtaaacaatggatacgggaagaaagaacagggcaccgatcacttgcagatctcaaaactgcactacattgatttctgagagattgaaaccaacccatcccttgtttggaacaatggaaaatagtgtgctgaagctggtgacaggagcctcatttgttaccatggagtatcagaggagaatgaggaaacatacagtcctgccatctttgcaggaaacagtgtgtagttggtgtagggtgcagtagactctgaaataacggcagtttttgataccttataatgaggaagaaataaaggctaaaatagctcacaaatccaaccctgtatctttaggaaaattcctgctaccctggaagcaagccctgctagcctcacacaaacctccctcaagtagctgctccagaaagaactacttttattggaatataaagaataaccaaatggaaccctcagaggactgtatgcaaagataacaaaaaagacaaatagttctttaacataaggttcagtatcataaagatgtgagtactccccaagttaatttataaattaatcattgtatcaatgaaaatgtacataagaattcaagaactagaaaatctgattttaaggttcaaatactaaaataaaaatagccaggagaattctgaaaaaacataaaataatagccttaccaggtaagacagacattataaaactaccataattaatagaacctcgtgtacattaatacacagataaatcaactgaatagaatagagccccacaataaaattaaatacatatgacttagtatataataaagatgatgtatcatcggtgggaaaaggatgacattcaacaggtacttttgggacaatagagatattagaaaatgtaaagttgtctctttatctaatttgaataaattaattccagatgagtcaaagtttacaaaaaaataaaaagtaaacataaattttgttataattctggagtagtgacagaattttttgatacaatatgactcaaaattcaaagtccacaaatatttcctaaatttagccacagaaaaaattttaaatatttttgcatggtttaaaaaaaatgaaaaatattgaattaggaaagacttgcaacacatcacagaaaaatgttagctttctttatataaaaaggatgcagaagtcagaagaatccatagaaaatagtcaaaaaatataaaaaatcagttcacagaaaaatataaatatcttaaatatacgaaatggtgttcaactgctaagtgtcaaattaaaactgcaatatgccattataataattaaaaatatatgtatcaaacaatacactgtgttagagtgtaacagcagaggcttttctatattgttggtgggaatgtggtttggtataatttttatggacagcaattaacaatagatattaaaattaaaaatatggcaggccgaggtgggtggatcacctgagatcaggagtttgagaccagcctgaccaacatggtgaaacccggtctctactaagatacaaacttaggtggcacatgtctgtaatcccagctacttgggaggctgacgcaggagaatcgcttgaacccgggaggtggaggctgcagtgagccgagatcgcaccattgcactccagcctgggcaacaagagcaaaatgtctcaaaaataaataaatttttaaaataaataaaaatagacataccctttgatgtaagaatcctgttttcgattatatttattcacatgtgctaaccgaactctgtacaatatagtcaatgaagtatttgtgatagcataagatttgatcaatataaatgtctattaatatagagtattggttaagtatattatggtataaactattcaatggaaaattaaaaaatcatgaaacagcatgagccaggactatatgcatttaaggatctctaagatcagtgtctataccatgtgtcatttgtttgtaaaaataattagaatacagtacacacacatatatgcatatttaggtagtgtacatatgattttatgtatagaatagctctagaattacacaaaagaaaacagtaacatattatgtctgaatagtactgaatggctgcagtttctaggatgagagtatttaacatatttttctaccatgtttgtgtgttactgatttttaaaattcaatttaatgttaccattaacaactttatttatttgcatttctaatgtcaaagttagaaaacataagacatcattaaattctgaacttatgtgtcaaggtcatgctgaacacccacccacatacaaatatttaaaataatacacccgagacttacaattttgcatcttctctgtaatcatccagaccctcatcatatgattttgatctttctgtctttgagttgggctgagcatccaggctaggagggccaacagattctgtaattaattaaaatccaatatttagacattcacaagtggttcccagattcttttaacggtggaaacatcagtttatcatactattctaagtggaaaacagagcatgagatacggtttacaaaaccaccctttagacgtaccgtggtcatgtgagagctgacggcgaattaatggagctgaagttgtgaggcaaggaggaactgttgctatggaggggacctgagaggtagaggctgatataacagcagaggcagggatatgtgcaatatcatgatcaatgctagggctagttggttcatctgtaagaaaaaaggaaaatcagaatgttcaatgacctaattgttattaataataaaactcagtcaataatcattattaagggggtcagataaggattttaacacttcaccaccaaagcacatcactaaatgacctattcagtctgctaaaaattgatttacagttattactctagtaattctaaataattctgagaatatggtgtaagaaattaaatgagctgctctaccaaccaattaatgccttcactaactgattgtcaaggtactaaagtttataggtacctcgaacctaaacccatcaaaccagagcaataatcatgtaacaccctgaaagaattacttttcaaattttaaatgtaccacagattatcacttcaggaaattaaggtgattggctgaggctcagttttcaaagcattaattcctaaaaccgtatccccgcctcatccctacacaagtgtatctcaatttttgaaaagacaaagtccagtctctagcttccaaaataagtttccagggccatttgcacaaaattcttactcttataaaaacatcagtgatttaaattctaatacttgaggccaagaaatgtaattcaataggatgctggaacgataatccttaaaattaaatgccccagaataaaacctgttaaagaatatactacaatgataaaccaggattttgatgcctggatttaaaaggtccagctattttaattttgattaaattctaaggatgctgtaccatattatcaggattttaatcaagaggactgataatgttacaaaaatataacatttccattttatggccaaaatcagtaaattctaactgtgtttagcttattttctgtttttacaactttctttaaaagcagctctttacattttaggaagagaagacattttgaaaatttctctatgcaccactttttactaagtatacgacagtttactattatgtcagtaagaatgcagtaattctttttccaaaagcaagaagataactgaagttttaaaaattcaatgaggataacaatttaatttcactaaaacttgtagtatttaaaactgattttgatatttaaattgcacatgtttaacaaagtttcttcaaatgatacatcatataaagcagcctggttttatagagtctgctgatccataattctgttacagattaatgaatactgatgtgaagaggaatacactgtattcttcaaaaagtatctgactcatgcagtatgaatacatctttaattatactgggataaatctttgaggagaatgattttatgccttgcaaaactaaagagagtgaaattcaaattgtgcatggattaagcattattgcaaagcattaaatacaattttcaaattttgtgtccctggatttcctgatggtattcattcaatctcttccaacttactatattttggagaacatttctgaaacacactggattaaaataatcagttttagatatgtctgcaaaaacaggtgggaggatagatactcacctgttctaaaggaggactgaatggagaaggcgtgggagaagagactaacattgggcttactcatttcagtattgttgcattctttataataaattccttttactggtatgttaaaaggagaaaaggaaaagctaaacatacttttaaagtaaacacaattacattacctcacatttacagactatactaatccaattcttgattccctttgaaaatataaagacttttctaccggtttaaaaatactgtgttcgttaggaataatccaaattcaaaaactctacttttcacatacactttaattattaccaatgtgcatattatgtaaaaacaagaataattccaatttatcttattttccaatgtagaaaaatacatattatttagttgaccaaacggaaaacaaaaatttttcatctcatatacaaatatattcaaaagcatcatgctgtcacactttcaaatgacttctaaatttttaaataaaatattctgttagatgaaaatcaatcatctttatcctaggcatatcacatactacattaagacattaaataatgcattcaaaacatacttatgaactactggggttacagatttattaagtggcataaacattcgtgttaaactacgtaatcaaagaactgacttaagaaacgaggtcttggacaggcgtggtgcccacgcctgtgatctcagcactttgggaggccaagacgggtggatcacctgaggtcaggagttcgagaccagcctggccaacatggcaaaaccctgtctctaccaaaaatacaaaaattagctgggcatggtggtgcgcgcctgtagtcccagctactcgggaagctgaggcaggagaatcgcttgaacccgggaggcggagctgcagtaagctgagatcatgccactgcactccagcctggacaacagaggactctgtcacaaaaaaaaaaaaaaaaagtcttcatttactttcttcactaaaagacccagagctctttataataaaaagaacggtgaaggacacctaagttgctacacatcaaaattcaatgtggctactgttccttaacatgtaaaaaaaaatacaggcctatatatccaaaaattttgctttggaaaacaatgttttccaaaagtaaataatcctcacagataaaatctactccattattcaatttggattttttccaaatggagagtatttcaaattatgtttctatttattattcgtatctgaataggaaactttcactgtttattgcttatcaattaatattttagaaaaacatcttaaagatttcatattgtgaaaattcatacatgttacataataatttctcagatatcaaagcatgaaagaagggaagccctcctatatgaagagttcttataagtaaggaccactaaaatcacagtggaaagagcgaaacacatgaaaagacaactcatggaagaaatacaaaagccaaataaaaatgtaaaaaatactggtaaaaacctattactgaaatgatcaaataaaagcaagatgaaacagtgatttataactgttttttcatctcataaactgacaagtattttcactttaagatgttctcatcctatttgttcctcttcgtgttccgcaagataactacagagagtgtctatgcttgtctatcccagaggttcagtgggattcacaggagcggctggccctcctgtgggcgggcatgatctaggcctgaccaaccatagggcctatccctctcaatccacagagactggccaaggggcgagaaccacgcagtcagggccccttatattaatagtatctctaggattcaatacatggacagtgagaaaactatggactttctcttcttatccttggagaacaaaaactgtagaaatcagtaaactgttgagttgtcaccaacggccaccttttctactatgtggagaaaaagaatctgagaatgaagaaagcaaaacgaaaaaagactcacaggccaggcgcggtggctcatgcctgtaatcctagcagtttgggaggccaaggtgggatgatcacttgaagtcaggagttcgagaccagcctggccaacatggtgaagctccatctctactaaaaatacaaaaattagctgggcatggtggcacacactggtaatcccagctactcaggaggttgaggcaggagaatcgcttgaacctgggaggtggaggctgcagtgaagcgagattgcgccactgcccgactccagcctgggcaacagagcaagactctatgtcaaaaaagaaaaaagaaggaaaaaaaaaaggaaaaagaaaaactcactcttgatgtcattacttgggtatctggatccaggcatgcatggaaccaggtctaccacagaagttcttccctgtgagctaacattacttcttggcaggagctaatttgaaataattgccctgtccctgtaaccaagagaattatgatgaacataaatgtggagggcaatgcatttctagcaccctgacaaatgtgcatgtcttctcataacacccaatgtccactgttacaggttagggcacagagcaaaaaaaagtcccttctaaggtgagctgagttatgaggcacgtttctcacagctgaccataattacaaagaagcatataattaatgtactttatattttatgattatagttgacaataattttatgtaactcagtgaaattatcagaattttcagcatagaccatggcagaataatcagttccctgacataattctgctttttatttcacctctgctacgaagtagtattcctaacccctccccaaattacagcataataattgaaggaatattaacactattacttatttcaatgacagagtaaactatatattgcaaaaagaggggtaaatttgtataagttgaaagaaatggcaactaacctaaaattatatatgtggttccaaaacagcaacagcatgtatatatctttttaccaaaatatggaaattgaataagctgtttctgttccaactcctaccagaagggacatacctcaagcaaaatacgcttaaaatcttgatttttcctcatccttagggaaaaggagaggaaatattgctaatggattctgtgtcttaaaaataaattcaggccaggtgtggtggctcacgcctgtaatcccagcactttgggaggccaaggcgggcggatcacgaggtcaggagatcaagaccatcctggttaatacggtgaaaccccgtctctactaaaaatacaaaaaaattagccaggtgtggtggcggacgcctatagtcccagctactcgggaggctgaggcaggagaatggcatgaacccgggaggcagagcttgcagtgagccgagatcaggctgctgcactccagcctgggcaacagagcaagactctgtttcaaaaataaataaataaataaataaataaattcaaatgtgacaaatatcctttctttttatttgccttctgagatatacactcaatttaaatcaaaggaggtgaacggctaaagttaaatgatcttattaatagtcaagcataagctccttctttcaagtaataatgtattaatctttggcaatgccacttttttttttaatcagagttaagcccaatgaaataaagacatcctaaaaaattgaactccctaggcaaatttaaatgagccccattaataccaattactgaacatcaggtacaagagctgataaaaatggcatgctggagcaactccatttacattatatttaaaaggcctggagaaagaatgtttaaaaatgatgctaatatattcacatggccttctcatctttgacccagcaacagaccttgagtaggctcactaaacatttttcactaattataaataaaaattttgaagcaataagtcctgttttatatgaactggtgatgggtgcccatcacctagttcaaatattcccaatttttacaataattaagctaattatcgtaactggaattcaattttctaattaagaccaagtttctttaatggtcagttctgtgaacatggatttaaattaacattcagcttcttcaaagtcatctggagatttggttatcttaataaccaaaaggtcaatgctgtatctccctattagatagaaatggttttacagtggttaggaaggggagagtattttgaataaattccctattcacgtttgccatggcaagatggcagtcagtgctgacgatgagggagtggagttgtaaatccaagaggaactactgtgaagtaggtatttgaaagggaggtgacaaaatcagagcaaaagcagggatgtgcacaatatcatggtcagctcatctacaagaaagcatgcaccaggtcagcacagcaagggctctaattttacaaagggcaagtggaaggatcacttctagatttgccacggttaacaggttacaattacttggctgaatctttgcagtcccatagatcaaacaagttaactgaactcttaagatctgggggtgagggtgtgtgtccatgggccagtgtacaagcgtgtgtgtatgaaaaatgatccagcttgccagctgacatgctgtaacaatttcaacaaattcaacatttacttagaaatttaataaatatcagctcaccaatttcactaatctatcttgaaaattattaattctcaattctagtacacagaaaagcagcaagggagtagaaatgtggatgactgagtagggaggtcaagagacctggtgtgttcgattttgcaaaagccacttaacttttctggatattacattcactacctataaaataaagaagttggacttgggtagtgagaagggccaattctagttcaaaaggcctacaattacgaatccactaaaggggtggaattatctatttaatttatgtaaacatataaaacatttttaggtttttataaaccaggcatttgttagggggcttttgagatttgggtctattttcaacattaaaggaactaggtgaaaaggctccaaagtctactttagtgaaacaatttcatagtttataagagctaggttttgggagggcacagtggctcacgcctgtaattccagcactttgggaggttgaggcaggcggatcaggagttcgagaccagcttggccaacatggtgaaaccccgtttctactaaaaatacaaaaattagccgggtgtggtggcacacgcctgtaatcccagctacttgggagactgaggtgggagaatcgcttgaacctggaaggcagaggttgcagtgagccgagatcatgccactgcactccaggctgggtgacagagtgagactccatctcaaaaaaaaaaaaaaaatgcggctaggttttaaaaaaaacgtatttccctaaataaataagcatagcaatctataaagtgtgctacaaagaaatttaaagtgtttcagaataaaagttaatgtggccaggtgcggtggctcatacctgtaatcccagcactttgggaggctgagggggacggatcacctgaggtcaggagtttgtgagatcagtctggctaacatggtgaaaccccgtttctactaaaaatacaaaaaattagctgggcatggtggtgcacacctgtaatcccagctactcgggaggctgaggcaggagaatcacttgaacccgggaggcggaggttgcagtgagctgagatcgtgtcattgcactccagtttaggcaacgaaagtgaaattccgtctcaaaaacaaacaaaaaaaactaatgctactatcaaagaaaagataaaagagcatctaaaattatttattggtggaacatttttgttaacgaactcgacacttctaaaccatctggatatggcagtgccgttaaggctatgaccatcaaattcaatttagcttaggctaaccctcactgagcacacatacagccaacgttggggtaagagggaggaggagaagtcttagagatatgacaaaagcatggggaagagatgccaattcaaacctgggtgatctgagctaataatagtcggcataaaacttagaatgatttttcaagctaagatttaaaaaagtaaaatccaagatttaaatttttgctcattttgaggcactgtccaaagaatatgaaatttgcagccaacaggcaatcggctctgtcagttctctgagagagcttcagcaaagtacttaactttccttatccataaaacgggttattaattctgccataaattccccactgggttatggtaaggactggtacattataaagtatgtggtagattataaagcacggcataagtttttgttattttattattttattttattttttgagtggagtctcactattctgtcgcccaggctggagtgcagtggtacgatctcagctctttgcaacctctgcttcccaggttcaagcaattctcctgcctccgcctcccaagtagctgggctcacaggcaccccaccacgcccagctaatatttttgtatttttttttgtagagatggagtttcactgtgttggccaggctggtcttgaactcccaacctcaagtgatctgactgcctcagcctcccaaagtgctgggattacgggcgcaagccactgcacccggactattttattattttttaaattacctcacatcgttactcaaatagtggaagcaaaaatctctaagcttaagtaccaatggcatcacatttttgggaaaagccaatatatgaaaaagacatataaagatgataagtacatgatttctctttataaaagatgtaagatgataaagtatatgatttctctttataaacagactatttgctaagactcagcctgaattagtattaaagaagggctgggtgctcattgcatcgtcctgtcatatcaccactggcactgagcccagagctcccaaagggagaaactgggtatagggaatggtcacctcttccctttgggtaaatttcagggagctaagttcccctgtatggacaatgtaatccagctatatcttaccaaatctaacacttctaaatcatcttgatatggcagtgccaataaggctgtgaccatcaaattcaatttaacttagggctaaccctcaactgagcacacacgcagccaatgttggggtaagatggaggaggagtcttaagagatatgacaaaactatggagaaagaaagttaagatgaaaccctgagtgtaggtaacagtcgtagcatttttgtattactagtaatgagtggtataaattagagaagtgtaggaagtcaggattttagaacacattgtaatatctgctattcaccgtgagattactcatgaacagctcacattgttgaggtttgtgtttacttataaaagaagttgaaatttattttcaggacttactatgcagctttataaagtggggggtgggaacagtaaacaaaatactgttaatgagtaatattccaaatttaaaaacaaaatgtattcattttgttttgtatgcctgtatgcctcctgcaaccttagtatatagcaggggtcctcaactcctgcgctgcagactggtactggtccatggccggttaggagctgggccgcacagcagaaggtgagcagcgggggaaggagggcgaaagtcaaataagataggaactaattagagagtacttttattcttagtaaataaaattatttatttacatcaatctatatgtatatagaattatacagatctttattttctattttagccaaaatcttctctttaataacataattgttttatttctatacttcataactaggaagaaatattaacagatatatccagcacatttttttactactccaatgtaatctgattatattgttgttattatgtaggaagaaaatatgatgccactgttctgataagatcgcatgggcctgtgaaacagccacaggttgtaagatttttttacattttaaaacttcataaaacaatcattcgtcatcagttgccttctataaaatatctattctagatgatgtataagattccatctacaacaggagtctactatttgctgagcttggccttaggggtatagatatgaatatgggtacaatttaggttgagattccccacaatgttgacaacttgaatatatccgatttataaaaaaaaacataagctgtgtggaactttttaaaaaagcttttagtgtcacctatccaattaagtgttttctcaagaaacatttttaaagctatcaatagctttacaattgatagctttaaaaatgtttccgtagaaaagaaacaacagtcctcaacagctttaaaaatgttcccgtagaaaagaaaaactcaactagtactcaaagagaagcatattatattgtaaaatgatggagaactcttttcataaacccatgggacaccagggggactacaagtatggccttggttggtggcaaaaagagaaggaaaaaagcccctgcatcgcatgcctccagggggcgctcttcacaggcattccatataaatggcgtgctccctggagctgtgctctgggacgaggctgaatgaggcaaacctagagaccctgtctcttatcacttactatgcgattttagagatgttatttagcctctctataccttaaatttctcacttataaaatgaagataatattaaggacataagtcatcacctgttagcagatgatgttttagagctgcacagtcatgatgagaactgtattgttgtgctatacatttaaccagcatttcaaaattgtctttcagccattatctcaacaaatacttactgagtgaattctttatgtgccacgcagtgttctaggcattagggacacaaaagtgaaccaaagattttaaatctctgctctcatgtagtttatgttttagttctactgagaaacatgtaacaaaaaaacaaaacatgtcaagtggaaacagtaatacgaagataaataaaaaagcttaagggaagagaatgtccgtttctgtgtctgtgcgtgggatacctgttttagataggtgagtcacaaagcctgcttggataagatctttgagcagagacccaaatgtcatgaggaagacagaggcttgttaactatctgtggaatgtataccagggttagaaaccagctgtacctgtccctgtagcaacacacacctgacagcaaggaggctggtgaggctgcagatgggatgcacatggaagattgtgataggagatcacgaagtaggatctctctgacaccatcagagagggagttgtgaggcagaccatggagggcctttcagatcacgggaggattttgcatgctattttgggtgagatgaatgggaaggaaacagagggttctgcacagaggagtggtgtgatctaattgacatttttaaaaacatcacactggctgctgtatggagaacagatctggggtgggagggagcagacagaagactcaacaggacaggtgccggcaactgtggcacacgcttataatttaagtaacttctctaaatctgttccaggatttatagtatggcaaactaacttgacaatgaagaggtcttttctctcagtacacgttaaatttacaaagaaatatgttttagaaagtaaaagcactgtttaaatgaaaggttggtaactaattatcaaaactgttccacttggtttttcattcacctgaatcaacaattaggtataatttgcttcgctgatttccttaatctcaggaatttgtttcatcaaaataaaaatttgaaatgggtactaggtacatgaagtttttgttttttttttaaaaaaaggaaaattggtactagaaataacttttaaagaggtttgtgaaagctctggttgaagcacagcttatgagattcactagaaacattttaaaatcacagtgtaagacttctatgcctattgaactagaaataatacttttctggaaagatttcttatacatttggcatattagccaatgactctaaatgagctcacctataaatgggatggaagccaaagaatcgccaggcggactggtactcgaggcttttctttcctccattctttttatgtggacctctcgacgtgcatcattgggcagccagcaggtagtgtctgacccggtctcctggtcatttactgccaagatgtaagactgatgccttaaaggctgcggtgtctggcgtccagatggaggtttttcccttaggatgacagcttctttattatctaaagtatctgattgctcagtttcagcctcttgtaaacttaaatcttgattcctttgactgacaggtagttctaaatctgaagtaccagcgttttcactcgactgaggggcaggcttggcagaggctccagataaagagggggatttcccagtctccacttgctgatcgggggcactgtcagtccttacccatgtctgctgattcaacagactgttctgatgcaagtgatttactggtctttggtctttgatagaaacaaatgatttctggctaaatgatggttttgtgacatgcgtggaaggagctttcagagaattacttcggactttcacaagaggtgacctgtcttgtgaaataccccgaggcagtgacattccacaagtagtctgaaaatttctgtttgactgcaatgtttttagatctggtggaatttttttaaactgcgacacagatcccactcctctaccactcattcgcctgttatcagaattaacaacgcttggagccacagtaaaattggaacctcgaaaagatttatgaatttcttgctgcctaggtctttcacaaatacctcgtctatcatcctgttcagtaaacccactccacttgtaagtctgttttttctctccattggaatcaggtattggagttccagaattgacattttctaaggtttcatcctgtccctcaatataatcccatgaacgagttctatgattactaaaactaacagatggagacgtcagtgctccttgagatgcacttcttggacaatacttcattagcacagaatcttccagtctttcttgggacacactgcgttgccgtatctggacagactggggcactcgatcatgagaggtgcttcgacgtcgtccctgcaaagtagtgcggttggggacgacctggttataatctgtcgtgctttgagatgctgctcttaaactatctaatctttcttgtattgtccgacaacctatgtgcaatcgtctgttatcaatatactctttgtaagttttatagtttttccagtctatgtgctgatgggaatttggcgaatagtgattaacagatacagagggagcctccacagcttgagatctgctgcttgagattccatcagaatgtccactgtaatttccagacttaagtaaaattccagaaggttccagtgatctggagcctgcaggctgatgaattagatgagtggtgggaattgataatggtggtgatgtggttcttgacactgtttttaaagaggtctgctcactcacgccatacctcacttcttcagttctatgtgaaggacctgtatggttgtttctattggataacaaatctacaaccttctcagaaggcacaatgacagtccttacactttcattgcaaacacacactgctgtgtttgattttgcaacatctgttggtgatggaggcacttgtatttccattctataggccctaccaggttgtgtcagtactggtgtactggtttgctgtttgctcaatgatgagtcaggaggagatatttcaactggctgtgccatggctgatggggcagatggcagccagggatagcagattggtggaggttcaggtatattgcgggcattgccgctataagcttcgttgcctttcaggtaggcatcttgagaatatgcctgtatagaaatgagaggaaggtgtcactggaaattcataaaaagaataataatttccatttttacagtgcactattttatctatgtcctacctcgttcctgagtgacattcactatagcatgcatgcaaacacaacataagggtactctacaaatctagaaagagctagtctctcagaaatcaaataaactgtagaatctgcaacacatacaaattacaatcacctctttgctcaaaacatgtgaaactcatcaaatttctacccaaccaattagatgtacccacattacttctaaaattctccccattcaagccttctgagtttcagcagttgacaggttaaatggctgccaaataaatcccagcaaaggaagattcatgtattttgccagagaaaaggtgaaaatattaaaaatcttaaatgcattttaagtactactactataataaattaagtctaatttatttgaagcatcttgtcaattaaccattacagagtccctaagaataatccattttgacaaattaagaccttcagcagccatgctaagtattttaatatttaaagtaagataatatgcaagtttaagaaataaagcacatataataaaggcagaaaaacatgaaaaaaggtaactcatcgttctgtatataatttatatttttattttaagctaatgcaaaagtatatcatacaaatttatttggtctcctttacttattataaggagacatttctctattactaacaggcaggcatgcagcctaaatagttttttatcaactatttgtaaaattattcagcaatatttttaaagccttaagaataacagaaatcaactatagagactttacaaaacagagctcatcagtgcaacacagggactatgttcagcatctgagacagatgtggtaacacatcttcccctaatcaaaacaagcttaactcaagactatcatcacatcctgctctttgcattcgacagcttgcaaagctcaagtgcagccacaaacgtaacagcaaagtagtagtgacaggaagagggtgagatacttaaaaaacatatatatatatatatatatatatatatatatatatatatatatatatatatactgatgcagataaatattacgctgtagcatcagttatgtacaggatacaaaagaaaaccaaacataaaaataaaaaataaggatggcaaaccatctatcacaaacgtattctgcaaattagtaagattaacacgatagagggatttctctaagcaaaagtgaacagtttttaatagattggcttattacaaatctctacaaaacatgacttaaaaagcaaggaaatggctactgtgcatttcttaccagtgctgtgacatcctttgtaaactgtagctagcagaaaataggaaaacatagtagaagctgcttactgatataaagacaaaatcatgttgtcatattgatgctggaaacggcaagctaaaaatacatctatacttgtttctctggaaggtaccaagagaggtaaagggcagtgaagcataaagaataactccagtattcttctgaacatctttttctcaggcttttatctgattcttgtttgatgtgtctaccattcttgaaagcaaaatacatctggtgacatgcattcctaacagatattttcttcaatatgcactgctgtctgataacatgctacaaagcttccctccacgaaagcaacagtgatgtctctcatttccccccagcttcttccatctctgcttccagatgacgaaacgaatgctctattatgcatttaaaatagtacaacctcctccttccccagtaaatcagagcataaccacaagctgtcagcagactgcagctgcctttacactaagattcaggggggaaaatgacttcttttaagtaagtttcactcaaaaattaagatctttcaacactgtgccttttgtactattgtattagtttgcaaaaataactactggatagacataaaaatattacttccagagtaattcttgttaacctataataaatattatagaacagagactagaatgcagtgacaaattaaagctagccatataaaataaaatatgtctacatagtatttttatggcatgaatacagttaatcccaacatgcattttgggtgtgtgcattgacacaccaagtctatcttttccatgctgattagaatcataccaatacttttctgcaataggaaaattgtgtctggatgagagaatactgtactgtctggtacagcatttcccacaacatccttgtgtagttttattatataccacctgaaaaggaggatgggggagaggaggtccctatggtcaatgatgtagggccacttggcaagctttttgatttctcaaaaccacgacgacactaatgtacattgtgaaattcgaaaggaaaatataaacttattcaccatggaggccatttttttcccagaggttttaacataattagaatatctacttgggtaatgctattctagaactaatattttaaagatgactcctttattcaaatttgggaagaaatattactgtttagtaatagaagtatacggctggaactattaaaacttgagaatattttacatacttcagacatctctaatattcctgtatggcaattctaaatgctaaatagtctacattacagtcacaggtccccacttctgagttaagttatcacaaggggccctgaaatccatacaaatgcaggcattaacagtgaacatctcacacatgcagtactattatctaatgtaagcagatatggttgagataaaatatgaattcattcaagaacatttttcacaaaatgtacattgtgaaactcaaaagtacaaacttactcgccagggaacccatttttttccccagagattttaaaataattagaatatctgcctgggaaatgctgttctagaacttttttttttttttttttttgagaccgagtctcactctgttgcccaggctggagtgcagtggcgcaatcttggctcactgcaacctgtgcctcccaggttcaagcaattctcctgcctcagcctcctgagtagctgggattacaggcatgagccaccatgctcagctaatttttgtatttttaatggaggtggggtttcactatgttcgccaggttggtctcgaactcctgacctcaagtgatccacctgcctcggactcccaaagtgccaggattacaggtgtgaaccaccgagcccgggtagaactaatattttaaagctatctcctttattcaaatttggggaggaatattatttttgaaaccaatgtcataagaattacatattcagtattaacaattttgaattttagttaggctttaagcccaaatggatactttacaacatatgaaagtgttttgatagaatcagacaacatttaaatttttcccaatttactagctcttgtgaattcaacagaatatgacaaaacatttttagccattttttccactcagcctttttgtataccacttcacattccttcttgagctttctttacccttgtacttaagtattacaccttttggagtttaacagcttgtattttaaaaactgaagccttccctaacagccctgttttgcctattagatacaaaaagctctaaaaagtggggggggggggggaggaggaggaggaagaaaataagaaagatgacccaaagaattctttctttgtaattagaactccaaacagtatgttaaatacaacttaatattaacagcctggatcttgattatatgtacaatgcctaatagtaactaaataaccctaaaataatctctagttcattttttatacagtcacatcaaaatcaccatgaccatacctatgataaatggtaaacaaaatgaaacagagaaaaaaaaaaaaaaaaaaaaaaaacctgaagaataaataaggtggtaagattaaaattcctgcctttcagttcacctttaacaggttattaatttaatgcctttacctatgataaaagcaagagtaacttcatgtttgttggtagatgccaaccatgccagcatagggaatgggagaaggggatggtgtagatggagaaggactttctttttattatacctttctgcattatttcaaatattttcaaccagcacatactattcttgtaattatttaaaaatagattttaaaaaattacaaagtaaactgctgctaacctgcaaaatatgaaagaaccctccagaattcatactcttgcttccctcactctaggccggaccacctacatgtacacttgacaaatggctacttaaataggatattgtactgataatagaacacatgaaatgcttattttaaaagtaattctaataaacttcaagaaaaacttagtttaaattacatttttcaaattatcacatatccatagagcagcaaaaaagaacactggactcagaacccagaggttcacgttgtaataacagctccaacaccaactggcagggtgacttatggtaagccacctaaacagttcatctccactcaacagcagtataggactgtggtttagagtacaggctttcatctcagacccgcccgagttcaaatccttataccatttgctttcttccttattataccagacatgctgtttaactttgctgtgtttaacatagaacagcataaagtaggtttaaaatgtcctggccaaatattagttatacccaagaatctccagagttataaaaaccgattaacttaaaatttaatctttgagtcaatggagccaaatgcttaacaaagtatcctgggtgatgaaccaagaagtatgccccgatctagttctcctaccactatctcactcagggaagtattctctttggtcagtgctacggtctgaatgtttgtgtgttcccctcccctaattcgtatgttgacacttaatcaccagtgtgaatgagttaggagatggggcctctgggagatgattaggtcatgagggtagacctcatgtatgaaattagtgtccttataaaagaagccacagagagctgcgtcagctcttccaccaagtgaagacacagtgaaaaggtactatctatgagaaaatgggccctcacgagacaccaaatctacctgagccttgaccttgggcttcccagcctccagaatatgagaaataaatttctttgtttataggccatccagtctaaggtattttgttacagcagcccaaatagactaagagagtcagcatcattgtttaggtgaccagactggtgtggctatttcactcatgcatagataacatttaatggggaaacaaaatcattttggtttttggaaatacaataaaaaacctttttattttgcaataaacacgaacctgtctaagataccagagtctaaaatattacaacaaaatactgttaaaatgattaaaatgaatgtaatactatttatattgttaacctagaaaatatatgctggtttaaaaaatgaggctgccaagcacaggactcctattactagcactagtttaaaaacataaatgaattattcttaattttacttcatggttttaaacattctatcattgtcatccatgaattatgaaacctataatcatatacctgtccttacacgagtcaaattttaagccaaattaaattttctaggccacctctcaaaggtgagcagagcacttctaaaataatttggtctgtatatcacttcaggaaaagaaaaaaaacctccatgcactacccaatcctgttgcccaggcaaacatatacaacctacaagtgtttccatgggtaaatgatttttacagtggctgtaaaaatgttcacattacccattgcttttctttacaataaatattcaacctcatgggaacaaatacatctttaaaagcatatattttgaataacagatttaagatctgcataagtacttctgaagtacattaaagaacattttaactctggaatatatgttagagacagaaaattatatattcctttgatttcttaatgaattacactacattcaaatgtgaattaaggttaaaaagtagagttttcttttatgattaaaggcatgtacttttatttcttaatgattaaagtaattcaaataccatgttttaaaaataaattttatgttacagtataccagaactctttactgctgagccttgaagatctgcatgctcatgttatttactgaactggtttttctctgtctctgggatactttatattttacttttactttagatttacttaaataaaatttaacaagacagactattctagaatatgaatgagtaacagaacaaaactaatttttctttaagtgacctctttttccattaatcatatcattacaaaattactccttccattacatgaagtggtttgctgctcttcatcaatcacactgcaggatatcatggcgattctgcatttaattgcttccatgccagccattctgtgaaatgagcactgttccaagagccatccaaccagtaccttcaccttggcaaggaaagggtctactgaagatcggaaaacagttcagtttcataagctgattctgtcttcaagccttcagattgcaaggaggaagccaggtaaatccttcgctaccatatacaccatcttctgtataagaagagcactagagaagaattccctatttatttctagtctagttattttcatagccattggtgtctgtggttatgtctgctacatgatcactatgctgaattgtcagggtaggaactctacaaccacttttgcatgtctaggaaaattactgcagcaaactgtatcttccttcctgagcctcccaactccaactgaactgtgtacttcagaagggtaattgttatcggtactaagccattcctaagtaaaatctacatgccttgaaaacatggggttaatccccatgagtttcacttaattatagtttacatgtcagtgaatgactctttaggatcggctttagtgatttttttttttataaaacatgtttacagattatttatggcctttgatgagctaagttcaaactactgccttacaaatgaagaacattactataccatttccattaccacgacaaagagtccatcagctccctgcttttcttgaatttagctataggtaataagaaaaaaacccaattgtttaccaaaaagaattaaaaataaatacttcagcggccactgccatttcctagatctgttagttgtaagtatgttacttaaagagtttttctattttattctacagaactgcaaaatcaattgaaggaaaatgttattttcttgaatgaaatatgtgtgtgtgtgtgtgtgcatatatatatacacacatatatacacatatatacatatatatacatatacacacatatatgtacatatatacacatacatatatatacacatatatacatacatatatacacatatatatacatacatatatacacatatatacacatatatatacatacatatatatacacacacacactatatatatatatatatatatatatatatatttttttttttttttttttttttttttttttgagatgaagttttgctgtttcacccaggctggagtgcagtggcgcgatcttggctcactgcaacctctgccttccggtttcaagcgattctcctgtctcagcctcccaagtagctgggattacaggtgcccaccacaatgcccagctaatttttgtatttagtagagatagggtagagatagggtttcaccacattggccaggctagtctcgaactcctgacctcatgatccgcccgcctcggcctcccaaagtgctgggattacaggcgtgagccaccgtgcccagatgaaatttatatttttatcatcagcagtatttaagcttagtaaaggagttaagtattctattcaatttctttctttataaaaatcagaaaaatattttagactaaatactaaagttttcaagtttcatttcaagaccataacatattttccccttaagttgtagactccgttcattgtgaacattttaggaacgaattgatactactaacaatactgcttggtgaatttacaaacgtaatatttattggaaaattagaaaatggcaatcataaagtttgtcctcgtattacaaaaataagattctattttttttttttctctgtacatagtgagaaggaaaaaaaaaaagattctaattcctggggatatgcacttgcactctaaactcttcctttggtccaaggatgaactagaaggcaacactaggacaaactctttaggaatctcattctaaatgagagcattaagagttcactgtagaatcaacataacatttccatgtcacttaattgcaaaaacttggcaatggtatttttgtaaaatgtagagaattccagattctgtaaaaggaaccagagggtttttaaattctagaattttttttaaattccatctttaatacttccatctcaaaaatattttccgaacattcatgactgtaaaacaactcatatatgaataaataaaacttaccacttggagaatgtcttcatcttttggcataacactaagttccaatgttgtatcactgaaattgaattatatactattttaggagaggtagaagtgtataaaaaaagacttaatggaaaaacagttaactcagaagtattttttaaattgtttaagagtttattctggttttcttatatcttaatttttaaaatcaaatcattagaatgaaaagaagtcacctttgtatacgtaagttaactatatacaaaagagggacggacccctgccatgtttgtgctattcataatcagtaaagttttctttataacatgtttctaatttagaaatataaagtatgttgcttatattaaatagtcccaggacaaactcttaacaatatcagtatacaattatttattgttttattcaagtcacaaaacaaattatagattgttgtcatatattctgttcaagttaaaattcattaacatcaaagaaccctcaaacttaatattttaagtaattttttttttagactgagtctcacactgtcaccccggctggagtgcagtggcgcaatcttggctcactgcaacctctgcctcctgggtctaagccattctcatgcctcagcttcccaagtagctgggactacagggcatgtgccaccatacccagctaatttttctatttttagtagagaggagggctcaccacattggccatgctgatctggaattcctgacctcaagggacctgcccacttcagcctcccaaagtgctgggattacaggcgtgagccactgtgcccagccaagtaatattaaacatcttaattttgcaatattccctcctggcctcagaagtgaaggaaatcgctttactgtcacaactactgagctgactcatttttaataactatataacatttcaactatttgcttttttccctatgatttacttttagtgcctttacagggacagctcaaagtctaattttattttggttctgtaaatttcctgttgaaaatgatagagaaatttccctaagtttagaaagttcaaaggggtaaacaaaactgaatcctgtgatctggaggtacatacagatatggcaaaggtgccgggcgaagtggcttacgttcccaggccaaggtgggtggatcacttgaggtcaggagttcgagaccagcctggccaacatgttgaaaactcgtctccactaaaaatacaaaaattagctggacgtggtggcaggtgcctgtaatcccagcttctcaggaggctgaggcaggagaattgcttgaacctgggaggcggacattgcagtgagctgagatcatgccattgcattccagcctgggcaacaagagtgaaactccctctcaaaaaagaaataataaaataaaataaaataaaagttatggcaaaggcagtgctactatctccaccaaatgcttcaacagctaatctaacaatatcagacatattttcccccaatacagtcaagagattaagaaacaatcaacaacaaaaaacaaaataatctactggtgtctcttcttgacagatttgaatcattatgtttagtttcataaatgctcagattatactaaacccatgagaaccacaggttcaaataaatttaactagtaaaatatgtaggtactttcatttcaatatttagagttggtagaaactgatgtttagataaactcctgtgcaaggacacatctgtttgtttgttgtttttgttttgagacagggtctcactctgacactcaggctagagtgcagtggctctatcaaggttcacttgattaacctcacttgactgacctcctggactcaggtgatcctcccacctcagcctcccaagtatctgggacaacagacacacaccagcacgcccagctaattttttgtagagacagggtttcaccatgttgcccaggctggtatcaaactcctaggctcaagtgatcggcccacctcagcctcctaaaatgctgggattacaggcatgagccactgcacccagcccacaaggacacatgttatattaatccactgcagaatctcaagggctttgtggtgcattacccatttgctaccaactgcagacagaagaaaaacaacacttttaatggaaataagattatgaaaaaatatttctctaatattcaaattgattttagtggttgaagtgttattattctgaaagatgaactgtaccagtaacagaagaatcaatgtagattttgaagaaaacaatgattaagttggtttttaaagaagagatattaacaaatacactaagtcttttaagttatgggctgacaaaacatatcgttgtatttatgatgatctaaattattttgaggaaaaaaattctggcaaatctgttatcccttggagaggctttaaattcattatcaacattagaggcaatattcaagagttgttttctgttagactcccattaaatattaaaacattaaagaaaacactctgagatcaattaatcatgaccatgtcatttaattgtaagaaatggcaatgtattagggcattagtgtaaataatttagattacagcatgagccactctagacatacttaggagagcttgataaaaatcttcagaaaatgaactgcacttgaattacagacaggtgagtttggccaacagaaagcattagataatccaaaagttcctgtatttgaatctgagaagaacctcttacaacagagtgatgatccgactaggctcagatccatggcctagccttgacagaaattcaatatggtaactctttggtttctaacttatttgtaatttggaaaaattttctagttgtgtgggtgaaacagagtaggactaaatgatcttcgaggtctcatagacagtcactctataaatatgtatctaactttagagctcaaaatcctactattctgtaaaatgcaggcaggcaaatggattaaaagggaatgtcttgttgtcttggttagaacaaatgagttgaggctaggaagattattcaaaaagatacttaaaagtaacatacccctgtaagaggttttaaaataaactatatatgcatttatttatatattaaaaacaaattatacatttgtcacttcaaataaaaggggtaaacacagtaaatctaaagtgtgtgccttacagcctctatgggattttaatcataaatctgatacatctgtcaaaccaaagccaccaactaagctatcctcagatagctggtccttggcaactctcaaatgcattatatctaagggaaagttccacatctccttgtcaccacaattccttgtaagaatagaagattgtattaaatctatgtgctctattgatctataaaacccatctttgggttttaatgttttaagactcttacctgttttgaattaaagcaattacttgggaataggttttgccaataacactttctccattgacttttataattcggtcaccttcaaagagaagttaaaaaacaaatgagagatcctgcagaaagtcacttttgaacacttttgaaatatttcttgaataatgtccttatttttaatgtcgtatatattaaaataataaaatacagagttgtgagaaaattattagtatcataattataaaacaattatatgaatatcctagcttattacttttaaagtttttacaaaagtaaatacattttaatatatccagctttttgtgaaactagccatgttctaagtaagagttccagtcattactgaatttagaaatttcaaaaggtctagttaccaggggaccagagctatactacttatgctcctatcagttgtttcctgagttgcagaactaattatctctccacgtaccctgtctttttttctctttttttttttttttttttttttttttgagacagagtctcactcttgtctcccaggctggagtacagtggtgcaatctcggcttactgcaacctctgcctcccgggttcaagcaattctctttctactctgagtagagtaggaaaggaaaagacagaaacaaagaacagaggaaagaagaaaataggcaaaaatgtactttttgtgtgcttatcacagcatatctccacttcatcttcccaatcatgtggggcttaaaatacgacagatgatacattctaaagaaatcccacatgcatactaatatacatattatacatattaatgatatttaaatcaggcttactttaagtataataaaaaaaactaaggtgggtaatacattaacagtacatccttataaatcttagcaatgatgtccactactttctaatatttgtaggtgaaaatatagcattgtatttaaaaggcagtgaaatatagcttttcaataattcccattttaaattgtctaatgtttaaaaaacaaaagaaaagagtattttagagtgtgcactaatataaatgaaatctctacttagggtttattaaaatcacaaatcacaaaacattttagaacaaacagctactatatccagccaattaagccacatatactgacaccttcagatgaagccaggcttatgttccgcattggagacttaagccactttgtgctgcaaattaattaactcaactctgtcagatcaggcacttccagaacttgaaaatccaagattatttcacttatatcaaataaataccttcatcattttgctactttgtaatcctttgtcaaaattcaatgcatgcaaaatttgttcctttaaagagcctctaagagtctatcatctgtgtggtaattaaaagtgctcacagtgtatcaatttatattgttatttctgttcaaacccattcatatgggcaccaagaaacataattagttctcaaaattagtaacaacagatgtgaaggaaaaggaagaagcatacagaaagatacaaaaggaaaaaatatcgaacatgaaatatggaagaaataaagtgaaaaagaaattaaaacgtattgtttaaagaagaatatcagcacctgtacataatccagcttcaaaagcaggtcctccttctttaacttgcttaacaaatatggtatccattggttccaagcggtttctttgttttcctgttacagagaagcccaaagcatgattttacttcacaatactttactaaaatacctaaatataaaatagtatttgagagaattaagcaaagctttttaatgaaatattaaatacatatcctgaatttggatgctaaaattataatgtaggggttttcatttaattcaaacatttattttgcttcttccataacataatgacaaccacaacactgtaatgctttccatttactggctacattccgtatgtcagttgccacactaaatactgtatctcagagctaatttccacagcaagtaagtactactactaccattcataaaagaggaaactgaagcttagagggattaaataaagtctccaaggtcaaacagctaacaagtgccaaagatgattacacaggcggtactcactccatggcttttgttttttgttttgttttgttttgttttgtttttttgagatggagtctcactctgtcacccaggctggagtgcagtggtgcaatcttggctcactgcaacctccacatcccgggttcgagtgattctcctgcctcagcctcctgagtagctgggactacaggtgtacaccaccccgcctgctaatttttgtatgttttagtagagacggggtttcaccatattggccaggctggtctcgaactcctgaccccgtgattcacccgccctggcctcccaaagtgctgggattacaggcgtgagccaccgtgcccagcctctactgcttcttaatactgcattgtgctaagcattaaaatgtaacaatgaacaagacatattcctttcccttcagggagtctggtaggaggagaaagacatacaaacaaataacagtatagtataaaaaacaatcagagacaaatacaaaatacagtcatggcaatgaggagagcatgatcaaccccgtaagtcagaatttcacaagctgttttccatggatcattggcattaacatctaaggtgtttgctaaaaatggatgttttggagtctgaccagaaatctgctctgtcaacaagtttcccagatgatcctaatacacattaaattttgagaacaactagttgtttcagtgaaatagaagtcaaggaaaaattcgcagatgagaggacatttaagctaagtgacaaacagcataagtattgtgggggaagaaggaggtacacggtagttctaaaggtgtggtcccaggaccagcagcatcagtatcacctgggaatatgttaggaatgcaaatttgtggaccccaccctagatctcctgaatcagaaactctgaggtgattgtgatgcacacttaagtttgagaatcactgaagtagaagacacagtcctgacccttaaagaagaatgtaactgagaaaataaggcatatacatgtgttgagtaacatgatactacttgttaaacagcaatactgggcaaaaaatgattgagtgtcaaatacaaagagttcataattattgccatataaaactgaattgttaccatagtgtatgcaccaagatggcttaaaggaagttacttaataaaggaatatctatcactagctccccttaaatacttagctatttattctgaaagacgccctccaaagcaatgaatggctagatttcaaaggcaatggggcatagtagaaattgcttgttttagaagcgagtagacatcggtccaaaacacttcctttgccacttgaaattttctgtgtgctacactttatttttcttcattaaacttacaacccactacctaaaattacatttttatttgcttacatgtttgttgtatatctctctaacataaagatcaggaattttcgcaatgctcactaatatccatagcatagagcaggcattcaataaataattattcaatgaattaatacatttattatttagtttaaattcacacaagccctcaagatgggcattatgatcctaaaattgccatttgagtgaagaggaaaaagagactcagtaacttgctaagaggcagcatagggatttgaaccctcaggcctgaattcaagtgtggcaattccatgctgcctcaaaagtaactgaatgtgatttatttctcaagctctgctgtattcaagtagacagtccatttgcaattaatttaaaaggaaaaatactttcttatcaattcaagttgcttaaaatgcaaacgctgaattcctatcaagttggtgatcaggttaggtcagtctgtggtcaatctaatatttacaatagttggcattaaagaaaaaacatctatcttcttggctagatatctaaaggcttagtaagtcttgttgcatcaagtcactgctttcatggaaagatttatataataaaagagaagagacatttttcctattaatgtcttctagtccactgtgtctcaaaggtgattatttcatacttaaaaatacaaaatgtaaatgaccattaatgaattctacaaaataataaaacgttggttgggtagcaatgcgatgacttctgaaaattctgatagaaaatttcacttacacagaacagaggtggtccaaaataatgtggtgttaattctacaaaagaaatactaattttgaaatgactaccattgtaaagtcagacatactttgccactgacaaatctttcaatacactatgcctgaaaacatacgaagatggaatagattaaaatagagtccaatcctatagcaagcactgttacatctgctgagagttgcacttttaattcttgctcacattttttttttttttttgagacagagtcttgcactgttgcccgggctggagtgcagtggtgtgatcttggctcactgtaacctctgcctcccaggttcaagcgattctcctgcctcagcctcccgagtagctgggataacaggtgcccgccaccatgcctggctaatttttttgtatttttagtagagatggggtttcactatgttggccaggccggtctcgaactcctgaccttgtgatccaccctcctcggcttcccaaagtgctgggattacaggtgtgagccaccgagcccggcctcttgctcactttcctttctgaactttctccaaaaatctgacttgctacctagatatcatccaattcctcctagagagagaaaaacatttcctgtaaatatcccttaaatataagcagatttcactatgaaatatacttttcttcaatttctatacaccttgactctatgtcttgagttaaacacttgactcatgaattttaagagtgtcttctttttaagatatgtgctccgcaattttgccagaactggaaatcagaagtatcatatttaacacgtgtgtcattcacaagctctctcaggtctttagcttttgtaaatacatttctagatatgcagaactaaaagcctgatcccgaattgtggtaattcaccaggaaaagtgactccttacttccctgtatgattacttagcagacccagatggcttccctggcaattcttagtaaaagcctctttcaattccacatctgtattttataacttctcaattttttgagaacacatgggacatgtttcaaagaactgttaaataccttattcaaatatcatttcctaaccttatcaaaagagagtgtgcctttttggcacatacatgcagttaaatcttcctatatttgtagaaaagaaggtaaaaagacaattatcttacatggatgagaatggctaaagtaaccaggttcaaaaaaagtcccattttatgttataatatataattagtactgacttaaaaagacataaaaagcacatgtaaatttacctgaacttgaacactacacttgaaatcagaaagaatacacatacgtctacaatgaagtaaatatgatcagttgggggaaaaataacttgagtaaaaaaattaattatatataggtagtagctgccatctaaatactgaatgttcaggtggatgtgattcttattctctatattcattataatgcaacagttaagaccttgggccctataaccatattacatggtttaaaatcccacctctgtcattcattttccaagtggggtcatcagattttgcaatatttgatacatatttaaactaaaaaatagtagtagtctatctgaaattcaagtttaattgagcattctgtatttcatatgacaaccctatatccaagtgattttagatgaatgatttgtatgtgcccccagtttactgatctgaaaaatggggatgataataattattcctacctcgcaaggttgttgtgaggatttaaaaaagataatccagtaaagcatttatataatatctagtacatgcaggtatttgttaagtattacttattattatgatagacctgattataaacttttcaggtttacaaacagatcagagatgatcttgggtacacagagcctgtcacatcgcaagtgagcaataaatactggttgaaaggacactcatcaaattcaactgtcatattatagggaagtcaaggaatactgccgggggaggggataggacgagaaacatgaaagaaaagaaagtaaaaagagattatactaaaaaaatttccaataactctgacacaaactatacacctgtcttcaaagagattgtgtctaaaaccaaagtgctacatctataggcctgggggctttgtcagtcaaaaaggatgagttaaatctctagtgacctccttctttggagaaagcctaagacaaaatcatttgcaacatctaaattatttgaaatttttaaatattatttgaaatttctaaatattaagtatacaaaaaaaaaccacactaaagctaatagattacttttaagaagcaacaaaatttgaactatgacagttacaaaaaggactctgtaatgaagatcacagagaaacagatcatgatagtaagaaaatcctacagttctgaggacaagagaaacatatttcttaacagactggaaaaatatatagtttatacaaagaaaaactatcccacattttaatcaagagcaaagcaatagaaaataatggctcttgtctatggccataccaccttaaatgtgcccaatcttgtctgatgtcggaagtttagcaggactggggctggttaatacttggatgggagactgcctgggaatatcaggtgctataggctttaaaatatatatatatatatataagaaagaaagaaaataatggttataactgagattgagcttttgtttcttctctctcagagttcccaaacttgctattggagaatttttttaattaaaccaaatctctgcttttatgagacttatttcaaaaaatggtattttttccattggtttctttgttgccaaagaaaaatctctatctttatacaacaaaaggctgttgaaatgagactatgctccaatctgaaagtcagataagcctcgcaagaagtataccctccagaaaggtggaaaactaaagaggtttatcacataatggaatatgaaggcaccaagcatcagctatttaagggaaataaatagcatattgaaattaatatctatttttcagataaaaaataactgaaaccccaacacagactgaaatacatagcaaagttatgtctgagtgatgaaaagggatctttatttctctttgatggaaaatagactgccacagaaaaaaaacagcatgtagaagaatttattgagcaataggaatgtggatctattaaggaaaaaaacaaaaataaggagtaatatacaccaaattcaggctagtaattacctctggaggaagggaataggaaaagagtggcataaaagggccttattatatttgcagtcatttatgtcttcaggagagagaaacagagaaggaaaaagaaaggttatgagggggtggaggtgaagctgaaatgttaagatgacaaagatgggtggcaagcatttagaagtaacatttttgtttgcctaaaatatttcataactagtatttcttattgttgacaacaggcttctaacttttattttgggaatatggtttactggtatcttaagagtctaacagagacacaatgtccaacattaaaaatccatatgtatcatatgataaatatatcctatataagtcattaagcagaatccaatttaagaggactgctgtggcagattattagtcctttgtttgtttgttttttggtaaggagagaagcactaagaaagatgtgccaacttattaaatttaggtgttccccaaattctcactcaaaatgctctcacttgcaggtgacagctagcactttaaaattatatctccaagtctccaatctgcagatccagcaattaccatgagctcccaaacccaaattccaataatctctggatactgtcagtagaatgtcacctgtcaggtctcaatcacattatatctattattagtaaaaacatactatctttctactcaacctgatcttcaagtagtaacaaatagaacaaaatgaaataagaaagtttgtttaatataaaaaagcaaaccatgttctaactgaatcatgctaacctttctttcaacccacacctctctagtttttaaaaggttttactggccaggcatggtggctcacgcctgtaatcccagcactttgggaggcagaggcgggtggatcacgaggtcaggagttcaagaccagcctggctaagatggtgaaaccctgtctctactaaaaacacacaaaaaattagccgggcattgtggcacatccctataatgccagctacttgggaggctgaggcagataactgcttaaacacgggaggtggaggttgcagtgagcctagactgcgccactgcactccagcctgggtgacagagcgagactccatcttggaaaaaaaaaaaaaaaagttttaccgtggaaatgtccagcatacacaaaagtagagaggacaataaagcccatgaatgcagcttaattataaaaacattttcaatcttgtcttgtttcattgaaacccacccactttaaaacattttaatgcaaatcccagatatcatgtcattcataggtactttaaatatatccatacacaccactaacagataagaactgtacattttcttaaaagcaagaaacaggggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacctgggaggcggagcttgcagtgagccaagatcgcgccactgcactccagcctgggcgacagagcgagactccgtctcaaaaaaaaaaaaaaaaaaaaaggaagaaacaaaatccttcaacagttcttcacagtatgtagcattctgcactatgtgatcggtactgcaagctgacaaacaaacccactctattttcatcttcctaaatacctacttaacattaataaaaagcagtatgtcatgacagaaatgatagccccaaaggctatgaaataaatttagaaaggtttcacatgtaaaaatcatatgagaatcctaaattaagtgccttaacaagtagcccagtgcaactgctctacctatgtattcaagttcagtaagttcatatacgcacgagaatatacaggacatgaaaatctccagcacacagaacactgcatggcacacagtagatgctcaataaatgtttgctaattaaaattagagccctggaaaatgctaatagtaaaaattcccaaaaccagcttggagagttgtttcagggacaaagcaatagtgctacgactaatctgtactatttccctcaaatagtataaggaaaatgctgccactcaacagcagtttaagtacagtaccactaggtgtcggacatgaatcaaaattttctggcattatgaactatccaggcaagaaagactgtggatgggtgttattcattcaacaaatatttaccgagctcttacaaatgtgccaggcattgattatcctacaatgaacaaagaatcctggcatctgccttctaaagtatttaaagttcatgtagcattgtacatttcacatgtaacatttcacacacagtattatcatatctagattcatagccctattatttctgttatgctagaatttaatttctctgcaaactcagaaaaatttgttatggtgctctaaccaactatctttctatctgactttatcacctctcaatcctttaaccaattaaacttgcttgactttatcaagaccttccattccctttagccttctccattcttctaaactatcagtctccctccagaaattactatcatgctcacttcggcaacatatatactaaaattggaacagaagttactttctttcttactaagattacccgtggatcagtatttcaacaaaattgaccagtaccctcaacttcctttccccttaacctttcaaagcattcgatgtgccaatctctaactacggagaattccaaaatacacctgctctgttcttgttcttggcctgctactacagctgaataaaactgcaggacaagcattgatttacaatttcccagttcagctaagttcttgacactactcagaaaagtctcttgcttgcattttaattcctgtcccctcaaggttgctgtttcaaacttctagtaaccttcttttttatttatttttatagagacaaggtcttgctacattgaccaggttgatctcgaactgacttcaagcgatcctcctgcctcggcctcccacccaaagtgctaggattacaggcatgagtcaccacacccggccatcataaacctctttaacttgctgttccatgctgatttcctcacactagttcaataaccttgtctcccagttcactcaattgctatatcctcaactttttttttctttgcctgtcctcattttcttcgtcctatttcaggtggggatttagtcatcagtcctcttcaggaccttgccaccataattctctcttctcacatgtaaaacttcatgtgagaaaatccctagtcttctctccaaatctcatggatatataaatgcttcccaaacaacaaaagttctctccacctttccatatagctaccctctctatccctttgtttttcaaactacttacaaatgtagtgtatgtatcgcttaccttcagttacctctaattcagggtttctcagaaattaacaaatacctccttgggggaaaactgccaactaccccaccctgaccttgtcacggtttgctgctctaatttttatgttccaacccacttctatctgtcttcctcctcccttccgtccactgcactgaaactgttctcagtaactttaccaaactgccatttgtcaggtctagtccaactgtatccctttagtccaaatcctaatgaattctctaagacaaaggacaaattttccactccccttgccccacttaaaattatcacctcctaataagcaaattaccaactcctcctggttgtcctcagacctttccactacttactctcaaatttcctttctgattcttctttctctgaccagctcttagagtcctgtcttcattctacatgtctttgtcctctctgtgtatggtttcacttacacttaagacttaattataacatataaaatgactgtcaaatctattttcaacccctaacctctttcttgagaactctagaaacaaattttcagctagatactgaactctctacaggcatcagaaatgcaacttatcccaaattaaactcatttctccagaggaaggagagatatatttcacttcaatatccttcagtccttcatttaatgacacctccatctatccagtcactcaagtcagaaaaacataatgctccacaaggcatctttaactggaaacacacactccatcctaaaatctttcaaccaaatctgggcaaatgtaacttctaaatgtctctaaaatctgttctggaatgccatttttccttcctcctgataaactcctattcatctgttaacaacccaatggacaccccatctgagatcccctcacctggtggttaaaactgacttcaaaaagttccagccagttgtggtggctcatatctgtaatcccagcattttgggaggctgagatgggttgatcacctgcagtcaggagattgagaccagcctggccaacatggtgaaaccccatctctactaaaaaaaatacaaaaattagcagggtgtggtgatgagcgcctgtagtcccagctactagggaggctaaggcaggataatcgcttgaacccagaaagcataggatccagtgagccaagattgtgctgctatactccagactgagcaatagagtgaggctctgtctcagaaaaaaaaaaaaaaaagtagtttctagtttggtggaggatataagtataaaataattacctaagtacaaaaataaaggtacatgaaattgttgtaggatcatggcacaaggaatcagagcctgtattctacatatattcattagatgtatatgtgccaggaactgttctgggctttaagagataaagaaaataaagtttctgctctacattccaactgagagagaaaaatgctgaggaagaaataagtaatatgagaaatggtgacaactgcaatggagaacaataagcagagtgagaaggaaaggaagagggaaaggcagggctgtttttctgaagtggtcagggaaggcctctctaacaggtgacatgtgcacagctatctgaaggaagtgaggttagaggccacatcacttccttcccagtaattagtttagtgagtggctcacaggactgactcaacagatgtttgctaaaggaacaaataaacaaaaattatatttctgatttaatgtgcttggcatttacatgtaaatatttctattctgtttttatagcaaagatgaaaaattatctgttaaacatcaaaaacagggactgtaactattataattaaatctttactacatggatttatgaatcacgtactttcaatgtaggctaactagctggagagcaatcaggaaagaaaatgggactactcaactagggggtgtctatgattaaggtcttaagttatggagcagctgaaaaaaaaacacagctcaacttctatgaaatcaacttggccaggtgtggtggctcatacctgtaatcctagcactttgggaggcagagccaggagcctagtacaagaccagcctaggcaacatggcaaaaccttgtcgctacaaaaaatacaaaaatcagtcaagcacagtggtgcaagcctgtggtcccagctattccagaggctgaggtggaggctgcagtgagctgagattgtaccactgcactccagcctgggagacagaatgagaccctgtatttaagggggaaaaaaatggctcagcatggtagcttggtcttgtaatcctagcactttgggaggccaaggtgggaggatcacttgagctcaggagttcaagatcagcctgagcaacatagtgagaacttgtctctaaaaaaattttaataataaaaagaaaccattatacaatgatttgatcattatacaatgcatatatgcattaaaatatcacactgcatctcataaatatgtataactgtcaattataaatttaaaaattaatttagaaaaaaaagctcaaaattacctaattacagagttacctctagagtaacatttctataaagaagttccttccagaggagaaattaatattctgcagaacattaatactccgccatgcacttttcttctttttcacctgtatcgtcctatctattcagtgtctccaattagttctctgcaatcctaaatttcatgttaagtgttttagaacccttgaagagattttttaaatttcatttattttcttggctgccaaattaacttcatgcactgtttttcaaactcttaaaacctactcctagaaatggaacttctgacaatgctacttgaatccagttgaattccttgcattttagatcactataaacaaggtttcccaggacttgaagtaaaatattttttttaacctttcatctaacttgaccaccttactttaccagtttattttacaaagaggaagttcaagttgttatgtaaatccaagattaccatgtttttgttattactgttctagcttatacacatagcagctatgggaaactgatttctaaatcaaaagagtgtcactggcactttgtgttagagaggttgatgggaaaagacaaaagaaaagtaggagggcagtcagaaatctgcttttcttcttcaacagcagaggttagatactaacatagtaaattttgcagctttgagagcagtcattttagaagcttgtgccaattcaagatggtggtcatcattagaaataccccagtgcacctccctttattcaacacatttactcagcaaacatctgagctcctactatatgtaccaggtacttactaggcactgaaaactcagcaataaaagacaatttctatccttaatgatctttgctctgaaagtaatacataaaagaaattattttccataaaaatactgaaaagtcaaagtatgtaagaaaagtttactttgtatattcttttctcttttttccccagacagtctcactctgttccccaggctggagtgcagtgacacgatcttggctcactgcaacctctgcctcttgggttcaagtgattctcctgcctcagcctcccaagtagatgggatttacaggcatgtgccaccacacccggctaatttttctatttttagtagagacgagggtttcactgtgttggccagactggtctcaactcctgacctcaggtgatccacccaccccggcctcccatagtgctgggattacaggcgtgagccactgtgcctagcctgcatattctaatgctcagtctttgcctctcgtttctctatttgccttcattaggttcgtgctgctgccaccacctccctcgaacaggtacgtcaggaggaagaaattccctacttgtttaccacatagcatgaacaatcactcagattgtctccaaaatatgagtagaattttccagtagagaattagggaaaaggtctatagctttcgaaaattgtgaaacaccaatctacttcatcttatacaaaatatcccttcaaacatctgaaagcagctatcactttttccctaagcaattctctttcaagcaaagttccatgttttctccatcttctttttaaaaatacatatcataggtcagccgggtgcagaggctcacgcctataatcccagcactttgggaggccgaggtgggtggatcaccttgaggtcaggagttcaagacagcgtggccaacacggtgaaaccctgtctctactaaaaatacaaaaattagccaggcgtggtggtaggtgcctataaacccagctactcgggaggctgaggcaggagaattgcttgaacccagaggcgcaggctgcagtgagccgagatggtgccatcgcactccagcctaagcaataagagcaaaactctgtctcaaaaaaaaaaaaaaaaaatcatcataggtcaaaatgtatatatattcttaccatcacagcccctttatatctgaggctcccaagtgttttaatcatgtcctagtcagtcagaagacaaccctggagacctcctttcccatattttcccacctgtccactagagaaaaacaaaataaatattttgaaattaacttgttactagctacatatagaatcacttttattacctttgtgtgtgcttatgtatgcatatgtgtacatgtgtatatatgtatataagtgagtttatacagtttacatgaggaaatattacccataatagcaaactacagataacttggtaattttattataactacatcttaataggacaaatacatgggtagcaaattatctaatgacttatccatgtactagctaactgggctaatatagagagatgggtaatttatatctgaaccatagtgtatatacatgtaaaacctagctgctagaaaattatatcctaaaatattattgataccagtgaaacaatatatgcccaggccactgaacatgagcatccactttaaggacttttctacccagcaaatagaagaaaaagcccaagtccagttaggaatctctatcaggagactctcccgcacttaagaggaagggtaactacaaataatgcccccaccaacccagaggctactttggagctgaacaaagtaggaaaaagaaaaaaaggaaggggaaagataactctaagaagtggccatgggctaaactgcacatggacatggatttttaggctaactcaggtaacagcctgtccctggacaaaagcaaacaccaatcaacttggagaagagattttttgtcttagatctcaaagaatccccaagtaataatttttgaaggtcataaaacacaaagcagttaaaaaaaaaaaaccatggaaaacaacaatattctaagctaaagcttagaaaacaaaccagagaaaacaaacaagagaaacagattcaaaaacttctgataaaggaatcaccaggcacagattataaaaaaattccgcttaccatgtctgaagaaataaaaagataaaactaaaagtagtccaggtgaagaaactataagaagtgatcaagcatatttgctgcagtaccctaaaaaacttctcataatcaaactttaaaacttaactaaaaagaaatttactgaacatatattggaagaaattaactagaatgcagaccagaaagacaaaaaagaagaagaaaaagaaaaactagagaatttagtagccatgggagatggagtaagaatgaaataatatcttcaatattactgaataattgtgtacccagcaaaaataccttccaaaaataagggcagaacacagatatttcacagaaaaaaggagagagaattacatcacatataagtaacatgttggagccaggcgcagtggctcatgcctataatcccaactactcaggaggctgaggctctgagtagtgcctgagggggactgcctgaggccaggagttcaagatcagcatgggtaacacagtgagaccccatctctttaaaaaacaacaaaaaaagcaacatgtagataggaaggagataatggagttaaaatgttctaaggtccttatattttgtaagagtagaacagaattttaagtagcatcagacttcgatgtgcttgcatattgtttctaggataaccactgaaagaagggtaataatgttctttaacctttcaagtagaaagtataaaagaaaaattattttttaatctcagaaaagagaaaaatataagaatgaaccaagagaaagttcaaaataaaagattaaacaataaatacataattaattacattaaatacatacgtgaaaatttctaaatctacctacagtgaactagctggttacagaatcaactcttccacccatgaataatagccagaaaagctagacgatgtataaccacatttgtgtgaaggcaccagaaagctaccaaggcagagatggcttaatgggacaagcttccaaatagatggaaatccagagaggtgagtccagtgctttgcacaactgttcaccttgaggcgtttcctgtttccaaagtaatggctgagagactgaccagctgcacagagcttccatcaatctcaaaaggctgaggagacaaaaaaaaaaaggaacttcagggccagccaaggaaaagagctctagaaaacaccatgttttcacttggggtccccaaaagaatacaacctgtgagcagggatgaaaagaaaaaggccaaccatgtcaagcatggaggtgggctgttcctctgcacacctccttctgaagaacttgccgaggggaagactgtgactgacagccccagctgccgccctttggatccatcaccatgttcacacagaggccacatttccccattcctgcccaaagcaggattcttctaaaagacaagtgtttgcctggggactcttcactggcctagcagaggcattcttagatctgtgctgcaggctggggcccttcctaccaattctttcctttcctctcttctttcacaggggtcaggcctgtctcatggtctcaggttttcccctgtcctctcttgctttcttctttatcctttacaagcattgcccccaataagccttctgcatatctcatcctggtttagtttatgcttccatcttgatgtctgctactcaacaccaattatcagatcaaggcctgactttaggtgaaggcaatccttgagcagagatgcaaaaattctaaataaaacagaaaaccaaatctggtgatatataaaaagcatcacacactgtggacaagtttggtttagtccagtaatgcagggctggtttcatatttgaaaactttatcaacatgatctactacattaagtgattaaggaagaaaaatccaaggattatcccaaaagatgcagaccattttaacactcattcatgagagagatacaccagattcatagatcaaaagattccatatttcaaatattccagtattataaacaatataaaacaaatcaaaattccaacagaatttttttcatgtgggtatagaaactgaaaatttgattctaagaagacattctacccaatagcagcacttattataaagccacattaattaaaatagtgttgttttggtgcaaagaaagtgatcaatggaatagaacaaaggttggcaaactttttctgtaaagagccagacagtaaatattttaggctttctgggacacatgcaatctccgtcgcatattcttctttttttaacaaccctataaaaatacagatctattcttagcttggaggctgtacaaaaatgagccatgggtcaatccctggaacagaagcaagtctagaaacagatctacacacatacaatttatgatcaaggtggtattacagagctctagagaaagtatggactttccacaaaatagtgtggggccaaataaatatctacataggaaaaaaattcatcttgacctcatatcatatgcaaaaataatcaatttcaggtggactttaggcttaattgtgaataacgcatcttgaagatgacacaggaggatatctgcatgaccatggagtagaaaaaaattcttacctagaactcataaactattaaccacaaaaggaaagactgatcattcagaggacattaaaattagaaacttccctttatagaaattactaatacgaaactgaaaggcaagtcacaggttgaattacctgctaatagtatatcactaacaaagtcctcatccacaatatttaaagaatgcctacaagttaataataaaaaaagaactgacaggtaaaatccaaataaaaggtaatcaacctcattagtcttcaggaaatccaaattaaagccatagtccacaccactgtacatccactaggatgattaaaattacaaagactgacaacagcaagtgtcagtgaggatacagagcaagcggaactctcatacactgttgctgagtgtgtaaatgggtacggtcccctcagaaaactgtttagcggcatctactaaatgtaatcatatgcatacccatgacccagcaatgcctagatatacataccctctagaaatgagtacaaatgtgtacaaaagtacacatacaagaatactcatagctgcattgtttgaagtagctaaacactgaaaaaaattcaatgtcaattaacagtagattggataggttgtacatattctttttacaaacatcagctttattgaggtataacatacataagataaaaaatacccattttaagtgcagggttcaataagtttagacaactgcatacacccatgtaaccactaccataaccatgatatggaacatttctattatgctaacaagttccctggtaccctttcccagtcaattcaggaaaccacagacctgtttagaagaggattttgttttgttttgtttaagagacaaggtcttggccaggcgcagtggctcacgcctgtaatcccagcactttgggaggccaaggcgggtggatcatgaggtcaggaaatcgagaccatcctggctaacacggtgaaaccccgtctctactaaaaatacaaaaaaaattagccaggcgtggtggcgggcgcctatagtcccagctacttgggaggctgaggcagaatggtgtgaacccgggaagcggagcttgcagtgagctgagatcgcgccactgtactccagcctgggcgacagagagagactctgtctcaaaaaaaaaaaaattaaaaaaaaagagacaaggtctcactatttgctatgctgcccaagatggccttgaattcctgggttcaagcaatctttctgtcctcagccttcccagtaaccaggtctacaggtgcaaaccaccatgccaactcacagacctgtttagattactctttcctaggatttcatataaatggaatcagatagtactcttttgtgcttgatttcttccactcatcaaaatgtttttaacaacaagagcatgagcaaaataataaaaagtagataaattatattttatcaaaattaaaaacttttgtgcagcaaaggacattactaagaaagtgaaaaaaaagaaggtgaaaagacgacctacataatggaggaaaatagatgcaaatcatatatctgataaggacttggtaaccagaatatataaatacaaccaaagacaaaaaccacgattatctcaacagatgcagaaaaggccttcgacaagattcaacagcccttcatgctaaaaactctcaataaattaagtattgatgggacgtatctcaaaataataagagctatttatgacaaacccacagccaatatcatactgaatgggcaaaaactgaaagcattccctttgaaaactggcacacaacagggatgccctctctcaccactcctattcaacatagtgttggacgttctggccagggcaatcaggcaagagagagaaataaagcatattcaattaggaaaagaggaggtcaaattgtccctgtttgcagatgacatgattgtatatttagaaaaccctatcgcctcagcccaaaatatccttaggctgataagcaaattcagcaaagtcttaggatacaaaatcaatgtgcaaaaatcacaagcattcctatacaccaataacagacagccaaatcatgagtgaactcccattcacaattgtttcaaagagaataaaatacctgggaatccaacttacaagggatgtgaaggacctcttcaaggagaactacaaaccactgctcaacgaaataaaagaggacacaaacaaatggaagaacattccatgctcttggataggaagaatcaatattgtgaaaatggccatactgcccaaagtaatttatagattcaatgccatccccatcaaactaacaatgactttcttcacagaactggaaaaaactactttaaaattcatatggaaccaaaaaagagcctgcattgccaagacaatcctaagccaaaagaacaaggctggaggcatcacactacctgacttcaaactatactacaaggctacagtaaccaaaacagcatggtactggtaccaaaacagagatatagatcaatggaacagaacagaggcctcagaaataacaccacatatctacaaccatctgatctttgacaaacctgacaaaaacaagaaatggggaaaggattccctatttaataaaaggtgctgggaaaactggctagccatacgtagaaagctgaaactggatcccttccttacaccttatacaaaaattaattcaacatggattaaagacttaaatgttagacctaaaaccataaaaatcctagaagaaaacctaggcaataccattcaggacataggcatgggcaaggacttcgtgtctaaaacaccaaaagcaatggcaacaaaaggcaaaattgacaaatgggatctaattaaactaaagagcttctgcacatcaaaagaaactaccatcagagtgaacagacaatctacagaatgggaggaaatttttacaatctacccatctgacaaagggctaacatccagaatctacaaagaacttaaacaaatttacaagaaaaaatcaaacaaccccatcaaaaagtgggcaaaagatatgaacagacacttctcaaaagaagacatttatgcagccaacagacacatgaaaaaatgctcatcatcgcggctggaggagcggacgggccccgcggggcccgagggcaaggagcagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccaccccatctgggatgtgaggagcgcctctgcccggccgagaccccgtctgggaggtgaggagcgtctctgcccggccaccccgtctgagaagtgaggagaccctctgcctggcaaccaccccgtctgagaagtgaggagcccctccgcccggcagctgccccgtctgagaagtgaggagcccctccgcccggcagctgccccgtctaagaagtgaggagcctctccgcccggcagccaccccatctgggaagtgaggagtgtctccgcccggcagccaccccgtccgggagggaggtggggggggtcagccccccgcccggccagccgccccatccgggagggaggtgggggggtcatccccccgcccggccagccgccccgtccgggaggtgagaggcacctctgcccggccgcccctactgggaagtgaggagcccctcagcctggccagccaccccgtccgggagggagatgggggggtcagcccccccacccggccagccgccccgtccgggagggaggtgggggggtcagccctccgcccggccagccgccccgtctgggaggtgaggggcgcctctgcccggccacccctactgtgaagtgaggagcccctctgcccggccagccgccccgtccgggagggaggttggggggtcagccccccgcccggccagccgccctgtccgggagggaggtggggggggtcagccctccgcccagccagccgccccgtctgggaggtgaggggcgcctctgcccggccgcccctactgggaagtgaggagcccctctgcccggccagccgccccgtccgggagggaggtgggggggtcggccccccgcccggccagccgccccgtccgggagggaggtgggggggtcggccccccgcccggccagccgccccgtccgggagggaggtgggggggtcggccccccgcccggccagccgccccgtccgggagggaggtgggggggtcggccccccgcccggccagccgccccgtccgggagggaggtgggggggtcggccccccgcccggccagccgccccgtccgggagggaggtggggggggggtcagcccccctgcccggccagccgccccgtccgggaggtgaggggcgcctctgcccggccgcccctactggaaagtgaggagcccctctgcccggccagccgccccgtccgggagggaggtgggggtgtcagccccccgcccggccagccgccccgtccgggagggaggtggggggggtcagcccccctgcccggccagccgccccgtccgggaggtgaggggcgcctctgcccggccacccctactgggaagtgaggagcccctctgcccggccagccgccccgtcagggagggaggtgggggggtcagcccccggccggccagccgccccgtccgggagggaggtggggggggggtcagccccctcgcccggccagccgccccgtccgggaggtgaggggtgcctctgcccggccgcccctactgggaagtgaggagcccctctgcccggccagccgccccgtccgggagggaggttggggggtcagccccccgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggctgctttgtggaatagaaaggcgggaaaggtggggaaaagattgagaaaccggatggttgccgtgtctgtgtagaaagaagtagacatgggagacttttcattttgttctacactaagaaaaattcctctgccttgggatcctgttgatctgtgaccttgcccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaatgctcatcatcactgaccatcaagagaaatgcaaattaaaaccgcaatgagataccatctcacaccagttagaatggcgatctttaaaaagtcaggaaacaacaggtactggagaggatgtagagaaacaggaaagcttttatactgttggtgggattgtaaactagttcaaccattgtggaagacagtgtggcgattccttaaggatctagaactagaaataccatttgatccagccatcccgttactgggcatatactcaaaggattataaatcatgctgctataaagacacatgcacacacacatatgtttattgcggcactattcacaatagcaaagacttggaaccaacccaactgtccatcaatgatagactggattaagaaaatgtggcacatgtacaccatggaatactatgcagccataaaaaaggatgagttcatgtcctttgtagagacgtcgatgaagctagaaaccatcatctgagcaaactatcgcaaggatagaaaaccaaacactgcatgttctcactcataggtgggaattgaacaatgagaacacctgtacacagggtgggaaacttcacacactggggcctgttgtggggtggggggagagaggaggcatagcattaggagatatacctaatgtaaatgacgagttaacgggtgcagcacaccaacatggcacatgtatacatatgtaaaaaacctgcacattgtgcacatgtaccctaaagtattaaaaaaaaatacttatacctcaacaacaaaaaacaacccaatttaaaaacaggcaatggatttgaacagaaatttctccacacaacatacacaaatggcgacaagcacacaaaaagatgcccaaagtcattaggcattaaggaaatacaagtgaaaaccacagtgagataccacttcacacccactgggttggctataatacaaaaatggaaaacaacacatgttggagaggatgtacagaaattagaaccctcattcattgctggtggagacatagaaatggtatagccactgtggaaaacggtttggcagttcctcaaaatatgaaacataggattaccatgtgacctagcaactctattcctaggtataacctccaaaaattgaaaacaagaattcagacaaacacctgtgcatgcatgttcacagcagcactattgtccaaagaagatatacaaatggatcttttattgttatctacctttcaaaggaacagaatcctctttcttttttttgagatggaatttcactcttgttgcccaagatggagtgtgatggcggatctcggctcactgcaatctccgcctcccgggttcaagcgattctcctgcctcagccttgcgagtagctgggattacaggcatgtgccaccacacccggctaattttggatttttagtagagatagggtttctccatgttggtcaggctggtctcgaactcccaacctcaggtgatctgcccacctcggcctcccaaagtgctggaattacaggcgtaagccactgcgcccggcccagaatcctctttcttacgtattttcaagaatgaattatgtgagagtaaagaactttcttttttttgttttgtagatagagatcttgctatgttacccaggctgttctcaacctcctggcctcaagctgttctcctgccttggcctcccaaagtgctgggattacaggcatgggccactatacccatccaagagtaaagaactttattgagaggctgtggtagaaacttagagactgcctgagttgtagtccagttctgccacctgctagtaacttaaacactctgcaccttagtttcatcatctgaaatatggcggtgataataacacccaccttagaagctgttgagaaggttaaatgagttaatccatgcaaagtcttagaatgcagccagtacactgttaaattagctgccaccaccaccactaccatcatcattatcatcttcatcatcatcattattcttcctacttcctaaaatatcctcaagaatatttaagacacctgtgattgtactaataaccagcattaaaagttcataaaaaacatacctaattagtatgtttccctaactatcagagaaactcaaatagtttaaatggtcagtatagttaaaaatgactctgggaggcagtggggcacaactgtagtcccagctacttaggaagctgaggcaggaggatcacttgagctcatgaatttgaggctgcagtgagctatcatcatgccactacactccagcctgggcacagagcaacaccctctctctcttaaaaaaaaaaaaaaaaaaaaaaaagatgctgaagggttcagtgaatgttccctcccaaagacttcagaaaagagatccatgtaacgctgctacattttgaaagcaattctaaacatgcttctgataccccacccaaagccttcgatcatggaccatgcttgaaaagtctcccatcagtacaggatacctttaccaaatgaggtttcaccaaggttactgctgaatatcactccaacactggtggaaactcaatttctaattatgttttgtaatatccagatctctctgatattatatctgattttttgcaccaaagaatgaaatgcttataatcctccattcccaatacaacatcatacatttcctgcattaaatagcctaaaatcctcctctctgaatatttccttttattaatggtgcagcgattgtgaagaaagttattgcacatatctccttaatcaaaattgacatatgtagcggaagagctctgctcatcagtataccacaggaagctaaatatcggatgttctgctcaggcccctatgctgagccagggctccaaccactgtcatcaactttggatggcatcccgagaccacccttctctcaaggccatctgaccagtcccagctgccgaaagactcactgaagctggctgctaccatcccactattcttattttgattatttatattcataaattctttaaaatattatttataattatattacattagaacatgttatactatattgttatatatttatattataaattattatttatattctccagagatttaagggaatacaggatgtcagcaaggtattaattatctacaagcaactattaccaccaaaaatattattttacttaacctttttcttataaaaaatctgcatcatagtacagaaaactaaccaacaagaagaaaaaatacttttaaaatataaaagagtgcatacataaaggatatgagaaacaaagcaaaatgcaaacactgggtaagtaaaataatcagaaaattaaatggctcggtatttcttggttgataagaaagaaaaaagaaaattaagtggcaaaagagatttcactaaactgccaaaaggaaagaagaccaaaacaaaatcattcaactgtttaacagaattttggcattttaacagcatctcttaggagtttgaataaaatcctggcaattattttctctccagtgattctaggctttgactctgatcattacactggaggctccgattccattaaactaacacaaaattctacataagaaggatttcatgatctcaatatgcttgaaaataagttatcaaaggaaatgagacagtaagataaaaatcataacattctgttgaattaaaatactaaattatacatagtttgtttctgaataggttgcattctaaaaactgacttgtaaataattgtctagaagttagaagaaatttttttcacatacaatatggtgtaattgttgatcaggttatttgcaatggtatcatgactatcatacttagggctaaacaggcctttgtgaaatagcctgagaccccaacgatcaactgggatgccaacagcaaactcacacttggaaagcaaaggtgcgatcaaggtaggtggagcactaggactccataacctcattaagctttgcaggtccactgctagccaagtactgaaactgagtaacaagtgatggttgctcctgcaaagtgttcacagcctctaaacctgggatctccttgacctttctccatgcaggattcacagaattaatttcataacatactaaacataccctatatttatcttctaattcttaacactacataagtcatacccttttttttaagacattatttttaaaataaaattaaagaaatgaggaagggacttaaaaagatgttaacagaagtaagagggcagaattataagatggacctaagagttagacacaactgatttggaaatccagttactaccacttactagcagtgtgactgtgggcaagctatttctcagcctcagttccctcatctacaaaataagaatattatctcataccttacagggttagagtgaggattaaagacgataaaaatatgtattatgatgcctgaaatagattaagttctcagtcatgcgctaatttccaccactctcccaacccactccccaaaatcaagcagttcttccaaatatattacaattgtattataaatcactttctccaaatactctcatacctttccatattcttctttgcttaggaagaaaactacagatcttctggacttaatacatatccaaccttgttgaactttgatcagaagaggtaaggtacttgaatttctatttctctcattttaaagccttagttttctgatttttaaaattatcttattagtcttttaactaacttattgatttacctttttgttaacctcacttataattattttctccctcaacctgttagacccctgatggtaaacttttactacatttcaattacagttgtcccttgaacaatgggtttgaactctgcagatatgcggattttttttttttttcagtaaaaatatggtattcatagtaacacaaggatgcaaaagctgtgtttccaatacatgggttccacagggtctattacaggacatgaatgtgtgcagattagcatatatgtgggcggtcctggaagcaatcccctgggtatatcaagggatgactgtatttacatcctttatggactttttcttttagccatcttatcttctagttattatattgactctatattttcttacaatgtaacttttcttacttaggattatcccttaatcaacaacgcacaatgccagtaaagcaaccagataatttaacctcaaactatagcagtaactcaattcagatctcaagttcagttgtaagggataataatcataaaagatcaccggatatgcagccttgaatatccattcttctaaacggtttgaatgttgtcactggatcaagccagactcatggcctatacacttggaccacaatgctttggtgcccatcactttaaaccaggatttcttgtccttgcactattaatattcgggaccaggtaatggtaataactattattattattttgagacagagtcttgctctgtcatccatgttggagtgcagtggtgcaatcttggctcactgcaacctccgcctcccaggttcaagcgattctcctgcttcagcctcctgagtagctgggattagaagcgtgcatccccacccctggctaatttttttatttttagtagagaagaggtttcaccatgttggccaggctggtctcaaactcctgacctcaagtgatctgcccgcctcagccttccaaagtgctggggttacaggcgtgagccactgtgcccaacccagataattctttgttgtgggggggctgccctgtgcactgtttcaacagcacctctggcctctatccaccagatgccaatatatactccccctctcccaactgtgataaagatgtgtataaagagggtacattaccatatacctccagggagcaatatcatccccagctgagaagcgctttaagctgaatgagaccttggggtttgcagtcagcttacattaaggaaccactttaaaaacagccataggaagaagtggtgttgaaaatatcatctactatatcgctctttgttttccaagggagaaacccgtctcagacctcagtgcaaaatgttgttttcttagaataatgtgtatccttaactgatcatattctcatcttttctatggccactggcaagctcaaaagcaaacttacagcccaccgtcaataacagtataggaccggccaggtgcagtggctcatgcctgtaatcccagcattttgggaggccgaggcaggcggatcatgaggtcaagagacagagaccatcctggccaacatggtgaaaccccgtttctactaaaaatacaaaaattagctgggcgtggtggcgtgcgcttttagtcccagctactgatggtgggtgaggcaggagaatcgcttgaacccaggaggaggaggtggcattgagccgagatcatgccactgcacttcagcctgtcaacagagtgagattccgtctcaaaaaaaaaaaataataataataataataataataacagtatagatcctaaaccgtgaatttatgtgtactaaatcttctgaatgtcaatttaattaattttttaccataattgaccttatattttatcttgctataaataaggtgtttcttcatgtggccataaacccttgagtgaaattaagcataaattaataattaaaataggcaaactgttatcttctccagcagattataccctttaggctcactctattattcctcttcaaatctccttctgctgaatctataatagatcttctagttttcccttataaatattcaagtttattctccctagccaaagcacaaaactaaatccattctcttcagcgaactacgtcagacacataatgatctgcatgaagttttataacaatgtctttctatatttattagaaatatattcccccccataagaagcatgaattctagatgctgtgtgtccagtaggttgtccaggtatcagcacatcagcctttaggatgatgggaagatggagtacctacatcctcctttctcttgctgatgccagcttcgtgagttttccctttccccactaaggcttatttctaacccatgccaagtagcatttggaattcatcctaaccctggtgcatgacagatggtaatgcaggagtggctcatcttgtaccagtgacaactatgaagagtcctgcctggccttacaccttcagattacttttgatagtgcaaaaaaaaaaaaggccatttccttctcattttaactcataaccttttcaagacctcaaatggttattacaaagctccatcaacaggttgagtggttaaacaatttgtggtatattcatacaaacgaaaaaacagtagtactatcagtacccatacatataatacagtgaaggtcaaaaatattatgcctgacaaaagagtacatgctgtattatttcatttataaaaaaaatctagaagaggcaaaaattaacctatacagtgataaaaatcagatcagtgattgtctaaagacagcagaataaaaaggagcacaagggaactttatggagtgatggaaaggttgttttgatatcacatcttaattgggatagtgatttcacgggttatacagtcatcaaaacttaccaaactatacacttacaatagatgcaaatgtggtattcttgctaaacacgtatgaccttgaactagggagaaaacatcagataaactgaaaatgaaggacattctaaaaaataactgatcagtactagtaataaaatacaaggaaagactaaagggacacaacaagtgaatacaacgtgggattccggaagagaacaaggatactagcggaaaaactggtgacatccaaataaagtctgtagtttacatagtagtattgtaccaatgctaattgcttagtattgttgattgtaccatggtattgtaagtttgttttgttttgttttgttttttgagacggagtctcgccctgtcccccaggctggagtgcagtggagcgatctcggctcactgcaagctctgcctcccaggttcacgccattctcctgcctcagcctcctgagtagctgggattacaggcgcccgccaccacacccggctaatattttgtatttttagtaaagacaggattttcgctgtgttagccaggatagtctcgatctcctgaccttgtgatccacccgcctcagcctcccaaagtgctgggattacaggcgtgagcgactgcgcccgcccctgccatggtattgtaagtttttaacactagggaaagtaaaataaaggatacatgaaaattctctgtactatttttgcaactttgttgtctaaaattatctagaaataaaagtttttaatgggtgcattttgttgagtgtgaattttaactcattcaagttgatttaaaatcagttattaagaaataattttatctccagcctgattgtccttttacgttcattaatgtttaaatcaacagtaacattaactacaagaataacccaaaccctcttcttttcaatatttgactcaataaacccaattgataaaacacacagcatttcttacctaaaataatcacctcatctagaaagattactaattgaaataaaaatcttaagtgctctccttggaattataatgatatattcctccacaaaaacacatacaattaacaacaaaaccattacatgttcaaattaagatgagacaatggaattcataaaactttgaagtccacagtaaaaaacatttaattctatgactctcacacctaagaactattatatatttgaacaccaaaaattatatcatctcatttagtatcacttaaagaacagaaagaaatgggtagaaaaacattcagagataaattaaaatgtttatagcatacctcctctgtttccattttcttcatcctacaaatgaaaatatatatatacatatatgagtacatatttataaactcttgttaatcacagcaaggctcaatttaattcaaatcgacctccccagattgtgccaattacaatctcactaacaatattcttaatgatcacattctcttctatagccactggcaagctcaaaagcaaacgtatagcccatcttcaataacagtataggaagtaccttttactggaaagatagagttttcacaaatagagataagcaggctgtgggtgaagccaatttaggggtaagacatcaggagttcagtttttggcatttgagtgcgagatttctaatggagatatccaagtgaagttgtcaagtaggcagttggacagatggaaaggtcaggtcatcacttactgtactatacttaaatgtgcctttaagggatattacaggacccagagctgtctatataaatggattggtcccaaattgctacatatttaagttcttgtattcaattttgaagtttatctacttggtctctttcattgttaccaagctgtcttgctgccatgttatctacctctagctggaaaattagaaaagaaacctttaaaaactagtctaaaaatacattttcaaatatttgctgagcctctaccatactggagctaccatgtaccttagaaagaaaaacagacgttcggtgaagggctgataatttattacataattttttgacctttattttggctgcccaatgttttttttttttcttcttctgattataagatctagtctgagactgaggttgccagttaagtgacaaaataaggacactgttatattaattacacattttctaaaagctatacaatattaaaatttttaattcgtttgaagtgaatttataaaatttcataattaaaatggaaaagattccaatatatattttccatgtaaaatttacaagacagagccctatttacaagaacatctgtattaaataatagcattaatagctaaaatttattgagcaattacagtgtcaatttctatgttaagtgtgttacaagtattgtatcatttaatcatcacacagcctgtgaggaaggtactactattgtgttagtcgacttatccaaggtcacagatctaacaggaggcagaaatggaactcaaacccaggctcttttgatgccaatgaccatgctgttaacaagcgtaagcatgtcctggaatagcatcatttcattcaaagttgttttggtgtaacattcacgagaaaaattaattccccactggggccctgtctgtgtgaagtttgcacattctccctacgtctgtgtgagttctctccaggtcctatggttccttcccacatgccaaaactgtgcctgttcgattcacaggtgtgcccacattgtcccagtctgaacaagcgtggctgtgtgtgtgctctgcaatgggatggacagcatcctgtccagggttaggccccacctcatgccctgagctgcatgagctgccgggataggctccagccaccctcaactctggactttttataacgctttcttaagtgtataaacaccgcacatttacttcaatgtttaatactggaagtgttttggtctttatttacaagtttggtgattttttttttttgaccagaaatatgccaagtaaactctagccaacataagatcagttatcacttaaatacgtttcacataaagttgcagtttccaaaaatctactgacaatgttaagtgagggtttattgtactgtgctactaaaatttctagaaatattttccaataataataatacatgtttatataagtttggtaaaattatcttataaaaaaattgtactacctatatgttcatcatgacccaaagctcttattcaaaacaaaacaaaaacaaaaagacaaaaaatacacaatcctaatgtaattatcaagtgctctcatatgtgacctaatgcgtaagtaacactatttgagactttttaatatcagctagattcttaagagatctagtccagttgttttatacacatttgagaaaacccaaacagataaatttcattctaaaggtagcaattatttacaatccttaaaagatattcagttgtttcctgttatctcagtgttaaagtaaccaaatataaaaaattttaaaaaagaaaaggaaaaaaaagagctattcagtacttcaaaaaagcataccctgtaggacattactagaaagacatatttaacaaaaaataatttaaaactgtggtctctagataaaaatacggacactactttttaaaagacagttttggattcatagatatttagaattagaaaagactttgtaatactctagttcaattcctacaaatgaaaatggaaatctagaggtcaaaagaagtggcctggccagggtctcgtaactcttctgaatatcatcatttccattatactattgtgtaatagttcagcatcaagcatgtatattggtcaaattcaaatcctagatcaactacttatctgttttatgacccagatcagtttccacatctgttatatggggctaataataccacctgctccacaggattctggcgtggataaagtaagataacgctcataacgaatggtaaggaacacagagcaagtacccagtgtgtcaactgcacttataattatctcaggctgtccttttcaggctgtgttactgtccactgaagcctgtcgatgtaattcattctgatgagaagctgtgtttttcaattctaacatgccatcatattacatatctgaaagttaagtattgttctaattctactaattttctataactgctagaatatttcagtgaaccatttcctttgcatagtctgcccagaaaactcactacctttctagataataaacagttacatattagaaaaagtagaaagaaatctggaattagaagtccttaaaaaatgcagatttggagtttagaatcactatgatctttcagagaagactaaagtttctgttttgttcttgaaggtgggaaaatacctaaaaggagaaaaataatataataaaaattcaaatgtaatgcttgattcttttaagacagaaaaaaggccatagggaagggtaagaggaagactagaaggggataggaatggccttgtggtttttttttcaagttgcggtaactatttctcttaccttatatgaaaattgaattgcagactctgggggataaacaataaaatgtcttaatgtaaaaccaaagccttgagatgttcttttcaacgtaactgttttgggacctggccaggagaatgtttcatcttcagacagtgatacagtttcactttgttcttttccatctttattttttgagacctaaagtgaaaagatatttaaaagttaactacataacacaatatacttcctcatctaaaaaaattctatgtaaaaatgttaatacctgagcgccgatatgaactattttctgatgcataaactacacaaagcatgcaattatcaaaaactaaaatttattatattattataacaaagcaagcaattatcaaaacctagaatttttttctagaaaataatgccataaaaaattagtcagaagaaagaactctcagaaaatagaaatataattcctaaaattagaaatgcaatagaaggaatgaaagataataccaaagaaattttaaagagcactatggattaagaaacagaaagcatgaaagaacagatataaaactctgacgaagaaataaacctaaaccttatcagatagtccaacagcaacaaaggacattagaaaataacagaaaaggtcttcaggttctgagcacgaattcaatatccacatagataacccttctgataccctggccttcttgttctttgacctcctctcctccactctcagctttcacttggtcatgactgaaacccccttctaagcccaaatcaagaatcccacctagaaccaccacctattattagttcactatttagttcattccctctcatcccccaacccttacaattcttcaatctggagctgactctaccaccctttccctgtccctcatcaccccatgttctcactttcctcttaagccagcttcaattcactcctttaccctctcccacttcctcaaagttgcctgacaaaacctaaccctggataaatcaacactgcctactctgggcctgctgtacttatgcaggtgaacgtgggtagagaaaaacaaaaactaagctatttcactctaagttcatgactaccaacctcaagagagcctttagtgttgtcagtcaatagtaacacatttctctctggtcattcatcctagatgactatttcatcccttttccccaccctcacctgcagcagatggtcctgctttctattacactcagaaaacagaagcaataaaatgagaactgaatcgcctgccatgatcaccccatcaacctgcaaccgtgcccatgttcccctgccttcccttctgctatgatggataagccatccattctcacaaggccccagcagttgagactagattcctcccctcttactattcaaagatacaggtccaacaattctcccctctctcttttgcatcacttattctctctttactatatatagcattcctatctgcatacacatattttgtaatttctttaatcttaacaaaatttttttttttttttttgagacagggtcttgctctgtggcctgggctggagtgcagtgccatgatcatagttcactgcagactggatcacaggggctcaggagatattcccacctcaccctcccaggtagatgggactacaggtgaatgtcatcaagctaattttttttttttttttttttttttttgtagagacaaggtctcactatgttgctcaggctggtcttgagctcctatgctcaagtgatcctcctggctcagcctcccaaagtggtgggattacaggtgtgagccaccacacttggccaaaatcctctcttgatcacacacaaccctctccagctaccaccttgtttgtctgcttctctttggcgcaaaactccttaaaagttatctgtacttgctgtttccaattcttttccttccatttctctgaaatccctttaaatcaggcttttatctgcctgactcccagaaactgctcttgtcagggtcccccatgacttccacattttaaactaaatgatcaattctcagttctcatcttatgtgcaccttattggcacaggcgtcacctcctccttcttgaagaattttctcaacttgacttctcacactgatttttcttccaactcacaggcgactttgtctcaggctcctttgttctcatctgctaagttcctgaacctggaggtacccagggctcagtctatggacttctctagctatactctgtcttttggtgatttcattccatttcctacattaaacaccgtctaatatgcaaattattcccaaatctgtatttctaacccaagcctctctccaacctgatatgtatcttaaacttaacatgtctgcatagctgctaagattttgttttaaattacaactccaagttaatcccagcattttgaaaaggtcacctttattgaattgcaaatgcttgaatagtcttgcttctattatattttttattatcttccaccagtgagtctacccactctgccacaataatttgcctcatataaaggtgaaaagataactaggtggtaacattgcccagccaaacttgcagtaggggtggccatatgattgagttctagtaaatggaatgttaatgaaagtaataatacagtataccaaaaacaaaaacaaaaacaaaaaaaaacagcatttccatatactagcaataagcaactggaaatttaaaactttttaaaataccatttataattacattaaaatatgaaatatttagggataaatctgacaaaagatttgtaagatctacaaactgaagctccaaaacattaagagatattaaagaataaatagagagatataccatgttcatgatttagaagacgcagtactgttacaatgttaactctccccaaagtgatctataaatccattgcaatcccaatcaaaatctcagcagatttttgtgtgcaagctgctatgatatttctaaaatccactttataatgcaaagaacctaaaataaccaaaacaacttcaaataagaacaaagttggaacactcagacttcaagacttacaaagctacagttatcaacacagtacagtattggcatcaagaaacacagattcacagaacagaatatggagtcctgctctagacccacaaccacatgatgctgccattctactcctaggtatttatccaaaagaaacatgaacccatgtcaatattgtacaagtataatacaaatacttgtaaacacaaatcgccctggaacaactgtgtggaggctgtgtgcaagaaaagaaaagaactttgatctgtaactcgtatcacaaacaaaaattaactcaaatgatcatacacctaggccggccgtggtggctcacgcctgtaatcccagcactttgggaggccgaggcaggcagatcacttgaggccaggagttcgagaccagcctggccaacatggtgaaacctcatctctactaaaaatacaaaaattagctgggtgtggtggcacacacctataatccccactacttgagaggctaaggcagaagaattgcttgaactcagaaggtggaggttgcagtgagccgagattacaccactacactccagcctgggtgcagagtgagactctgtctcaaaaaagtcaaataaaataaatgatcataaacctaaatgtaacacttaaaactatgaaacttctggaagaaaacaggggaaaatctttatgaacttaggtcaagatttcttagatataaccccaaggaacataatccattaacagcaacaacaaaaaatattcactagaagaacatacaatgaattttttttaaaaagataaatgaaacttcatcaaaattaagaccctctgctcttcgaaagacacttcctggccagtcatggtggctcacacctgtaatcccagcactttgggagactgaggcaggaggatctcagccaggagtttgagacctgcctgggcaacacagggagaccctgtctctacacaaaatttaaaaattagccaggtagctgggcacagtggctcacacctgtaatcccagcactttgggaggctaaagtgaggggatcacctgaggtcaggagttcaagaccaatctggccaacatggtgaaaccccgtctctactaaaaatacaaaaattagccaggtgtggtggcatgcgcctgtaatcccagctactcaggagaatcgcttgaaccagggaggcggaggttgcagcaagccgagatcatgtcactgcactccagcctgggcaacagagccagactctgtctcaaaacaaacaaacaaattagccaggtgtggtggtgcatgcctgtagtcccagctactcaggaggctaaggcatgagaatcacctgagcccaggaggttgaagctacagtgagctgtgatcacaccactgcactccagcctgggttacagaatgaaaccctgcctcaaaaaatatatatattttatgaaaagtatacacacacacacacacgtatatacatacacacatacacttttatgaaaacgaaaaggcaagccatagaatgggagaatatatttgcaaatcatgtatctgataaaggacttgtatctagaatatataaagaactctcaaaattcaataatggaaatgcaaactaaaaccataatgaaataccactgcacacataatagatgtgctatataaaaactaaccatactgagtgttggtcaggacgtgaagcaactagaactctcagacactgctagtgggaatgtaaaatggtacactttggaaaacagtctgacagtttcttaagttaaacatacacctaccatatgacaccgccattctactcatagagaaattgaaagcatacgtcaacagaaagacttgtacataaatgtgcatagcaactttattatagccacaaactggaaaacaactgaaatatttcagtaacagatgaatggataactaaactgtgacacagccaaacaacagaatgctacttatcaataaaatgaaataaactattgatatatgtagcaatatgttaattaggctgagttaaagaacccagatcaaagaagaagaggaggaggagaaggagtacatactgtatgctccatttatataaatcctagaaaaattctaaatactggtctatactgactgaaagcagattagcagttgctctgggtgggtgtaagggtggagattattatgaagcagcatgaggaaatgtgaagggtggtgaataaccttgactgtggtgatgttttcactggtgcatacttgcgtataaacttaccgaactgtacagtttacacatgtacagttgattatatatcaaacatacctcaataaagacatttaaacaaaagaagcagcaataggatgcttatcatgaaattcaagaaagtggttatcctgaggggataggagtgtgtgaatgaggaaacatggggctgagatctggggaaaacacacacattactccaacagcatgggtaatgtataagttaaaatctgtggggagttcctaagggttcattttattataccatataaagtcaatatgatatacaaaaagatatatatgtgcgcatctttttgtatacagcaaatataaacataaaaagtagatcgggctcagtggctcatgcctgtaatcacagcactttgggaggctgaggcaggcagatcacctgaggtcaggagtttgagactagcctggccaacatggtgaaaccccatctctattaaaaatacaaaaattagctgagtgcaatggcacgtgcctgtaatcccagctacttgagaggctgaggcaggagaagcactagaacctggcaggcggaggctgcagtgagctgagggcgccacggcactccagcctgggcaacatagagagagactccgtgtcagggggaaaaaacaaaaaaccctaaaaagtaaaaatgattctagaatttaacactggaaaaaataactattaatcattgtttcctatctcccatcattcttcaagaacacaagattctattttgagtctatctcttttttgccaacttttattgtaggttctgagtgtacatgtgcagttttgttacaaaagtgtactgcattactgcatgctgctgaggactggcataggaatgtgattctctctttttatctgacccagaattttaatttccagtttagcattgtggttcagaacataggctcgcattctcgcttataagtgggagttaaacaatgggtacacatggacatacagaggggaaaaatagatactggagactccaaaagcggggagggtggaaagggatgagggtggaaaattacccgtacaatgttcactattcaggtgatggttatgctaaaagcccagacttcacccctacgcaatatacccaggtaacaaaactgcacttgtaccccctaaatctataaacataatttgaaaaaaagaacttaggatttggagatttggagtcagctgaatcaggcactaactctggctctgccatttgctagttgcagtatagtggacaattatttaacgtctctaagcctcagttttctcatcattaaaataagaataaatgcacttctcctaaagaatgaatgtggattaaatatgaaatgtgtatgaagagcagagtacataaacatttaataaatattaactccgggccaggcacagtggctcacacctgtaatccgagcactttgagaggctgaggcaggcagattatgaggtcaggagttcgagatcagcctggccaaagagaccagcctggccaacctggtgaagccccgtctctactaaaaatacaaaaattagctgggcgtggtggtgggcatctgtaatcccagctactctggcggctaaggaaggagaattgctggaacccaggaggcggaggttgcagtgagccaagaacacgccattgtactcctgcctaagcgacagagcgagactccgactctaaataaataaatattaactcctcattctttctctgcaagctccattgtcttttcaaatctatttttcctgatagctctttaaatcacaatctctcacaacactttaacatacttgcatgtaaaatgcaactagaaagatgcatcaaagcaaataatggagcattggaaaaaactgggctagcaatcaatagtgtaagtaagaaataagaaaataagaaactggatcttggatgaactgctaactttttcctccctattcttagctatttgtgtgaatgaagtctctgaagtcatctatggaggctatgtatatttgaaactaacttatcataaatccgttgtagtttatcccccacttctaggatttagcggagcataacatgagagactcaagctaagccccaagcgactgcaaaagcaagcatatgattaggtagcgtttatagggtaagaggtatgctaggcttagtttcccaaatagtctagttaagctgtaagtaatgactggatcctccttttgagatccaaatgagagttcattgtatatgtgcagatcacggtctcattcactgacatactcttccttcattcaatcaataaatgaatatttattgaggacctactgtttacccaaccttgttccacagagtagatacacggatgaataaaatagtcattaaaattttagttcttttttaaattaagcttctcattttgagacaactgtagattcacaggtagttttaagaaataatacacagtcaggcatggtggctcatgcctgtaatcccagcacttagggaggcagaggtgggagggcagcttgagcccaggagttcgagaccagcctgggcaacatagtgagacctcactctccacaaaaaggaaaaaaaaaagagagagagaggaaaagaaagatagagagatcctatgtaatctttacgcaatttccttcaacagtaacttcttagaaaactatagtacaacatcacaaccaggttactgacacagatacaatccactcgtgttattcatatttctccagttttacctgtactcgttgtgtgtttagttctgtgcagggttatcacattatgtaagtgtatatacccaccataccagtcaagatacagaagtgtcgcatccccacaaggatctctcctgttgccctttcataactatacctacacctgctctctccctccacctcctacatgtcccctaaaacccttggcaaccactaatctgtttttcttttggtttgtttctgtctttttgttgttgttgttttgtttattttgagacagtcttgctctgtggcccaggctggaatgcagtggtataatccggctcactgcagccttaacctccaatgatcaagcaatcctcccacctcagcctcccaagtagctgggtctacaggcatgcaccgccatcatgcctggctgcctggtttgttttgagggtttttgtttgtttgtttgtttttgtttttagagacagggtctcactatgttgcccaggctggcctcaaactcctgggctgatgttatcctcctgccttagcctcccaaattaatctgttctatatttccattattttgtcatttcaagaatgttatgcaaatagaatcatacagtcagtaaccatttgggattggcttttttcacttagaataattctctggacattcaccgaggttgctgcatgtatctatagttcattccttttcattgctgagttgtattccatggaatggatgtaccacattttgtttaaccatttatctgttaaaagacatctcagctgtttcaagttttgggttactatgaataaatatgctatgaacattcacgtacaggtttttgtatgaacacaatttacatttccctggaataaatgtccaagagtgctactgttgggtcatatgtcatcttagcacatctgggctgctataacaaaatatcataggctaggttgcttataaacaactgaaatttatttctcatggttctagaggcccaggaagcccaagatcaaggcaccggcagattcagtgtttggtgaaggcctacttcctaaataggccgcacattcttgattacatggtggaagggcaaggtcgtttcctggggcttcttttttataggggcatgaatcccattcatggggctccatcctcagaaactaatctcccaaagggcctaccctcctaaaaccatcaccttgagggtttgggtgtcaacatataaatttttggaggacattcagaccacagcatataattacatgtttacttttataagaaactgccaaactgcttttcagactggttgtaccattttacatgcccaccagcagtgtataagtgatccatttctccacatccttcacaggacttggtattgccactattgtttattttagccattgtgacaagtggataatggtatctcactgtgatcttaatttgtacttcccttatggcaaatgatgatgagtatcttttcatgtgcttagctgccatcccattatataattttagagcacaaaagagtcttttaagatttaatctaaatattttaagtttcagggtacatgtgcacaacgtgcaggtttgttacatatgtatacatgtgccatgttggtgtgctgcacccattaactcgtcatttaacattaggtatatctcctaatgctatccctcccctctcctcccaccccacaacaggccccagtgtgtgatgttccccttcctgtgtccatgtgttctcattgttcaattcccaccctaaaacttaaagtataataattaaaaaagaagaaaagaaaaaaaaagatttaatctaaataagtgaacccttcacacatgatgtccagatttgctaagtgatttatccaagattgtggctggtttacatcacagtaagaattaaaataatggtctcctgaattcgatgctagaatattttctctatgttaaattgtttttcatcatctcttttatttcataatctacatattcttccccgtaacagctttttgatctaatttattatcttttatattttccttttcctgtgggactcatatttcaacactttaaaaactatacagtattaaatttatttctaatgtattattatgacttggcctcacagctcccaaatatatccaagttttcttttgttgaaaatcatataggtaactcttggatcatggttacatgcttcacatttctgaattgagctgctatgtcttgttttactgggctctttacacaaacagagaagatgggatgcagagtaggcaatttctttcttgctctctgcaaactaattaagatttctgaatgtgacatagctcaggtgtctcagtcattccacccacccagaacataacactgtagctcctctagtctcctagagggttacatttctatgggccttcacagaagcggaagataaaaaaaatatacatatgtgccctcttcactccttctactcacccacattgccgctgatctgttagatcttataacaagggcaagctataggcacacacagtgaaggagccagcagtcatgggtttctccacctaagaaatatccctctacacacatcttatttccctaatgtgagtgccaattcatgtatcagagtgcaagaagccaagaagtgactggaataatagcagttaaattcctgtggactaagaactgtcatttgactcccttaaaagacttcataacaaggtcatttgattgaataataactcaaggttaaaagaaaccaaaataaagatttaaaaactaattccataaaaattagatataacaactagacaaagcaaactcaaagagggtgaaagagagtttaaggggaaatcactaatcataaagcaaataaaggtgataaaaacctcacataagggaatgcaaaccggcatcccaaacaggaacaatggaaatgttccaaaagactgcaatgaaagtttcacaactgcataaagttgctaaaaaaccattgcaatgtatgcttacaatggatggatcttatagttactaagtcatacttaaataaaaatgttatttagatagacatgttacatctggttttcacagataaaaagtacaaagtctacatgttcaacagagatgaaagagatagggctgtcacaaaagtaaatgcaagggaattataaaagagtgcctgtataaacaatatataagtcctaatctatcttttgtaattatttgcactttaagtagaacagggtcctagtatattccaggaatcattcataagacccaagaaagcattttatactgtgttctcttaaaagataactggtattgattccatcatgtaactaagattacaagcctaactcccatggactcttggaaagcattttgtctttttttttttccattttaccatcaatattaataataccacttacttaaagtaaaatttcgttccttacattagggccagtttcatggtgatgcaacacctttttaggatgtcattagctgagaaaaaacaagacaggatttgaatgtgtgcagccacgtggctttttattgttgtatataaactgttggaactagtatggtatgaccgtcacctggctcgttttttcttttgtaacactggaagatggcatgcttggggggaaggacatgcactctgactagactgcccgggtctggattcttgatttgttaagttgtggctcgtggacaagctccttaacacaactgtgccttgtctttaacatgaggatgataatgacagtgcacttcatattcttgttaagaagattaaatgagtttgtaaagggattaaaacagtaccagccacatagtacacgcactatttaactacctaaaaaaaaaaaacataggggtcactgatacataaaggcttatatcaaaaacgtattgtgataccacttttgagatacttgggaaaacagtatataaaatattgttttgtctgaaaggaaaaacaaaatcttgaatatccataaaacttttagcatatttttgcagatatcacaagtgtgatggaaaaacaggcttgctgtgaggaatttgtcaaaaatacacagctaatagtaggtgatggagctagcccatgcttttctctatatgccatgaataggaagggaataatatgtttttcaacatttaaatattgcctatttttaaattactctatccatagtcctaatgccacagagatcaatcttattgtaaattattcctcacatagtaggattctttgacagggtatttctctgcaaaatttttcaacatgtggaaatctgacgttgtgaactaaagggttgtttaaattcccactgagagaaaagactcttgaatacagtttattgcatgctaagtatgcttgataacttcacaagcagcttgtttacagagtttctaattttaaagatttctttctctttttttttttgtcaataaaggtcgacaatgggaaatgctttgatgataaatatctagacgtatctagatgttttttcccaaaaagtaattctgtttttcagcgggtattgaacatttaagagataaaagatgatgactgcctgtaatcccagcactttgaggccgaggcaggcggatcacgaggtcaggagattgagaccatcctggctaacacagtgaaacccccgtctccactaaaaatacaaaaaattagccaggcgtggtggcggacacctgtggtcccagctgcttgagaggctgagacaggagaatggcgtgaacccgggaggcggagcatgcagtgagtggagatcacaccagtgcactccagcctgggcaacacagcgaaactccatctcaaaaaaaaaaaaaaaaaaaagatgatgactaatgagactgtaatactctcacaacatgaacttgaacaatctaagtgactttagttgataatacttccaattaaacatttgggcttaattttttttaaatgtagctttcaatgttcaacttcattatttacttggacattcatttataataatacttttcatatagctggctttcataaactaactgttgacatgagtcctttctgctgtatctgtatggtttcatgtatggattatttttgaatcactgatattttcactatatttatttctgtattcagggttctggttttttaatttaatttttacctggatagcacatttctctgtctttctctctctgatttactttattttcaaaggtaagttttttgttttttttttgagacagagtctcgctctgttgcccaggctggagtgcagtggcatgagcctggctcactgcaacctccacctcccaagcccaagcaatcctcccacctcagcctagggtatgtctttatagtataatgccagaagatggtttgttaatataaattgtaaaggaataactcagaaacctggtctaggctatgtccataagcagctgctaccatactctgtccctgtcagcctctcaacctagaagggcacatggttaggaaaccaccttccctttggacatgcacacatctcacacaatgttttacctgcaaagtttcaattgtactcctcagtgttattctcaggaaaattaaaaaccatctacttctcatttttcagaaacagttatggcttcagttttagagaaaaacaaatcaaaataaaaatactttataaagtaatttgcatatgctacatacactgcatgactgtttcctaaaaaagacagaaagcctaggccaggcatggtggctcacacctgtaatcccagcacattgggaggccaaggtgggcggatcgcttcaggtcaggaatttgagaccagcttggccaacgtatcaaaacaccgtctctactgaaaatacaaaaattagctgggcgtggtggtgcacgcctgtaattccaggaactcaggaggccgaggtacaagaatcacttgaacaagggaggcagaggttgcagtgagccaagatcgtgccattgcactccagccttggttacagaatgacaccctgactgaaaagaaaaaaaaaacccagcaaaaaaacaacttgaagatacaacactataaaacactcttcaaacactaaccataattaaatgataatacaagatccccaaaatttaactgacaactgccacatttaactattactacaaatttgagaggcatatacagtatttacattttttaaaatgaggctcagagaaatgcgtacttcaagcattttctttttaaatgatatcttaaataacttagatcttgctgaaacaaaaactcctgtcaaaaacaaaacttcccaggagtttatcagtttgactgttgaataactgagcaaactaggaatgggttttttaatttatgttttatttttaatttttgttttttgagataggatcttactctctcacccaggctggaatgcagtggcgtgatcacagctcactgcaacctccacctcctgggttcaagcaattctcctgcctcagcctcctaagtggctgggattacaggcgcccgccatcttgcccggctaatttttgtacttttagtagagacagggtttcaccacgtttgccaggctggtctcgaactcctgatatcaggtgatccgcccccctcagcctcccaaagtgctgggattacaggcgtgagccaccgcgcccggcctaggaatgggttaacaaataatgactgatattcggactgctataatcatttaaatctgctttatatacactttagtttccttttttttgtaaagaaacacagaaggataaatcaatatatttaaaattggggggaggaggggttgcagtataaaaatgtaattttggccattcatgtatttcttcctcaacaaaccatgtagcagtactctaataataaatattcaaatttgtttgttttttccattcctatattttagtaaacatgcaacttcctaaaggcagaaagagccaaatgatggaaagaaataatttgctgaatacatattcaaaagagtttagtggcagtcaatcatatttagtataggtccaaaacaacaagagcatccaatcaatatagatattagcagtttatagtgtcataagcatttggcccctactctcaaagcctaactagctctattaagcatttataatcagttaccttttaagcatgtctaccaaaatcaaagatcacgattttatttacattcctgatttgctgttaacttcccaaagagtatctaccagtcataaagatacaatgagattatcatttagtgcaacaaacctctttcttttctaaatataataccgtattgatagaattgtcttcttggctggtgcagtggctcacacctgtaatcccagcactttgggaggccgaggtgggcggatcacttgaggtcaggagttcaagatcagcctggccaacatggtaaaaccccgtctctactagaaatacaaaaatttgtcaggcatggtggcagacgccagtaatcccagctactcaggaggctgaggcaggagaatcgcttgaacctgggaagtggaggttgcagtgagccaagatcgcaccactgcactccagtttagttaacccactcactaacattattttcaataaggagaggacactgaagaaaagatattaagctaaaacaaatcaagaaaaacatggtaccacactgttaagatgaaatcaaatgggaattcacatatacttcactggaagtacaatcttcctataaacctacttggcaatatctactaagaaacttcaattttatacttgttaagctagtaaataatgaaataagagataagggcaaaaagacagattacaagctattcattccaaggtataaataactcaaattggaaactacttaggccggacatggtgagtcatgcctgtaatcccagcactttgggaagccgaggcaagaggactgcttgagcccaggagttgaaaccagctgtgtaacatgatgaggccctgtctctacaaaaaatttaaaaatcagccagacatagtagcatgcatctgtggtccaagctacatgggaggctaaggcaggtggatcccttgagcccaagaggtcaaggctgcagtgagccgagatggcgccacacactccagcctgggcaacagagtgagaccctatctcaaataaataaataaataaataaaaataaagataaataaactcaaactggaaactatgttgtctaacaacaacaaaaaagaatagtaagtaaattatgatacagctcctaaagtcatgactgtgaacatttttcaatggcatgagaaaatgcccaaaatataatgttaagcaaaaatataaaactccccaatatgatcaaaattattttaatcacatacacactttttggaattaggagctgtttaaattttttcctgaacgattcatggattttccataatgaacatgcacgcaagcagttgttacctttcacatccagttgcaatattgggcggcacatccctgcagatgagttatgactgttttcacatgtttcccgtgtactaactgaataaactattcctttctcagcaccaaagtgccttacagcagaacttcccgatcagtgtactttaaggcttaaaagcagtttctaagccaggtgaggtgactcacatccataatcccagcactttgggagactgaggcaggcaatggtttgagcccagaagttcacctgctacttccaggagagcaagggcaacctgataccaacctggccaacatggtgaaaccccatttctacaaaaaatacaaaatttagccaggtgtggtggtgcatgcctgtagtccaagctactcaggaggctgaggtgggagggtgagcccatgaggtctgggtgatggagaccctgtctcaaagaaaaaaaaaggcagtttcccaggccctctactgtagagagtacctttactgtaggacttactaaccatattataattgcttgttcatacatctatctctttaatcacagagcagcttcctgacaagatgcccaagtcttactctagtgcccaacacaaaacctgacagaaagcaggacctcaaaaatgaatgaaatttatacgaaatgagtaaagtttacataaaacaaagataatagaaaatgaagactttaaaacattgttggggaattgttcttatttccttatttctccattttcctcatttgaggcagtgagtgcatatagcacatttcacaacaactagacaaaaccagagaaacagacataaactcaaatacagatatgcctatttttacacattttcttgtaaagaagttttaccaaatagagatattttcaaaagctactttatgatatgaataaaatcttgtttactctgaatcaaggaacagattgcatttctgtggttaaaaacaattacttcccttccctttgggtagacaggaatcaccaaattaaaagtcgagcttaaatttcagttcatcttagctaccaatgaaataatgcaatcccctttgagcagataccagcaataccaagcacgaatataggctacggaagaaaaagctacagacggtcagacacatatcatgtggtttcactattttgcttgatgagctatgattatcttgactatgattatcagaaactcatcttattaaatgtatgtataaataagtttttataatgtaagttaattttgagttatcagtaatactatatcagcaaccaatgttaatggtgaactcattttcattggcaacacttgagagactacacaatttcaaagaattttatagctagaaggaaagtcagagataacagaattcaatttggtggccaggtggagtggctcatgcctgtaatcccagcactctgggaggcctaggcgggtggatcacctgaggtcagaagttcgaggccagcctggccaacatggcgaaaccccatctctactaaaaatacaaaaattagctgaaagtggtggcgtgccatctgtaatcccaggtactcaggaggctggggcaggagaatcccttgaaccaagggaggtggaggttgaagtgagccgagatggcaccactgaactccagcctgggtgacagagaaagactccgtctcaaaaaaaaaaattcaatttggttattcaccattttatagaacagaacactgacactccaagaggttaaatgatttgccaaatgttacacaaattttggtgatccaaactatgcattagggtccaaattaaggcaggacagaccagtaagagagtactgctccaataggccaagactagatggggaaacaacttatagaagatgacgaaatggtttttcacatgtgtaaaaatatagggtctctatgtatcagctagggtgaaggcagtctcatatcagacgtgaatcacccatttactcattagttctcagtgaaggttgactgtcatagtctgctatttccaggagagcaagggcatcctgacacaggagttaagctccgtcctaaaagaacccatgccccatgaataggaagaaagatggaagcttaaagggagtagcatcaaatatacctagaattactcaatctcagagatggggtttcctttttctttcccttcctcccactccaaatctctgagaccttttgctgaaagatagcttagaacagaaattcaatatacaaatattgaatactgtatacagagctgctctgcttgggagagaggcaagggcgtttgtacagaaacctactctactaattccttggaaacactaacagtctgatagagacttttaaaatcatagatctagttgagccaatttattttacaaatacagacactgagtccctgaaagactcactggtggcctcatagctaattagtgacacagcttggactagaacctcagtttccaatcttctgatcttggaacttttccaccataccactaacaaattgttttaacaatctgaagataatagctattggctaatgtatcattttttttctaatttatatttatgaaaacataatgtatgttcacttaggatacaccagaaaataaatctaagcaaaaaggaaataatttaacttacctgtcattccccgtctagagaaaattatgtcaatacttcgagacatatacatattcttccagactttttcatacataaatatacactggctggaagtggtggctcacacctataattccaacactttgggaggccaaggtgggcggatcgccagagcccaggaattcaagaccagcctgggcaatatggcaaaaccccatctctacaaaaaatacaaaaaattagcccagcatggtggcacgtgcctgtagtctcagctacccgggaggctgaggtagaaggatcatctgagcccggaaggttgaggctgcagtgagccgtgatcacgccactgcactccagcctggacatcagggtcaaggtctcttgtctcaaaaataattatatctatatgtatgtatatatgtgtgtgtatatatatgtatatatgtatatgtatgtgtatatatatgtatatatgtatgtgtatatatatgtatatatgtatatgtatgtgtatatatacatgtatatatgtatatgtatgtgtatatatacatgtatatatgtatatgtatgtatatgtatatatgtatatgtgtgtgtgtgtgtgtgtatatacacatacacacaaaaaatacatactttaggaaaatcttctaacctatttctttttattcaatattttatgtaagtctttccatatcaattacatatacctacatcattatttttaaagactacatggtatttcattacataaataacattttatttgttcactcttctctttgttcattatcttttttacactacattactactactattattataactacaactgccttgtagaccagtgtctatgaaaaaccattgagaattacattaggataaattcctaagaatggagctgctggctcaaatgtttactttttgtttgtttttagttttagacacaatattttaaagtgccatccagaaaagcagggaaccaaatccactgacagcatgagattcctatatccatattccagccaacactgagtatttttttcatctttgcaaatatgttaaagatgaaaatggttcttaatgttttaatttttttattctttcattactagtgaggctagacatcttggcatataacatgctattctaagtgccccataatataaataacatagaaaaacaggatgggcgtggtggctcactcttgtaatcccagcactttgggaggccaagacaggcacatcacctgaggtggcgagttcgagaccatcctgatcaacatggtgaaaccctgtctctactaaaaatacaaaaattagcaggtgtggtagcatgtgcctgtagttccagctactcaggacgctgaggcaaaagaatcgcttgaacccaggaggtggaggttgcagtgagccgagatcgcgccactgcactccagcctgagtgacagagggagactccatctcaaaaaaaaaaatatatatatatatatacacatatatatatacacacacacacataaacacacacatacacacacacacatataaaacatagaaaggcagatacaatatagtctccagcgtctttaagattaaattagaaaagtacatggtgtcattggtgttcagaacacagctctcatataaaattacaaattggggttaacaggaatgtcttaaaatatagtagcagaactcaaagcaaaatccctgggaactggaaaggaagcttaaaatacacagaaactgagaggtcatcagctggggtagcagaccccttagagacaagataacaagcctttcagggtaagaggatcaagctgtcttacattctgattagtgtgagcactggtatgtaccctaactttaggcggaaacatcagagttggtccagctttgagttgttgggtccagcaaaggcaaacggcatgaagctgagctaatagcatccacagttccctggggaaagacagggcttagacatggagcaatgaggctgtcatccaacttctaatgtggtaataacacacagttcactcacgttctttcaaatacatcgctgaggtcaaactgaattgtgtcttatttatttcaaaaacccaactaagtaaaaaattctaaatatagaaggtatttattttatatcttgttcatgaaaagttatgattaaatatcaaaaagtattttagacacattttagaggcattggtggaacttactatttcaaaccctggaggaaggccttttagaaagcactgaattattttaatcacttcataatttatgtcctataaatacaactgcctttcaacataatgtatttctggaaacattataagatggattattttaataggcaatatttttacacagaataaatgttttaattggctaaaatacagaaatgaccaaataatgccagagaagcccaataataccagagaaggttgaacaatgagaaacctctaaaaccttttacaagggcaaactgttatgatttttaagtaagcataaatacataagatgtatattttacaaagagaatcttcaagtattatgaagtgcatacaatactcacaaaaaatagaaatccaatataccataaattttactaaaaatgtgtaagctagaaataagaaacatgaatcactcagatccacctgaagagacaaaatggaattctctgttacaagaagggcagtaacactgctttactaatagtgcaggtgttcagatttttcttgatgatgttggtattgttgttattactgaagtctagtagatggagaggaatggtgttgggagggaaggacataagtttagtctgtgatatgggtttaaagcacctgtaaggtgccagtggagatacttagcagttaaacaaacgaatctaagctcaggaaagtgatctgagatttggaaatcatcagtctatcatatgatacctataggcatggagtcgatgaaaacatccatggaaagtatagattacggggggaaaaactggtacaattcttcttactaaattatataaaatatttaaatcaaattttaagtaattttaattttcacaagaagaaaccatttctaagagtctgtcttcttataaaccagctctatattttggaaacagtaacagccaaaagttggaaacaacccaaatgtccattaagagtagaatggatagaccagactccatggctcacgcatataatcccggcactttgggaggccaaggtgggcggatcacctgaggtcaggagtttgagaccagcctggccaacatggcggaaccccatctctactaaaaatacaaaaagtagctgggagtggtggcagacacctataatcccagctactcaggaggctgaggcaggagaatcacttgaatctgaaaggtgcaggttgcagtgagcagagattgtgccactgcactccagcccaggcagcaagaaactctgtctcaaaaaataaaaaaaataaaaaaattaaaaaaaaaaagagtaggataaactgtggtctattcacacaatgaactaccataaacaaatttttagacaatttacagctaatgcaacaacatggatacatttcaaagataatgctgagtgaaaaaaaaacacaacaggtgcatacagcgtgataatattcacacgaaagttcaaataggcaaaaccactatatggtgatgaagtctggagagggatgatctttggaggagaaaacaatgaccacaaaaggcataacagaggcttctgaggcgctgttcatgttctatgtctgggtggccaatgacgacacaggcgtgttcactttgcaaacctcgccaagctatgtatttatgatttatgcattttatgtactgctatatttctatttaaaacatttacaaaaacaaacatgaatctgattgtcattgtcatgctaaaaagccaacaatagaattcccatcacgctgggaaggaaatctaaaacttttttttttttttgagacagagttttgctcttcttgccttcttgcccaaggctagagtgcaatggcactatctcagctcactgcaacctctgcctctgcctccccggtacaagcaattctcctgcctcagcctcccgagtagcttggattacaggcgctcgccaccacgcccggctaatttttttgtatttttagtagagatggggtttcaccatgttgaccaggctggtcttgaactcctgacctcaggtgatccgcccgcctcagcctcccaaagtgctgggattacaggcgtgagacactgcgcctggcccctaaaaccttctcttgcagagggattgactctaacctaacaccctcatccctctcccccattcactggctcctgccacacaaatctcctggctgcgtcaaagctcactacccaagctctgtctcatcttaggggttttactaccataaaccaggtatataaagaaactgtattgagtagaaaatgaatgttttcttttcctgtaaaagagttttatttttgtaattatatttttatttctgtgttcattcatttagtatctctctcctccactagactataatcttcaggaacacagacatacatgttcaccattttacagcctatacccagcacagtggtcaggacaaaatcaggtacaaaagatatacaccaatggcccactgaaacttcatttttttctaaattcacaagtatatattgtaacaccaagctgggatctaaatgttaggattattgcccaaattacattcctttgatctctaggccccagaaagtaccattcaactcacccatacccccttatgcctaggcccacaatcatcaaatttaacaaaatattttgactggtcactatggtttgtggtaagcttaacataaattcccattccctattgcacaagaaagaattaacacaggaggcctgactgctatccttagaaaggccagcttgcaaggcggccctccgttggtgtttggcaactgggatttcaagacggttcccgtcattccttaatgatagtggctccccgtgcctagactgtgcaaatgacatggtttatgctgaacacttcctttccttctgggagtctagaatgttgatatacactaggctgaaggtacctatgtgacctgcccccagtaaacatcttgtcttgaatgagcttccctggtaggcagtatttcacacatattttaacaatctgttgctggaaaattaagtatatcctatgtggctccgctggcagaagactcttagaagcttgtaggtggtgtcctctgaactttgtcccatacactttttcactttgcttttgtattctttcactgtaatacatcattgcctgcgtactactttatgctgaatcctttaagtcctcctagaaaagaaatgaaccatggccaggcacagtgcacgcctgtaatcccagcactttgggaggctgaggcagacagatcacctgagctcaggagttcaaaaccagcctggccaaatggttaaaccctgtctctactaaaaatagaaaaattagctgggcatgctggcacgcacctgtcatctcagctattcaggaggctggggcaggagaatcacttgaacctgggaggtggaggttgcagtgagctgagatggtgccaccatactccagcctgggtaacagagcaaaattccatctcaaaaaaaaaaaaaaaaaaaaaaaaaaaaaaaaaaaaaaaaaaaaaacgaaaagaaagaaaagaaactccctgaacattatctcccaattcctaaatggattatcatcaatcacagtgatagaaaaaagaaaaccgtgattcccaccttgcaatattcatgctatgtgtcatcccctacccttgagtgtgggctagacctagcgatttacttctaataaatagataaatagaatctagggtgggtgcagtggctcacgcctataatcccagcattttcagaggccgaggcaggtggatcacttgaaatcatgagtttaagaccagcccggccaacgtggcaaaaccccgtctctactaaaaatacaaaaattagctgggcgtggtggcgggtgcctgtaattccagctactccggaggctgaggcatgagaatcacttgaaccctggaggcagaggttgcagtaagctgagattgccccactgcattccagcctgggtgatggagtgagactgcgtcaaaaaaaaaaaaaaagaatagaatttagcaaatgtgatgggatatcacttccaagattaggttacaaagcactgtgacctgtctcgcctacactctctctggctctcttccatcatttcttcttatgaagccagctgccctattgttagctgccctctggagagacccatatgtcaagaaacctctgaggacagcctcagccaacagcccccttaagaactgaggccctcaatccaagcacctgcagggagctaaatcccaccagcaacccatgagtgatcctgaaagcagacccttccccaggcaagtctcaagatgactgcggttctggctgatgccatgatgacagcctcgaaagaccctgagctggaggacccaggtaagccagacctggattcctgactcccagagaaactgagataataaatgttcctttaatcactaaattttaagggtaatctgttactcagcaatagataactgaactgacacactctaccaccaaaaacaactaaaaatccagacaatatatgtgaaacaatagtttccaggcattggacatcaggcccacaagggacagtgatccctcaaaaagaggacacaaacagtgggccctatgggcgccctagcttactacacagaaagtttcagggctttggcacagggcaggggaaccaggcagggcggctcaagttcacagcacagagtcctggagaagaaagtggcccagagagacagaaagctctgagaatctgcagggggtcctccccgaccccagtcttcagctgagcaatgatgagggaaaagaatctcctgaagaaattacaggcaccaaccctcaaaactcacacaggacgaagaagagagcccgttttcgccaatgagtgggaaaaacctcagcattcaggggcagtaggtaaagtactcagaagtgtactgtgcctctgtagtggggcagagtggttctgagaatgttaactcgaggcagtaaaatgtgacgctggatgaaggctgaaatgaggcactatgacctaacataggattaacactgaggcgtgggctcagtggaggctcaaatatactactgggatggctctaggaagtttggaaaaaatgatggcccacattaaatgaagtagagatgccagaactgctatgacagaccatgacagaagggatctgaaggctcagagaatcgggcctgctaaacacgtctatgtgctatgtgttacatcagaaaaccaaccagctaacagcgaccctcgggagggcccacaggacactccgtgtaccacggcaatactgaatgtgctgatggaggcagtgccagttctctgtccccttctggccagcactgacagtagaagatattgctataggtctgggcttcttaaggaccagggaggatgttaggatcacagaacagcagaggccaggtagcagcatttaacattccaagtcaatgaaacgtaggaatgagtatcaaaatcaagatagcatccagaggcccgacccagaatctctagagatgggtaacaaaacatgttcctaggggtggcccttccctggctctcatccaccccagggaaaggtgaaagtgatgacccagatggggcaaaactcattaagccaagggaaaccatccagaggaaaaggacagctggaggtattcgctgctgagaaatgggtgaaatggccttataaaggggtctgggtgaaggggtgaggggtatgaggacaatatgacaaatagagggatgaatttcagcaacagaaaaagaaagagacaaaaagaaagcaagaaagaaaagaaagagacaccttttggtctagtatgttccctctcccactttcctatcccatcttttcttcttctccaggctcccctcgtttcctttcagttcacattttctccactactccctaaatgagccatcaatttaaaggatgcttttttcttacattttatacagagctttataatttctaatttaaaacctgatgagctggccaggcacggtggttcatacctctaatcccagcactttgggaggccgaagtgggtggatcacttgaggtcaggagttcgagaccagcctggccaacacggtgaaaccccgtctctactgaaaaaatacaaaaaattagccgggcatggtggtgtgcagctgtaatcccagctactagggaggctgaggcaggagaatcgcttgaacctgagaggcagaggttgcagtgagcgcagatcgcaccactgcactccagcctgggcgacaagagcgaaactccatctcaaaaaaataaaaaaataaaaaaaataaaaaaacccgatgagctgaacactatcttcaactaaagagccagtagtgtcagagtcatatgtactgcatttgggggggaaattctaaggcattttgttgataaagctagtaaattcagtagctcccacatttgcttattatatatgaccacccttagaaaaattaagtgctacattctttaatggacctattgtatagcttgtattaaatgaaggattttcccattcatcttttaaattgaaagtcactatgaatgggaccctacacaagaaactttccccatcaatcatgaattaaacatggtacaacacaggagtcaaaatttcatttctcaaatatatagtactatgtaaaaacatatcctgcttttctaagaatcactttttgttataactagaattaagaagcccaagaaatcatctaatcagtttataacataagaaaactaaatccagagcattaacacacttgctcagtcacacaaccaagcagcggcaaagtgactagtgagtacttgcctctactctcaagcaaactgttttccccaaagttgcggaggaggtagtatttttaagtgcttttctctttgcaatcaagtccaactctcatcaagaagccaagacagatgggtcggccatccattcatccacacaccatttagactgttcctttaaattcttccttttccttcagagatttccattttctctttcttattcatttaaacctgatttcacccatcaaccagagctctcaggcagaataccctactagggtatactggccaagtacctactaggtcctcttaagttacagatccagaagcagctggcttgctattaaccatcaatgtgaactaaaattaaggcaaattgtttacaatccaaacataaccactttccagctaaaagcaattatgcatattgttaaatgacagtaatgatgccactttttagaattttaacattgaattctgctcacataggctcaatgtttataattagattgcttatatgacatgttcaccaactcacaatatatttgtacatatatatcagcaatgctaaaggtttcagtaacagagcagaggaagaacatcaactaatcaacactacaaaaagcgcctaaaactcacagccactaatagttactgcaaaacctgatctgcccttcgaaagtgttttcccaccttagctttctcttcaatctttagctcttcagtactgtgtatctatcattccagacattcctttcatcttttcgtcccctttctggctcctattatctctttttcagtctacttctctccactactccctaaattggccagcaattgggaatgggagggaaatatataatttacacatatatttgcatattatatccatataattttattatttactctagatgtctgatacatctttagaattattattattattattatttttttgagatggagtctcactcgtcccccaggctggcgtgcaatggtgcgaccttggctcattgcaacctccacctcccaggttcaagcgattctcctgcctcagcctcccgagtaggtgggattacaggcgcctgccaccatgcccagctaatttttgtatttttagtagagatagggtttcaccatgttggccaggctggtctccaactcctgacctcaggtgatcggctcacctcggcctcccaaagtgctgggattacaggcatgagtcaccgtgcccggcctagaattactagttttaaaagctgatgactagaacactacattatatccttcggtaaagagaaggcatcaagcacccagactttggagtctcactccctgggcctgcgtgctgctctgcaccttcttagctatgtggccccgacaagagacttaagcccttgtttatcagcttcttcgtctgtaaaatgggaatgtgatattcatagcatctctgtagagttggttaaatagtctgacacatagttaagtactcactaaatattacctattcttcatcactcacaaaatattcaactaacgttcctgcggcatttttcatcattttagaagcttgctgtgaggggcagagagaggtgttttttttcctcccctgctgaaggccaatagctgtgatagctgcaattctgaagcttaggtcaatggttctccaatactgctggtgaaatacagaagcggtctggctggatttctcctaacaatggttaataggcctctgtcctttaattcccgtccccttgctctcacctgcaagatccacctgtggaaaaccagccatctgtgcattttggcaatgcccgttgtgtccctgcacatattagtgtctctgctcatcccatatgcaccctgcccaccagcaaggtttccctgtgccatttccagctgatgtcttatacacaaggtgatgagtgtggaagtgcgccgcaagcacgtgcagagagagcactcacacagcacacccacaacgctacagagaggctggcctggaggtcaagccaggaaaaaagccaatttaaagtattacacctaggcaaggcaaaaccctcggagttctcagcctaaagtccaatttccaggctccctaactgattaaaataataagaattaaagatggtttcgatttttccatttatgttaacaatgaaatataaaacatgaaaaattgaggcttttctttatgattaggtattctggattaatttaggatcttatccagtggttgcaaaaaagaagtaccatttagccacttagaatttttctacataattatttaaataatatggtaagtggtaacaccataatactttgcatttgtcctaatttttaaaaggatgatacaatgtaaagtaatatttaaagaaaaacaaattaagtacctctcaaaaataacctttaactctcttttggccattgaaggcagagctttaatgtgtggaagaatcacctgacgatcttgttaaactgcaaattctgattccctaaagtctagagtgagaccagaacatccgcatttcttacaagcttcccggagtgtagatactgctggtcagttcatagaccacacttaaagtagcaagaatttaaggtaccttaagtgtcaaaaggcctatttccaatttcctagcttatcaacgtaaagcctccgtctactggtgttagaagcagctgctgattttaacagctctaaggaacagagaactaggacacaatttaacaaaacaggaggagcggaggaggaagacaagaggaaggagcttcagggagaaagcagtaaaaattaaaaaaaaaaatgctctatgcagcctctctttccctcttccatttggtttccccagggagagagggaacttcactaagcttgaggcctctttggtgtgggtatctccttgtcgtttccagttcgaaggatccaatctaggattcctccggctcttctttcctgaaatggacttatacaaaatgagatttccattaaataataaaaatttccaatcattttacaaccttctttcaaagaaaaaaaaaagtgccttctttaatggcatgattgtttttccctttgtaatatcttaaattggaacagaacatttctctgagaagggaacatgtgaatagaaccctaaagaaagcaaagcagcaggctatgcagagatctgaaatgaaagtatttcaggaagtgggaacggtgagtgcaaaggccctgagatgaacagcaaaggaggccagtgtggttagagaagaatgactagggtttgaaaaggaagtagaaacagggtactggagataatgaaagaagggaacaaaatctcttcaggcccttggcttttatgctaatatgggcagcctctggtggactctggtagaataccatgttcatgttctgatgtttaaaatgatcatactcgatgctgagctgaaaacagaccgcaggctgtatacaagtatctacagaagtgataatgccaggatctcccatgcttgatgctccccagtattccttctgagttccctatgtatgtggctgtgtaataacagctgtcattggacttgaaggaaaccaagaactgggattatgtgatatgccatatatatgaaaccttaatgcacaacttcttgtatctggctccattattaccaaacattcaacccctatttctaaacactgattagaacatttgaaatttatcacacaccttggtgagggggagaaaatacttccggttctttttttttttttttttttttgagacggagtcttgctctgtcgtccagtctggagtgcagtggcgcgatctcggctcactgcaagttccatttcccgggttcacgccattctcctgcctcagccttctgagtagctgggactacaggcacccgccatcacgcctggctaatttttttgtatttttagtagagacggggtttcaccgtgttagccaggatggtctcgatctcctgacctcgtgatccgcctgcctcagcctcccaaagtgctaggattacaggcgtgagccaccacgcctggccaatacctccattcttaattgtggtatgggaataaccagtattgtaatctacaactttttaaaattcactcatctgtcaagaagcccaagaacaatcacctctctaagatcttcagaatacaaaaaatgtattgttttaaggttttttttttggttttttgttttttggttttttgagacaaggtcttgctctgtcacccaggctggagtgcagtggcagaatctcggttcactgcaacctccacttccccggctcaagcaattgccccacctcagcctcccaaatatctgggactacaggtgtgcactactatactcagctaattgttttgtaaagatgaggtctcactatattgcccaggctgttattaaagttatatcctaaaaatagtgtcactatgacccagtaatttcacctctaagactgtatcctatgaaaataatcctgaacaggaaacagtttaaaacacaaagatattcaccacacattataagagcagaacactggaagcaatttaaatgttcaacagataaatggtttcaatatatatacacacacacataatacatagtttatattatagtgtataatattatacactgtactttacactctatattatataggcattgaaaatgatgtcctaaaatggaaaagtgtacataatattccaacttgtaaaacccacacacaaactagacacactgggtgaaaaaaaatggcagtatcaatatattaacaggagttgaatttgaaggatttaattaagtaaaccaattttaattttccagtttttacaagtgaccatgcatttgtaatttttaaaattaaattaatggattttttactaccatctctttacttttaatgtaaatctcatataacatcacctataccaacttagaatacgctaataataattgtaagcatgtattaagcactcaacacgccagcactatgttaaatgctatatccaggttatctcattttaaacttcacaacaatccctgatgttggtactgtcagagaggagaaggcaagtaacactcaagccataccactgccacagagccaggaacaactccaggccttgaattcagttcttgggcactaaactctgcactttcaactataacactatactgcctccatacaacagtggtaatatttaataagtaatgttaccttgcagaattctcagtatgcaacctgagaaacatgatggccactctcccacttcccatggtatcatttcttttgtctgtctccttcagttgttctccttccttcccatcctgccttttctgcgacttgttttctctcacccatacttctttccgacctataccataagctttccaagggtatccggcagcatccttgattactgcttagcttcaacggtgaaactcaaagaaaccaagtgctgtcctaagtattcctataaacaagaggttacacactaaaagcctagagccacatctggtcagcagatgtattttgcttagatctcactattttgaaaaccttgaattagtcatcaacatttaaaaattaggacacgttaacatgaaaattcaaattttcagcttctcttgaaatctaaatgatctgacaacagtgggtacaacatgacaacaatctcctaaagccaaatctctagttatccatggtctccaccagcctctattgtctaacccctgactgtgatccactcactttctttactcttcaactgcctggctcccaaagtactgattttgtgacctccaccaaatactttaagtggtgacacagaagccacaggagatgtcatatgccatttttactttatgctaagttctacattttttcttttctttttttttttttttttttgagacagggtctcactctgtggcccaggctgcagtgcagtggcccattctcagctcactgcaacctccacatcccacgctcaggtgatcctcccacctcagcctcccgagtagctgggactataggtgcacaccaccatgcctgacttatttttctatttttttttttcttttttgagacagagtctcgctccactgccaggccagagtacagtggcacaatctcggctcactgcaacctccgcctcccaggttcaagcgattctcatgcctcagcctcccaagcagctgggattattaggcacatgccaccacgcctggctaattttttttgtatttttagtagagacagggttttgccatgttgcccaggctggtctcgaactcctgagatcaggcaatctgcccaccttggcctcccaaagtgctaggattacaggtgtgagccaccgcgtctggtggtaatttttctatttttggtagagatagggtttctccatgttggccaggctgctctcgaactcctgggctcaagtgatcctcccaaggtgctggtattacaggcatgagccattatgcctggcctaaaaactcttcttctcagagacattggcaactaaatggctgattatcagacctaaaccacaaggatggtagcaacaacaatcctagcaaaaaaccccaggccaaggcacatccaaaaaagcacttttgatatcgctggcttactggatcaatgcacccctagattctattgcaactcaaattaaattcctttgggattacccagaatgaagacgtcttaaaaaggtctcagacctcaaactagaaagttttctgatgatgagactaactaatgagtttagtaattgctgtaaactagtcactaaacgctaaaaaattttaagtttcagcttcgttaggctcctggtattatgaattttacatgttaagataattccagtatctatcttcttttatcctcttagcagccattcaaaatccatattttttacggtaatgtaaatccattaggcacagactagaaagtgcattgagggatcaatcttacggtgaaacaaacagagactaaatgaccttctccatctctgatttctctgatacattagtctattatgcccagcctaaactatgaaaatattttttcaccattccagaatagagaaaacagtacataaagaaaagtattggacaccccaaagtaccactgggaactaattccatatcataaacgaagaagctcacatcacagttatggaagaactgagaaatggttggggctggggcaagcatggtcagtgtgctttatttatcattcattgctttcaattacattttcaactgttttccttttaaatttcaaacaatattaaataacttgtttttagtaaggaagacaaatacccacaaagtgatgaataacctacgaggtaaataattcatagtttttaaagattcactgataactggaacaaaagctatcattcacgttgctttctattctgtaaaagaagccattatgctgaatttgtacaatattatctacgattaacaacaaaggtctgataataacaatgttgatcgagggataaagggaaaaataagagcttttgcttcttagggaagaacactcaaaagcagacaatagctaacctagcagattttctctattgcaaaataaccattttctaaacagactagtaatcaaaaaagttttaaaaagtacttccatttaatcccactgtgaaagaactcaagaaccatatttcactaaaactgaaaaactagctaaaaagcaactcactccaaaatcttgcctactttctaataaatacaatgtcagatgccttcaaaaatatgtaacatttatgttacaattatattgctttaattgttggccacttttaagtaattcattctaacttcccctcctccaccacttaaagctctgcaaatagtctcatctgtgctacttaagaattaacttaattcttttaaagtaattcagatcattagatttatcacattaaacaggtattttgacaaaaaaaaaattctaaaagattactttcctactcttacaagaagacagtgtttttatatcctgatttacttttgctttatacatcatagcagttttgaattaaaaagcaaatatatacatacacacttatgaaacaaacctgaccactccatgcacaatacagattgcacaacaaactccaattgtggttgatcatgcagtctaaaatcctgaactgggccatgactgcctatagcacagtctgcatctcttctctgactcagcttctgtcagcagagcagcggggttacgagagctctgcagtgatgtggtccacaaataagatcttcccctccctttcctgtctaagcagcaatagctaactggcagaacgacatcatcttcccaaatgtagttcccaccagtacatttaaattattagatcatgaaggaaagttttcataaaattcttactgagtatttaacattatttaatttgtaaaaggttattgctttttccttcttttctgggcatctttagtcattcaatgaaaacacaacctggggaggtggtatataaatcaatcaactatgctggctccggtccacagcaaacaaattccaacacaaggctgtgccatcatcaatgacgctcacactgacttgatcccaagggtaccaaagggtactccgtcctttcttaacctctcagtagcgccacacagagctaacaactccttcaatggctctcatcctgggtaccacagttccagtctctttgttctcttactacttctttaactattacttctttgcaaaaggcaatgtagcaatgtgagaaaagcctagatcttaataagacagatgtatgaccaaggaggctaaagacttatcctttaagcttcaaatcattcatttgtaagatggagacataccttcacgaggtttaatctgaaataacatctgtaacatgcttaaaacagtgtctaacagatatctaataaatgattaatagtttcaagatgatcacccctttctgtctaaatcagaattctatccttgacctccctctaatttcttacacttccataggtgaagtcacctcaacctgtgattttaactatgaattatttctaaagccctcttcaacaccaccctttctcccaagctccaaatctgcgtgactaaacacttgctaagcacatacacctacatactacatgtccaaaactgaattcatcaccttccctccaaacttgcacgacctcctctattccctaatctgcatagtggctgtacaactcatccccctagtcacccaaacagaaaccagagtcatcttagactcctccttccttacctctcatatctagctaccaaatcatgtcacttctcccaaaacatataatgaactgtcctttttccactccaccggcactgcctaaattcagacccccatcaactttctcctggattatcacagggcatctagttggtctcccaaacatcctgtcacccctctctggaatcttgtctgttcaggactaacaaaagcaccttttaaactaaaagctaatcatatgactactctataaattccttctgttgctcctttctgcctgtatacagcagtgtttcccaagtatgttcctacttgttttataggatgcagaatataaactacagttaagtaaaaaaaagtcttcaatagcaaaataaatttgagagaagctaggttaaacaatgctgctgctggaagcttgccaaaggctaaatataaagatcaaattcaaagtcctcaaaatctgaaaactgaggctactgaaaagcttgtttctaactagttcgccttggtggctggtttgtcggcctctgtccgtcccttaattggtggtgttcctcagattctggactttgaccctcttccctccctcaatgacctcatcaactcccaaaactataattaccatagatgctggcttaattgaactctgcctaactgacttgctagaccaaccaaaattcttgatttcctggctaattcttgaatactggctgatcccatggctcaactctattattattatttgtacaaatttatggggtatcatatgcaattttgttatctgcatagatagtgtagtggtcaagttggcttttcgtatatttatcacccaaataacacacactgtacccattaactaatttatcgtcattcacctgctcccactctgtcacccttctgagtctccattgtctatccttccactctctacacccatgtgtacaaatttttagcacccacttatgagcgagaacatgcaatattcaactttctgtgcttggtttgtttcacttaagataatgtcctccagttccatccacattgctgcaaaagatataatttcattctttcttatggctgaatagtattccatgaatagtcttccattccaaatataccacattgtctttgtctattcctccactgatggacacttaggttgattccatatctttgctactgtgaatagtgctgcaacaaacatacaagagcagatatctttttgataagtggatttcttttcctttgagtagattcctaggtcaaatggtagttccatttttacttctttaagaaatctccacacagttttccatagaggttgtaacaaagaaaagagagaagacccaaataaaaaaatcagatatgaaaaaggagacgttacaactgataccacagaaatacaaacgatcatcaaaaactattatgaacagcaattatgctcacaaactagaaaacctagaggaaatggataaattcctagaaacatacaaccactcaaggttgaaccaagaagaaatagaaaacctgaacacatcaataacaagtagcaaggctcaatcagtaatttaaaaaaatctcccaacaaagaaagctcaggactagatggattcacagccaaattctatcaaacatacaaagaactaaaaagaactaataccaatcctcctgaaactgttctaagaaatcaaggaataaggaattctccctaactcattctatgaggccagtatcaccctgataccaaaactggaaaagggggcgggcactgcgtctcatgcctgtaatccccgcactttgggaggctgagacgacaggacagcttgagctcaggagttcaagaccagctcaggcaaaacagtgagacctcatctctacaaaaaaaatttaaaaattagccaggtgtgatggtgcatgcctgtagtcccagctactcaggagactggacagaaagactgcttgaggccagcaggtcgaggctacagtaagccatgttcatgtcactgcactgcaggctgggtgacagagcaaaaccttctcttaaaaaaaaaaaaaaaacaatccagacaaggacacaacaacaacaacaacaacaacaaaaccctacagaccaatatccctgacgcacacagacacagaagtcctcaacaaaatacctgcaaactgaatccaaccgtactgcaagctcaactcttacaactgggaagataatctagacactcaattctgctcccaacaagtgacattcaagcttaacataagtcagttttatttttgcacatatctctttatgtctgttttgtgtttggtaataatgtaatgtagatggtatggaaactgatgaaatatgggtaaaaacaaaagttgttctttctgagaaaactaacttgagtacattgaaaggactcaataaaggctgttgctcacttctatatttttcccttcctggtcttgtagctgaataagctacagctagggagaatatccagtatctctagatataaatattctagatatactatatgtagaatctctagatagagagtatctagtgagacattaaatattctccctagtattctagagataatagatattctccctagctgtagcatattcagaatctaaagttgttccctgtgccacaacattcttctcttctttctacctagttaactccttcctcagttagcttagacacaatcttcccaggaagattttccctgatctctacagtaggtgaggtcagcctgctatatgttttcatagctccttactcttctgctaaaatcctattcattgcaactctactataagtacttgttcaattgtctgcgcttcccattgcccatgtatacccatgaaggtaggaaccagactatgtctgtatttttatgctgcgcaccctcagtgtctggcactcagaaggtgctcaataaatgtttgttgaatttgttaataaatgtggaaggacacttctaaatataacaggaaagtttggcactagatcaaatttgaatcatttttgattaacttctatcttgggaacaaaagggtcattatcatcagttgtaggcaaaacacaagttgcttccttcctcaatctcagtaagaaagtagctggtgcggtgactcccgcctttaatcccagcactttgggaggccaaggcgggtggatcccaaggtcaggagttcgagaacagcatggccaacatggcgaaaccccatctctattaaaaatacgaaaattggctgggcatggtggagggtgcctgtagtcccagctacttgggaggctgaggcaggtcaatcacttgaacctgagaggcagaggttgcagtgatccaagatcgcgccactgcactccagcctgggcaatggagcaagactccatctcaaaaaaaaaaaaaaaaaaaaaagggaaggaaggaaggaaggaaggagggagggagggtgggagggaaaaagagaaagaaagagagaaagagagaaagaagttagttggagcacttgggcttctagcaaaatcgctgcatatctaacaactgatactattccatcctctaagatgctgaaaaattctgggagaaggaaaagaagggtttcaggcatttgattttcaaaagttcccaggggaaccactaaacgaaaagttcataccaaaaaagaaaaaaaaaaactcagagactaaaggcccaactataatcaatcttttataaatcattcctaaacacagtctacttttcccatcttcagtccccacgtcagaacatcttcatctgtaaaatcctttagaaaactcaaacctgtttcacatgaaggataatattcacgtaactatcttttccttatttgagaatcaacatggaaatctccctgaattcccttctcccctcaaaaaaagataagtgcagccagatagcaagccaacagcaacaacaaaaacacgtgggcaatatttacaacaaaactaggtgtcaaggcatccctaggaaccccaaaacagacatgagaagaggcaaatcactaacaacacttttaagttgtacacagcatcagcatctggaaagaagggagcaaagagaaacatctgagcatgtgaccaaacagaagaaaccccagtgtaggggtttgaacagtaacccccctgaaaggatatgtccacccagaacctgtgggcatgaccttattttgaaaaagggtctttgcagatgtaattaagaacttttttttttttgagacagtttcactctgtcacccagtctggagtgcagtggctccatctgggctcaccacaacctccgccacttggattcaagacgattttcatgcctcagcctcccgagtagctggaattacaggcatgcaccactacacccagctaattttttgtatttttagcagagatagggttttgccatgttggccagggtggtctcgaactcctgacctcaagtgatctgcctgcctcagcttcccaaagtgctgggattacaggtgtgagccactgcacctggccaagttaaggatcttgagaattacctaaatccagtgacatatgaccttacaagagaaaggcagatggagacttgggcatgcagtggagaaggccatgtacggacaggcagagactggacctatgttgccacaaaatagatatgatctatacagtggtccttcaatattcatgggagattggttccaagacctcctgcggataccaaaatccacgcatgctcaagttcctaatataaaatgaagcaatatttgcatataacctaacacacctcctgcagtaaatcatctctaaattacttacaatacctaatacaatgtgaataccacataaacggttgttatactgtggttttgggaataatgacaagaacaaaaactctgtacttgttcagcacagacacaatttttttccccaatatttttgatccacagttagttgaatccacgaatgtgcaaccccatggatacagagggctgtttatacaatctatggacaaagaagggtgtctatatgattaaataaaaaaaaagtaaacaaaaacaatttcctaaaaggattagaataacaatctgatatgaacggggtgcccagagcctttccttcccctcacatccactactagcacataatgtttccagaagccaatatgcagaacccagagaagaaagtaagtctcactgatctgccttatacaaattcttttaaatatacaatctgtatttactaggcaaatactgggtattacagaggtattacctcaaggttaaaaaaaaaaacggcgctgatgaattcccaagatcacactagctatgccacattcagaagaatgtctaaatataatcataaatccagctttgtatctactgatattcaaggacagtctccacattgtgagtaaggagaaaatcaggacatatactcaagaatataagtcttctcaatatattaatgagtagtgcaatgaacaaaaaaatagaactcaagagagtgtcttccttaggttgtacgaagggcaaagaagttgtgggattataaacagtgctgcatacatagcactactcctgactatgccagagccctcttcagaacagagataagcaacaggggaaaacatagtaagtaaccaattctgaatcaaaaacacacccaatatcaaatagaaaactcagcagctagtcaccagggaaaagtaaataaagtctttaacttccctgtttttttatttttattttttacaataataaacagtttcttctgatctgtctacttaccccgaaacagatgaatagtcagaaatatcaaatttgggttctcaatctattcttttattcacaaatctacatagtggaaattcttgcacattaaatagataactagaagaggacttataaaacatttccatcacatcaagtttctttttttctttttttttttttttaagtgatgggggtctccctatttggtccaggctggtctcaaactcctgggctcaagcaatcctcccgactctacctcccaaagtactgggatgacaggcattagccaccacgtccagcccacatcaagtttctcaaacctatagtacaatatatccatttgtcttttggattatttgagaagcacaaaatgccatcatccagattagattgtgaaataatttgcacaatacccaattttataagaacatggcaacttaaaccataaaactattttagtgaaagcaatccaaaattgagttttttgcatttagatatctttctacttcaaaccagggaagatatggaaggcttacaatattttaacacatttaattacttacagtcaattaaaattagataaaatagtaggacaatctttaagtccaataacctttcgttttagtaatctaatcacatcaactagacagaaaaacaagtgcctaccatatggtctttctgtaacagaaaatagctgcattgaataacagcatctgtgcatcttatcaacgctagcattgcccatacttaaatcagcatattgttaactataataagaagacaggacccttcacaaagcaaagaacaaaagaaactgaatattacctttgtgctagattacttgacctggtagtaactaaagaaatgaagaacatcaaggcacaatgaacttcataaaacgcttaacctggaagaaatgaatgggaaggaacactaacaatttacggagaaattctttagatctgggtactcactttgctgatggctcttatctagtgataggccccactcaatacattaaaatccaggcttctgccgaaatgccacttaatgatccctgctgctgctactgccatcattctcaattctaacaggttttagctttaaccctaacttgcagcataaaacttttggcatggaacagtattctgacacttaaattcaggtgtatgaagaaacacaaaattaaaattaaataatagagttataccatactgtaactagtctagaatgaatcctatgcctccaatgaagaaacttgctttttaaaaattgttttttggccgggcacggtggttcacgcctgtaatcctagcactttgggaggccacagtaggcagatcacaaggtcaggagatcgagaccatcctaacacggtgaaaccccgtctctactaaaaatacaaaaaattagccaggcatggtggcgggcgcctgtagtcccagctactcgggaggctgaggcaggagaaaggcatgagcccgcgaggcagagctttcagtgagccaagatcacgccactgcactccagcctgggcgacagagtgagagtccatctcaaaaaaaaaaagaaaagaaaagaaaagaaaaagaaaaaattgttttttaagtgttgctttgagcagtgtgtatgctttttagtattgttttaagcagtgtaggtttgccacaaaccaaattttcacaagactgaatacatattacctatttttaaagtctatacatagtgttcttttattgtcattttggtaataaaaaagagaaaatgtaaaaataatataatcctgatattctcatcattcagaataaacaactgttaacatttcatcacggtcaatgtttgtgatctttttttaactggttatgaaatatttatgacatgaaaaaataaaaatacataataaggaacatccatatactagccattcgttttaagaaataaaacatcatccatacagattatctttttatagcttctcttatcgaccagtctgattgccctttcacttgtctgttaattatcatgatctcatctcttagtggaaattgtttcatacatttgtactacacattgtcttggttactgttacttggttaccagcttcccaaaggtaaaaaaggtgcaaagaaaaaaggcaccaaaaattttaacagcagttctaacggaaatgaaatagaatttaaggtgggcaggaggtctaaggaagaacatatttcatactgtacatattttatataaactaaaataagtattcagctgggcgcagtggctcacacctgtaattccagcactttgggaggatgaggtgggtggatcactttgagatcaggagttcgagaccagcctgggcaacatggcaaaaccccatctctactaaacatacaaaaattaaccaggcatgctggcacacgcctgtaatcccagctactcaggaggctgaggcaggagaatcacttgagcctgggaggcggaggttgctgtgagcgcagattgcaccactgcactcaagcctgcgtgacaatgcaaggctctgtctcaaaaagaaataaaataaataagaattcacatactacatgtccaaatgcaaactcagtaacattttggagttttgctaagtctttattcattccaaaaacatatttattgacaacctattatgtgctaggcactcttctaggcacaagaaacacaatgtgaacaaaacagacaaactgcactctcaacacctgcgttctagatatattacctgtctcaaataaacaaacaaaatcaaatgcataagcatgccgggtggagactaagtgatagggagataaagcaaggaaggaaggcagagcatggcacagggagcaggggaggggcattcaacaaagggagtggttggcaaagcttcactcggaaggtgacctctaagcaaaagcccgaaggagccaaggaagcaagctgtgcagagactgggggaagtgttctaaggggagggttcagtgagtgggaaggctctggggactcccacgtttgtgtacatgcagaaaagcaagagaccagaatggctagcacagagtgaggcgggaagaggcacaggaggtgcgctcagggagggggaaggaccaattatacagggctttgcaggtcactgcaagaactttggccttcaatcttcagagaaatgagaagccatttgaggaatttgagcaaaggaatgacacaacttgatttataaattgtctgtcctgattgctgtgtggagaacaggctttaggctggcaaggactgaagtggagaaatcagtcaaccagatccacatgtcatatatgagaaaaaagagagacatcaaagatcactccaagatgcctggcctggaaggatgggattgctattgcttgagatgaggaagactggaaggagcatacttgggaaggtgggccaggggaatggaggtagagtcaggattgtggttttagatatgcctatttactattcaaatggagattctaggcagtcaggtcagttggatataggaatctgattctgcgagacagaggagcaggtcagcaatagagatatacacatgtacacataaagaaatataagtgagtgtgtgtgtgtcaattatctgcatatacttgatatttaaaaccatgaaacagtattgggagaagaaatgaggattaactgagctttgaggtgtagaaaggtttagcaaatcaggatgtcgaggaaacctcaaagagacagaaggaggtgacaacgaggaaggaagataatcaagagagtataatgtccgggaatctaaatgaacactgaataaaatgtaaagcctttcctgcatattcatttattcattcaaaaaatatcacctgacacttactatgtgtcagtccctgtggaaacaaacatggtccctgctcttatagggactgcaatccaagggggatatagataaacttgtaactggtattcctgaaagtgcagggtgttttgagagaatacactaggggcaactgaaagagtcttgcgggtcagggaaggctttcctgaggaagcagtattgaagaaaagaccagtatgatgagtaaaaatcagccatggagcagagggaggaggaacaggggacagtagagggaagggtagaagaaaggacctgacaggagttcaatctaggaagaacaaaaagaagtaacaagtgagacagaagcgcggaccaaattaccaaagtcctttcagacttcacagaggtctgaattttatttcaaaggaaatgggaagacagaaaattgtcttataggaggtaatgtaacgatcagctggagtacagtggcgcgattttggctacctgcaacctctgccttccgggttcaaggattctcatacctcagcctccaaacagttgggactacaggtgtgcgccaccacgcccagctaatttttgtatttttagtagggaccgggtttcaccatgttgctcaggctggtgtacaactcctgacctcaggtcatctgcccatcaggaggatcattctgattacagtagggacagagctgcggaaggggacaaggctaagttattgggaaactccgtagggaatctgtttctgtggttcatcagtgagatgcagctgacctgaactcaggtgggggtagtgggtattgggaatgtggactccacaagactttgcatatgaggaatgacgagacggaagagtgagaatgctgacctagtttttgacttggaccaataaatagatggtagtgctactcagcgaaagaaggtgcacaggaagagggagagtcagcggtagcggtgaaatctgatgagtttgcaatgcctggggaatatcccccaaaagtgttcggtaaataggcaactggctgaaaaggtctagagatcaaccataaagcctgagatagaggggtagatacggagtcaccagcacacaggagagtgcaaaataaaacccagggagtgagaaagagaatacaggaatggaaaggccttggctctggataaaaccaacaatggggcaagaagaggaagaaaaaccctacaaaagaggcagatagagagggagatagaaaggaggggaggagaagagagagcgcctgagaaggaactagggagtctgggatgaaagcaaaagcaaactgtccagcattccagaaggaagagtcaacacatggattcatacaaactcgtacccagaaaaatgtcttattgtattgtttacagtatttcaaaatcaaccaacaagtgtatttcatcagccataatacatttcagtcatagaataatcttagcctaggtcaagaagcaaaacaaaaataagttcatttgcattagtaaaaagtttaataataaagtgacaaaaattctattactggacaagagtatggactacagataaaaaatgaaataaatgttagaaatggaaaaaaaatcatgtggttaagaaagctgagggaaagttttctcttctttggcttaaaaaaaaagttaaaccttgaaagatgaagctatatggatatgaaaaggggtgataatatcatagaggattcaacagaagaatctatataaagtgattttgtgagcaaagttactcaaggattggtgtcagaagacttcacggactacacacacacacacacacacacacacacacaccccaaaaatcacttaagaggttcagagtgagtgatttcaagttttaaaaatacaccttgagatgtataaaagtatataaattcgtgtgagtaccatctggaccatccttactgtataatgccaagacatattctactgaactgtcctaatttcttatttgaagagggctgtttatttgttttgaggcttccaatatatcctgggggtggggaggcctaaatgtatatcatatatcaacacaataaaattgcaatgcttaagatgaacaagaaatctctgattgtttttcaacaaagcacaaggccttattcagagaaggtggagttggctaattagataaagcatgaaacagagactcctgttaattcattacattgatttcttctgtcctataaagttaggttttcttggctgattaacagcattactattaagacacacatgctcatctctttgttagttaaaaacacaataataaatgtagtatccaaacacattattgatttttaaaattttttaaagagtgatagtaccactgtggaatgtagtgcttctaataaaattgacgacaaaaattaaatgcaatgttcaaaaacctaaatatcagcccaaagtatttcattagcaactaactccctattactaaaaaatattcacaagatttaatgtgtatcagaagcatcaatcacagattaaaacacgtcacaactaaatacaggcaataattacacaagttctcttcactcccaaccctgaggttttaaaatgttttctgacaacatatatcccctttatttccacttccacatagaatctaggcaaaatacctattctttagaaagtcaaataatattgtagtttaataccaaacctaaatactgtatatatatttcacataagcaaaacacaggtgatattgtgttttcttcattgctaaacttaaaaacaagatagccatgctgccagcagtaaggtccaaatgaaaacaaatttcacagccgttaaaaaatacataactgtcattgttaataaaagccaagtgtgcaacaaactggaaatactgcttgctagccaaggacaagatgtgtctaaattcttggtttcaggacatctcttaaatgaccaaaaaaaaaaaaaaaaatcaaataacattagttcttgcaaacagaatgcaaatacaatgctaattaaagtattcacaagacaatgacaaataaggcttcaggaccacaatacatattattatgtaactgcaatacacattaagcaatcaccaggttgcaggtaggccttccaaaaggagttattatggtttaccgtgatcagaggattgtggtgttccacttaatcatgcttttgcctgcaagcaggtgtttacagatgtcaaaaagtaaaacactgattctaaatgtaaacctacagttctgcctaataaattgtacagtaatagcacactgtacctcacaacgttttctgcataaactttctaattcgacatgaagtaagctgcatgaagcaagtttctccgcttgctttatgaaccaaaatttaacttctgattcatttttattaaaatgccaaaactcacacacttagagccagcccttgtttcaaggactatgaagttaaaatttaacatccggtgcaaaagaaagtgagacagtgaatgagggttcatttgggtatgttattgtctaaagtaatcctcaacccttcaatgaaaacataggcatctcaaaagtaaaatttaaaggataacaatattcagtctatttaaagaacaaattacaggaaccgccaatgataaacatagtatattcataatagaagtaaattccgaatacttcaatctccaaacacgaggaaaaaaaaaaaaggtgagaggcaacagagtatatgcgtgtcataaatcaatgtattttctatgatttctgtcctgcctgctcaaaaattttcaggaagtctggagtaaaatctctgggcccttgggaagatgttagatgctagatgctaccctaaccagcaacgcaacccacctgacaccccagagcagctcacagaacttcagagtagtgaaagggagggtataaataagagaacagtaaaggcaggagatttttccgggagttggaattacgactctgtaaggtcgttttccaaggctgtgcttaaactattcacggaaaaacacttctttttctacctaaagcagagatctgcagcaacagcagccagactcccctcgtcagtaccaaagaaagactaagttccaggtgcaacaagcatactagctgccctctctgcaccttggagcagacacaaatgctgaaagccacccccaaccagctcaactccaaatatctcggaaggggactgaaggaaaacggatactgaggtgcccattctcaggcttgtagcatccacagccacagagacgggagaattcctggctctgagaaggggtgaccaagatgaggacattccaaactgcgggacatgttcttgcaaaagaaacacgggagtccctggaaacagacgtgggccaggcttctcctcgctactggttaagctggggcgctcccgccaacaggctcaaagccccgggaagcccctagtgaggccccgtggccggtaacccccaacttgcaggacgctcaagacacaggccaccgccctgccggccaggaacgctggctccgcgcttacctcgcaggccttgagcttgtcaccatctccctcagacagaccagtccgacgcgtggccatcatttcatttcaaatgacaaagaagggacaaatcctttggagtccacattggacgtggcggggaatgccaccacacacccgaaggggaagaattccacaagcaggctccgaggaggggcagggctgttgaaacagacaacgtgccagggaataaaggttttcaggaagcgccttcaaatgcctcgctgatttctcgtgacttcaactgacttcgccttcttcttccatttctggagacttaaaaacaaaggcgacaggtcttcttggcagccagtgtcgaggccaattgcagaaagcggtccccttcttcccagtgccactcctgagtcctggaaaaatccgaatgggtcgtgaaggttcgagtgtcagctcctagagagatcctaggaaaacgagaagttaaaggtcatgaactttctccaggcgcctatcactgtcttgcccacatgtccacaccaagttcgcgtttcctcccgagcaaaacaaacaaaaaaaaattttaacgtaaacaaacaaaaagcctataaattcgagggggtgtttaaaaaagagaaatctcgaaactgcccagcggttgcgtcaaacacacctggctgttatgcagccttcaagaaaaaatgttccccattcaagtgcattttaattcatgtctttcctgggtagagcagagggctgtgcatgttgttttctgcatcacccagacagggacacttcggtgaagttttctcccccacgaggctgaaatgggatcacactttccaagccccctcttcgctcccctccgccccccaaaaacgcaagcacaaagccagcctggctggggccggcgtgggctcggcggcgtctccgggtgactcgggcgccgcccctccgcccctccgccccggccggcgtccccgaggaggcggctgttttccttggcccgcggcggggctgggtggggacggccggggaggcgtgcgcggccgcgggtgggacgccggcgccgctcccgctccagggcatgattctggagctacacccgagcaactctgaagtcgcggcttttcccccaactaccactcgacacggcttcccttcccctgtggccacctagggggaaaaaacgagaaaaagcaaaccaccacccacctccccacgattcccccgccccttcctgaggcgggtcggggacctcgagctcccgaggagagcggccccaatatggactttctcaaaggtgctaggagccccggggcgagacaaaaccgggggccttacccttcccgcccgctcgggcccggcggccgaagcgcggcggcgagctgaagcggagacgctggccgggcgccgggcccggccgggacgcgctaggccgcaggctcggttaatattcatgagcggccccaggcgcccctcctccaaggctggccggccggaccccagcgcccaccgccggcctttgtgcccttccctccgccccgccgcccgcccttgctccgcacacgcgggcgcggcccctccgcccccgccgggcgcccgccgcgggctccctccggccccgagccagcgcccggccgggtggcctgtggcgggaagggagagagcccgcggcaagccgggcactccacggcccgcgagcgcagcgccctctcggctgagacggaaaagaaaccagacacgcaccagaggaagcgggacgagtggatccgcacggggctggccggctccgggacagcgcgccccgcccgcccgcccggcgtgagccggaccccgcagccggacgatcccgc

SEQ ID NO: 933 - DNA, 252724 bp, Homo sapiens
ggagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggtaagcggcgggcgcgggcccgggggttcgcgggggcgcggcaccggctcaggcggccgcggctgcggtgtttttgtttaggatccaggaggaaacgtgcaggaacttctctgcctcggctccggttgccgaagagaaaggggatcgcgcgtggtggggaggagaagggcgagagggggcgccaccggggaaggggcggctgccggggggcaggtcgggggcgcaggggtctagttcccagctttgtacctggaggcaggttcacccctcgcctctctcccctcccccaggctcatcccacttgtaagagtgggacattcttgtgctcacactagcaccagtagaggccactacacacctcattaaataaacaatcagacggccaattcattaattttcaggaaaggaaaggggagggggcttgagctcctggttccctggccagggatttcccagcttccgaagtctcgaggaagagctggctagtctcgagggactcctcgcgcggggattggagcccgagtctgcggaagagcgggggtgtcagaggggcacaattgcccgctcacaacccctggtgttgatttaacgatgaggacgccttggagagcggctcggagtgatcgtatctgttagtgtttccgttatgaaatgcctcttctttcctggggattacaactatatttacagcctattaaccactcttaaccaagggaattgtctaagcatcagattttaggtacttgtacaatgttttcagatggcattgtataaacattgaacctcaaaagccattttcagttcttttttggaatattatagattactgaaaccacctgcattcctattaaggggaccaacgaacaaaaatgccaagccttccgggaaggaccttacggtattgttgagcaggatacactcagcagttgaaaggcaaattagcatgtaatctgttaaaattatttgaccaaggtggtgtaccataaaacttgacaaaactttcactcgtgtgagatatgatatttttacatttgaaagcagtcttaccgctgaaccagtacttgtttttccctgatttatatgaaataatatttaaaatcacactgcaaggtaacttgactgataaacttttcatttccttgcagagtgtgtatgtagctcatggcttttgccaatgttaaagaacagctttaaacgtaaagtaccactcggtattctctaaacagctacgtaaacaatagtgttttaatgtcaaattaaacatcacttatgtcatgatgtacccttatacattcagtccgtatatggtttagaacacattttggtgctgaaatgcaggttactgatccaactgtctcttagatgagcaagagaaatataactattttggaaaacaagttcctgttactcatgatctattttatatggaaattcatatgtagttcaccaaatttcaagtttttgtttaaagttttgccgataattttgtaagtaactaaaatgctagtaattttattacttaggataataaaaataatgcaagcagtctcaggaagtggtcttaacatctgtttcaacattaactcaattgacaggtttttattttgcacagatgaggtgcaaggcatatgctctctgccttcatggagtttacagtctggtgtgtgggtaggaaagatagccatccatctactgattatataattaagtaattgtgataagcactacaaaggagaataggttttcacaaagtgggtactggagtgacataacctagtctgggtgttaagagtgtctcacaagaactgagatctgaggagtgggtaggagtggaggtggggaggctcacaggtaattagtcgtttaattgggtctagaacatagatctcctgattctcggtccagagtccttcctgtaaaccgctctgcttcattacaaaagcgagaggaataactgcaataaggaggggttggtcagttctgccataaaactgcggaagagatcaagagactggagaactgagtaagcagcaactggaacaagctgtccgcaaatcagatgtcctttgtcagtagttttattttttttatttttgtagagtgatagacttataaatctttttataggggattatagtgaatagattgtagggaagtggacatgttcagtagtagaaggtggagaaaaatagagatgtgggacaataggataaatggaaagtgtttttccatctgaggttatagacatacggaggtggaggaaaaagtaagaagtaaaggactggtgatagaaaatggtcagcaagggaggagggttggaattgagtaggaacataatctggtattctgaaaaagggcagattactgaaaagatatgtagagaccttggggaagatgacatggcagcagcctgtgcaatgcatgtcttctctatttagagtgaacattcttcaccgaggactctgtagcttctgcctgaaccatttatttcatgatgtgattcattgccttacagggtagtccatttctgtgttgaataacttctgttagaaaatgttgctttgtacagtacatttcactgtagttttcaccctccccacccttcttacattttttcctctttgcttacctttttcagcattactctatcttcaggttaatctcttctctgattaattcttcatttgtctttctggcttttcttgaactcactcacttaaatattagtatctaaagcttatctcattatacatactctgtttgccctcagttgccacctgtaagctaaggactctcttagtccacactttctcacttgccactcggtaccttcactaaataggatcttaggttactgaagtccgaagttaaactctgtgtcattttccctcgtgcttccttcatccccattctctaaacatgaacaaaccagttcctggcccctgtgtctcatgttgttggaaggattgcatggatttgtcttcttgtgttgcctgtcttggtcatcactgttcatccacttgcccaagctgagatcaagaagacctcctcttcccattgccatagcggatagttctttttgctttttacctctcagctgtttcttgactctgaatcggtatcttttcatcttcatccccacctggactaacagtagtggctccataattaatctctttgtctgtactgttaccctctagaagtctgtcctgctagaatgagcttcctgaaatattttcctgagcatgccactctcctacttaaaatctgttactagtgttctgtagcttgggtgttagaactctttggcatggagattgtgaggccctttgtattctttacctctgttctcccaaacccaataaagcctcatctcttgtcacccctaacatgcaccttgcattccaccactccagattaacgacacagcttcagatctccgtgcctttgcacatgctgttctttctgttaagtcacttctcaccttgtccacttctgaaactccttatctagtcaatgaatttttctctaccagctttctcttccaaagagagttatggtcactattctgtgttcccatagcttcctgagtacttttcatcttctgttacttattttcttgtcttttctgctagtctcaacctctgaaggggttggccgggttgtcttattcacctttgtttccctagtgtagcactaacatgtagcatagagaagataaccagtaaatgtttgttgactgaatgttgaattgcctttgtttttaacccgtagggccatacagcacaaatctgattcctttatatgatggcccttcatgtgtctaatcacatttcctgtgtgcatgtgtgtgtgggccccccctgcccttcccctcaaaccttatcctttttaagttaaccatccttaattccttcagccactcttcacattacttagtttccagatcttttgtgatcttggtcatcctcctggatatgctgtagttttagcgtttttttagttttgtcatctttggaaagatctttgatcttactgagtcatctaaaagaaaagactgatggcgttgctctgcctgtctgttagaatgaggcacaaaagagatcatagaattctgggatgaatgctcaaagaagataagaaatatgactgattttcataaactgtatgaaaattaatacatgatgtgagatagtgaaaagacatacatgaaggcagaggatatggggtatgacttgtggttctgcaacttcacatacatctgtaagttgggggatataggcaggcaagaataataccttacctacctaactggattgtcagaaaaataaaatgtaaaattgttcataaactataaagtactgtacctatgtagaatggcttcagtgtttctttgtgaactctaaaaatatactatattaaattatttgaaagtgtagacttttttttcttttggcttaattgatcattgctggtttcttccttatgagtttttctctacctcaatgaaaatattggggtaaccttaataaatctcattatatggaggctgtatttaatagtcttttttccaaacactttattttattagtgacttccatgtgattgggagctatttaccatatcattggtaagtgtttaggtttctgggtaaaattgcatcaataattggagaacagtcagaggaaatgactgtaggtaagatcatattgaccggagagctaagtgaagtgaggagaagttttgtgtttacgattttgaaaaattaactttgtcatggacatagctagtgaaagatgattttaaaatagagctcaaattttggattcatttagaatgaagagagtttttttgattcaaaaattttgtaaatagtgacaaaaaaaggcattcagacccactggtatgattttggtatatttctttctacttactgcctatatggcacattatctttttacattgtaatcatggtgtatgtataacttgaaatgttttcctttgacattataccatttttctttgttgtcacattatctttaaatcattttattttaaaaacttatttaaaaatacataaatatatgtttgtttgcagtcaaacaatataaaaatacatagaataaaagattttatcacttctacccacaaattccatttttgaaacccataagtaaccccttttaatatcttcccttgcatgtgcatatgtgtgtatggttttatttttttacagataagcaggatcatactacctattgttttttcaacttgctttttcacttagtatgttggagatcgttccatgccagtacatacagattttcctataaccattatttaaaatgtgtgtgtaatattccagggagcaaatataataatagtggctaattaaagtagtagttacagaacactccctgacttccaggcattgtgccatgctctttcacatgtatttaatcttttatacagtcctgtgaggaagatgacaatttcttcacattccacagatgaggaaactgagtctcagatattaagtgccttgccgaaggtctcacaacctttcatgtgcaagagttggcattggaatccaggtttttgcaacttcaaagcctatgttctttattcctctgcattctgctgctaattgtgtattctcctgttatggatatggaagttgtttttactgttttgctgtgataaagaatgctgtgatgaacatattctttctatattttggattcccccatataggattgctggtgaaaagttaacttgtgtgtgtatgtgggggtcagggttccatttattgcagaaaagtaatgatgtcattaagaataattccattgactaatactttcataactttttgaaggttttaccacttttaattgtgaactttgggtacttaaggccatgttttaaaatgcaagttcatctgttaactgaaaggttaagctaattaataagtaatttcaaaggtcccttctgccttccaggtttctcttactctgaagtccataaaatggaacagtgggtttatttcagcttaataacttctattcagttattgtgttccaacactggtcatttctggttttcagatgcaaaagtcacctttttttcattcgctaaagctcaggttattgtatatcttttttttgtagtgcaaagtaggatatgattggaaaatcgtctatgttacttgcaaatgattgtatatgattttattttatatgtgtaaaaatagctttagggctgagttatatggcttcagtgttaagtaattgtgaggtattttaagatacagtattaccagaaatattagatgcttactcttaggcttggaagggatgtagagtaaattgaccaggttacagagctggcttatgtaaacaggttttgattccctgtctgacccctttacataaagaaaaggcagagaggtatggtggttatatatgttttattttactgaatgaagtcagttcttcagttctgaggagttagcaggttggtggtctgaagtgcagattacgtgtctctgcttttccttttttaaagaaccattagaaataaccttctttaaaattatttcatagcgagaatccttacatttaactttttattaagtcagttctataggcaaagctaggagttgcagtaattttggctggttgcaaacgtttatctttgagggctaattatgcacaaaactacactgtggaaataaagatgaattggacgtgctttctgtcctcaggaagcatttggtctaatggtggaggtaagggagatattaggtaacttgatttggcgagagaaagtgccattactgctgtaggtagaaaaatacattctggaatcattgtgttactgttgatcaaggaatagtgctgctttccctcataattttggttctgtatctttagagtagtcctaacttagttttataaagccagtagactagaattctcaagaaggagttatatatcatttcctctgattactgcagtgtttgaatgtatgagaatgctcataattgagctgtctgggggtacagctactcccatgttttttggaaatctggagattgatcatactgattttcagaattgattattggtcattaatagtacaacttactaagaagtcctgagcagagtgaatttttgtaatgatactatgtggaaattgaaaacagaatgtttctgtttttctgctgtagtggtaaaaaaaaaaatcaccaaaatatgtctttatttatgaggtctagttaagataatagcattataatttacaaatttagggatagaataacaaattataagtttcattcataattttttaattcacagcatagctttaaatgtaacaagtaaaatttgaaaatctttttggttaattgttgaaagtttttgaagttggaggtaggataactagttttgtttgtttgtttgtttgtttgttttttctgagactgagtctcactctgttgcccaggctggagtgtactggtgcgatcttggctcactgcaacctctgcctcccagattcaagccattctgctgcctcagcctcccaagtagctgggactacaggcgtgcaccaccacaccctgctaattttttttgtacttttagtagaaacagggtttcaccattaatggccaggctggtttcaaactcctgacctcaaatgatctgcccgcctcggcctcccaaagtgttgggattacagacgtgagccaccgctgcacccaggcaactagttgttttaaatttatagagtgttgtatattcaagggattgtgtgcagaaattcttgtggtgataacccttttatttatttatttattttgagatgggctctcactctatcacccaggctggagtgcagtggcatgatcacagcttactgcagcctcaaccttccaggctcaggtgatccccagcctcagcctcccaagtagctggggctacagtcatgcctcaccatgcccagctaatttttttgggtatttttgtacagacagggtttcaccatattgccaaggctggtctcaaactcctagactcaagcaatctacccgcctcagcctcccaaagtgctgggattacaaatgtgacactgcactggcctaacctgtttattaatcgtacctcacctacataggactcaaccattatgcaacctacctccggaatataactgaagactagggaataagagaaataattttcaaagtaaatgcatttctccgagtcccaaaggactttgttcagagcctatctttaattcataggcagttctaacaaacagtataatctaatttctgagcccatagctgatcagaagtgggtagaaagactatcttgggaaatgccccctgcagcagaaggtagtgacagttgcaaggaaagatacttaaaataagcgtaagaacacagagatatcttcccataaacggaagttactgtctcagccaagttgaggaaaatttctttccctttccattactgctaatggatattgcctacccctggcctttccttttatcccctcctactgtagatacagttgctgtctgggagatagatcttccctcagaaatctcttgagtcttaatctctcctcaaattagtaagggttcaggttgatgcctgaggtaggaagaaaggaagtgtgaccaggaggggaggtgaggtggcagggtatggttcctacccctctggccatgacatttatctttattaacagcgttactaaacctgattgctaaaatatgtatgtggatttttaatttgggggtaaagttaattgttgaatttttattgttaaaaatgtaacagttcatactatgtaaaataaaatgtgaaatcatacactccaacccttcttcccagagtaatcacttttaatagctatggtctattttatatatacaattatatacttaaaatatctggtacatatataacaacaataacaagttggattttgctgtgcacactgacttttaacttgttttaggacatctttccatgtgagtgtgtataaatttatgagttgtgttgatagccatatgaaattgtattttctggatatatcataatttatttaaccaatttctttttgatgctcccaaatttttgattgcaaacaaatgatgcagtgaacccacgtttataaatgtccccatttgtgcacatgtgcaagtaaaccatagaataagtttgtgggtgtggaattgtagggcaagagggcatgtgtagtcacattatttccaaattgtttactaaacagctgatttacactcctttgagcagcaaatgagagtgtctgtttccacacttccttgccaacatattggttattttcagacttcctagtctttttgccaatttgatagaagaaaaaaaacctctgtaaatttcatattttaaaattattaatggagttgagcatcttttcagatttttattgatggtttatattgtttctgagaattgcctattcatgtgttttattcatatatctatatcttttattgaatcattgattcatttataaatatagataatacgtaattaagaataggaataatttaaaactttataatttgtcaaaacttccatagctgcttgtggttcttaacttagtgataagcaaactgagtaattgggttagttacctgactcctgctaaccactgctcatgctaacctgatgtggattcataagctttaaaactgttctgttttgaggaaagaaagttaaatattttattcattgatttgagtaacaaataggaattgaaacatgctattacctcttttaagacagaaagaacaattttggtttgaagtgattaagttcatttagtcaaatacttgagccagtttggcccaaggtactgtggtgatttaaagtggaaagtggattaaaaatgtggcagaagaaacaagtttgggaacaatggatattggttccattttggacaccttgagtctgaaatgtcagcagaacatccctgtaaaagggttgcagaattagggctcagttgaaaagtctaggctagaaacgtaggctcacaggttatctgatagagatgatagttcaagtcataagtgtagttcatgacacttaggaaggaaaaagaaagcctggggcaaagacttaggcatacatctatatagatgggtttccaaagggaggaagcgttcctctgtttactgaagaagataccactattcaagataccactagacctagaataagaattatataaaatgataaagttcatttcgcctatggaggcttattgagaaacacctgtgtgaataaatgagctagtgctaaagtaatgtcacttctttccctaacccctgcaggcatgtcatggccctgggttagaacagtaggcagggagagcaaaggcatacagagccaattttgaacaattctttaagtgacatatatcataaccacccactctactgggctgaaatgaacaaagaatgacttaatatgtgtccctgcttagaacaaagcctggcttattcatggaatgtaaactgttattattgtcgtttttattattgtatactagatggagaggctagctaaaaatacatgaaaattagataacatgatttggtttttgtttttatttgatggctgtgtgtaaatagattgttaaatgagtgagcttatgttgaagaggataaggatttgtttagtttgggatattcagctaagtttcttaagacttgagctgattttgaagccgtaagtagggtttttagatgcgcagccttttttgtttgtttgtttgtttgtttgtttgttttttggccaggagggtaaaatacagagcattatgaggcaaagtaaaggcaaaagcaacagaaatgttccgtaagctgtttcttgtaaggttcatttttattctggaattaataatttgtcatatagcagaggggtgatgatgatgatgaaatcatagccagataatctgtcatggtaggaaggagggtggagatagtgcatgttccaatttaatgaaaattaactttattattacgtatttgctttttaagacttcatttatttcctgttagatgttgtgggcatcttttatgaatcagcgatttctctggagtttgttcaaagcccgagaagtaagcttcaggattgtgtgtattaggaagttctaaggagttagcgtttgccactttctgaagaatactttaaaaaaattctgtaagctttgtggaagagcgaatttatttcttcttcagagtagttacagttaagtagaggcatttctgtttcagagtcagccttgttagtaattgaaattttggggtaagaaatgtagacaacattgtgatacttggcagttccactttgttcacacttaaactctgggattgcagtgtgatgagatgctcatactaaggcattctggagctgagctcagctggtagaagttcatatctcatgttttgtgctcatatgaatggcaggtagaatggcttgttctatttaaattagttcatattctctctctctttgtctctctcattctcatagttgaattgttttaacttaaatgtgtgtatgatatgacttctctgtactttatgtacttttattaaaaattaattaatttagagacatagtctcactctgttgcctaggctggagtgcagtggtgtggtctgagctcactgtaatctctgcctcttgggctcaagtgatcctcctgcctcagcctcccaagtagctgggactacaggtgcacaccaccatgcccagctagtttcttaattttttttttagaaacaagatcttactatattgtccaggcttgttttgaactcctgggctcaagtaattctcctgccttggccccccaaagtgctgggattacagatgtgagccactacacttggccctgtagtcatatatttatgttatgtttgtagcacgtggttaggttttgttttcttttgcctgacagtttttgtcttcttactaaatcatgtctatttaatgtaatagttcatatatttggctttaaacctcccattttattatttacttctgcttgcactgcttattctgtattcccctttctctcttttcctgccttccttggattattttaagttactctgtatttccctctcttttagcttgccagttataatttctttcactattcatttagtgtttcctaaatgcatctttaacttgttatttgtatgatttcatggacagtgcaaggcctctataacacctgaattccatttgtccttctcttttgttttaatgttattatgttattgttgtgtattttagttctctgtatgtttaagatccatcagatgttatttcatactcactattcatttagttttagttatttaaattcattaatttattcatttagatttacccacgtatttcgtttgtgagttgctcttcattttttttttttctgcatctctgatctttcatctgggatcatttctttctgcctggagaatataatttagcatttagttaggtttgttggagatgaattttctcagcttttgtctgtctgaaaacatttgtatttcaccttcatttttagatttttgtggagagggtgctggatgtagaattctaggtaaacagtgtgttttttcaacactttacatatgttgttccatgtccactgaactctatcttttctagtaagaagtcaactgtcttatttttcttcttttgtgagtaatgtgcttacctcccgtctttggccacttttaagatttgttctttagttatggttgtcagaaatgtcactatgatgtgcctagttatggttttctttgtatttatcccgcttattgagcttgttgtatgtgtgggctgatcactttcatcacttttggagagttcttggcttggctgttaatcccttcaaatatttttttctgaattaaattccattagaatttagttcacttaggctcccttacatccttatctctctgatgggttcagaaaaactatagatttgtagcttgtctgccctgttttggttgttaggaaaacagtaatagtcctgataactttacattctgattagaggcagcactctctatattgaattcttaatttcattttattgaccttttcagttctgtaatttctttttatttctttctttcttttcttttttttttttttgagacggagtcttgctctgtcacccaggctggagtgcagtggcatgatcttggctcactgcaggttcatgccattctcctgtctcagcatcccaagtagctgggactacaggcgcctgccaccatgcccggctaattttcttattttttgtacgtttagtagtgacggggtttcatcgtgttagccaggatggtctcctgacctcgtgatccacccacctcggcctcccaaagtgctgggattacaggcttgagccaccgcacctggcctcttttttttttttttttttttttaaatagtttgcaggtctctgctgaagttctccatcttgtgtttttattcctttaacccactccagcatgtgtgttcccgtaggagttttgcttttatgtctgttttatcacctgatttgggagggtttcttttcatgttcttagttgtgattgaatgacaggtgttgtgtatgaaaaattatcgagataatctggatgatactgtcttctcaggatttacctttacttctggtaggtggttatgctggaggtactaacagtctcctaccacattacatagggattgaggtgatttaaaattaggctttagactctatgagttgaaatagtttaggtatacctttagttcttagatgtagccctttgaggctctgatccacagtttaaggggtttaccctccctcttggcaggccctcactccagtttttgtccccttagggcttgggtctgtcgaaagctatgctcatctcagcctcttcagcagtagcctttagaatctgccgatagctctaggccaaaaggagccccacataccagatttgtccctttggcttttctttctttttgcatcttggttcctcaattcctcattgccttgattgcctttacacagatattttgtgttttgtctagtttctttagttattctcagcgggagaattggtctaaaccatctactctatcattcctgaaagctgaattctctcaatgcctctttcatcatttctgttatttgtggaagtttgtctggtttttcatcacatgtagtctgctgtttggtgtcccatttgtatttctttggaaaattattgagtagccaaaagcaatcctcctgatttcagattgttctgttttcatatacacagtattcttttaagtttctttaggatttctgtaattgggatttctgcagttgggaattctaatgatattctaaaatttgtttctctctctctgtaaattttccggggaaatttttgctccagttgatagaacaatcattcttttagcttctaggtcttttcaaatgtctgtttgtggtgaccatgatgatatgatggtgtctatatatattcagtattgctggttgacatggatgcttttctttctttttttttttttttgagacagagtctcgctgtgttgcccaggctggagtgcagtggcaatatcttggctcactgcaaactctgcctcccgggttcacgcctttctcctgcctcagcctcctgagtagctgggactgcaggcgcctgccaccacgcccagctaattttttttttttttttttgagacagagtctcgctctgtcccccaggctggagtgcagtggtgccatctcagctcactgcaagctccgcctcccaggttcacgccattctcctgcctcagcctcccaagtagctgggactacaggcgcccgccaccatgcccggctaattttttgtatttttagtagagacggggtttcactgtgttagctaggatggtctcgatctcctgacctcgtgatccacctgtttcggcctcccaaagtgctgggattacaggtgtgagccaccacactgggccctgaaatggatgattttcaagcttgtgtgggttcctgttctaatatttcaggtatagatgaaagaagagaaagttttagatttgcaaccatttaacagtttgattgacattcctagattattggtttaacagaatgatctacattcctatatcattagtttggtggtttgcagggagtaggggcaagatatagccagatagctatgagacagggaggtttactgctaacgcattgtttgcaatgctgagattcatcagttgtggagctagctgtggcagcctcctgtatttttgtttttgtccccctacccccccccctttttttttgagacagtgtctcactgcacccaggctggagtgcattggtgggttctcggctcactgcaacctctgcctcttgggttcaagtgattctagtgcccaatagctgggattacaggtgtgcacaaccacacctggctaatttttgtatttttagtagagatggggttttgccatgttggccaggttggtcttcaactcctgacctcaagtcatccacgtgccttggcctcgcaaagtactgggattataggtgtgagccactgcacctggtgtgtttctgtccctcatctctaatcctcaacatgagtgctgaaccagatgctttgccagccttttttcttggaggtatcatgggtccgtccacatatgcttgtcgctattctgtgatttccagtggaggtacagattttcccccttggtgtttttatttattaattttttaaaaatttgttcagttattttagtggatattaagataaggtgttggtgggcattggttaaatgcatgagcttagttttgccatcttggactgagaatctacactgggtattttgttgttgttctcatttggtttagtttgatgtctgatccaattaaaaagaatagtgtttttttttaacttttatgtacatttagattgaaattctgcaatcactgaaggactgtgctaggctagttagctcctgactgatgtaaaacctttgatagagtggggctttttttttttttttggagacagggtctcactctcacctaggctggagtgcaatggggtaatcacaggttactgcagcctcgacctcttgggttcaaatgatcctccccccttcagcctcccaagtagctgggactacagtcatgcgtcaccatgggctaatttttgtattttttttttttttttttgtagagacagggttttgctatgttgcccagctggtcttaaactcctgggcttaagcgatcctcccttcttggcctcccaaagtgctgggattataggcatgagccactgcgcacagccgagtaggggcattttttattcaacagacattttcatgattgccagctgcgttttggggcagtgccagattttgggagcacagatgtcagcacgttctttgatcttatatacctgttattgaggcagagatacctttctctgaggccaagagactttttttttttaaagagagagaaacagtgtttgatcaaagtttttgttttttaacccattagttagattgttgaatatcaattaatatataaacattgataatagtttttatatctatagaaaatattccagttaaaatcttatctataatttcagttgaattactcatttttatagtaaatttctgtttattctctgactagatgattatatcaattaagggtttatggtttatatatttttatatatatacacatacgtatatatatacgcacacacgcacatataatagatataatttacccatgttacacatatttagaaagtaggatagtatggattttatggcatttttattttttaatttgttaaataaggaattcagagtttagtaaggtaggtaggacatgagacagaaaagtagaggcattatatattcatttttacttaaaggaagaagagttagcagtctgcttccaccttaaagctagagtttgctagttgggaaataatgctttggaagtggtttgacagattgagtatagtataaggaattgggaaaaagcaggcaactgtggccaaaaagtagattggaaaggaaaatggctagcttcaatatgttggcatggggaaaacaaggttatatctgttagaggcataaaatactctgtacagagagttggttgtcttcattttatatccaacaagaatagtacaatttagggaaagttattaaattgaacctttcagactaatgctttgccatgatgtaggttaatttccctatatgtcgttcatccttgctcaaatatgtattttatttgtaatattataaagttgatataaaaaatacacttgatgccagattttcagtttttaatacagtggctttcacacttgttcaggtgttagaacatctggaagtagtggtatactttgagagatatcatgaactatattttaattacatgaaacaaatgaagtgtaattttactagctgtagatataactcatgtgagtgtaactcaactcggtagaaatatttaaggagcatttgttatgtatcataaatgcataatttcatgatgaaagtgaatcatggaagagctagaagaaaatagaaaagaggtttttaaaaagccttatcaatagtgtatacagtagtccccccttatccatgggagatacattccaagatcctagtatacgccttgaaaccatggatagtatcaaatctatataccagtttttttccctgtacatacatatggcaaagtttaatttataaattaggtacagtaagatattaataataactagaacagttatgacatattgtcataaaagttaagtgaatgttctgtctctctgtctcacagattatctaaatattttcatatcatggttgactatgggtaactgaaactgtagaaagtgaaaccgtggaaagcaaaactgtggataaggagggactgctgtaatatcttttaagattatatcttcagtaggggctggttgccttagccattggcagcatgctgaagtgattctttttaaaaatatttttagagtcaggatctcactctgtaacccaggctggagtgcagtggcatgatcatagctaacggtagccttcaactcctgggctcaagcctcctgagtagcttggactacaggtgggtgctaccacacctggctaattttaaaaatttgtatagagacagagtcttgctatgttgcccaggctggtctggaactcctggcctcaagagatcttcctgccttggcctcccaaagtgcaggcatgaaccatcgtgcctggccctaagcgattctttatgtgtagttactactttcagggcatcattacacatctactgagagaaaatttgtggttctggggcctggaaatctgaattttgagaagcatctgatggattttgtattcataaagtttgagaaacattttctaagtgctgattgaaaagaacaggatattgcttcagaatttaaaagaaacagtgtttgagaatgaactcctcctccagggaaaaatgtaatttatgtatgatggggtagttgctatttattcacttagatgttttttgtttgtttgtttgtttgtttttttgagacagagtctcactccatcacccaggctggagtgcagtgctgccatcacagcttactgcagccttgaccttgtgggctgagttgattgtcccatctcagcctctcaatggctgggactaccatgcttggctaattttttgtatttatttgtagagacagggttttgccatgttgcccaggctgggctcaaacttctaggctcaaatgatcggcccaccgtggcttcccagattgctgggattacaggtgtaagccaccacacctggcccacttttgttttaagaaatgtctttataactgaatattgaaaacaattgccgttctctgaaagtcttttagttgtttttccatagaaatgatcatactatatctgatggcttttaatttaattttgtttgtttgtttgtttgtttgttttttgagatggagtttcactcttgtcacccaggctgaagtgcaatgggccgatcttggcccactgcaacctccgcctcccaggttcaagcgattctcctgcctcagcctcctgagtagttgggattacaggcatgtgccactacactcagctaatttttgtatttttagtagagacagggtttcaccattttgaacaggctggtcttgaactcctgacctcaggtgatctgcctgcctcggcttcccaaagtgctgggattacaggtgtgagccaccgtgcccagccagcttttaattttttttttttaactgtgaaatgtcattagaatttggattgtatttcattaatgtaatatctggaagattcaaagttataatttttaaaagttttaattttgctttattaactgactcaactgttggacggaagcaggaacataaatgaaaaggtcatctgaaagtctcatgtatacaagctttttctaactctccaaaacaaggtgaatttcagacaaattcagtaaacctttattgagtacatgttgcatgctctatgttgggaccatgaggatgattaaaacttacatcctgtcctggtaaagttcacacttgtgggaatgagatagggtaggaatacatgtaaacaagcgatttgtgctttgcctaaatttaatgaatttaaaaggttattaaataaagtgaccatcataatacatgaagaaaaagtgtgtgtgtgcttgcgtgcatggaggtggggttgtggtggtgatggtcatgtttcatacttaggcccgttgtagtagcctaggtagtttacagaggtaaattggattagcatgatggcagtgtagagaagtacatggaatagaaagatatttagatgataaagtagaatttggtgatggattggatatggtggtgagggagagggacatgtcaaagatgattcctaaggttctttaggatttgcatagcaggatgatgggtgctgatgtcttttacggagaaagaactaagtttgggggacaagaagaacatgcgtttaattttggacattatgaatttgatacacctttgtgatatccaggggcagcattacagtctggagtgtgatggaagacatgggctgtagatttgtgagtcatatgcttagaatgtggttgaattgagaaagatgggttattataagacagagaagtgagcggagaagtaggaggaaaactaggagaaggttgtatcacaggaaccaaggaggagagtatctgattctgctggcagaattaagtatgctgatgattggagagtcttttgcatttacctgtcagtcactgttgaccttactgacagctggagatggaatttggaagcaggttgagggacaagtgggaagggaggaaatgaagactgaaaagttccagaaatttagccatgatggggatgactgaatgtagtggttgaggtctcatgagttgggtgtgtgtgtgtgtctgtttaatggatgagattctggagcgtatttaaaaatggaaggctctatttgagagggatagtttaagtatgcaaggaaaatgggataactgacagtgtaagtttcctgggaaggttgggagaacacggggttttgagcacaagtagaaagatttgcattcgacccattgtaggagagagaactctcctttaacgagagggaaggaacataagaacaggtgaatattattgttaatgaggcagtgaggccttttgctgtacgtgataagcaggaaatggttttcaggagtgttgaggaattggttgaccagagaggtaggattactattaccagaactaatatgagaatgtaccatactaggagatttaacaggattgtaaattatatgggaatagtattgttttcagtgccttttccccctcatctgccaggcctcagtgagcccattggagattgtagattcccagtaagtatttaccctactctagaatcttaaatgaaaaatgcataaacagtagctactcttgtctgacttgaattttgtggactaatgatagaattaataagtgaaggaggtctcttactataacagtgtttaattcaccatttcaacaaatctctccctgcagcctactaagctttttctttaattaagtacctgatttacacagcagattttactcatttgaggactcaagtcatgtctaaacagataaaggtatcagctcaggcatagttcaggtaccttgtaaatgcaatcagagttgttctgcagggtaattcagttttagacatccatttctaaaaacgggttctgtctgaaaatggaggccttaataaccaatttctcgttattcagaggccagttatctagtttatttatcaagattaggcagtcaccttgtttttcactcctttctaatctctctgactgttttgttgttttaaactcatgagtaagataaggagaagaaaaacagagaatgtacataaattaatggctaaaatgaagtgttcctttgcatgtttctttttcttatgctttatttctgtgactcatacggagctgttagaagtgacttcatataatattatacagtgtaataaaatgggttttcgatgtgtgaggataccctcatgttatttagattatggacacaattaacaattccagacagaattattttctcatgtttgaagtagtataggcacatggccctttatgggaggggggaagctcttctctgtgtgcccacttttcacatccctctccagcatgactctcccctttctgtcagtcttaccccaggagtccctggcctccttcctctccttgacactgtttgctttgcaagcatatgaaatactggcaccctatgaccagggtagactacaaccagggttggggtgcaggagccagatggagaaattcaaattatgatcatgagaacatgttcctctaggtagtggccatacttttatctctatatccttaggacgtaacacagtgcctggcatataatgtgtctccagaaatattttgtttttgaattaaagactatttcaaaattacagagtcataggaggaatcatttaatttatttttctgcttttataggtgaaaaaagtgaggcttagattcatagcacctatttaagttcctctgacatgaccagttatgctttagaccatacaaagaagtaagtgaatatgatatacaattccagccttctagaagtccaaagttaaatagaacgtccagcagccttttatctagcagggatttttgtgggggcgggaaagggacagagggaaggatgtgatggtggtgctttgttttggttgtggtgcctgtgttgcttgatactgtgttatggcaggtacagagttgcataatatagcttttgcccttaaggaacttgtctaatgtaacctgagacaacatattaagaatcagtgtgtctcaaagcagtatatgattaaatgccagatgagtggtgcacttttatgtatgccaactttataaaatgaaaaaatgctaatgatccatcacgaggcagacatgcactttcagttgctattctgaaagtggaaacagattggacttgggggaactctgcatctagaagtacaagttgatgattattgtccatttgatagagacactggaagggtgtcagtgtaaacactggccatgtgaagattgagcctgttgatggtttcttttgtatcataggatgccacgtcaccaactagggaattctgcccaatcagttgagccaaatagtgctgtcctattgtaaaattgtttaatctgtgtgcttgtgtgtgtgcttgtcagaatttgtgaatcatagaattgttttaactggaagaagacccccaagatcatctgcttcaaccccttccttcctctcttttccagagaggttgcactttacttgagctgtgactaggattatgccacattcttttgtaagttgtaacctatttttgtctgttttgaatttcctttttttgctaagctttagcacaaagttcaccaggttttgaatgaatgtctcatatttgcaataatttagggaacagttgagcatggaaggagagaatagaaatatggggagggagatcgtgaaatgatgtttccagtggaattaatagaagtacaaaggaccaagaattaaggtgcggctcagatctcccttttgtctgcttttggtttgtgatggtataacattgcctgcaaacagccacgatgaatattttcatttttattaatagcaatatgggggcatgaatagattctgtgatatttttagatacgcagagactgtgaagaaaatgacatttagtatataatttttaccctgctcttaaggtgtttgtaatctagttgagaggtcctaccttcaaaaggtttacgatctgattggagactgaaggacctaaagaagttaagtaacaatgtcatatctctgtcctttctgctaaatgaatgctacttactatttttccagtgcctagaagagtgccaggcccatagttgattttcagtaagtattggttgtatagataaatagaaggtactgacagtaagcatgagaggacctctgagtggtgtggcatttggagaaggcctgggatcttgtacagtgcaaagcttaagtaacttcattctaagtttgtatttccaactcccccaacctcagcatgttctccccacccacctcctcacaccccaaagcagtccctgtcttttgttaactgatttttttctttggaagcaagcctgatctttctcacatttattttgctactgctcaggctaccttcttttcttatctctacctttcctctttctcacaacattgctgttcctcttcaaggatttagaaggatcatgttttggtttataagacaactgtgttttcttaggtccttcttctctccagggattattgtaggaggtaaggcactttctgtggaagaactgagttatcagaaaaagttcagaaacatattctatgattatttagaggaaaactgtaggatagtgatatcttataataacatagcaatttttttaaattaattaatttatttattttgagacagagtctctctctctggcacaggctggagtgtagtgacatgatctcagctccccagaacctctgcctctcaggttctagtgattctcctgcctcagcctcccgagtagctgggattacaggtgcccgccaccacgcctggctaatttttgtatttctagtagagatggggttttgccatgttggccaggctggtcttgaactcctgacctcaggtgatccactcacctcggcctcccaaagtgctgggataacaggcatgagccaccgttttcaggttgtcataactacattctaattgactgcatatttttaaacacaaattaaactagttatgttctccaccctactcagttttggcagtataaaggcctgtttcacagagaagaacacataaacaagtaagtacaaggaagcttgtgtgaatgaagttctgctgtacagctcagtgactttctctgatttaagatgtagctcttggcaatttcaaatagtttgtgttctctgaaggagaagtccagtctatttaactgtgtttagcaaaaactaattatgattctctgatgggaaatagattctcagactcatttattcattcaacaagcatttattgagcagctatgtatgaggcactgtgctaggtaacgggagaaataagttaccagtctaacaaatggcatatcatacgtaaaaataatactgctgaggagaaggtgatatatgctgtaaaaggggtgcagagtgctttgggttttctaaaaatgagaaggttacttccatgaagcaactcagtgtaagctttatgggatgatagaatttgatagatcttgaaggctgggtacatggttcctctgtccattgcgcaggatgttggccctggcttagcagtggagacagacctatggcgatgggaagcgggagaggaagtataatgagcaaacatccagaagtgggaaagcattggtgatatgggcaacagaaagtaatttacttggaggtttagggtggtgatgtgaagtggcacaagaaagggatagaaaagaagcgtccttgatctgacagtggtgtatactgtgaattggaagagtgggttcagtctaggctgtttacccaagttggtgtttcatggaccattgttcttctaatctagtagtttaatagttttatattaggggaggggaaagtgttccctgttcaagtaagctagagaatccctgcaggagaagcagggagaaggatattgacaatgtagaatgctttctgtgatatactgtattcagttgtgttgccgtattaaacacagtggatgtttgaatgttctgtagatttttatcacctgaaatttgttggttttcatgctgatgtcttcaaggatgattcaggaggagcagtataggtggctggtctagtttcatttcccagccccagtccacaaagggctctgtttatctaaaacaatggcagtgtttcctaccgtcctgctaaataagaggtctaacacacagtaaagtgttcttaaaagattttagggacactgaggtgtagggtgtggcacgggcaaccgttggttgcacagatacagtagatgctctatgtttctattgagttaagatacagttagctgtattttccttgtatctttctgcagatctcttccttcatgcctcctctagaaacactagcagcgctgggtgtttctaaggtcttggggaccttaggcaagctggttaacctctctgtgctttagttttctcatgtgtaaagcactgtgtgctggagatttttaaaaagtgtgttgatatagtaagtcatttaatctgtggttatatacctagtaaatgacaagcaggaatttgaactcaggccaggctcttaaccagcttgctgcattacgaaatactaaacagtgtggttttccctcctggaattccctttctttctaagtgcattatctcttataccctttgtttagtcagactacttcctctatttcaaagagaaaggaaagaagctcttttttaattgttcagagttgtgtatggcaaagagaatgcccaaatagattttgttttggaatcttattgttactggttgtttactgccccacatccttagctccaaagagcagagaggatttactgtgaagtttggcatgtattgtaggctattatgccatgtaataggcccaaaattgtggccctaggaatacaaattatgttaagacatttaaggcaatttctagaaatctttttcccttgaaaagagtaccaataatttttctcgctaatggccaaaattactcaaatcttacttttggacttttaaaatatatttttactgcgttatagttgaaatgtaggtatggttgaaacgtaaatctagatcttaagtgtactattcaatcaattttgctgttggtactattcaatcaaataggccagtgggttttctttgtatttaatcaattagtatgggaaaatatttttattttaaataaatgtctctctttattttttgtgtatttctaaattcatatgtattttcaactcattttttcactcggatacatagtttaacaacagcctattggaagtactcttttatatgagtttctgctatacttgaatagtttcccttcagaaatgaactgtttgtgttggagctacatagagtgaataaatttcctgggcggaaacgataataaaatattcaggaagttattaggaaatgagaacttgtgttcttgttcagtcagataagcttctgagacctttgcatatatcaaagcagattgtattagaggaaggaatgagagatttggcaactttcttctaatagtgatagggaccttggtcaatagaatgatggaatatatgatgtataaatgaaagaaaaattctcaaagcaaagttgtttgagaattgttttttctctctctttttgtttgtcagggaagaaaagtgagagctttctgaagttaggttatgtaaataacccagtagggaaaactgttcctgggggagacctacaaataattgatggcaataagcttcaggagtatgaaagaagtggatgagtatgcctttcccccattgattccactcacattttttcttctctgtgctttgctctcttgttgccattagacagtttctatctgtccttaattttagccagtttgttctaaagtaactgtgaacactgtaactctctagccagtgcctttcttttattgaatggaattggtgtactagttgttttatttaacaaacagagtttataggcttgttttttcctcaacatgtcttcatggcagagacaatttacccttaagttggtgagccctggatcccctcacttgcatagacctcttctaggatctgggagaggctctagcagtgtagtgtgtttgttagttacatatttttgtaacatttgcaaaattgaaaaatttttttccatttttttttttcttcaaaaaggccctcaaattatatatgcttcaaatttcacaaaactcaggtcagccttggttcatggtagaggttgggtgttgatttctaattgtggccgaggtagatttggttagtggattaaaggacatgaggaaggaagcattagtgaggaagttgaaccattgactggtgtgtatagtggccagggatctctttctgagtgtcaggggtcatctcttctccctgcaaacatgggccagaaagaggcgggagaagttgggtaggactggaagaaggacagtggagggaaaggtgtgctgcagccaaggtggtaaacaaattaaggtgttctccttagatttcaaggatgcatttgcaaatagcgttttcaatagcattttaaaataactgaagagtcatttcaagataatatatttcatcttgataataatacattttaagaattttagaattattgaaaaatttgaaaagtcaatttcataattaactgattgacttgagattaaagtctttatcttattaattagaatatattgctgaacacataaaacacagacatgttcatttttgaagggcgttgctgtaacttgggttttgctagcttcttggtttggtagatgtttcatctctctcccctttttctcattgtctcacctgtatttttttctaccttttcatttcatgttccctttactttgggattcaaactcctcttagacttctcaggattttgaatgactggactatagataatcacattttaaaactgcattttaatattctgttctctttaaagaaaattaggtactctgcatggcctggggacaaatttacagttaaatagaagtataatgttctgagggccaattgtaactaccctgtggttaactggctcaggttcaaatacagttaaaattattttacttttcctaaaattccttctaattggactaacttatcagggttgataaaaacatttccagaacgtagtatggatctgccacctggtggtgaaatattacagcaagtactaagtgttttgtttttttttttctgagacaaggactcactgtcacccagactggagtgcagtagcaccatcacagctcactgtagcctcgacctcctggactcaagcaatcttcccaccttagcccccagagtagctgggaccataggtgcatgccaccacacctggctaatttttaaagtttttgtagagatagggtctcactatgttgcccaggctggtcttgagctcctgtctcagcctcccaaagtgctggcattacaggtatgagccaccacacccagccaaatactagtatttttttttttttttttgagatggagtcttgctctgtcacccaggcttgagtgcagtagcccaattttggctcactgcaacctccgcactccctgctccgggcccaagtgattctcctgcctcagcctcccgagtagctgggactacaggcatgcaccactgcatccagctaattattgtatttttagtagagatggggttttgccacattggccggactggtctcgagctcctgacctcaggtgatctgcccaactcggcctcccagagtgctgggattacaggcatgagccgccacgcccagcctaaatacttgataagaatttaataatggattcttgcctttgtggccataatatttagagtcgagtctacttaagctctttagatatgtaacattttcctcccctaagtttttttcactgagaaaatgttacttaaatgcgatagagtaggtaaattttgactgatgtgtttctgtctaccgcatcgtaatataagatgacatttgtagaattactgagctgaaataaattctgcacacattgagaatgtactctccttaaatttgaagatgagcttttgagaagagaagattgctgttaatttttctaaaatttcaatgtggatagtcattgattcacagaaaaaacagtaatatgaagttcacagaacaaagaaaaaacagtaagatgaagttcacagaacaaaggatttttttttttggaaagaaagcattttgtttattcacttaaaaatattagcaggcatattaaaactacttttagcaaatagactaacagttttatcaccctcaaatgaattattaatacatatcagtattttatatatgggcactgtgttaggtatacatgataaaatagtgaaaataaaaatgtctcttgtcctcctggagtttataatctagctagaatctgtaatctaacataatgttaagggccataaaggagaagtgcataatagggagagttcaccctggctagtgtatcagagaaagcttccctaaggaagtgacgtttcagctgagatctgacagatacagaccctggctaaaatgtgtgtctgtatccctttaaagtgggaaggagagtggcaagtatgaggaattgaaaataacagagtgcctggaatgtagtgagagaagggactgtggtgtgaatgaaaacaggaaagacggtaggagcaaataattcagggccttgttggatgtgtatcaaggactttggacttcatcatgagagtaatggaaagctgttgaattgtgtagttaagcagtgtcagatcagattaatgagaaatgaattggagcagggcaaaactgaaaagaggtcaggcagttggttagaaagcaattgtggtagttgtggcttggactagagagtgtaaatgggcgtgatgagaggctgccatatttcaaatatatttgaggtagaatagacaagacttggtgattgaatgggatggaagggggagaggtagagggagatgccaaggatgggcccaaatttctggcattcatacattcaataaatatataaatataaaacatatatatatataaaacacagtttggtccttaaagatagaaagtcgagtagccccagcgttcagttcacaatacattatcattggacagtgcaagatatctcttattttgtattttttactctgccttcatctgccacactcagtcccatttcccttgtctccttaggcttctactctaatatgttttatatatgtttttgaatatgcattaaatacataaaatatgaaatgttgttttgtgtgtttttaacttgtgatactgtgctgtacatgttattttcttcgttattctgccttatgttccttattactagctgtatggccataggtaagttatataatgatttttctgtttcctcatctgtaaagtgaggataacaatagtattaacagtacttagattatagataaacttttttaatcctcccaacaagtattcaggtgtctgcctcaagggatcctcctgccttagcttcccaaaacactgggattacaggcatgaggcactatgcctggcctgtttttcatttattttttattttatttattttcattgacaaataaaaattgaatatatttattgtggacaacataataatgttttaaaatatatagggattgtggaatggctaaattgagctaattaacatatgtattacctcatatacttaacgtttttctgtagtgagaatggttaaaatctaccctagaacttaaagtataattaaaaaaaaaatctcccagcgattttcaagaatataatacattgttataatattaactacactaaccttattgtacaatagacctcttgaacttattcctcctatctaactgaaattttttatccttttgctaacatcacccaaatccccacccttcaacctctggtaaccaccattctgctgtctgcatttatgaattctacatttttagattacacatttaagtgacatcatgcagtatttgtttttctatacctggcttattgtacttaaaatgtcctccaggttcatctttattgtcacaaatgggaagatttcctcctttttaaaggctgaatagtattccattgtgtatatataccattttttcctttatccattcatctgttgatggacactgggtaaattccacgtcttggctattgtgaataatgctgtagtgagtatggaggtgaagatatctctttgatatacttatttcatttcctttggatatatacccagtggtgggattgctggatcatagggaagttttatttttcattttttgaggaactttcatattgttttccacaatggctatactgtccatttatgtttcaattttacctttttctttttgtgtgtgtgtgtgtgtttaatgtgtgtgtgtttaatgtgtgtgtgtgttcagtggccccaggtcttctacagtttcttctttaatagttttaggtttcatctttaggtaataaatatttattcaacaactgccttgttctaggcattggatgtaaaaccgtgaaccaggtatacaggggccttagctgaccccatggagaaacaaagcaactggatggatagtggtagtgatttaggaaatatggatgatgaggaagtttggggcagaagtgggggttggatagagtaaagatcattagttcagttaaaaaagtttttttttaaactacagagggcccttatgccagctttttgtagtcaagccctccctccactcctaactcttggcattcactgatctattcaccatccctttcccttttccgggcataaaatatgtaatcttttggggctggcttctttcaccaagcataatgcctttatcacacaacaacatagatgaatctcaatgttgtatgaaagtttgttccttttcatcactgagtagtattccattgtatgaatgtaccatagcttatccattcacctggtgaatgacaactgggttgccagcagttcgtagggattatgaataaggcagctataaacatttgggtttataacgttaggtttttgcgtcaacatgttttcatttctctagggcatatatctcagagtaagattgctgggtcatatggtaagtgtttaactttatgagatactgctcagctgttcctcagaatggctgtaactttaaaattcccaccaacagtgtatgggagttatagttgattggcatcctcaccagtgttaggtattctcagttttgttttgttttagccattctattaggtattttagtgatgtctcatagttttaaattgcatttccctaatgactgatgatgttgagcatctttttctgtgcaacttgccctttttggtgaagtgtgtatgcaaatcttttgcccattaagaaaattggggttgttttcttgttgttgagttttgaattctttatatattttttatacaatttattttgttaataatttgcaaatattttctcccagtctgtctttttatactttcaatgtctttcacagcaaaagtttgaaatttagtgaggttcgacttgccagtttttttcttttatgaattatgtttttagtgttatgtctaagaactctgtgtctaagccaggtttacaaagacttttctcctttatttcttctaggaattttatagttttacatttgacatttagatttatgatccatattgagttaatttttacataaagtcaagattttcttttgcatatggatatccagttgttccaaccttgtttgttgaaaagactatcctttttccagtgaattgcattaggacttatgtcagaaatcagttgaccatagttgtgtgggtctacttctgtgttctctgtttggttccattgatctatatatctgtccttttgcctatcccacattgtcttgattgctgtagctttatagtaagttttcaagttgggtagtttgaatccttcaattttgtttttcttttctgaaattgtttagctattctactttctttctttttccctgtaagtttgtcagtttatctttatgaaaattttggttgagattatgactggaattgtattaagttcatagactaatttaggaagaatgggcatcttagctatcatgagtctttcaatccatgaatatagtatgtctttttttttttttttttgagatggagtctcactctgtcacccaggctggagtgcagcagtggcacaatctctgctcactgcaacctctgcatcctgagttctaactgcctgtttctagatttctttttttttttttttttgagttggagtctctgttgcctaggctggagtgcagtggcgcgatcttgattcacacgattctcctgcctcagcctcctgagtagctaggattacaggcacatgccacccatgcctggctaatttttgtatttttagtagagatggggtttcaccatgttggccaggctggtctcgaactcctgatctcatgtgattcacctgcctcgacctcccaaaatgctgggattacatgcgtgagccaccgcgcctagccagaaacaattttatttgttccttttcatttgtatgtcttctgttaattttctttgccttattacactggataggattttcagtacagcaaaaaatggtgaatgtggacatctttgccttgtttctgattttagggagaaagcactctgtcttttaccattaagtatgatgttagctttagtttttttgtagattctcttttttgagttaaactcccattctgttcctagtttctgagagttttttaaaatcatgaatggtagttgaattttgtcaaatacatttctgcatctgttgataagatcatgtggttttcctttatagtctgtcattatggtggcttacagtgagtggtttctgaatgttgagcaatcttatattaggataaacctcaacttggtagtggcttaatattccttttatttattatatgtaactggatttgatttgctaatgctgcattgaagatcatgccatctttgttcatgaggaatattggtttgtagttttcttgtactgtctttgtctggttttagtgtcagagtaatgctagctgcataaaatgagttgggacatgttccttccttttttattttctggaaaagatcatgtggaatgttatttcttctttaactgtttagtagaatttaatactgagatgaaatgggtcttctacaagataaatttactttcataatcagaataatgtaattgtagaaacttaaactatagaaatgaatgatgagaatatcatgtctcacaattcagatgattattaatattttggaattctttttctagttttttcctctgtatacataattgtatatttttgaattgcatataaatgtgggtatatatttaaaacaaaatttgtgattatactacaaataccattttatttctggacccagtgtggtttctaattttgttgtatggatatgccataattttacataaacattcttctaatgttgaacatttaagtgtgataaatgtcttttatgtgtttttttcctgataatttatttgacttatttctagaaaagaatttgacatatgtaaggctgctcacacacattgctaaattgctttctagaaagtatatatacgtttttactctaaaataggtaccttaaaaagtatgtttatatcttcagatatgtaaagacatataaaatatatagtaatatatatctgactatgcatattcatatttttttttaaaggaaggagtggaagtgaagagaatatatatcaaggggttagcaagattaagggaaagactaaagaaatttttctatgagacatctttgtagatcagggcaaagattcagtggaaaggaagatattgaaccaggagcaaaaatgcagagagttgtttgaaatgatgaaatatggtctggatgaaaatgtagggaaaaatgatatcaaggagagaaatgcaggaaacaaaggaactgtgcttcttttaggttgagacctgaaatagctgatatttgaccagtttttacctaaaaacatgtagtttcaaacacttttacctgatacttgtgatggaaagtaaagaggaaagatgcaaaataaattttgaagtgcaaagaagagaaattcaatttatagaaaagggattgcattttcccaaataggaggcaaggctatcttaatagaatgggtcagggtaaaaagagtgaaaaagttttgtataaatagtgtggggaatgtacagttatagtcacagacaaagatgagttaaggggcagtagtctcaacacaaaatgaaggctaggattaaaggagagggaaaggactgaagaggatggggacattcaaaagagagcattttagttaattttggtaaattaattgggcgtgaaatagagaagatgaagtaagagagagtaaagtcttgaggctagaaaaactcctaagaagaaggaagatgcttcctaagaagattcagaaagagtaaggaaggaaaagtgttagattttaatttgttgagcttgagttgacttgaaggaagagattcagatttgtgcatcattatggttgatagttgcagttctgagaatgaaaaagctctttgaggaaacaaatacagacaaaaggtcattttatttttattggttagtaattcaacaatgtcagatattttcaaaccacttatctttctgtctcctgattataatgatgagtgaacactagatttttatgtttgattaaaagcaatttatttttgtctccctacccccttttcagaagtgggaaatttcacttctttttaagaccggacataagtatgtgtagtaaagaataagaataggaggatagattagaattaattagttcagtgatttgtatgtacctgataaagtattctaataattgtttttggtatcttagagaaaaaatatctcctaggcaatatttttttttctgcatataaatgaaaatgttttgacatatgatataggactagtgaaccaataacttctcctgggcatctacctcaccatgtagaaaatggaatgaagactttggcaagcagtcaaataaaaatatgcaatgcatggaaaataacaaatgcgttaaaaagataatattgcccatattgagggaagtacaagttaaaacaacttacaccattttttttttttttgctccttaacttggtcaacatttaaaggcttcccagtgttgacaaagaaaagggaaaatgtctttctcatatactattgaagggaatatagattgatacagccttttttgtaggtggtgatatttatcaaaatttaaaatatacattattttttacttagtaattctgcttctagaaatctatcctacagatacctctcaagtgtgcaaaaagttatgggcacagagatgttccttgaagcattgtttataatagcaacaaattggaaatgacttaaacactgaccgttgggtatagccctcctacataggatgaccatatgtctaaatttgcttgggacggacccagtttacaccagcataattatttagagcattttattttactctcagatgtgtcctggtttggaagataatttacctgtttggtttatgttcacactaatagcatggagaactatgtagctgttcaaaataatgagatagaactataggaattgatatagaaatatattcaagatacattgttatgtgagagaaacaagttgcataacaatatatattattccatttattttattttatttttatttatttaagagggagtcttgctctgtcgctcaggttggagtgcagtagcgcaatcttggctcactgtggcctccgtctcctgggttcatgggattctcctgcctcagcctcctgagtagctggtactacaggcgcatgctgccaagcctattactccatgcatttaaaaaagtaaaatctctaagctctctgcatgtgagtgagagagaatgagagacaggagttaaaaatgtctggaaggattcatactaatttgttaatatgataatctctgcttaaagatggcagcccaatgaataggcatatattgaattttttaaaatataaaagcagcaataacaaaaaggtgggaactgttgattgccagcagatgctataatttttaaccagagagcattaataaacaactattacaattcttaacataaaattataagtattatactctgtcctgtataaataactattgtattagaaagaatactaatggaaaatttaaaaattatcactatcattccactattaccaatcattttacatgttacctcctgttcctcgtatctttatgtacataattcttacatcgttataatcagagcatatagtttcatattattttaaattacaccctatagcatattttttgttacaatatagtatctagcatttttagatgttttatatgtgctaagtactgtgttaaatggtttgcatgtgtaatagacttaatcctcccaattgcgttattgaggcagttactattatcccaatcttatagatgagtaaactgagaataagtaatttgcccaaggccacacagatacagcaaatggcagaactgggatttgaactcaggcagcctgactcttgaacccacgctcttatccactactattactacctccctttacaattttttagtgactgtgtaataacagcataccataatttacttagccgttttcctggttgtatatttaatttgtaggctttaaaatctgaacctcaaaagtttttattaaacaagctgatgcctactatgtgcaggaacctatttgaggtactatggacattggtacacatatgcagttatggtctagtattgttttatcttgccttatgtattacattcctgaaaagctatatacgtttgaggtgaaaatttgtttatacaaactttttttttccaatcgggtttcattattttaaagatacattattccagaaaaacaaatacttaaaaactagaaaatatttaataaaaattagcagtgagctcagcactgtttggtgcctttaagggttctgcttttgcgcatagtgaactgtattcgttttgttgttgttattgtttgtttgtttgtttgtttttctgagacagggtctcactctgtgtcccagggtggagtgtggtggcatgatcactacttgctgcaaccttgacctccctgggctcaggtgatcttcccaccacagcctcctgtggagctggaactgcaggcatacaccaccacacctggctaattttacacttttttttttttttttttgcagagactaaatggattctgtaggatattgtgggaaagactgggaatctttcccagtagaggtctcgctatgttgcccaggctggtctcaaattcctggactcaagtgatcctcccacctcagcctcccaaagtgctggggttaaggcataagccaccgtgcctggcctgtgagctgtattctttcatgtgacagttgcaagaaaaattacttaaataaatgcatgccaggatttgtgattaccgaataaaagtacataaaattgaactctctattcagatggagaaattacatgggtaatctccaaatcttttgtttacctttagaatatttatttatgcttatattgaaataaggtgaaattacaacttcagggttcatacagagaagtcacatttgtaactcaggtggatttattagatagcgttttaactacttctgttccctggattagtcacctagtcaccactcttgtctttgtgagatagagatatcaatttaatagaggaacctaagtactacacaagtgtcagctgctgtagttgattaagggggataattaagagctttattttaaagctcacctgctgaatatctagatacctgttatataagagcaaaacacatggttatctaacaaataacttataatccactttacttaattatggcattagtttttgatttgctgatccttctattaaaattttatattaaatacagcatttagttgatgagtttcattgaaaatgttcatttttaaattgatattgaatgtagttggtgtttggttactcagtgtatcttctgtacctggtctttttcagtgttcttatatttatatttcaagtcagtcataaagattttcacacataaataagattactattttgaaattgaaatgataaaataccataaagtgcccagctttagaattttaaattattttatgtcataattattgctttttaataagctttattttttagatcagttttagatttacagaaaattacagttagtgcagagttcccatatactccacacccagtatctcccattgttaacatcttatattaaaatgatacatttgttacaattagtaaacctatattgatatattaactgaagtctatactttattcagattttctcagtttttagtttttaacctaatgtcctttttttctgttccagaatcccatccagcataccatattacatttaattgttatgtcttcttgggctctcttggctgtgatagtttctcagactttccttatttttgatgaccttgatagttttaaggagtactggtcaggtattttatagaatgtttctctgttaggatttgtctgatgtttttctcaggattagactggggcttatggttttggaaggatgaccacagaggtaaagtgccatcacaccatttcaaggcattgatacataatatcaacatgatgtatcactattaacattgaccttgatcacctggctgagattgtgtttgtcaagttctccctggtaaagtcacctacctttttccatactgtactcttttgagaagaaagtcaccatgggcagcctgcacttcaggagtggggaattatgttctccctcgtagagggtggtgtttctatgtgaattatttggaattcttctgcatggggtatttgtcttttttctccatttaaaaatctttcaactgtatattatgaactcatgggtatttattttgtactttggattataatccagtaatcctttattttgttgcttaaattgtttcagctttgaccatgggaagttcctttttttttttttctttttggatacaaggtcgtgctctgtcacccaggctggagtgcagtgacatgcttacagctcactgcaacctctgcctcccaggctcaggtgatcctcccacctcaacctcccaagtagctgggaccacaggcgtgcactaccaaccacgcctggctaattttttgtattttttgtagagacagggtttcgccatgcttccctggctggtctcgaactcctaagctcaagcaatccacctgccttggcctcccagagtgctgggattataggcacgagccactgtgcctggccggaagctccttaatttggccccggtgtctcattgacatacctccatcattgtgctttttgttttgttttgtttttagcacttccttacctttgggcactacaacatgctccagactcatcatttgtatttcttgcctaattttagaattaaccattccttcaaggagccctggttccttctataactattttttttaattgcgatataactcacatactatataatccacctatttaaaatgtgcaactcagtagcttttgatatattcacagatgtgcagccattgccgcaatcaattttagaacattttcatcaccccaaaagaaatcttataccccataagcagtctactgtccatttctcatgttccccggtcctagataacactcttttgatttacctattcgggatatttcatgtaaatgaagtcatataatatgtgatcttttgtgcctggcagcttttacttagcatgatgttttcaaggttcgtccatgttgtagcttgtattagtatttcattcctttttatggccaaataataacttcattgtctggatataatacatgttatataatcattagttgaaggacattggtttatttgcgtgtttataccttttggctattatgaataatgctgcaatgtatattctatacaatagcctttctaaagattttgttgttgtttgaattggaattagtatctacacaattgattggtatacgttttaagtttcttttaagtgataattatcccctcttcacctccctgttttcttctttgtcatttgtccagaagaatttccacatggttgggatattgctggttgcttccccatggtgtttcttaccatcttcctctgtcttttttatttttatttttgtttcttaattgttagttggatctagagatttgatcatttcagggttttgttggactgccacataggtgatggtaatttattctttcatcaagaggtgtgtaatgtctgtttgggtctgtttctctgttgctattagctaccagggtttagaaaaccatagctaggctgggcacggtggctcacacctataagcccagcactttgggaggctgaggcgggcggatcacgaggtcaagagattgagaccatcctggccaacatggtgaaaccccgtctctactgaaaatacagaaattagccgggcatggtggtgtgcacctgaagtttcagctactcaggaggctaaggcaggagaattgcttgaacccaggaggcagaggttgtagtgagctgagattgtgccactgcactccagcctggcgacagagtgagactctgtcttaaaaaaaaaaaaaaaacttaacagctaatggtcagttgtctctggcttgttttttaaataacctataagctaatgttgatttttacattttgaaagtgtttttaaaaaagaattaaaaaaataagcaaaggagaatttgcgacagcaactgtgtgtagcctgaaaagcctaacatattttctgtctggccctctacagaaaatatttgctgacttctgtaccgtttactttttattgcctagagctgttgattcattaggagttgcaaaatagtgataatctatcattttttcatttatttggtagagtacttctataaacagaaactttcaccaacaattttattgccaccaggaacagtttgatggggaaagatgtttaatttttttcctcttccttttgaaaagttttcaagatgatttggttctatagcattcacgaaagatgaccaattagtctttatttgtttttttttttttgagattaaagtaatggaattcaacagatttgaccatttcagttgttttattatcattattgaagcctaaatgtcccatgggtcttcagaaagttcatggaaaatgcatatatgaaaaaactatgcatggatttcaaaatttctttacatcaaaataaacttgtgttaacttgttataagatgcctgaataggatctagtttgaggtgctaccagggataaaacatcattttgagaaaagcccctatcagagcagtatgaattctgctaaaattgaagcaagaacaaacgtcaaatttatggtgaagcttgggtggaagagtgctaaaatattgatgcttacgaaaagtttatggggacagtgcccccaaagaattcagcaggttacaaatagataactcattttaagaagggacaaaacagcgttgaagatgaaacccacagcagcagatcatctacatccatttgcaaggaaaaaattcatcttgttcatgtcctaattaacagcacaaacaatagcaaacacaatagatatctcggttggttcggcttacacaattatgactgaagaagttgagcaaacttttcactcgatagatatcaaaaccattgtgcccagatcagctgcagacaaaagcagaactttgcatggaaattttagacaagtgggctcaagatcctgaagcattcgaagaattgcaacaggagatgaaacgtggctttaccagtacaatgttgaagacaaagcacaatcaaagcattggctaccaagaggtggaagtggtgcagtcaaagcaaatgcagaccagtcaagagcaaagatcatggcaacggttttttgggatggccaaggcatattgcttattgactttttggagggccaaagaatggtaacatctgtttatatgagaatgttttgagaaagccaaaattttagcagaaaattgcacaggaaagcttcagcacagagtccttctcccccagggcaatactcctggtcattcttttcatcaagcaagggtgactttgtgagagttttgatgggaaatcattaggcatccaccttaaagtcctgatttggcttcttctgacttctttttgtttcctaatcttaaaaaatcttcaaagagcactcatttttctttacttaataatgtaaggctgggtgcagtggttacacctgtaattccagcactttgggaggctgaggttggatgattgcttgagcacaggagttcatgactaacctgggcaacatggtgagaccctgtctcttaaaaaaaaagaaaaattagctgggtgtggtagcatgtgcctgtggtcccagctactcaggagattgaggcggaaggatcaattgagcccaggaggtcaaggctgcagtgagttgtgatcatgccacttgcactctagcctgggctacagagcgagaccctgtctcaaaaaaacaattaataataatgtaaaaaagactgcactgagatggctaaattcttaggactgagttctttagggatggactaactggttggtatcattgcttacaaaaatgttttgaccttgttggggagcttgtgttgagaaataaagacgatattttaaatttttatcttttaatttcatttttccacgaacgttttgaagtcctctcatatttggccagtcagagcctcttttttttttttttttttttgagaccgagtcttactcccatcacccaggctggagtgcagtggtgcagtcttggctcactgcaacctctgcctcccaggttcaagcgattctgctggctcagcctcccaggtagctgggattacaggtgtgcgccaccatgcctggctaatttttgtatttttagtagagacagggttttgccatgttggccaggctggtccggaactcctgacttcaggtgatctgtccacctcagcctcccaaagtgctgggattacaggcgcgagccactatgcccagcccagagcctcttttgagtgtttgagatgaccttagtggccattgatagttttattttctattatgatgagatgtttcatattcatctcattttctaatcccagacctggaactagccttttttttttttttttttttttgtaagttcttttcagtggaaaatgatgcgtagagaccaaaacctgagtatggaaagtgctcattgccactgggttggtcatcattactaggccttttaagtgaagtgagctaggaaatacctattttttaaagtagtaaaatgaatttatattagtacttaaaattgaaggctaaaagattatactttaatgttactgatttttacatctatagtgtttttcttctacaccaagaatatcatgttctccaaatcagtaaagttactcatttgctttatcccacaacacacacacacacacacaccctcagaataacaatactaatgctaactgcaataaaatggtcattaaaacagcttaaatttttttgcagttcttttggtccttagagtatatcctactatgtatagtttggttactgggttcttaaattctctcgaactagttctctgtgtgattttaatgacagctggtcaattaggtttgtctaatttatactttcaatttttagagattttttaaaatctaattttgttttttaattatgtaaaatgtttacatagcctcaaagtcaaatctatgaacaagttctgtgaagagacttagcctcaatccctgtctctttcaccatatttcctctccctgtgtgtattaaaagttatatatatgtgtgtgtgttaatatcctacatttcttaggtaaatacactcatttttctccaaacttacttgttttcacttaatttgttatagaaatcactccatggtagaaaataaacttattttacagtcttgcgtacaactgcatagtacctccttgtgtcagtgtgtcatagtttattcaacatgtctcttattgagggacatcaaagttgtttccaggttgttactacaagtagtggtacagtgaatagccttgcttgtacctgcctgtttttatattttggccagtgtatcttagggagagattcatagacatgggattgctaggtaaaagggtaaatgcatatataattgcgctagattttgcagattttcctctatagtgaatgcactattttgcatttccatcagcctattttcctatatttgcctacagagtatgtcatcaaacatttggatttttgccaatatgataggtgagcaattgtatctcactgtagttttaatttgcatttcttttattatgaagttgagcatctttttaaatgattaagggccatttgcattccagttcagtaattaattctacatctgtatgaaaatgatatgcagcagtgtggatagtcttattttactcctggagatgcatttacaactgcttttggtttatatatatatgacttcattgtgggtattttgaggttggtgtcctattcttctgatgctgttaacttctttcttagattttagaggtttcccctcttttcttcaatattattttgtatcacaagtgtgttatcaaacttttaagagctcaacgaatgaatgaaatttgtctatgacaggacgacagcttaccaatgcaggactgagttaagaagcttttgaatttagtttatctttatcagtaaatgcacagttgaatagaagaattctagaacctggtttacagaccttgtgagactatgacaggatttttctaacacatctgtttattttgcattgaaagcttgtgtatgcatagaattctttgcagaaactagctttgataatataagattcattattaaggatttttaatcttgtgttcttttcctttgcttatgtttaaattgttagattgtcctatgggatttcataaatattacttctgttagtaaagctgctgacagcagaagctttcaataaattattcatgtgctatttgttttctgtgttcatgaattaattcaacttagaatttttttaactgaacttggtaacaatttgtagacatatgggtacttgaataaaatctgtaatacttgttttccatatgaggaaagtactcttagcaatatttagagcaacatcagctctctagaacatagctgattactaaggagtaatggcaaaatcgctttaaaaatgtgaaataattactcttataaaactgctgctttttcaagatgtgagccacggaattatatcattttctacttttcttgttcactatcatttgtatacttactgttcactttcatttattgaaaacttcagatgttattttacgtcttcctctccattccaaatctaccattgttctcgataatttttatctacttgacttgcattctcaatagcattttcagttctttaacctcgtcatctccagtcacttctcttccatgccatttcaaacaccagcgtctataaatgtgccctatcgctttgtcatcactcaggagcgctaaaatattaaaataataccccagtctcacatagtctccagtcgttccaggttcctcacattatagccgtgctatttttatccatctcagttcagtcctatttatttccttccctgccttagattccatgtacaaccattttgatatcttttttttttttttgagatggaatctcactctgttgcccaggctggagtgcaatggtataatctctactcactgcaccctgtgcctcccaggttcaagcgattctcctgcctcagcctctcaagtagctgggattacaggtgtgtgccaccatgcccagctgatttttgtattttttgtagagatggggtttcggcatgttggccaggctggtcttgaactcctgacctcagatgatccacccacctcagcctcctaaagtgctgggattgcaagtgtgagccactgcacccagccactttgatgtcttgaaccctcttcattgtcactttcaactcatctgcctagaaaagtttaatttcaaatgtctactttccttccttttctactttataaaatcacattctcctatttgaacttctttaaatacagttaccaacgtcagctgggctctcagtgtagcccagtaattctgttttgcctctttagtgctctcttccattcttgccacagctatttcagatgttttccactacctgcaaattctggtccttcccaacaccaccacccttctctcatcatcagcagatgaactcatctcatattttagaggctattcaagccgttaatgattcctgtaactaactaccaccagacctactcatatgttcattcttctttcttgttacaagaggggcagcattccttcaatccaaaattaatccttctacacatcttttctcatgtaagcattttaatgctttaactttccctttaagcgttactttagttgcattgtccacattagacatgctgtattttcattttcattaaattcaaaatattttgtaatttctcatgtgatttcttctttgatctgtgggttagtttataagtgtgttgcttaatttctaaatatcttaggattttccaggtttctgttattgatttgtagtttaattccattgtggttagaaaacaaactttgtacaatttcaatccccttatgtgcacattaatagtcaaggggattcttctgccaaattctggagtatgcacgctctcacgcgcacgcgtgcgcacacacgctctctttcccactctctctctgcagctcttttctgtttgtactctgatctgcaaattgcagccaccttggcctccccaatcctaatctctgcctcttcaactccgtgagactgcaaagctctctttggtttcccccaccatgtgctgaggcctggaaatggtctacaggctgtaaaatggtatcattttagggcttactttgtttacctctctctcaagggtcatagtcctgtgctgtctattgtccagtgtctgaaaagcattgtctcatcgattttgtccagtttttagttgtccaaggcaaggagggtgagtcccatccttgatactctattgtggccagaagcctgcatcatcttaccgtgtaattgcctgtatctatttcagtctttctactggttctttccatcagcttttcaacatgctcaagtctctcctctattgcaaagaatatagaagaaaaccaagctcatgtcgtctttatttaccaacctatctctcctctaccttttacagccaaactttttgaaagttatctctatccttgctactcaaaaatattgtttgtggactgatagcatctttgtcatctaataactcattagaaatgtaacatctcaggccccatcctagaactactgaatcagaatctgaattttagtccaggtgcggtgattcatgcctgtaatctcagcactttagaggccgaggcgggcggatcatgaggtcgggagttcaagaccagcctggccaatatggtgaaaccccatctctactaaaaatacaaaaattagctgggcgtggtggcacatgcctgtagtcacagctattcgggaggctgaggcagaagaatcgcttgaacccgggaggcagaggttgcagtgagccgagatcacgccactgcactcctgcctgggctatagagcaagattccgtctcaaaaaaaaaaatttaataaggtttaacaaggtaattagaatatacactataatttgagaacactgtctacattttccttcttcactttccatcttgttccttagtgtgttgtagtctgtcatctgtttataggactacattagagctgttcttgcctggatcatcagtgactttctcaatgtatatctaatgaatgggggtctctctatctaatgaatggctgtgttttactctcagcagttcatcttcctttctgatatattcctttggcttttgggatgccctgttctcttgtcctctgacctctgtggccttttcaggcttttctttctctgcctgtctcttaaatgttggtgttctacagaatttggtccccagctttcttcagattttacatttctctgcctgtctcatcttttcctgtaactccagtttcaacatgtattcttcattctgaatctctcctgagttccaggattatatgtcctccacataagcaccttaaactctccatgttactgtggacacatgatctccttcatcatgtcctcctcctcagtgactggcaccatttagccatcgtccaagctagaaacttgtcattcatcttcaactactccatcaccctttcccctcctttactcaccttactttcgcatttattcagtcttaagacgtattgattccactctaaaaattcatcatgtctgccatttttttttctgtcactattgctgctttcctaaacaggacttcagtaggtttcaactgagattaccacagtggcttcccaactggtttccctatctccaatcttgttccctttaaactaatctccatttggcagtaagaatgatccttttaatattaagtaaatgtgatctttacttaccatcttaaagcccttcaagacccttaccaactcttcttaacttccaaacttattagcttaatgtatgaaatcgtcactatctggtcactgccttcccagttgtgaatttctttgagtactttgccacttccactgccagcttgtttccaggcctttgtacctactgttcctttgacagagtgtcttctgctcttcactggctggctcctgaggtttcatgtcattttgcaggaatgtcctccttgactgtctaggccggttagattctcttcatgtacgtatgtactttgtacatatcctgtcatggctcctatcacactgttctgtggttgtgtttgtggctgtgatcatatcattgtatatgtcctccactataagcactcttaagggcagatagtaagtgtcttgttcccttaacctaggtgcttagcatgtggcacccactctacaccaggcagggttcctgctctcattgagctaatagtgtattgtggggatggaggtgggttagggtgcaagaaacaaaagcaacaaaagaaaaataattttattcttatacatgatagatccttagtaatatttttgaaagaatgtgtaaattattattattgttttgagatggggtctcactctgtagtccaggctggaacgcagtggcatgatcatggctcactatgtcctttatctcctgggctcaagcagtcctctcaccacagcctcccaagtagctgggactacaggcacatgccactgtgccaggttaatttttttaaatgtattttttgtagagatggaggtctcactgttttgctcaggctggtctcaaactcctaggctcaagcgatcatcttgccttggcttcccaaagtgctgggattacaggtgtgagccactgcgactggccaaattattattttaaagagcccttcaagtgcagaaatcttgaatgttactgacattactgacttaagttcttgaaagttcagctttctaaactgaaagctaagttcagctatctaaaaatgtaatatacctttctggacctagtgttctgtggtaattaggttattgttcaaacccttcaaatctaattcttagtttttttgttttcttatgtagtttccctgaacagaactgtggtaatcaaggactagtggaggtgtactttagaaatagcagtgagaattaatggttagctttgaaaatagaaaagtaaaataataggtgttctatggtataattgttttttattaagaaaggatatgttttattcattgtattttataaagttcaagccattgatgctaaaattagaaaaagtttgtcatcaaatagctaaaatattgatttgatagccaacagatgaagttacttgaaataagctatattagtctattctcacactgctataaggaactacctgagactgggtaatttatgaagaaaagaggtgtaattgattcacagtcctgcaggctgtgcaggaagcatggctggggaggcctcacaaaacttacagtaatggtggtggaaggtgaaggtggagcagggcacatcttcacatggagaagtaggagagagagtggaggggaaggtgccacacacttttaaacaaccaggtctcatgtatcaccagaacagcaaggggaaatgcgccccatgatccaatcacctgccaccaggcctcacctccaacactggagattataattcaacatgagatttgggcagggacacagacccaaactgtatcataggcagaatatttagagcacctcttgaaaaatgtggtcactttattaattttgaactctatatgaaaatattttattaaatttcttgaaaaatcttatctactcagtatcagtgaagtgttttcattataagcatcagaaacattaactaacttaagtacaaagggcatttgttaggatgatatggggttgcttaaaggataaacagaaaagataaagaaccaaacaaatgtccactgtttcagttgggccagaggaattacttttctgcgaatgattacttttctgggcagggcattggatttcttgagtctatacgcctaagagtgcctgctgcgtgttgtgtagtttctggtttattgtaattgcttagacaacaacccaatgcagtgttttctcttgatgtcttaatattgtaaaagtatctaggaataaggacattttcctaaataacagtatcattaatcacatctaagaaaattaaaattaactcagtaatgctgtctaatatactcagcatttaaagtcatctggatattctccaaatgttttttgttgcccaggatccagtaaggtttcactcattgcatttgcttgtttctcattagtctcattagttcatgtaggacagtcttcttattgcctttgttttttatgacattcactttattttacttgaagagtccagggtagttgtcttgtagaatgtctcacattttggatttgtgtaattattttttcatgcttagatttaggttagacactttgggcaagaatactacatgctgcttattgcatctcatcaggatgtttatgaagccaggttgtcccactactgttaataatgaatttgatcatttagttaagatggtatctgccaaatctgtccattgtgaaggtacatttccccctttgtaattaatgatttgtggatgacactcaaattgtgtgacttcttttttccagtggttttagcattcatcagtaatgaatcagttattactgaacttttaatgaaaagtttctaaaaagtttcctttctaaatagacatttctgattaggcactaaagagaaggtactggtagtcacttaaaaatccttccatttttactgtttagatgtcagaccagttgtattagacagctgggaaagagctttgctttgattcctcacaattattgtcatgattcgtattaatcttttaccttttccagaaataatacaatttttttattagagaacttgattattttaaaacacattaatgaagggtaacataggccagtgcagtgctgtacaatggaaatatagtacaagccaaatacataatttgaaatcttctagatagcacattagaaaagtaaaaaacaggttgaactaattttaataatatattttatttacatgaatatatccaaaatattttaacacgtaattagtataaaaattgttgatgaatattctacattctgtgtgtgtgcaataagtcttctaaatctggtgtgtattttatattacttaaaatcttaatttagatgagctacattaagttaccaataactacatgtcacacatcactgtccctattggatagtgcagatatggtggttacaatcttgggcacaaaggaaccagactaacttgattcagatcttgccttcttcaccagctggcatcatgactttgggcaaattcttcattctctttgtggtgtagttttcccattgtaaaatggggataataatagttcttactactagggatggggaattgaaataattaatgtaggaaaagcactgaatccatctctggcacatagtaaatgcttagtaaatgttaactcttatcattatgcctttagacttcgtccaataattcccattctgtcttagaagtgtccttgtattttgtaagggaagttaggactagatattggatcccttgacttctgttttatatcttgctggttttaccctcagtcccttgctttacaaactcttttgtagtgactttctaaaccaataagatgaaatagattttttaggagacttttaatttcaagcattctcgccccttgttaccataatttattgaaatgaatgggaaaacccagcacctctgcaaatggcagtgagtaaatgagagatttatcattatgattttttaaacccacaaaagattgagagctacaatatattgggttgctttttctttgtaatacaaatacatctctcccacagaagcctatgtaattgtagcagtaaggtaaaacagattcacatacaaaattaaggtgatctcgaagattgatgaagtgtagttgtatctagttcagagttatttaggatggcttccagatttgttgattacccagtcttatattaggtcataataactgcagaagatagagaagggagtattaaatgaagttttgcaaaggagatgtcctgtttaaaaataacttgatggtttactgtgatataacatttggtacctagaatactagtatcattgcccatcatagaaaaataaaacatcattaaacaaagaagtatcagttagttgaagcctttgtaagcattcactgaatcagcattcctaaagacggtgatgttgctaaaatgaaatggtggtagttgaatattacagtgtaaaacaatgccatcattcaggggattgaattgtacctccaagttaatttttacattatattatcattgcagccatattttcatcagtatagcaaaagtggaactgaaaaatactcatttcagaaatttaaaagactttgcaactgtattgggtgaatgtgcatcagtattgggtcttactcttaggagaatcttctggccaccagtattaaaaagtggcttataagatatttctaggctgagtgcagtggctcatgcctgcattcccagcactttgggaggctaaggcgggaggatgacttgaaaccaggagtttgagaccagcctgggcaacatagtgaggcccggtctgtaccaaaaagacaaacaacaacaacaaaacccaaaagctttcatgaacgttctgtaattaatgtgaaacaattcttatatatttctcatctagcagaatgaaaaatgaccaattcagatttcccccacttttgagctaaagtatagctaaatatgagctaaatattgctaagactgtttattattaatggacttttcctgagaattgttttggagaatttccaagtaactggttagaacattaatggtactgtttgcaggttatcacattgccccttgtcttcttgcacatcatgaagaaattatataaaatattaactttagttatttatggtactttaagaagttacataaaacatttttacaaaggacagacttcaagtcatcttgagatcaaattttggagactaaggctgatcttagaaaaagcaatggagatttgatgttatccacagtcattaagtaccactaatacttaattccatcttggcccaggcacctttcctacctataggacactgaaaaaggataaaacaaaacaacaaacaaaaaccaaggtgcaaatagccatggcaagacgggtcattttaatactctctaatagtctagcctgctcatgggaagatagaccttagaaaagaggaaaaagcaaacaggtaattgctgtgaagattacacatagcgtagaaggatagaggactaggatctcttcagaaatagttgttagaaaaggcctctgtagaagggacagtttggttaaaacatgaaggaagaagctagccatgcgacagagagtgggtgcagggcaagtgttccaggcagaggggatggcacatgcggaggccccagcgtgagaaaggacatggcttgttcaagagactgaataatgtggcttattcacagcccattgagagaagtgagaggaagtgtgataggagattaggttggagagaggcaggaaccagatcctgtaggcaggccatggtaatgaatttgggttttattttagctgtactggggagttctttaaagattagggaagaaagatgatcaaacttggttttaagatcacttaatattattttacacataacagttgtcaaaatatgcgtagaagtacagtccatattattttatacataacaatttctaaaatgtgattgtgaaaactaaggtcctagactgttagcgattttgggggagatattataggtttttgaactgtgaatagttaactatttattgaggacgtgttatctgccaagcagtgaggaattttatacaaattctctctcatcttcacagaaatttccttgaaaggaggcataatttttcctgtttgatgggggagaaaatgttagatacagagagaaattaagcaactagcacacaagggctaggattcaaaaatatgtctgccttactttactgtcccatagctttttttagtgtctttttgcagggaggaagatggaggggagaagaacaaggctgaaaattgaagaaaaggaaagcactcttataaatttttgtggaataaaggaatttagatttttttttttatttgggggagtggttgggaaggtagtggctgtaaattagaacagtgtatcaaggtacattaccctatagaaattgaatcaccctagaatttccctataggacattatgatcctgaacaagaattttagatctagctttgattagacattgacatccagtgtttttatggtatagttgtatgccgtgaagttttaaaagcatatatgtttatcagacaattaaaatgatctgtataatattaacaattaattgcatgttttccccaggagaggggttctgtaaagttgaaatatagggaagatgatgtgtctgaggtagatcagtctttggagaaatcagctgtgcagggcagagagagactgaactctggaaccaggagcactaactgttacgtagcaaagcagggtggaaaatgtttgttaacgcttaagtgttgcctgctcttagttaataacatgaatgttgttgagatctttgaatgttaaattattttaattttctaattttctaaggtagttgagaatttgaagcaagatagtctgaaccgcatagtgatagtggacactaaagaatcaagatggatgaaatgtaggatttggagactgacgagaagggatgggatggttgaaagaaacattaacaagtagtaaaaaaagaaaaataggaagtcctttgacagtagtgtcttagcttatgataataaagtgatacttttcttacaatgaacattatacagaatgcttgcatttgtaggtatataaaaatgctacttatccttctgccctgagtttctgctactactaaactttgaacctcttttggcaataagacaggtttcattttacttctgcaagtattcagataccatatgttaatgttttactctgggtacaataaagtttagaattattactggtcacacacaattaagacatgcaccgagggatatgatttgttgatgttgttgggagttacaacagaaaggagttccctgtggatattttctttctgtaagatggaattctatcaagaagtgtgaagtattctatcagaatgtgaggaatagtctatcaagaagtgagagctattccattaagacgtgagaaatttgaagagacttgggaatgtagaagatattagataggatcattaaacctatttcaaaatggaatccagtgactctggccatactaaaccaaaattaagcaaatataattggctgggagtcaggtccctggggagaagtataagccagtttttatacaaagtcagctaaggagtgagtgtttgataacccttttattgtaacaaaaagtgggtaaagaaaatgatgatagatcttttagaaaataatctcctgttccaagcaaaggattgttctccaccaccaccaacaaaatttttgttactgaaaaaaaagataagaagaatgtgtatgcaattgttcatatatatacatatataaaagtagcaaacagaaatacacggagtaaaaagtgttctccctgtacgctctctgctctcttttggcagctcaaacccactactctccccagggagaaaacaatgttaactgttcagtgtttgttattctagtcttttccctttgtatttgcatttaaatatgggcacacaagcatctgtacatgtgtacatattttaatatcagaagagtcatactcgacatattttgaacgtacattttttattatttatgtatcttgacaatcttttaatctcagcatacaaatgtaccccagacttttcataatgttcctctcctgtgcagacgatatgtgtgtatgaatttatgaatgaagatggctatatttctgcttaagtaatactatttttatgtaaaatatttagacaataccaaaggtgaaagaaaaaattaaaaatcaactgaaatccttgagataatccttattttggcgaccatttaaaaaatgtttttctttagctatttacacgagtgtgaacatacatcacacctgccacatataaaggtataatatttatttatttatttatttagagacaaggttttctttggtcatccagactaggtctccctcagtcacccagactggagtgtagtggtgtaatcttggctcactgcatcctcttcctcccgtgctccagtgatcctcccacctcagcctcccaagtagctgggactactggtacaggtcaccactcctggctaatttttgtcttgttttgttttgttttttggtagagatggggtttagacatgttgtccagactggtcttgaactcctgggctcaagcaatccgcctgccttggctccccaaagtgctgggattacaagggtgagccacagcacccagccaatgtagtatttataagtggattatacatacaagatgatttttgtcatggaactattttatctgcttggggatttttatctttcctctactccctttctcctatctttcctctcccagtaaccagtagtaacaacctggtgtacatttttcctacctttctcaatgcccatataatcatatacatatgaaattatataatttacactcatcttcattattcatttttcacagaactgattctacatcaactgaaatgtagcccactcattttttttttgctggataatattctaaggcaaggatcagcaaactgcaataaacggatcaaatccatccagccacctatttgtataaataaagttttgttggaacatagcttcacccatttttgtattgagcagtttaaccttttaaattctttacctgttatatgtgacacaattttccccccaatccattgtcttttgctttgttatggtattttgccataaaaaatttttttttaatgcaataaagtaaaacatgcctcttcttttctagcttttagtttcctattttgatttaaaaggctgcctaactccaggattatccttgtattttcctaaaatttcttctaaggtttttatcacttgcattttttataggcctggaatacatttttatgtctatattgagtggcattgtagtataacgtagtataagatcacagataatgaacaaatagctaacaataatgtagtataagatcacagaccctggttctgtgatttactacctgttcgacctttgacaaggtccttaacatttatatgttgttttcctctctaaaatggggctgattcttgtacctgttttgtaagatgatagtgaagcttaaatgagtggttattatgtagaaaatatttcgaacattatctggtacatagaaacatgtgcttttactgttattacatggtgtgagtaggcatctcatttttttcccatatggataaccagttgtcctagtaacatttattgagtagttagttcatccttttcctcaatcgatttaaaatgtcatctctactacatgttaagtttccaaatatatatagctctgtttgggggctttatagcctgttatgtgtctttatcctctgctccagagccacagtggcttagttactatagctttatacatacttgtaactaacaagtggagtccctttactttgttttgcagaattactttggctcttactggctttttttttttgctcttccatatagttttgtaaacactcatcagaatttacaaaaactgtttgttattaagtcttagtgtggaaaggagtgatactaagtggccattattagaatggaacctgcagtctcttattaatactttaaccattggaagtttttagaagttatctggttatgtaatctaaagattagtgccatccaccatgctaggtgggtactgggaatatagcaaatgaaaactgtacaaagatagatcataagcctgcatttcccaaactataccctgagatacccaaaggaacctcagagaactcccagggtcatttcaaacttctagggaaacatggccacatctgttggacattatgcgaacttctagctcaaggtagttcacagtttcaacagctgattgtgccatcttcattttgtacctgtgatatctttgtgaagttgagcttttagtggttactgttttaaaaagcaagtactatgcaaaaatcagtgtggaacaggaaatgtgggtggcagtatttagttgcacagcatctaagttttagaagttgtgcagggccctgtaggtgaaaacatcccatagtaactaattgtggttattttaaaatgaaatatatatatatatttttcagtttgcatgtattattttttcaaaaaggtgttaatttgttgggacatagatactcattttgtttgaacctaactgttaaaagaaataggatggttagctatctcttttgacctatggaattcttgaaagaaattatagagaaaataagggtaccaggagccaagcaagtttgggaacctctctactttaacttaaagttattacaaatattcaaagattaagaacatttggagtgctctgtaggtagcgcatacaccatgcttgcttagaacaggcaaaactaacattgcctgggcacctgggacagacagcatttctgagcaaatgatatttaagctgagcttgaaggaagactgagaactgactgaaaaggagtggtggtgggaatagcttgtgtgaagaggcgggagcggtggggaactgactgggagagcaatgcaggggagctggaaataggcagaagctagatcaggtggtgactgacgtggcagtcgactaaaggagtttcttcaggtttctttgtaaaaggcaacggcaagcctttgaggggttttaagtgaagagaggatatcttaggtcactgccctcctactgagagaacaaaatacaaaacgatatacagaaatatttaagtaactttttgtaaaaattttgaagtgccttgattttgaaaggcatttgtaagctttcctttgagtgtaattcactcttactttttcaaacacatatactttttttcgttgttcaacctggctcaattttaaaaatgaaataaaaagcaagacagtgttaaactgcgaaacatttaaattgtaattttgggggtattttttcaaatggcaaaaattgtgttgtaattttgaaatagaatgtattttattatcagtaatacaatatttcagatttttaatttgtgtattttaaccaccaatctaacacatttatcttttaagtttctgagttaagtttggggggtataatagagatttaatagttacatagtaaagatataaaggtaatttctcttagtttagctatctttttatactttttatttatgtgtttattctactatgattccagtaaactaatgcaacataaacattttgatagtaataagaaactaattgcaggttactttttaaaaatttctaagcttattttcaggaattttaagacttgaaaaataaatttcatggtcattaaatgggcatagagacctgaaacactttttttttttgagacggagtctggctcttgccaggctatagtgcaatggtgtaatctcggctcactgcaacctccacctcccaggttcaagtgattttcccgcctcagcctcccaactagctgggactacaggcatgtgccaccatgcctggctaatttttgtatttttagtagagatggggtttcaccatgttggccaggctggtctcgaactgctgacctcatgatccacccaccttggcctcccaaagtgctgggattacaggcgtgagccaccgtgcccagccacctcttttctaatacctgcttgtggtgtttgggaaagtgtaattagtctgattagaattagaatttgtttatcattgaagtattggaaaacttttaaaacaattgaatgttatttcttttcctctgccagtgtgttttatatttctttagaggtgtttgttcattatataatatagaatttatgtcatccttaaattcataatgcaaataaattataaagaagtgtgtagatatattcgaaaaacagtcttagtttcatttgctggattgggtttctctgatttttcacatgaagaaagctgatgacaacttgagttgtttacaagggaattggtcagaagttttcttgaagaaaagtgataaagctttaagttggaaagctttccaacaggctgagagtataaggtttataacaaatatttttctttaaattttgttcttcccatgttcaaagaactgacagggacttagagaaagtaagctaattccttccgtgctctttacactaaaatgaattctagatgaagattaaatgtagaaaatcacaagagtaatagaacaaagcaaggctgaaattttttatgatcttgggataaaaaagacctaagtataactatgtttagttttatgtagcttaaaatttattcttataacaaatattataaagtcaaatggaaaaaagaatatttgtaaaatatgatagcagattgctttttaagtcagtcggatgaataaattctctagaaaatggacaaagtgtgtgtatagtaaatttatgaaaaaaatacaaataactgataaacataaaaagatacctcttaagaatcattttaattttctgcctcttttatgttcaacagagaatttcactttgaatgcagtaacttaaagtatttataaatctgattctagggtttgaaataaaacttttattagatactcatgtcatttaacaaggcttgtttatctcaggtagaaggtttttttttcccctaatgttcttctaaatggctcaaagtttggtttcctacttgaaagtaaatcttatttattagacatttgtagtgagatgactatatttatgtgtcacattcaaagaacaacagttaataatttttggacttgttagtaatatattttctgacaaataatagaagagagatttgcttaactttgttctttttctttatttttgtaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtaagttttaagtgatttttttttttgcattttcaaatatttataacatacatcttgataaaagcactgttctcttggagttttcttttaattagtagcaacaaatatactcatttaacagatatcaattgtgcatatactctgcgtatgggaccttgctgtagggcttgctcagtgccgtagagaataaactgtagcgtgtttccacttgtctgatggcttaatattgctatcagaagtactgagcagttcttttctccttttaaacttggaagtggcagaggaagtggtataggaaaattaaatcactttgacggccaacttctatcttacccagcataaccatttagtatggttttgtaaaacttgcagtaaagtcagaatcctggttccttgatgccttaaccaaggaaatgacattcaattggattaattgttttaaaatctacagagtgtatattaaggtggagagcagaaagttataaagagaggaactttccctccttttcagagtatccttatttgaagaatgatggaaagtgtaagaaaaattagggatcttgaagagtaagatgtggtttctaagtaagtcatgtctgttttgtagtagatactagcgttcctgagatagtgtttctttacttgagtaccagatgaaatagtttttgtgaagggtcatgttatacaaaaatgttatctttaagtcctgtatttactctcaccttggtgaaacgcccacgtgtgagacagaacctcagagacagtagtctcccatctcattcctactccaggattatggtttcccatctcatgctcactccagagtatatttgcttatacattcagagcataatggctggtttttttcctctttggggacaaatactcaaagttgaatttgggtgtgacaaagtttctgtaattattccataatcatagattgaggatggaaaaataaaagaagaaaaaaatgggtccttttgccaatttcccttttctttccttccttctctccctccttcccttctaccctcccttccttgcttccttctttcctctttttatttttcttccttttcttttctttcttctctctcccttaaaaaataatctatttgccaggctttctccaacatgtttcataaataaattagtataatgactgcctctacaacgtcacttaggtcagtgtctgtttataatttaagttcttaaatatctcttatctgggctttattcatgggctccttcctctcggctgtccccccatatactatcatcaaatccagtgaattctgcttagtaatttctctgtacttaatccactttctccttcccgaggctactcccagtcttccctcaccacagccttataagcatctgcctgctaccttattcttcccctcctccagtccagtctccaccctgtctagagtactctttctcacccttcagtgatcctccagtaacaccatcaaggtaacatctaactcttaaataacaggcctgttgattccttttatgagctgtcctccacttctccaaccttatttcttaacatttcaccctgcctctgtccccacccccgtcccctacatccaccatcaccctcaccacagttttaagcactggcagtactgttttgtttcctttcatttattctctgccttccagcctttgctcatggcatccccactgcctgttaattttatcctccaccttttcctcactttcttctcctctgctaagtttgtccattcttcctctttgataccttcaggaagcatttttttgacccagtatctaagcaagcagcaccgtagaaggtgatacattctgtgatgactgcatacagggttctgtaggaaagttatttaaaccactcttggccctaggtatcaggagtaaatagtgcccaagctaagggattaaataaaagttcttttaaatagttgcatggtatacattgtctagatatacatactgtgatttatttaaagatttctttattgatgaacaattaaatggattaaaattgttggatgttataggcaatactatagtgaactgccttctgcaaatctttatttctgtaaaacagattactggaattgggattgctggatcataggatacactgtgtgtgtgtgtgtgtgcgcgcaattaaaaggtactagtttgtcagttcctcaaaatgttaaccatagtgttaccatatgacctagcagttccacttgtaggtgtcctggggtagttatgggttatgcagagtgactgcaagtgagtacaagatttcttcccggaatgatgaaaaggttctgaaattagattatggtgatgattacacaactttgttcatatactaaaaaatattaaattatgtactttagatagtgaactttatggtatataaattacatctcaataaaacctaaaaaaattctgccaaattgccaatctaaaagacttagagttttttggttgcaagcagtagaaactgattgtagccaagtcaagcaagaagggaagtttttgaaagaacattaaataggtaactcatagaattaagtatgagaggtctttttctctgagctgtctcatttctccacaaccaaaatttctgtttttctgcctgggcagtatgctggctgtgagtattttgtgcccagaggtggggtaatagggtgttctaaatacagacattgttaatatcttcttgtcaactccgggtcttaactcccactctcctttttctcctgcagttctccagaggcagcaggacaaccggcttccttcttgggagcgcaggaagctgcagcgttccctgccttgttatgtcagttactagtcctccatctgctttccctactcagaaattttttgaaatctcttgtctgccaattctccatatgtttttgtgagcttacattttaaaaattattaattttcatgagacctcaggaggaagaattttttgactctttaaaaatacaactgagctgggcgcagtggcttacgcctataatcccagcactataggaggccaagacgggcggatcacctgaggtcaggagtttgagaccagcctgaccaacatggtgaaaccccatctctactaaaaatacaaaaattagccagtatggtggtgcccgcctgtaatcccagctacttgggaggctgaggcaggagaattgtttgaaccctggaggcagatgttgcagtgagccaagattgtgccactgcactccagcatgggtgacagagtgagactctgtctcataaaaaaaattaattaattaatttaatttaatttaatttaattaaaatagaaccatattttggttttattgattaagatttcctcctttccccaacttgatcaaattctgtgtttatctttgttaattcttatcttctgatattctggtttcttaaaagtagatttttggtcaaatctggggagctcaaggtaaaaaagcagattttttagataattttatctttatttttttccttcaaaaatccccttgaaataaaaaaaaaataagaaaaagaaaaagtttattgcagggctgtaaaacctgtgtgatttatgtttggactaattcaccatcataaaactagaaaacctgtaatcatttctcatgatttgtttgctcttccttaaagaaacatattgttttattctgagcatagcaatcactttttagatattataatagctagttaagtgtttatgcaatatactatatataaattatttattttaagtactttttttttttttaacaatcctgtgaggcctgttattctcattttacttgtgaagaaactgagtcttagggagtggttaaataacttgccaacttcagacacccatgaagtggtggtgttgggattcagattcagatatgtgacttgaaaactgatgctcttagctgctacatcctgtggcgtctatatttatgacgacatttttggttcacattttattttgagatcattttaaacgtagggagtaggtgcaagaatagaaccaagaaatctcatataccttcacctagattacctgattgttaacatcttatcgtatctgccttaaccccccaaaaatgcatacatccaaagacatattttttcggagccagtaagagtaaattgcagacaggttttcctgtaactgccacctaaatacctacgtgtatatttctttgaaacaaggacattctcctagataaccacagatgtccatcaaaattaggaaattaaccttaatacaatactactgtttaatttagatttcactgattatctcaataatgttctttatagtaaaaaccaaaagcagagtacccgcctgtcctcctcccacacatactcttatttctggcccaagattacatatttcacttggtggctgtgtcctttaaaactctttagatataacttggtttttccttgcctcattttgagtttgtttgatttctccctgaatagattcagattcctcatttttgggagaaataccacagaagtaatgctgtgttctcagtgcatcatgccaagaagcatgtgatattttgttctgttgctggtgatgttaacttttactacttaagatggtctgtgcagtgtttctccattgtaaagcttggtacttttgttagttaataatgagtattttgggaagagatactttgatactctgtaaatatactgttcctcatgacatttttgtttactagttttggtgtccattgaggattcatacgtgaatcagttattactatcaaatggtgatttttctagttccatcatttctataaggcaaagcttttccttttcttccacttatttgtttatatttgcatgaaccgacagattcttgtcttattcagtgggttataatgcatgttaataccattatcccagatttaatcagaggaagctcccttcagtctgacttctgtgcccttttgatatgtccacattgttctttggacagttttcttactttacgtcgtaagatgtaccaggttcatcttgtgctttctctccttctgcactcttagaattggccatttctccaagaaattatttagaaaaggtagagacaccatatgtaccattgctactgaagtaatatggatgctgcaccttctctgtggacagggctaggaaatatataggggtgtgtgtgtgtgtgtatatatatatatatatatatatatatatatacacattatatatattatatatatgtatagcaatgaataaagactagacaaaatgtgtacatgtttcacacatacttttatatttatatagatatcatatatatttttatatctatgattatataaaaccatgatgtttacactgatacctccattctagaccagtaccataggacttattctacccatctccttttcaatgtttataccttgcttctctaactgtgaggaatctgattccagttatccttaatgcatttacttatttgcccagtatccctgtatttagctaatttccatggactttcttctcaaccctggttctgccatatgttgtagccatgtgagctgacttgctcctggctcccaagacaaaattttaaagtaatatttaaataaattttatttcttctcttcctttattgtccaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccaggtattaactcattatcaggactgatggttttatgtttatgaatgggtaaacattgttctgttagaatttttaaaaataatgaatgttggccgggcgcagtggctcacacctgtaatcccagcactttgggaggttgaagcgggtggatcacctgagttccagcctggccaacatggcgaaaccccatctctactaaaaatacaaaaattagccagacatggtggcaggcgcttataactccagctactctggaggctgaggaaggagaattacttgaacccgggaggtggagggtgcagtgagctgagattgtgccattgcactccagcctgggcgatagagcaagactccatctcaaaaaaaaaaaaaagaggaatgttaatatgcggtatgacattttactgtcagcataggaagtctcagtttcttacagaagtgaaaagaagaaaatgtgccagaagatccactctttagggaatgcattattaaaaatttatcaagcaataaagtatattcactgtctaatggtattcttcttggtcaaaaaaatattagtgctgtgtcttttgtcaagccttctctccaacaataggatatttttattgttaggtcttttcacttgtgcaaatcagagacccatccaggctagttcgtataagggatgggttgggtggtaagtgttaacatggtggctctagagacaatggcaggcaagagtccttggatctttatactccccattttagtgtaaattcagctcctatttcagtctttcttctttttgtgtgtcttctcagttcctgccccttctggtgttcctcataatcaattttgtatatcttttctcactgtataacttctgcttactcataacttcctcccagttgtagctcatcatagcccctctagccttttggtgtttcatgactgtttaccttctgttctcactgctaggtgccccctccatatttctcatctcaaatttgagtttctgaatataattgaactatccctacattatttgggaagagttatatgtctattaaataggctcatttttaatctatggactggttcgcaaagcaggactgtgagctacaactcttgagggtgttcctaatagcccttcaactcataaatgtaggttctttttttgtcgttatccctcgtcattcctgtctcagtatattctcagcaaggacagtatcttttaaagtgtgcgtttgtgcgtgtgtgtgtgtgagcgcctgtgcacgcatatgcatatgtgtatgtgtcttgagacacggtcttgctctgtaacccgggctagagtgcagtggtgcgatcttggttcgctgcagccttgatctcctgggctcaagtgttcctcctacctcagcctacgagtagctgggacaaacggtacacaccaccacatctggctaatttttttgtattttttttagagatggattttgccatattgcccaagttggccttgaactcctgggctcaagtgattctcctaccttggcctcccaaagtgctgggcttataggtatgggccacagtggccagcgtgagatgtatattattagatcttgtcacacctttgctcaaaactccctaatggttttccatgtcattcagagttaaagttctgggctgtaaagatttataatcttaataccacttccttcctttctctcccctatcccatctcctactcttttctccctcactcgaagattgtgatcactttatgtttctagaacaatccagatatgctcttggccattttctctttctggaatcctctttcctcagatacctgcctgggtcactgtcttacctctctgctcaaatatcgctttatcagtgaagccttccttgaacactctgtttaaaacaacaatctttgatttccacccccagtgttttctccttctaccttcattttacttcagaacatattaccatctgacatgttctatcttacttgtctctctccctcattagtatgtaagctcaaccagagcagggaatttttgtctgctgccaaaaacactttctggcacatagaagccagtaatattggctatgaatttgtttaattgattctatcaaaattcaattaaatatacctaagtaattcaagttgaattaaaaaaaagaactattgccatataccaatattattcagtctgcttgctcacttgcttttacatgacagaggtaatacttctcaacacctagggtagcatttaagcaaatcctcaaaatctgaatccaagaaaacaagatttgtagtgtcaaaaggtgagatcactactcaacatctgaaacgaaaacataatgtggaatgttttgcttacttaagtaagggagagttgtgcttgtcaaacatagttttcttgagcaaagctaagtccttatctcctatagagtttttcagaagacattgttttgggttgtactggttaagagacagaggtggattaatgtcagtcatagaaatatgttttgtggttgattacggaggtgggagcaagttaatgtcagccttaaaagtcagtgactccaccattagttggctgacttttaaagcctgggcttatcactgattggctttcaaagccacattcacccttgtgagttgtcactaatcgattaggcaatgtttccttgttaccatggctacaagactgtcattaattggttagacaagtttaaagctagtcctggaggttgttatcatggctgtagaacatcttttccaaagcatatgggcacaagagtcacatctcttctgcctgagacctttttgtcaaaactcaatattaagttaatattaccttattgaggagagaactctgtcttctgcccacaagagtgtggccttttcatgtattcacaagaggacaactctataaagtgaacacacattaattctaatgtctgaataagaaatacaaaaatatagtggtagctagattgttgctcagttacaaaatcaagggactgacagactgagcaagttaaagagacgaaactcagaaagcttttcagaaataacacacagatacagggaaggaaaggaaacctcttatccctgtgagtaaggagaatgccatgggtcctgagcttgctcagtctccactgtttgtacacatggcttttatcttatctttcaatgtgaatgggattcatgtcaaatatctctcgattgattgacaagtacgtaccctgaaggcaggagcaataagttatacatccttaagacccctaaagagcctagcacaatgctttgcacatagaatttatttgagaagtgtttgctaatttgaatggaaatttttgtatcacttttgcttaaaatattttgtcatataaagccacacagactgaataagaaccagtcattcctcaagattaaagcagtaaagtgctttgtcgtgtgtgtatgtggtaatgatggggtcttgctatattgcctacgctggtctcaaactcctgggctcaagcagtcctccctcctcggcctcccaaagtatcgggattatgggtgtgagccaccatgtccagcctgttttgtcctttaattattgtctttgttaattttttttttttttagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaaggtaagtgttgtctgcctaaaagccttcttcagccttagcttgagactttgtcatatcccatttgggactattgactaatttaaaaagattatcaactttatttaaacacatcataatgctcatatgtcatccttcaaatatgttcatatgatatatatgatgaggatatttaaagaaaaagatactttcaaaatattaagagataattattccctttgttcctgttgaagccgcagtgtactcagcttaagtcttcaggattttcttccctaaattgttgcaagagctttggtcctgagtagcctgagtcttctcacacattctcatatgcatttttttgatagtagtttttccactgcacaatcagtatgagaaactgggctggccacagtggctcacacctgtaatcccagcacttcgggacgctgaggtgggcagatcacgaggtcaggagatcgagaccatcctggctaacacggtgaaaccccgtctctactaaaaatacaaaaaattagctgggcgttgtggcatgtgcctgtagtcccagctactcgggaggctgaggcagaagaatcgctttaacccaggaggcgaaggttgcagtgacctgagatcgcgtcactgcactctagcctgggcgagagacctagacgccgtctcaaaaaaaaaaaaaagaaactgtattcctcatcctgttgtttttgccttttgaatcctatcagaaatcacaaattcttcatctttcacaaaataccaaccactttactgtccttcctatctcctctcattacttccttatgcagtgggtgcttttcttaggtgtgttctcataagagatgtggggtggtggtaggtaggtatgtttttgcttccaaaataatgctgtcttgtgcactgtaggatgtttactggcatccctgccttctacccataggtggcagtagcacttccgcattgtgacaaccaaaaatgtccctggatactgtgagatggtccttgggaagcaaaattgcccccagttgaggaccattgttctacagcagtgctgttcaattgaaatataatgcaagccacacatgtaatttaaaaatgtcttacagccacgtttttaaaaagtaagaagtacatgtacaataataaatataatagtaatattttatgtgatgtaccagttaatgtgaaatgtagttctaccaaaagaataaagtttatgtttagtgggaaacattttaacacagctttagcttgtacatttattttaaaatttcagaaattcagttctgcagtcatacaggccacatttcaggtagccacatgtgactagtggctattgacttggacagggcagatctagagtttcccagttgcaaaatcaaaagtgaacagacaattttaatttttatagttcagtatccaagacgtagaaacaggtatctatctagttatctgggtgatcagccttcagtgatcactggggaagatggaatacaatcagattgttccccacgtgctccattagcaaaacatggcatcctccccaatatcacctgatttctttctcatcatccatccactcaccaacttcctgtcttcacattttgcttcctccctgtctttccactcctctttccagctaaatattacataagcaaagaatttataagacttcatttttttttttttttgccaactgaaacatagggaaccttaaaatagtgataaaaatgtgaagttcttacagtagaaattttaattggctacaagttagaacaaaatctttatcaggagtaggaaggctgaaatatattattttaaaacatattttgtcatgaagggacattctgaagatataaaacttatatataatgattttttatgtcagaaataaatgtgaggctttctatgattctcatttgttcaataattactcaacaaatatttaccaaatgctggctatgtcatgcatgttctaggtgctgggaatagagtagtgaaccaaatggagttcttgatcttacagagctcatagtctagtgggaaagagtcagataataagtaaaaatttaaaaatgtcagtttatggtaagtgctatgaagaaaagacaaattatatcaggagtgtcaagagaaatagaggtaagattgctattttatacaacgtgttagataattgttcttttagtagaatgattctcagactggggtctgagtgggccagggtatgcacatcatgatagaaaagtttcatatcttcctgaaacatccaattttattcaaagatatccttgggagcagatgatttttaactaaatcaaatgtgaatatattatggttaataacactgctctgaattttaaggataaagcagtagactttaagattgagttaacttatttctgcctgtagttctctaggctcctgaatactcagattaggtggctgaaaagtctgagaagcactgccttggtatgtcactgtctcaagaagcttcagaagaaaataagagcaggacagtgttggtggtgttcacattggtctttccagactctagcacagtgcttggcccataactggggaggggaagtggtggccaatatatttagcttgaataacccaaagtaatgttggaaaatataagtgaatggagcacaggagtgcttttggttggatgtatgtaattacccaaaatatctttgtttctgctagagccttatgagatatgtagataggcctcagctaataaattatttagacccaaaattagaaagaggcttagaagttgaaagaaaaaagtggctagaaattcagatagtgttaggctggatctagtaaaaaaaaaagatcttaaataactaaacatccttctttattactcatcttaagacttctttgaaagtgaacttaagaacatttccatggcttttataaatgtccaaaaattgatctatatatttaacctttgatcaaatttgttcagatttacaataatcatcgctaatgaaagaggggggtggaaatggatcccattcactaagtagttttattttaaagggagagaatctggaaaatataaatgctagtgttcaaggtgattgacagaaaaatgtaatttagtagtcaaataatgttatcttttaatggaatgatagatctgaaccccactgcaagggaacaggttaaaatgcttgatattattacaattgacagtagtagaaaaataagattatttaaaaagtaaatggaagacttccacttctgggaaaattgagtagatatatttttccctattccttttgctaaatacacctaaaaaccctggatgttacatgtgaaacaaacataagaagactctgaaaggtagagagagaaagactgagattgagtagctagggagcttgagacccaaggaacagcataattgttagttcttttttttctttcttgagacagagtctcgctctgttacccaggctggagtgtggtggcgtgatctcagttcactgcagcctccgcctcccaggatcaaatgagtagctgggattataggcatgtgtcaccactgccagctaatttttgtatttttcatagagacggggtttcaccatgttggccaggctggtctcaaactcctggcctcaagtgatccaccaatcttggcctcccaaaatgctgggattacagatgtgcgttactgtgcccagccaacttggtggttagttctgtgggctcagtttcccgccccccccgccgcataagaccctttcaggaacctgggctgtgttttgcctcatatatcccagacttggagctaaagaagctagcaacctggaaatcctactaggcacaaacaaaaaaagcctcaacagaaggtgctctctagccaaaggggcaggaaaagagcatctcagcaagacaaaagctgttagactgtactttctcctactccagtcaaacaccgcagaagaaactgtggccccaccctaccatgccagtcaaagaccatgccaggagcctagacttccacccttcccaggttgtagtgaagcatctcagcctccttgctaagtggtgtcaaagttggagtagggagccaagacttttatcctagccaggcagtaatgaggcccctcccatgtaagtagagaacaaatggagagcctccactttcaccccatccagccataagaggcaacccttcccttcacactggggtggtatcaaaggaggcccagcggagagtcaaagctttaccatcatgtagtagcaaggctcgcttcatggtgtcaacaccatgtgaccatgtgggggaacaataatgagacaatcctaccccttctacccagggaggcatcagtggaggcctagtggggagctggaactcccaaccctgctaagaagcaatgaggaaacccctccccacttacatgttaatggaggctgagtgggaaacctgaactacccccacctgacagtaatgagacagcacccccccacacacacccactttctctgctagagtggtgttagaagaagagagctaaaacagaaggattaaataagatccagagtgtcataacatagtacctaaaatatccaggtttcagttgaatgtaatgcatcatgccaagaaccaggaaaatctcaactgaaaggagaaaagacagtgacagagattttagaattacctgacaaagattgtaaagcagtcatcatagcatcacttcagtgagcaattataaacacatttgaagcaaatgaaaaagtagaaatctcaacgaagaaagaggtctcctcagtgcaggtttgaaaaaatttacctctctttcaaataacaacaaatacaaaactaaattaaacagttttcttttttgcttttctcttcattcttaccaccctaaagaagttgtctttaacatctgttttcttctccgtttctttatctgatgtatctgcaagattttaccttctacatgtctttggaatccatccatgaaggcaccatgtgccttattctaagttacagtcggtgcagtggcctcctaattgttcttcctacttgtactctggcctcattccaaatacaccttcacactcctgccagagcagtcttttcaaagctcttattttaccacagcactctcaaccccctacccacttttaaaaatgtttaatggatttccgttgttcttaggttaaggacccaaattcttaaaatggttttcaaagccttatgcagtctggctccatcctcatcctcctctattttcttacactttgccacactgatttcttttagatccccaaaccactgtgatcctttctgccacaattaatttgcatgtgctagtctatctttctgaaatatttttcgcacctcattatttagttagcttctactcattcttcagatctcagcttaagggttactttgtcaggaaaatctctcctcatccctaatttcctggcaggttcttttgctataccattttgtagagttatcttctatgtctgtgtttcccacttgagatgcatgacagcactgattgtgtttttgctcagtgctatatccccagctgctacctgacacatatagacaaaccaattaatatttgttaaatgaatgagtaaatctctctccttaccttctttatccaactttttaagagtagtcaatacttttttgctttctttttgtccctattgttacggccataatcttttgctctttaattctggaccattgtaattatataatcaaacttctgctttagtgttttcccatcctttttttgtttcttcacgaagtctgagtgtgtcattactctgctcaaaagcctttccctaagacctgaaaccataaaaattctagaagataacattcaaaaaactcttctagacattggcttaggcaaagacttcatgaccctgaatgcaaaagcaaacacaagaaaaacaaagataaatagatgggacttaatttaaaaagcttccacacagcaaaagaaataatcagtagagtaaacagacaacccagagctcgggagaaaagcttcacaatctatacatctgacaaaggactaatatccagaagctagaaggaactcaaacaaatcagtgagaaaaacaagcaatcccatcaaaaagtgggctaaggacatgaatagacaattctcaaaagaagatatacaaatggccaacaaacatgaaaaaatgctcaacatcattaattatgagggaaatgcaaatcaaaaccgcagtgcaaaaccaccttcctcctgcaagaatggccataatcaaaaaatcaaaagtaatagatgttgatgtggatatggtgaaaagggaacacttttacactgctggtgggaatgtaagctagtacaaccactatggaaaacagtgtggagattccataaagaactaaaagtagatctatcattcgatccagcaatcccgttcctgtatctataatgaggaatagaagtcattatacaaaaaagataacttgcacatgcatgtttatagcagcacaatttgcaattgcaaaaatatggaaccagcccaaatgcccatcagttgatgagtgaataaagaaattgtggtatgtatatatatatatacgtatatatatatacacatactactcagcaataaaaaggaatgaaataacaccattcacagcaacctggattgaatgggagaccattattctaagtgaaataactcaggaatggaaaaccaaacatcctatgttctcactcataagtgggagctaagctatgaagatgcaaaggcataagaatggtacagtggactttggggacttggaggaaagggtgggaggcgggtgagggataaaaagctacatgttgggtgcagtgtacactgtttgggtgatgggtgcaccaaaatctgagaaatcaccactaaataactttttcatgtaaccaaacgcaacctgttccctaaaagcctattgaaataatttttttgaaagcctttccgcttggtcaaaaaataaaagttctccttagcactccaagcttttccagactgaccctaggctactcagggataccttatgcccagcaatactgaatttacttgagtccattggctgtatatattttttcacattgttttttttctttgcctgcatctttgaattttggagttctaaaggctcgatggtctttttactgtgagccatgaactaattgaatgaattaattctgccaagcaaatggacattatttctcccagcctttttttaaagggagtaaaatcaatcccgttaagaaagactgactgctatgctactggtactcacatatgccaaatatcaggcacatcaagtatcaacaatattttttagtgtaattattagatataaattactgtatctcgctttcaaaaatgacaactagtgtttcaaattatgttcatctcagctgggtatcatatgtatacattgctgatttctcatttgatgaacattaagttttttgtttctgaaacttagtagtaaattttatccaggtataaaatgtaggattttaatttttgtaaatttttcttattttgtgaggcaccaaagacccgtcttatctctccatttattttatcccagtcattcctgctctattccattatataatatcttacttctgtgtttcatcaggtaaacctgggatttaagggtgttattaagacatttctgataggaaggttgcttgataaaggttagtcatgaccttgcagggtcgtatttcttggagaagtcaccaaatctgattctggctttcagctttctgtgtccagaaacttaatcaagtttatcagattcaggaagactgattacctagactttacaatgtaatgaaatttaagccagactagcactttatttatttagaatgagaattataaatgtggccaagactgtatagtcatttcctctgattttttttttaatcctataaggaattcttttttttttttgagatggagtcttgctctgttgcccaagctggagtgcaatggcgtgatcttggcttactgcaacctccgcttcccgggttcaagcgattctcctgcctcagcctccgtgtagctgggattacaggcatgcaccaccacgcctggctaatttttgtatttttagtagagatggggtttctcctgtaatcccagcactttgggaggccggggcgggtggatcacctggggtcaggagtttgaggccagcctataaggaattctatatgaaaagccaaattataatcagaacgttttttaattgatccatggacacagactagaaatgtaacagtattaagatttggaagaaaagtccagcctgtgaaaaccagtttagatgtggaacttcaaaataaaaatgtatgtatacatttattattgtgtttggtactgtattttgaatttatgtcatctctgaaagtgacttttaaagtggcagctttaattaggtacttgtccctagaattaactgcatctcttgccctatgtcaggtacctttatatgtctgattttgttagtaactctccaaattaactaaacttgttcactttatacaaatttgatcagagtattgattgttcttcaatgttataggattattttcttttctctttaaatcggcttaaataactctgtagagttggccagtattcatcaacatcctggttgataatggcatgatggtgactgatttgtgcccagctaccacacccagggagctgctctctggcaaccattctctctttcttcccttcctcttttcctctctctcctagataagctaccatagggaaactttcagtaggcactgtgaccccatgacttactgtttcggatctaacattttgccctctttatgttttctttctgttattaatctcagtgtggcatagctgtggtggtgtaactaactctcagattgattccagacttcaaaattacataatttggaaaaaaactggccagaatagggagacagggatgggctgaaggaagtgaaattggttccaagagtgatacccctttggaaataactagaagtgtcagggataattcattgtaacatttgatttgcatttgtgatatttatgcatgtaaaatatgagcaaagcaaattggactaaattaaattctggtaattttatattagtcttggttcatctatagctatataaataataatactctttaagtgttttctctattttatgtggagagtttttcaggtattattttcctagtactgaaatgtatcttttttttttttttttttttaacacagctctgaaagattggtattgctggcaggtggtagcctggagatcagtgatgttactgaggatgatgctgggacttatttttgtatagctgataatggaaatgagacaattgaagctcaagcagagcttacagtgcaaggtatgtaaatatttactgtataatttaaaaatcctgtgtactttctgggtctgctaatttttaagaaatattaacatgggcgaggcaatacagcaaaacaattaaaagcataactcctagaccagactgcttgggtttaaattctaaatcttatatttcctagatatatgactataggaaacttatttaatttctctcaacctcattttcctcagctgtaaaatggaaataataagaatatttaccttattgggatgatttgagggttaaaagagctaatacttataaaacccctggaatagtgactaggatattgtgaaagctcaatgttagttattgttgttactatttgtagtggtggtggtggtggtggtggtgacaggaagggtatgatctggggcatctggaagattcacttttcttgtctcaggatgttttctgatgaagacgtctctgttctgtgaccccgaattatttctctcctctctgttggtgtccttttcttttgggtgaacagatcacccaggaaggagtacactgtgcctctcaatataacttggtttgatgatttggtgtttattttcctctcttcatacttctgataatcactgcaagggtagttgttcttcctttttctcctactcttcccttttccccttataggttctttgattcagacgtcagaaaataaagatggcatgactacatagtcttgtttttatccccatttcctgtgccattcctccatatggaaatgtaccctcaagtgctggctagaggtgactaaagtgaccaaaggtcacttttctacctcttcttcccaccccctcaaaactcccagattggtagctttcaacctaggaagactgctcccagtgctgtttctccctaagagttaggagtgctgtttcactcctaagaatgaaactctgaccgggactgttgcctgaggaatgccccacaaattggagtaaatcatagtggttctgaggttcctggggttctttgctcggggcctcagcctcctcttttcttaagttcaccatttagatacaattaagacctggcctttagtgctttcacaaacatatatattaccagagtggttggtacccttgatgcacgttagtttatagccaagctgaacacctgaataatacaattactctcagattggcaaccaagtgaataatgtatgctatctcatagataattactggaaaagactgaccaagaattaaaaataaccataaatatatttaaggagataagaaaaatatttgcaatatgatgcaaaaacaagaaaatataaacacagaaccaaatagaaatattaagaatgaaaaatatactaaaaataaagaataaagcaatctgcatgatagagaaaggtatcccatttttaaattttgttttattttgattttttttgagacagggtctccctctgttgcccagcctggagtgcagtggtgcagtctctgctcactgcagcctctccctctgtcacctaggctggagtgcagtggcacaatctctgctccctgcagcctcgacctcctgggttcaagcgatcatcctgcctcagccccacaagtagctgagactacaggcatgtgccaccaggcccagttaatttttgtatttttggtagagatggggtttcaccatgttgcccaggctggtctcgaactcctgggctcaagtgatccacccgcctcggcctcccaaagtgctgggattataggcatgagccactgtgcctagccagagaaaggtataacattgatgagcaaactcatgaattggaagattacattgaggaattctctgagaatgcagcattatatgataaagaaagataacacatggagtaaaatctaagagatacgataggtataggtagaaggactatctagataaataggtgtcttagaggagagaaaggaagagggaaatatttgaagaaataattaagataaatttttcagaattagacttgtagaacaccttagactaaaaggactagtagactgttaaataggtgaaagaaggaaaaacccaccttgaggcccatttacagtaacatacaataatgtataattatatatacagtaacgtataatatcaaagacaaaaaaattctaaaagcttccagtgacaaagagcagatcacctacaaaagaaaaagattggattgtacctaagtgttgatttgagaaatctggtatcgggaggacaatagcgtaatctttttaaggtgttaaaagatgttgaatacacacaatttatatgcatccaaaatgtgagacataataaaaattatcacacaagatctctgaaggtttgctgcacaaagatacgttgaaaacacttttggaataaatactcaataaaagatatacctgggaaatactgcaagagccttttaaaacaaagggggagttggccgggcgcggtggctcgcgcctgtaatcccagcactttgggaggccgaggcgggcggatcacgaggtcaggagatcgagatcatcccggctaaaacggtgaaaccccgtctctactaaaaatacaaaaaaattagccggcgtagtggcggccgcctgtagtcccagctacttgggaggctaaggcaggagaatggcgtgaacctgggaagccgagcttgcagtgagccgagatcccgccactgcactccagcctgggcgacagagcgagactccgtctcaaaaaaaaaaaaaaaacaaaaaaacaaaaaaacaaagggggagttttaaaacagctcccagattctttgactatccttctatagagtggtggggtttatgtccgttgctcttgaatctaggcaggcttggagctatttggatcaatagagtatggcagaagtcatatgtgacttccgaggcttataaaaagctgtgcattggttgtcatacttggagagaatttttttaaaaggaaaaaaagaaaaagcagtgcggatttttcctggctctctcgatgctaagaatatacaatggggaaagcatagtctcttcagtagatggtcctggaaaaactggatagccacatgtgggagaatgaaatcagatccttatctcatatatgtaaatcacatatacaccatacacaaaaatcaacccaaaatggattaaacacttaaacataagacctgaactgtaaaactactaaaagaaaagaggggaaaagcttattgacgttggtctttgcaaagaccaacgtttttttggatatgaccccagaaaacacaggcaacgaaagcaaaaatagataaattggattgcattgaactgagacgctcctgccagtaatggaaacaatcaacagtgaagagacaacctatggaatgggagaaaatatttgcaaaccaatgaaaacagaagaagaaaatgataacaagagcaaaaattaatgaaataaaaaaacaaacattcaaaacagagaatgtcagcaaagccaaaagttggttctttgtaatgcataacaatattgataaatccctgggaagacatacattacttgacagagatctttatctagacccggggttggcagagtacagcttgtgggctaaatcttcctgactgcttgtttttgtacagcttgtaagctaaaaatagtttatatatttttaaatagttgaaaaatatcagaagaataatattttgtgatacatgaaaactttatgagatttcaaaatttattgttcatgcagtcttactggcatactgccacactcattcatttatgtattgcctatggctgctttcatgccactacacaggagttgagtagttgtgacagagaccatatggctcacaaagcctaaaatatttactgtctggctctttacagaaaaagtttgccaatccctgatgtaggttttacaaagaactcctacagatcagtaagataaacaaagacagaaaccaatagaaaatgggcaaaagacttgaacatcgacctggaagaagatgtctagctagctattaatatttgaaaaagtggttgtcgttattagtcttcagagaaatgcaaataaaaaccatagtgggatatcactgtattccactataatggctaaagttgaaaagctcaacaaataccagacattggttaggatgaaaaccactggggactctaatgtactgttgacaggagtatacactgacacaatcactttaaaattctgcttggcagaatctattaaaaactgtacactggctaggcgcagtgactcatgcctgtaatcccagcactttgagaggctgaggcaggaggatcacttgaggccaggatttgaagaccagcctgggcagcatagtgagaccctatatctacaaaaaatgaaaaaattagctaggcatagtggcacacacctgtatttccagctactcaggagactgaagcaggaggattgcttgagctaaggaatttgaggttacagtgaactacgattgtgccgctgcattccagtctgggtgacaaagcaaaaccatctctaaaaaataaaaacttaaaaaaactgtacacagaaataccctatgatatagtagttgtattcctaggagtatacttaccagaaatgtataattatatgcccccaaaaccatgcacaataatgttcttactgggaataattcaaatctccatcaaaatacaaatgtagagtagtcttccagtcatacaatggcaaattatcagcaatgaatattgacagatcactgctacattcgacaatgtgggtaaatatcacaaacacccttgaagaagccagacacaaaagaatacctactatatatatgtaattacattgttatatataattccatttgtgtaaacttcaaaaacagacaaaactaatctatggttttagaagtcagaatactgattacttttggagaagggcagaatcgttaccgaatgttgcacagcccggcttctggtgtgtttatgttcagtttcttaatctgggtggtagttacaattcaagctgtattgttcatgtgtgccacatgagatcatctctttttttactgtttacagattataactcataatgtgcaaaaacatatttggaaaattttgttttgagccctgtcccataattgaaagcatttatttttcagatagggaaagcagattttgagaaatagttggagagatatatataaatacagtcatacctgtctgacttctgttatttttttaagaagttatagctataggaaatgccatagtgagtgttaatgtagaaaaggttgtaagttcatttttcatctgttaaatgtttcagatttattgtcttatcattaactcctggagtttctacacatgcagtgacgtgaattagcccatcatgtatttcctgtcatctcagattgttgataacacttaaaatgggtcatgagggttttttaaaacagaaacttttcctttttctcttcaaacagttacaacagtctgtgatacacatgtctcccgtgccaccaaaaagaaatttttccatttgtatttttgtggaacaaatggataaattctaaattggctacccctttgacattgtaaatacctataactaatctaccacttaagttttaaacctcactgtctttccttaagccacagcctatgtcactctacttctttgactcttctgctctactcttatccctggccacattaagacattgatctccccttttctctcagtctttgtgatttcacttccctttacttcatgatcagttacaatattctgctgtcattcattagaactcttagttctcttggcttcgggataaaaagcaaattccttatgtcatacatacagagtacatccagatccttcatagttggctttttcagcgttaactggagaggcaccacagaggagtgattgagagcaatcttgccccagtgcgcctggattccagtctcagctctgtctcttagctttgtgaacttggccaagttaattaatttacctatgtctttgtttcttttatcagttgaatgggttgttttaaggattaaactcttttttttttagaagagccagcataaagcacttttattgtaataataaaattggaaactcatatgtgatgttgtggggagaggggcaacaatttctgtcaccagttcactacacaggacatcaaaggagtgacaagggactgaagaaggaaaagccaggaaacgttgagatcagcagagagagtcaagtggcagaaaacaggagatgttgaagctgcgatgacaagcatcatttgcttaacattcaaggatttgtcatgatagctgggctttcattgggtggttaagtctacaaacaacacctttaatttatactttcaattaaagttcttaaaattaaggaagtggtggagcttggaaagttatgagattacaaaatttctgaaagtccattagaaaagccacaggatggggcagaggaaataagccaggccaccaagaaggcttcagaggtccccgctggcccagggacagatacctgtagcatccaacatcgcagtgaaaatgatctgctttcaaaaggcagaggatttcaggggagggtagagtggaactgatggaggcaaaggctccccatccccacctcagtttttggtagggcttttaatttaaccgaaggacatctttcaactttgagaataattcagccctcaagagtgcgtcagatctgctatggctttgcagcgcaacagcaagaatgtttagtatataatagattaaaatttcatccaaaaaaaatttaaaataaagattcttataacctccccccacaacactaaatcctgttctaaagttaaccagtcacttgttctgttaatatttgaccatagacttacttggaaactagatcgaaaagactgaagctgaatcatcaccccaaagtgaaaatgaaataaactgagtaacttaaggcttatggcatatagtttaagtaaaatgagaagaaagaggaagaggaaatggaggtgccagaagcaaagctgagtgacagaacgcattcagtcagggtagatgttatacaggttgtagtggatctacatgtggaaaagctccatatggatttatgtgcatgtgtctggaggcaccagatccttctgtggcagatgtaagaacaggaagccaagggaggaggccattcttgccatcccagtcttagaagctccatgttgaagacaagagtggcatgatgccctggtgcccagtggcactgaaagcatagtctagagatacattcagtttggctctgtgacccacattcatctgggcaacccctacctcccactcccgggtcaccttctgcttgcctagcacacacttaaagggctcatttctgtcctttgaagagtcaaatttctttccatcttaaagcatcccggcttccggaaggtatccaactcctggggagatgatctccaccttcgctcccaggacatcggcggatgccggtgggcaggcagtgtggactgagagggacctgtcagtggttcccaggctctgcctcatccctgctgtccatcatctgcacacatgggcacccccgcacgccccgtcctgcactaggagtaaattcttagcactttccccctaaatctggaatggagatggagtcctctttaccaaattagttttctgaacatactgtgctgtttgatagcagtgttcccctgtgtccccttacttccaactacaatttcctgatagaccctcaagattagtttacttgacccctctgtgaagcttttcttaaccatcccctcataattggtttcttaaaatagttctctttttaccagtagtatttcttactgatttgtttatatgtcctcttcaactcctactagactggagttcttatcaacaggaactggtcttactcatttttaaaaatcatagtaggttattaacgaatggaatgagtgaatgaaactttaaatggaaattgttaaatgtggcaccagaatgatttgatttgatttgatgtttgtggttactttactattcatgttttcctttgcactttgtttttcatagacttctaatgtaaaagaaatgggattaaaagaaaaatcttctgaaagttattctggaggaagatgaaccattacctctacttttatgattgaggtcataattgccaccttcacatgcatacatgtttacaaacaattcatcagttttattcattcccatttttgaccttttgataccttccataagccaacataatattaaaaaaaataactgaagccattaaaggtgaactttcctccacatggctgccatctctgctttaaaaactcttacacatttattactgtcatgattcaaagctaagtgcattgacgtctttaatcccaactccatgagatgctccactactttgacttgataccagtgtgtcatgctgtttctctttttatttctttgcccgttccttttgttttgccttcatgggcatcttttcttccacttgttgattaaactattagtgttccaccgagttctgttgtcagcctgctactcttcacactctacctgcttctggtttcaggtataatttacatacagtaatgcccagattcccagaccagaccccttgtcaagcttcagacatttgcaattggatgtcccacaggtacctcagaaatcgcatgtccaaaattgaacttaacattcttctctcaaaatatttttcttctttgattttctgtatcttgatagtgtcactgcctacctttttacctgtgctagaaacatgaaaatcattcttgattatttcaatctttttattttttttccacattcagttcattagattctctttctccttgctttcactcccctgattcaagtccaagtcatctcttacctatattactgcagtagtttcctaactgatttctctagttctaacctggtctctcctcaaatccattcttcacagagtggcaaaagtgattaaaattctttcattaaaaacttggaaaaatgattgcaatgatataaatggtgcttacaaattaataagaacaagattaatatctgttaaaaaaggggggaggtggaaaacatagtttgcttacagaaatgagatgaaaatggccagttgacctgaaaagagttcaaccccactaattgtataagaaatacagattaaagtagcccatttttgcgtactgattgaattttaaaataataacctactcttggcaaaattatatggggattctcatacactgctggtagtggtacaaattgatgtaaccttggagggcagtttggtaattttatcaaaagctttaaaactcacacattcattgaccagcagttccacatctgataatttgttttgatgaaataaggatgtgtgcaaagatttatgcatggaagtatgcatgcaatgatgtatatttagtggcaaaaattataaaccacttaaatgcccaaaaataggtgattggttaaataaaacagcctacctatgtatcagaatacaatgcttcctacaaaaatcatgttttagaagtttgttaaatggcaagagaaaatactttgggtatattaaatgacgaaaagtaagatcccaaagcaacatgtgagaagtatgatttgtgccacaaagttacattgtaaattgcatcagatccttgactttcttataaaaattagcctcacaccaattaggaagaagctttatgtatcttcctcttgaggccttctccctgtaattttcagaatactggatgtttacttatcttgaaaggatcatttttcttctaagctccaagcagagagagaactggattctgagtccattaatgagtgcatgattgtcattgcttctcaaggtaacttaatttcaagggcaaccactagctacttaaaaacaccatgcagttattttgcttgtactatcacttctgcctagaatgttcctccttccactcccttgcctggctttcctcagaaacctctgaaactctgactcctacctattcctatcccttgtacccttcttccattagctgtgcattaattatgcacatgtattttatacattatctgtcttgttttacgtatcacatttacattttccccccagtttttgtatccagtttctaccctactagactgagttctttgaggacaggactggatcttgtcaatctttagatccttagcacctaatgtagtagtgcctgatgctgtgtatttgaccacaacggattgcttaagaacatattctccgtacttctggataagatgtcagacagtaaattataatccattcttttatagtatgctatctgtattcagaatatttcagaatttcactttataaactttatatttttaaggtattactgtatgttagaaaagtctttacaattgctttataatcctttattggggccttaatcattttggattggtttgcagttcttcttagatttttattgcatcagtggtcatgttagctttgagataaattccacattttacaagcttgaaataatttcctaatagttatgtaaatttattctgaaccacagtagcctcatttccatggtaactaaccaccttcagaagagaactttcagatattctagaaaagaccagaaatatccatgtgaaataaaatgaactaatgatgtaaagttagaactcagatttatgtggagtacagatgcatgatattggaccctgaaaatgttgcagatagaagagccgttcaaagacctgaagattctgcctgtttgctgtttgtacatcaggcaaaatgcaacctaagaaaaactcagctgtattgtgatttttgttactaaaatgaccccaatgaggaagctttgtgggacaaataagcaaaattcatggtgcagaaatggatttgtggtgccactaagagattaacattgtgcttcacagaaggaatgtggtctcatgaaaggatatatggtttttggaagcatatccctgatttcgagcctctggcaatgtgatcttgggcaaattaatttatttacttgaacctcattcttcctatttgtaaagtagggataagagtccttctttgtggtggtgttgtgaggaatatccttgatacagtgcctggtacattataggcattcagtaaatgtacctcagctaatgttcccagggctcagagaatctttcctttgtaagactccttcacttgattctgttgtctttgatttcttttttgccttctaaaggattctgtttcctccttagattatttaaattgacatctcagataactttctgtttgcttttgttccatgccaccagccatccatcagatggcaccatgttttgtggtctttgagccaagccagtcacaccccattcctcatgcccagtctagcttcttaggctttctcacctaagtctgtgcttgctgggctcctgcctatctaggacaacatgacaaaatactagtaaatattcttcattctttatttaaagagcataacaattgataatacgaggacaaagtcatgtcccttccagcccagaagtaagtgaaaagatttgactatcattgttggcattactctgcttcttaggttatctgtcttgatctcagaatttcaagcattccttaataattagcccactctgggtctcttatttattaattttaactatcttttcttggatatatattcttttattgtatatattcagttttattggtggaatgtcttttttttttttttgagacaaaatctcactatgtcgcccaggctggagtgcagttgcgcgatctcggctcactgcatcctccacctcctgggttcaagtgattctcctgcctcagcctcctgagtagctgggattacaggcacccgccatcatgcccggctaatttttgtagttttgctagagacgggtttcaccatgttggccaggctgttcttgaattcctcacctcaagtgatccacccaccccggcctcccaaagtgctgggattacaggcatgagattatactgcacctggcaaatgtttttcatgtagtatttactaccttatttttattgaaccatatttcttctgccttaaaggggtatcatcaaatctacaagctttggttaagagaaccatgacaggaagaatcttagtaattttaattatattgtcagtaagcttcttgtattaaatatattgaatctcttaaacttcatttaagaaattcccattctcctcttcaattttagttaggttcccctttcttcattaaagagatgatagaattaggaacagcaggaaaagtggagcagttttataatttttttaaatgccccctttcttgctaaaaatcaaactaaagagctccaaagtgggcagtggaaagataatgtcctagtgaaaagaatatctaaaacaggtttcttcattttgtatttcttcccccgctacctatttctacccctaactgttaagggtgtattgatggcactttcatataaacccagtttacacacaggaatggggtcttaccccatcaggtccccacaggagcattttatatcagagcagcacagttaccctcagtttatctgaaagttacatgcattgaatggtgatttaaattctgagaataactgacaaaaagctaaatgaatctaaattattctactttttcccagtccctattgtaatgataaccaagatttctttggtcttttttggccagagaagtctcttaggttgaaatcatatcagtggttttcaaacttgtttttttttttttggccagggaactcaagcaaaatcataattggaagtgagatatttaaaatagataaacatggaactactcagatggaagcagggcagggtaggaatagttgccacacccagaccctccattccttgtttagatttttttcttgttgatgatttcaaatacagagttttgtccaggggccgtagctcatgcctgtaatctcagcactttgcaaggccgaggcgagtggatcacgaggtcaagagattgagaccatcctggccaacatggtgcaaccccgtctctaccaaaaatacaaaaattagctgggcgtggtggcaggtgactgtaatcccagctactcgagaggctgaggcaggagaatcgcttgaaccctggaggtggaggttgcagtgagccgagattgcgccattgcactccagcctggcgacagagtaagactcggtctaaaaaaaaaaaaaacagggtttcagtgaccatgttaaaagtaacagcaaagatacttttcaaacactatttattctgtatctactgcaaataggcagaaggcagaatccagtatcactggagatacaatgacatatagggcacattctcatcttcaaggatacagtaggtgatacagagaagtagttagacatttctgtcccaggatgataaaaactataagattacgtgtcaactatgtctttgagacttattcttgtccaggtgatttcagtgattcttgtgcagaaagtagaaggaaaaaaaagatacgatatttttaacagataaatttattctttgaattcttaacatcacattatgaattagaaatgatagtacatctaaacatttttaaaatatttaagaaatttttaaattactacataatatttgtacatatttgtgggatacatgtgatattttgatacatgcattcagtatttaatgataaaaatcaggatatttgggatttctatcatctcaaacattgatcatttccttttgttgggaacatttcaaatcttctagttattttgaaatatatagtatgttattgttaattatagtcaccttattgttgctatcaaacacagaaacttatttcttctatcaactgtaggtttgtacccatttaccaaccttcttcatcccctctcaccttgatctcttgcccagcacacacacctttcccagctcctggaacctgtgaaagatctaattcagtaatgatcacagacctaaatagtttgtagtttcaaagcagaatttacatggactgaatttgacttgtgaactttgaaatcctgagaaatgggtcagatggttgttctgtgccattttcaaaaccaaatcattttgtaagatcctgctgtctgccatcctttttaaatcatgttttacatagtatttttttaaaagaactatttttcagaatacagtgcttttctcctttttaaaaaatcttaatcatagtaatttcccaataagaaagcaaaggtggtaaagaatactttttcctaaggaaaaaatattttataattgttttcaacatttttttgtgttagacatttttcataataaaaagctgaaggaattttacagcaaatacccaccaccttcagtcttcagttgacattttactgtaatgctgtatcaaatatctatcattatattaatcaatctaaattttttgttacatttcagagtaagttgcagacatacccagatccttaagcattcatatcattagctaagctttaatattttgtttgcagtttttttctctttcgaggtaaaatttatatacagtgtaatgcacaaatcttagatgtgctgtttatgtgttccagcaaatacacattactatacaaccaaaacccatattaaaatataaaatattaccaccactgcagaaagtttccacattcctcttctcagtaaatcctctgcttactaccccagagggtctattcttttgttttttattccccactataaattagttttgtctgtcctaaagcttcttataaaagtaatcatgttgtctgtgtttgtttgtttaaggcttctttcacaaagcataacgtatttgaggtccatccatgttgctgcttgtattagaaacctgttcttctttgttaatgagtagtatttctgagtagtgtatgccaggccttttcccagagtggtcataccagttcacattcctaccaacagtgtatgtgagttctggttgctccacattctgacccacatttagtggtgtcagtcattttaactttagtcatcctggtaggtgtatagtagcatttctatatggttttaatatgcattttcctgatgagtagtgatgttgaatactttacgattgcatattggctgttctggcatcttcctttgtgaggtattttctaaacagtgttgatttcctgggtagatggtacatgttatagacatattaaaactaattcttaaagtgttctgtcaggaaactgtctacttattgatacctgaaaatagtggacaataaaaaaaattgatataatttcaagcctgttttacatgtctttagaaatagttgattttagctattatttatttgtgagtttgttctcacactgctatgaaggaatacccaagactcggtaatttatgaaggaaagaggtttaattgactcacagttctgcagggctagggaggcctcgggaaacttagaatcatagtggaaggggaagcaaacatgtccttcttcacatggtggcaggaaggagaagtgccaagcaaacccttataaaactatcagatctcgtgagaactcactatcatgagaacagcatggaagtaaccacccccatgattcagttacctcccacagggtctctcccacaacatgtggggattatggaaactgtaagtcaagatgagatttgggtggggacacagccaaaccatatcagcttctattttgattattttgggatttgaacattttctccatgtaaccatttgaaattctcttgaagaagcaaaagaacaatctcatgtgctgtgaaatacctgttatttataaatggattctaaatatttttggccacataaactactggttcagaatatctgtgcctttagtaaataattgaatttgcctattgtattagtcagggttatccaaagaaacagagccaataggaagcataagttttccatataaataaataaatacataaatacatgtatgtgtggtgttatgaaatatgtatacatatattggttttcatccccagttcctggcgcatatctcccatagcctttgttacagtcttctcttatgttgggtatgttaggcctcaggggcaggccttaggaaacagaatctctctgatcttctcctgccctcctttcacctgccccaaggctctaatcttccccagcctttctgatggtgggttttaggacccttcccaaagaggggcccacctcatatgctggaggaaagaatactgacatcatgaagctttcataaaaactcgggaggagtgggttcagagagcttctggatagctgaaaacatggacgctcctagagggtggtaccccagggaggacatggaagctctgcgcccctttctccctacctcaccctacacatttcctcattgtatcaatgtcctttatattaaaccagcaaatgttaagaaagtgtttctctgagttctgtgagccgctccagcaaattaattgaacccagagagggagtcctgggaacctccacttgaaacacattggtcagaggttctggaggactaggcttgtaaccggttgggggtgggaggaattctggggagtgagccctcatcatgtgcaatctaatgctgtctgcaggtagatagtgttggaattgaattggagaatacccagctggtgtccactgctaggtgtgtgggggggaaactcccacataatttggtcacagaagcgttcttctgtgttgatgattgtggtggtgtgagagtagaaaaaaaatgcagcttgagagggtgtttttgaaactgtgggtgtatgtttagagaaagagagaagagacttttattataaagtattggttcacgtgattatggaggctgagaagtcccatgttctgctgtttctggagacctgagaaagccagcagtatagtttgaaggcctgagagctggagagtcagtggtttaaattctgctgtgagtctgaaggcctgagaaccaggagtgctgagggtaggagaagatcagtgtcccaactggaacaggcagaaaacaatttcagcctttttgtttctcattggactggatgatgccaacacacattgagtgccatctgctgtaactcagtccacagatccaaatgcttttctcttctggaaacaccctcacagagaggcacagaaatagtgagtaaccagatatctaggcatgccatggcccagtcaagttgacacataaaatttactgtcacacatagtatactcgtcttcatctaattacaaatagtttaaaaatctaattacaaaatctaatcactgcattggcaaaacaccatttctccccaaaaccctggagaaatcttcccatgcttatgaggtgtaaattatttgtgaagcattggccctacctgaaatctgggtcaaagggaactacagatctagagcatatcacaccagtgtgttaaagtgaaaaaataatgtaagcaagttatattggcgaaagtcgttattgtcagccccttattctgggattgtaatggttgatttccaatgattacgtaatataattatactttaaatgtaaataatgctttatattattgagggtctaaagggatttaatagataaagtgcacgttacaatacctgacttacatctgatactgaacaaaatttagttctctcttgtaaaaccctatgtagaggtattgttattagtccactgactgataaagcttctgaaagcctccgaattatattttcctctttaaaccttatcaaaaatagttgttccattttaaaatactgcaagagttagggtagtagaattatgaggcattttgacttgccaagaaatttaattatagtagaaataatatcaagcaatttttattttatttccaaggtataatttatactgtgtcacatttacattatatggatatacctgacaaatttttaaaatatctttcatattaacaagaaagtattttcacatatattaggtcttatgtccttttaaggaaaattgatttccctaagattacaaaacacatttggaggcaaagcccagattaaaagctcaggacttctgattcctagtctagtattctttaaaaaaaaaaaaatttgtaatagttggtgtatatatttatcgggtacatgagatattttgacgctggcatacaatgcttaataatcacatcagggtaaatggagtatccatcacccaagcatttatcctttgtgttacaaacagtccagttattctctcttaattatttaaaaatgtacaataaattattgttgactgtagtcaccttgttttgccatcaaattctagatcttattaattctaattatatttttgtgctcattaaccattaccccccacccactacctttcccagcctctggtaaccatcattctactctctatctccatgagttcagttgttttcatttttagctcccacaaataagtgagaacatctgaagcatgtcttctgtgcctggcttatttcacttaacataacgacctccagttccattatctgatatgagcgtagctagtcctgctcactttcagtttctcttggtgtgaaatatctttttccacccttttactttcagtctatgtgtctttacaggtgagtttattgcaagcagcatatagttgaatgaagtttttaaaattcattccaccaatctatatcttttaagtggagctcttaatccatttacgttcagcattaacattgatatgtgaggttttgatcctgttacattgtgaattgttttctagttgttttataaatttgttgtttcttcttctgtcttttggcttgatggaattctgttgtgttgccatttgattcctttctttttctttttttgtgagtttgttttataaagtctttgtgtttttttttttaacttgtgttgtcatggtggtgaatgtcaacctttcattaccacatttaggtctcctttgagcatttcttatagggctggtttggtggtgataaattttctcagggaaagactttttctgggaaagaatttctccatttatgaatcttaatcttgctggatataaaattcttggctgatgtttggtggtggtggtggtgatactgatggtggtggtggtggttttccttactgcactttgaaaatgccagctcattctcttctggcttataaggattctgctgagaagtcaactgttagtctgatggggttttctttataggtaactagatgctttttttcttgctaattttaaaattctttcttttactttgactttagacagtctgattataatatgctgtggtgcatattccaagtcctttttggaatatattttcctcaggatctctaggcctcctctatgtgaatgtctaactctcttgctagacttgggaagttttcatcagttgtttccttaaataggttttctaaactttctgatttttctttcccctcaggaatacccgtaattcacaagtccagtcactttatgtagtcacaaacatcttgaagtctttgttcttttttattctttttaagtttttgtctgactggattatttcaaaagacctgccttaaagttctgagattctttcttctgttcaggcttgtctattgttgaagctttcaaatgtattttgtaattccttcaatgaattgttcagttctagaatttgtttgaagatatctatctcgataaatttctcattggtatcctaaatagatgttctgacttcttggtactggttttcagatttctcttgcaatctcattgagcttctttaaaatcagtatttttaattctttatctagaagttcaaggatttatttttggttaggacctattgcgggagaattattgtgttcctttgaatgtgtcataatatgttgctttttcatacttcctatatctttacattggtttctgtgcatctggagtaacagtcactacttcttatttttgaatttgctttcattgagtggggagactttttattgaagatatgtctataatgttgattggatagggcgttttggctttccttctgggtatgcgcagtggctttaaggattctgtgtgatttccttggctacagatagccttagtgttaaatctgtggatttttctgtgtgttagtgtgcagttattggtggagtctgtgatgaggttttgctggagactggaatgcctcatgggtccttcagtggtagtggtggtgggctaagtatgtctatcattgtgacctggtatgtggtatatgctggcacccatgttggtagttccaggtaggctgattctttggccactgggtggctctctcaaatgcctgttgtagtagaggtagaccatgcaggtgagcagactcttgacctactgggaagccagggtggtatgggcaatgggaatagcagtagtagtgagaagctcttctcattcacaagtgttgtgcccttgttttatcagttgttgcaatgggctgtgcatgtcagcctccaggccagtaggtggcacttgcaggtaatagccagctatattgtcaacagtaggttttatgcctaacctctgtttctgaggacaagtgcttgcacaggtgtcccagatggtggattgagttgcagaattctcaggaacctggatccccctaacctccacttccctctgcggagtaggggccaagctgagtggagctggagcaggcaagcttgtactcaggcctcccaatggtgggtgcatctaccttccttgacgggggtggcagggcagttctcaggcccctggtgaaattcttgggtgagggatgactgttgctatgccgaagtcttaacatgggtatggaggggcagtcccagcagccacagatgtggcttgtgtaagtaggacttacttccttctcatgccccagtcctggcagagttccctcccactcctaactgtggcagcagatcagcctgttcagtcatggcagtgttctgcaactcagtccagggccttaggagatacaacccagcttaatcccaagcctccatggcagctctcctcctgctcaggtcccaagcaggtagggggataccccagtttcagtatcagctgcccataccagtttctcagttctggttgcaggagtccagactcttgcttgagtcccagttcttcaagccccagcccgaatttctgacaccaaagcctggcactgccacttgttcccaggaccatccacagcttgttaagagctgggattgagaatggcctcttactgtagctgcctatatctgatggaatgtatgggacgtccctggagcagttccttgtccagtcactccccaggtgagatccaggattcaggagggtcaaggtgctctcctacagcctggattgtacaattcccctgtggaaacatggactgcagaaatacactcactcaccctctcccctactggggatacattcctgattttcagccagtcctggccacacgggttacctgttttccttcttctcagatgttgaagtttccttttgcttttctcttgaactcccatgctccctcttggataatatatttaaagtgtgattgtctacacacaatttttgttcttctaagtggatgagatatgctggaaatgcttctactcagccatcttggagagaaacttgaaatttctgaagttctgtagatcttatcctaactctgttttattgaaaactttaacaattcctacatcaatactaatactgtttcccttgttgatattttgttggaaggatcccttctcattgttcttttaaaaaaaaaattgtttttgaccaaatgtggtggctcacatctgtaatcccagcattctgggaggctgagacaagaggatcgcttgaggtcaggagtttgagaccagcctggccaatatagtgaaaccccatctctactaaaaatacagaaattagctggcttggtagtgcatgcctgtagttccagctactcctgaggctgagacaggagaattgcttgaactcgggaggcagaggttgcagtgagccgagatcgtcctgctgcactccagcctgggagaaagagtgagactctttttttttttttttttttttttttacaattttttcttctagatggcctgcagattcagcttgttaaatttgataaaatttctcctgggatattaaatggcatttcattgactttacagattcatttcaaaagaattgtgattgatatatttacagaattaagtctttgtagccaggtgtgtgtgtatattattattaccatttttttgagacaggatctcactctgttgcccagactggagtgcagtgtgtggtcatcgctcactgcagccttgacttcctgggctcaagcaatcctcctgcttcagcctcctgtgtaactgggaccactacgacacccagctaatttttgtatttttttgtagagatggcgatctcactttgttacccaggctggtcttgaaatcctggcctcaagcattccttctgccttggccttccaaaattctgggattacagtcatgagccatcacacctgtcctcacttttatttttaattaaatatttttaatagataacatatgaagatgttctagaaaggatatatagtgaaatattactgctatgtcccagccctcctccacagaagcaaccattatttttttcttatccttctagagatattctatgcctgttcaagcaaagaagtgtgtaaaaatagcataataggtgtaacaagcaatcttagagattgtcatcatcaggagcagatccagcttttttgaggtctgcagtgaaaactactttggaggccttgtttaagacagtgagtagcgaggtgtggtaatacacacctgtaatcctagctattcaggaagctgaggcagaagggttgcttgagccccggagtttgagttctgcctgggcaactatagcaagattctgtctcaaaaatttttttaaaaagacagtgaataccaaactatgtacaaaatgagtagttatttagaacgagaaaagaaagcacaataaactagtttttcaaagctgataaacactacaaacgttaccaaaacccagaaaaaacagcactttaaaaatattaccttatacacgtatgtgttgtaatatttgtttttgctgcattttgtttcattgtctcctcatatgtcagtgattttgtaagtcattttctatgaaaatagaaagctaatttggtcttttcctccagtgtttaagatatagtcatttgaatatgactccacacctttgtgtctcggtgttgggtcctgttagtacagtgggcagaaggagtattcctggaagtcttcctatactgagacagtttaggtatacacaaaagttttggcgaaaaccacataaatatatcccactaaacccactaatggtatatgtagctcaatttcctcttgacttctcttaagtacaaaaatgacttcagccactccatcatgacctggcataagggcaagtcaacatggaagcagcagcagtcttgatggactgtggttaaaatagcttactatttggtggttcctaatcttttgctgcttcagtgttcagggaatatccttatgtctttatgcaaatgtgtgagtgtttctgatagatgaatctcttgaggtgaaattgctgtatcaaagagtttatacaatttagatttttatagatattactaaatcaccctataaaagattgtatcaatttatatcatcaccaatatatataagactgcccgtttctcatactcttgttatttgcatattacttacatgagtgaggttcaacatcttttctcatatattaggaaattctgtgtattttcattttgtgcactgtctatatcttttactcagtttttatttgtaatttttttcttattaatttgttggaacttgtatatattagggaaattagttctgttatctgttttccccctgttcattgtctttttacttcatgatagtttttaattatgtatacttttaatttttctatgtagtcctcttgaatatacaaaaaccccaaaacaccaaactgttgtttttcctattctctactttctgctcaacgcagaaaacctctgtgatcccagaatgtgggggttatttccccacacaccaagcagtacttcagtggacacctgctgtatgtcctataattcagttcagttctgacactacctacctttctatttttctaatagaaacagtactacttactaaataccgagtttatttcatatgtatattcttgcctcctcaccatttccatgtagagatatggcactggagagagtgtcatatctcacaggttgagagctcaggaccaccagactaccatctctcttcaggtggtagtcccaagtctgggtctccagaacttctgactgactagctacagattgaggttcccatgatccccttgttgggttttattaatttgctagagtggctcacagggctcagggaaatgcttacttaaatttaaccgtttattataaaggatattacaaagtgttaaacagcatagggcaaggtacgtgggaaggggcatggactttccatgtcctctctgggaaccacccttcaggaacctgcatgagttcagctacctagacgctctcccaaaccctgtccttataagtttctatggaggtttcattgtgtaggcatgattgattacatcattggccactggtgatcaattgaaccttgagctcatctccccttctggagtttggggaatggagctgaaaattccaaccctctcatgtttgattccactgttaggtagccctcatctggaggctatcaagtaccccatcaagacttgtcttattataggacaaaagttgctcctatcacccaggaaattccaagagatttaggggctctgtgtcaggaaaccaggatgaagtccaaaggcagatttcacagtatcacaagccaatatgtttaaattttcttttgtgacttccgagtttgtgtcatacttagtcctccctccaagattatattttttaaaaatctcatgtcttctagtgcttttatggcagtgtttggttttaatcattaaatttttgatacgtatggaatttactttggtgtaagaaatgagatacaaatccaacattattctttccaagtgattacagtttctaggattttttattgagttatgtatcttttccctgatgtaatgtgtcacttcaatcgtatgagaattttcatacatatttgcatctatagttgtgcctccatttttttatttgaatagaaacagtgctacttattaaaatgccgaggttatttcatgtgtacattcttgtctccccaccatttccatgtctgaccactgctactactgtgtcctatcataacattccatatatgcttaaatccaagcaaagggtggatttccatctttaaaaactaagcaggcattttggacaacacattcttggcagtggaacttggacaacatttatcaaacatattagggaaagttctcactctacattataaaaaggacaactgtatatcaaatgttacataagtgaaataagatggaaacatttttaaaactgcttaaactattttcttaaagagactttctccactgccagagatcttgaattacctcctggtcagtcttccagaagcaattctttatataattgacgaacttggcttccactttgggaagaaaaccagctttttctgtacttccttgctgttttgctttaatgtcttctacagaactaggttctcttggtgttttaggaagtttgtttgtttttttttctcctgttttttgaaggattcttgatcttggtgttgatggttttgaatcttttccattttggtttgatttttgtgcatttttggctggagtgtctcatacagatttcttcagtggagcttattcttgtctcctcttcctctccacaacccgggtaaccttgctaccacctccaggggcagatcactttccaaatgtacctaagagtttcatgtcctcctcttcttgatcttctaagcctcttcaccttcctccccagctcctaagtgctgttacctgatatgcacaggccctgaaccatacttcaacccaaaggccatgggtggtgttatttcaaagaccccaagggaaatcattggctgttcaaatcatcatgttcaaagttgccactattactttatttattttgttttgttgttgttgttgttgttgttgttgagacagagtctcactctgttgcccaggctggagtgcagtggtgtgatcttggctcactgcaacctccacctcctgggttcaagcaattctcatgcctcaacctgctgagtagctggggttataggtgtgcgtcaccatgcccagctaatttttgagtttttgtatttttagtagactgggtttaatatgttggccaggctggtctcgaacccctgacctcaagtgatccacccacctcggcctctcagagtgctgggattacagatgtgagtcatcatgcctggccagttgccagtattattttaattggactgccttcgtaattcattgtctctgtgtcaacaatctgcagttcatcatttgcaccagcctctaagctgaccattcttaaagataactgatgctcattttcatcattatccaccttaagatggtaatgtttgtcagcctttggttcacaatgaaaaacatggtcctcaggcctcaggggctcatgttcatgtccattgaatcttccatggggtggtggcacacacttaggtgggagagaaagcagatagaaatgaacaactattgcttaagagaacagccacacaggatggaatcaaaccaggcgattctttaatattttgtttccttaataaaattacatatttttcttcctaaaggttttatactttacttgttaggtacgtatctattttattgtttttgtagttatgaatttggtttttagatttacattttctgatttttttttgatacgtaagaatgtgaatgacaacaaaaaacatgttaatcatttattctgctagtttaccagagatttatatttcattctaatagtttttcagcttattcttttggcttttatttttcttttaaaaattatttaagtaatgcagtaacattattaaagaatcaaaccgtatcaacaaagtaaacctcctcctttattgccccttccccattcccacccctttcctcagaggatgactgttattagtttagtgtgtatgcttccaggtgtcttcaaaaagcatttacatacatgtacatctacaaataaatttttttcattagcagatattatatcatctagtttgctctgcaaattgctttttgtcattactgtatttaaatttctctctgtttgtacctacaggactataatcagtatttaaatgccccaaagcgatgtttatcaaactttaatgtacctgcaaaccacctggagatcttttaaaatgctgaaaccgattcagagggtttggggtggggaaacagagattctgtatttctaataagctcccagatgttgccagtgctattggtcctatactacactttgattgggaaggctgtaacatatgctttagacctattgtagtttgtgtaattattattcctgttcatgaaatcattggggtccctccccactacagatagtacagtaatgcacattggaatttctccaggtgagagagattttcttgaatattctgagtagacagtcattgtcatgatgtgtgtgtatgtgtgtggtaggggccggtggtggatttctccaacccttttcccgtatttgtattttgtttctttttcttattttttttttttttcttattttttttgagacagagtctcactctgtcgcccaggctggagtgcagtggtgcaatctcagctcactgcaacctctgcctcccatgttcaagcgattctcctgcctcagcctcccaagtagctgggattacaggcacccaccaccacgccccgctgattattattattattggtttttttttttttttttgagacgaagtcttgttgtgtcacccaggttggagtgcaatggcacgattgatctcagctcattgcaacttccacttcctgggttcagtccattctcctgtctcagccttccaagtagctgggattacaggcacatgccaccacactcaggtaattttttgtgtttttggtagagacagggtttcaccatgttggacagggttgtcttgaactcctaacctcaagtaatctacccgcctcagcctcccaaagtgctggaattacaggcataagccaccacgcccagcctctttttcttatttccttaaattagctaggacgtgcagtagaatgttgaatagcttcatcaatagctactctctgacaggaatatgaaattggtacagcctttggtaatatttaccaaaatgtaaaatacaaaaacaccttgacttagttattccctttaagaatctattcttctaaaacccttgcacatgcatacaaagatatgtacaaggatgcatattatagcatttacctgtagtagaaaaatgaaaagtaaccttaagtgtgcattaataggagaataattacattgggatatggtcataccattgacctactatgctatatatgtggctacatgtatactaatatgcagtattattaagagagaaatacaagttgcagaaaattagttattggttgactcagtctgtattttattttattttttagagatgggggtcttgctaagttgcccaaattggagtgcagtggtgtaatcataactcacagcagcttcgaactcctgggctcaagcagtctcctgcctttgcctcctgagtgactgaaactgtaggcatgttccacatgcctggccaattttttttttttttttttttgtagagataggggtctcactatgttgcctagactccagtctgtattttaaaaacaagttaagtgtgtgtgtatatgtgatgtgttttaaatacatagaaaaatgtttggagagttcacacaccaaaaatatgaatagtatttctctctaaggagggtactggtgttgacaggtagtttgaagcttgataaagaggaggcttttatgttttctgtgttctgtacaccttttatactgagtacttttcaccttcttaactttgaaaatgataaaaaggaaagtagagagatggagaaaataaagcaaacaatactgtcagttaacagaaaaatccaactgtagaacagtagggagaatcagagagcaggtgaattcaaaccatccagtagtcaattttcttaaatagtcaacaagcatggtaaaaaatcaaatggtacaaaaacatatgtggtactgttacagtcctgccaatgcaccacagtgtagcaatctcttgtgagatatcacctggagttcagagttctttgtctcagtgatgaagagaattaaggggcgtggacacaaagggtgaggttggaacaaaagtttaataagtgaaagaagacagctctccacagcagagagaggacccagaagaggattgccgtttttacagttgaatgcaaaggctttttaaaagaaaccagtgagggctgaacatctcatttacgtaaggtgagaatttctgatagctctacccagtcctcctaatgtgcatgcaggcggttagcttgagttattccatatcgctttgttccccttactgcacatgtgtcaggagacgggattttccattgtgggcatgtctgggcaagtcacctgtgtagcctttcttatctgtgtggctgtggacatgtcttaggcaaacctccctgtgcaagttcccttatctgtgcctgcagcttgatttttcaggttgttctgtttgaaataattccactgaggacccaccctaactgcctaccttaccggtttcttcctttctcctctctcagtactgtgataccacccccatacctgctatagtggcttctctctaaaaacagaaaatagcaagtgttggtaaggatatggagaaattggaacccttttgcacttttggtacagcgaaaagtatagttgctggtaaaaagtatggtggcgccttaaaaaatgaaaaactagaattaccatttgaactaacagttcctcttctgggcatgttaccaaactgaacttcggtctgcccacccagtgcagcaaagctaaacactgacatttggattgctgcaaagagaaatggagatgtttattgcagggcaccaaacaaggagaatcggatagctcatgcttaagacctgaactctccaatggcttgcaagcaagggtttataaaggcagggggaaatttcaggaaggtagaagttataggcaaaatcataaggcaatacatggaggttatacattggtttggcctaaaagggcgggagatcttgaagtggggtttacaggttgtaggtagattttctgatttgcagttcattaaggaagagaagttttgttttaaaatctggggatcagcagaaaagaatattagttctggctcatgggtgtgacttctcccaagtccctcaggaagaactttaggacaaagatattcagtcctcagttcccccttacctgatgtgtacatgccaacagatccatttggtggggtccaggtttctgaaaaacaacccagggacatgtgtccatcaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacactgcatgttctcactcataggtgggaattgaacaatgagaacacttggacacaggaaggggaacatcacacaccagggcctgtcatggggtggggggaggggggagggatagcattaggagatatacctaatgtaaatgacgagttaatgggtgcagcacaccaacatggcacttgtatacatatgtaacaaacctgcacgttgtgcacatgtaccctagaatttaaggtataattaaaaaaaaaaaaaagatgttgcctttagtttctatagggaaccaaacatcccacgactctaacttccttggctattgttttaagctgctattaccctcttgcttatcaagttgttcatttgcttctcagggccagctaggtgcctggaacttctcttgaaggaactcaagattttcctttatttccatgctgggggcgggggaggcccataggcccctcaaggggttcctgctccatctgaggtccatgttcaaaagaattgaaagtaggtctcaaaaatatatttctacacccacattcacagctgcattattcacaataactgaaacatggaaacaacccaagtgtacgatgatgaatgaatggatgttagatgttgtgtatacatacaatattgagacatcaagcaaagattaagtatgtttaactttgttaaagaagtggagcctatatttaataaaggtttttgtgaatttttcaaaataaaaattgatatatagaatacaatttttcaaagttaagagctttagaccgtaagacccaaagtttgaggaacattgcattacaattaaatcatgtgatcacagagctaacatgtaaacatgagcacaaatgttggtgctgaaatttcatgttcatgaaaattttacatcatcataaacatttaaaagcaaaatttaaaattcatgcagaaagtcagacactcaagagtggacttaggagaaacaatgatataaaacattgaattcttaagaaacttgagaatccttgaaaaaaattctactaatatgcattgagcacctattttggtttaggccactgggatttcaatagtaaatagggcagtcaagggctagaaacaggaaagagtgagggactgtgtgtcaggaaatgcttctttaaggaagttttttgttttgttttgtatttttgagatggagtctccctctggtgcccaggctgaagtgcagtggcacagtctcggctcactgcaacctctgcctcccagttgattctcctgcctcagcctcccaagtagctggaattacaggcatgcaccacagggtccagctaatttttgtatttttagtagagacggggggtggggggggggggtctcaccatgttggctaggttggtctcgaactcctgacctccagtgatccacctgacttggcctcccaaagtgctaggattacaggtgtgagccaccgcgctggccgagaaatacttttaattagtatcagatggatgagtacctgttagctaaattgagggctagggtaaggaaaagacaatgagactaggggcaggattgggatgaaaggagagaaatataatttcatagtcaagtggaaacattgttataatattacttcaaacttacatcataagttaagttatgatgtcacctgtttctcttggagaagcctattcaccttcattggaatgggaagctttctcaagaaatgtcagaggattcaaatatattcttgctttgttagttgagtcagtaccaatagtacacttgtgattagactgtcaaacaaaatccctgaagggatttcacactgttaaatgcttggtttttatttgtttttatttgttgggtttttttttttaaacggcatagatgtaaatttgtgaattacagaaaagaagcagttttaacatgaaatggacaaaattgatttctttctctgcttacagagcttaataagaatttcagtccataagcctttcaaatgaaacaatagaaactccaacaattcagagctaatgtaaatgaaaacggttatcttccaaatcacagcataataaagtaaccttgaatcattggtgttggccctatattgttatttatttgaattaaatggcaattttcagcattatgtaacagtgatggaattaagtgatgtttctagtaaaagaattttgcaagtataatatattttagtattaaattccacttgtacatttagcaattaaaattattcctgaaatgatgatggcatttgaagggatagggagctgtcaaagaggatttgaagcttaattatctctttggtaacaaaatgcataatcttccattacaacacttattttcttatggtaattgactcatttgttctctggttatcaatttaacttcccaaccacaaacatctgctcttacaattgtgtttaattggtgtgaatactatctacagagtagttaaaatccagaaaacattttaagggcattattttataattcatgaaagggaaactaatgattaattgaacattgcttatgatgattttttctaatagtctgtgaaagtctgtttactaaaaatgcataccgaaattatctgctcccccctcctttttttttttttttttttttggaagaggcttttgctgtgttttccagagtaattatttactctgccttagggggagcctcagttcttgcagttctttagactcaaggaatatgttaatgtcttggaacatggtaccttagtagttaagagtataggctttgaaggtagaaaaaaattagtatgctatcatttataatctaaataagaggattggggacaaattgtgggtgtgggtatgtgcttataattttcataatggaataataaatcataaatttaccagtagggtaaaggaggaaataggatgagagaaacagggttagaaggtaggtaggtttgtttgaatgtaccttgtctttatagatttaaaaatttacaaagtagttcctgaaactggaaagtaaaatgaaacaggcgactccaaaggtgtatccagttggtaatacagccacacagtaagttacaattctaagtatatggaattataattccatgtaaatttaaaattgtaattggactataatgtacctagtgggatttactctaaggacacaactgcaaaaaatctttggttgttttcttttatcatattgttggtacagatgtttattctgagactatgggtgtaggataaagtaaatgagtaattatgttagtgtcattgagaacagatttttggcttgagatacagatgtaaaattaagaagattcagctaaaagctacagtcttagacttaattgaaaatatcagtaggaaatcatgatgaagtttatatttaaaaaatacaaaattgctgactttgtccacaaaaagggtctcagagcaatgaccataaactgaagtccaatagagtcatgtgaaaaaggactcaggagctttcactgtgttcaggtttcctccattggtcaaatatgggatagtttaagaatcaaaagaataataacctgagtgaattgaaacaaaccaaatatatcttaaactaaaggctcttaatacttaaatgaaaaatcctcagcaattacctttgggagaggatattagaaaaccagctcactgttttgaaaacgtaagtgaagggaaaaagtcaagcatttattctgccccttttcgaagtacggtactttaggataaccagataattgtggggttatcctaataattgaaggaatatagtaataagtaatataagggatgtttctctttacagaatgagtgatagaataagagtattactattttgcaccgcctgatgggcaatgataaccaaaggctgttaacatcaccaaaagagagatagacacacatgatgaacctcctgatagatgcacatggaactgcctatgaagtagtctcgggggaaaaaaaaaaaactagcctgactccaatcagggttctacatttaactgtgagctttcagaaagaacatgttaaataccactatggcaatgtggtcagcaaaagacagattgcaggaaaaccttatattacaaatgacttggtttcttaaacaaatttcaaacaaaagataaagaggagtctgtagatggaaaaaaaaacctaagaaacaaattaacaccagtgaatgcaccttgtttgcccaatttgaataaagtagatcatttttaagaacatagaggccaggcgtagtggctcatgcctgtaaacctagcactttgggaggctaaggtaggaggatcgcttgagcccaggagtttgagactagcctgggcaacatagtgagacctcctctgtattaaaaaatcaaaaaattagctgggtgtggtggtgcgttcctgtagtctcagctacttgagcggctgaggcaggaggattacttgagtctgggaagtcgaggctgcagtgagccatgatcatgccactgcactccagtctgtgcaacagagtgagaacattggccagttagtgaaatgtgaataccgactgggtaataggtgatattaagaaactattattattattattattattattattattattattattattacttgagacagagtcttgttctgtcgcccaggctgaagtgccgtggcacaatcctggctcactgcaacctccacctcctgggttcaagcgattctccggtctcagcctcccgagtatctgggactacaggcatgagtcaccacgcctggctaatttttgtatttttaatagagacgggtttttgccaagttggccaggctagtcttgaactcctgacctcaggtgatcacctgcctcggccccactaagtgccaggattacaggcgtgagccaccatgcccggccaataaattattttagataccagcctgatgatggtatcatggttatgtttagaaatgagagttcttggcttatagaggtactcatttatatatgaaatagtgtaatacgtggagtttgctttcaaaataatatgtgtgtagggtagaggctgggaatggaatggattaaggcatagatgaatcagtattgaccatgacttgataattgttgaatcaacgtaataggtacataggatttattctattctcttaaataaaaagttttttaaaagaatataggttttggagtcagactgcctaggttcaaaatccagatctgtcactgactaagccttgtgctatggagttacttagcgtctctgtgtattagtgtccttgcctataaaatggaaataatataatattaactgcataatagaattgttctaggaactaaatggttataagtggaaagcgcttatgaatgttagctttgatgtgttcattatcacacatcaaagatatacgttaaagttataaatcattggctaaagatcttagtgtacttaggaatagtctagttgaattccttatttagtaacccaggagtttgaaacccacatttagcaaaatgtccagtggtagaaccagaactcaactttatgtctcttgactcctagtctttacaactgcttcacagtaaatcacttcaaagaatatccaagagtcaaaagacagaatttttacaaatttagttaaatgatataatggcttttaatagtaattcatgagtcaggcagcatctcatctaaagaacagataagcactacactgggcaggcagaacagttagtttttgtagggaaacttgagcaggaacaaagaaacagtggattggttaacattagttgcttcagattactttcattgtaagggtcaaagcagaggggactttcttatgttggctaaaactgtcccatttggggatttgacacacacactctcctgatttctcagaaggtcagataaataacttaggtttagtttggtgatatgcaactttggcacgagtgactgcattttggttcagtctgtttggtttgatctgtagagtagaagctcaatccatattagtagtctcccataaattttatttaacacaagtaagcttaagtaaccttgttctaaatagaaagactcacagttgcaaacatcttcagttttcctgtatctaaaatgtattgcagttcaaatgaagactccaagttcttgtttgtctgtttgctttgagaaggaacagacaaacttaacataagatgagtctaaatttatctggggagtggaacactaaacaaacatgttagaaaaattttgaggaaataaaggaagaatatttgttccaccatatattataacatattgcatagttataataattttatggttctggcccaggaataggcagatggatgaaaccaattagtgtcctgaaataaacccccaagagtacgtagattttagtattaaatctttcaaatctgtcattctttttgggatgactgatcttgccagatatatgtaaagctggatacttagtaagtctagtttgtttcgtagaaatattagaagaaaatacaagtgaatgttgttatagtacagaagaagggaaagcctttggagtaaaaatagtgaaatacagatgctaaaatggagagaacttataaattttaccatatgcaaacgtaaaactttgttacaatagatgccttaagttaaagacagaagaggaaacaaatattggcagcatgtatagcttactgtattagtcagggcccagttaggagccagaaactatactaggcatttgaacagagcaaatttaatataaagaattattaatggccggtcgcggtggctcatgcctgtaatcccagcactttgggaggccgaggcaggtggatcacctgaggtcaggagttcgagaccagcctggccaacatggtgaaaccctgtctctactaaaaatacaaaaattagccggacgtggtggtgcacgtctgtaatcccggctacttgagaggctgaggtacaagaatcgcttgaacctgtgaggcgaagattgcagtgagccgagatcacgccattgcactccagtctgggcaatagagcgagactccatctcaaaaaaaaaaaagaattattaactattaaaatctacttactaaaaagggcaaaataggacattaaagaatacaaaaatagtaaatatagggattagctatgactacctcttgagctgagggagagaatccaaaaatcaggaagactgttgttcagaccttgttgaagaaagtgtagctgctgccaaaggacatagctatgggccaaagctggggcacaggaaatcccctgctgggaggcctcagagctggtgtgcagaaaacacctgctggggtgctgtgggctggacagatgataagccgaaaattgcccactgggatgacatgagttggagctggtgtacaggaccctatccaatgggatgcagtgtgtcagagctggtgcacagaaagccccatgctggagtaagctagagaaacttacaggagggtgatcattattgggtctttcacaatcagcctcaccataggagcaaaaagaagagcatcctccaaactgaaaattaagcccatcactctgctttgctgtgcaacaaagcaccagctgacaaaagtccatatccactactgcaaagaaggacagatttggagctgagagccttgaaataataactctcattataccaaaagctcttatatatagataagaaaattataaacactctaattggaaaaacggcagcatatttatatacataattcacaaaagaataaatacaaaaggcttgtcattgtttgaaaggatcaagtcaaatttgctattaatagatttccctgatttcatcttgttgtacagatttatgttttctggatcttccatcactgtgaatgtatgttgtttcctaagattatacatgatttccctccttgggggaggttctgcttgactggggttctatctcctttttgtactgttgttcttcatttacctaagttatgtagctagtttagatttctcttcagggcctgctctagacagtgcaataggccaaaaaagttcttttttaaaaaaggaaagggagattggaaaggcataaataaatctgtctctactcacatacaagcatgattgtctatgtagataatccccaaactgtatttacagaggctgatacagctaatgagataatttaggatggccacaggataaaaggttaatacacataaatcaatttcattcctacatactagcagagaacaactggaaattttaaaaaatttaaagtaccacttagaatagcatcaaaagtatttgaaatacctaggtatttatctaacagagcatgaatgagatttgcttactgaaatctgtaaaacatttatgaaagaaatcagacttaaatagagagataaacctgtgttcagggaaaagaagacaatatttttaagacgtcaagttgccacaaattcaacacaatcccaatcaaaatcccagcaggctgggcagatgttaggtcaactgtaaataaagctgctgtcgttgccattgttgttgttatttcatagaactagcctgcagtggagcttgctgctttgtgatgtagggagttcctgtcattcacacttttcaaatacagatcgctaagaccctttgtcaaggatgtcatataggaaattatatcattaggtaggatgctggactagatctacttcaacccttctaattaaaaatattatgatctattatttgtaagttagcaatttacagctgtggggcatgtggaaagggagctactggaatattcagactttttcaaatgtacttatcctttccccgtcaccctgtaaaaccattgcatataatgagggatcttagtaataggagtgtgttgcatgagtgagctgtttaaggactctaatgtgacgtttattttactttgttgttgttgttcttacttatcaagctgactgaaaaggaaagttttatcaatcttttccactctttgaattctaattatagctcttaaaaaatggtataaatcttagggaagtattctttaatatttatttttagacatttttaatttctccaatatagtcaacttagtaaatagttccaaataaggaaactcagaaattatctttaaaacagttagttgtaccagcaaatcattttttaaagataattgtattcctaacatgtattttttattatatatttattttatgcttttgcaaaaatatgtgaaagcttcaaataatgagtaaaaatcctgtggattttatgatttaaaaattggttgaaatatgaatagctgcctagttctattttcattaatgtcttaatttcctttttattttaaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtagtaagtatttttcaaagaagtgtgtttatttctgtaacctttagatatttttaaatgtagtcaccgagagatcagttatcttatatatactagtttgtgtactgcaaatgaaatagaagaattcacatagaatgtaataccttcattggctgatgagaaagctgagcccagaaatactttggtagcttatgtaagatcacatagcaagtcagtggcttacctaagcctagagtctagactcttacttgaacacactggcactctgaaacacagctgccaccattttctggcagatgattagcacacatgtgtgtgcgtgtatgtgtgtccccagttgtcttcacagctctctgttcaagaagcagaaatctttccacacttctccttgaagtgtggaaagatgatccttttgaaaaacataatatgtaagaatgcaactgactatacaaaacttaaccttaaatcgtataccgatgcccagacccttcaaaataaggatgacccagtgtcggacaattgtggtagcaatagttataaagattcttttttaaaaatgcatttaaaaagtgtcaagtgtatttaagaatactcagccataattgctttttactatactttatatatagtaaatgattcttagatattacctactattatcatcaatatctaacattttagtaatagaattatccagctttagtaataaagattaatgacataccttgagatctatacatgacattcataaaaatgatcagaactatagttgttaaagacataatgtctcattacaaatttgtcatacaagtaaacattcttagaaatatattttctatttttgaaatgcatgatctcctgttgcaaaaagtaatttacaagtatttaacattaaaaagcaatctgttatagttaaaatagcctcttaaaatcaatatttggaaactagaaaatttttaaatcatatttattataccaataacagtagttaaaaattttttttgttttttaagacagggtctcgctgtgtcaccctggctggagtgcagtggtttgatcatagctcaccacagcctcaaactcctgggcttaagcgatcctcctgccaacctgagtagctggaactacaggcacgcactaccatgaccagccaattttgtattttttgtagagatggggtttcactgtgttgctcagtctggtcttcagcgcctgggctcaagtgatactcctgcctcggcctcccaaagtgctggggttacaggtgtgagccactgctcctggcccagtagtaatagttgacattcatatagtactttttcatttaaggaaagctcacatggcttcatttaatttattgtagtctaatctgttagaactattgatattatagatagtcttaggaaaaataataccttaaattcacaaattggactttaactgtggtcagttggtattgcgtgccagatctttttccaggcaaaggtgtagtttgcaaacagtgagagtatgactttccatgcgttaagttcttcatcgtgaatgacagtatgtactcttctattcagttaaattggtaccttgccaatgctttagtatgaaattgagttaacaagtacttggataatatttaataattggatcataaaaactttacttgtttttttcctctccaaaaagcatatttttgagattttgatctggtatttatcaattaaattatgtaattttatttatgcttttcttcttcagaaggaacataatcttcaagttttgggtctggtgaaatcagatgaagggttctatcagtgcattgctgaaaatgatgttggaaatgcacaagctggagcccaactgataatccttgaacatggtaagaagggctgaaatagtcagatgatagaggctgtgtgcttgatgaacaagcacccatccgtccaaataactcatgattgataacccattagtaaaggccaatatgtggcatagctaagagaaaaagaatagcagtctaaatcatttctattacataaaattacctagaagcacaattttggataatgttgaaaagaaatttttactaagaaaaggaaaactgaatattatagtcttaataaattaatttttaaaagaatttagtcatcttaatctcacaaatatatttctgtcctataaagaaaaacttcttttttttccaattctatacacttttattaatacacttacaaaaaataacattcaaacactgagaaaactaaataactttggaagcagagctcattgttttctgcttacatataagtgacaattctgggctgttggcacaaaatagtcaacattcataaaaccctgactactatatatcaaacataagttaaaatcataggcagtagtttatcaaatccacgtttcttagaaaaacttagtatttattttgcattgaaatttttagtttttccagaatacaattaatttaccttttctgattaccaccaaaaaaccaagtttattatttaaaaattcagataacaatgaaaagtataaagaaaaaaatccatcctgtatctcaaattagggaacccacactgtaatttgagcagagttttaacataaggaattaacattgatattgggattggagtaacaaaggtttgactagtaagaagtaaagagaactctagacaatataagaatggcaactatcaggagcaactacaacccctaggtctgagatagagccctcaggaagaggcccctctttttacggatgagatccagaccctgttggagagggtgtaaccatggtttactggatggcagagaagttgatgtggtgttttgctctctaaacttgctcaaaatctcctttcttgagggttggggaaagctgcttacagagaggtatctcactggaggcattctgctacaaaaccacccagtggatcaggtgtaaggggaagctgctggctataggaggctgccagggtagtacactagaaccaggaaggaaactcctttcttctgtactgtatctccattgccttctattgataaagtttaatacatatgccagctggcaaaggaaaagtatataaaggacatggctctgtttttgcagcataggcaatgaaatcagaatttggagctgagaggcagtaaattgataactggtacacacttcaaatcctaccacctgggtacactgtgtatggttttataatttcctgttttgttgcaacagcatgctgtgtatatctttctgtgtcaacagttgatctgcatcaatattgtttcttattaaataatatgtatatatatatatatacactgttttatataacagattttatattggttaacatttagattgtcacctgttttttcctattacaaacaaggatgtattgaactttttatgtgattattttcttatactaaattactagaagttgaattattggataacagttctgtgttaaattgataagggtacctgttgggtgcattattcatttgttttagcaactgaaacatttttcattttgagcatttctcaaaaatacatgaaaaagatgccactttagacatctgatcttttattcaagtcaaatacaatcaggtattggtgtgcctccaggaagaatttctctgatgattgtagtttggccagggaagctaattggcaaagatggcacctactctggcttttcactaacatggcatatatgtaggatttttgtgtgctattttttgaaaaatatacttgagagtgctgttacagaaaagcataaaatattagaactgcttttttcttcttaggtttgtatataccctcccctgtttattggaaatgattttagtagaagcatgccatttttccatcttggtgaaatgcctgagtacaattactaaataaggcactagcagaattagtgaggtagataggcttatttctttttacttgtggcagtgacttttcttagtaaacctcgtagctatttggggtatatttatttacatggaactaagcaaaggcacttcattatatttgtgtttgagattactgttacaaatctaactctaacagtagaaatggttaagtatgccaggaagttcctaaactaatcctaattgggctttcctctgaaaatatttggatagtgttaaaattgtagtcatagtgtatttgcttctctctttttgagaatagcgttttatgagctgatgaaattttttagtgacgttattgggcatgtattaaagatgcatagattataagaaggagagtaagtgtcatgttattaattgtgttttctattttgctgttttaatttgcaagataaatatttatacaggaaagctaaaagaaggaatacagtaacttactagatctgagctcttcttttttagagtttacaatataataagggatgtaagagatatataaaacttgaataccagtccagatgcataaataaagcagcatacagttcagaagagaggaattctgtctgtgtgatcagggaattttttcatgtaaggtgtcccctttgtaataggccttgaattataagatttctagatgttaattcaaaggaagacctggatcaatatggaaataaaatagaagacctgttcctgtagtaaggtagcctttaacagcagaataggatcagagtgcatgattataaataataaaaacaatgccatgtgtaatgagtatgatgataaagtcaggtttagaggaagacagagtgcaagctggttgaaggaaaattgttatgaggccattgtgagatgataaatacttacactagagaaatcggtggaaaaggatcctactaaggagattgtgttagtctgttcttgcattgctataaagaaatacgtgaggctaggtaatttataaagaaaagaggtttagttggctcccagttccacaggctgtacaggaagcatggtgctggcatctgcttggctcctggggaggcctcaggaagcttccaatcatggtggaaggcaagaggggagcaggcatctcacatggcaggaccaggatcaggagagtgaggtgggggggtgccacacacttttaaacaaccagatcttgtgagaactcactatctcaaggacagcaccaagccatgagggatcttcccccatgacccaaacacctccccaggttccacctccaacactggggattaccttttcacatgagatttgggcagggacaaatatccagactatgtcagaggtgttagtgatttatctgattgagactttatcaactgattgaacattaaacattgttatagagaagccagagatacttccaaggtttacccaagttctgggtaactaggtgtattagtccattttcacactgctgttaaagacatacctgaaacagggcaatttacaaaagagatttaatgggacttgcccttccacatggctggggaggtctcacaatcatggcagaaggcaaggaggagcgagtcacatcttatatggatggcagcaggcaaagagagagcttgtgcagggaaactcccattttccaagccatcagatctcatgagactcattcactatcacgagaacagcacaggaaagacccacccctataattcaatcatctcccactgggtgattccactgggaggtggaatgggaattgtgggagttacaattcaagataagatttgggtggggacacatccaaaccatatcactagaagaatggtgacacctttacaaaaacagaaaaagagggcagatcaaagtggaaggagatttccacttctgtttaggatataaagaggtgcataaagaaaatcccattctcaccacataaagagcttagtaatctacaacgtcacaggttctcttgagcccagcagagagctgagcatgcaaagcaaatatattagttcattttcacactgctgataaagacatacctgagactgggtaatttataaagaaaaagaggtttaatggactcacagttccacatggctggggaggcctcacaatcatggcagaaggcaaaaggcacatgttacatggtggcagacaagagagaatgggagtcaagtgaaaggggaaacccctcatgaaatcatcatgtcgtgagatttactcactaccacaagaaccgtatggggagaaccacccccatgatttaattatctaccagtaggtcccttccacaacacgtgggaattatgggagctacaattcaaggtgaggtttgggtggggacacagccaaaccataacagcaaccaaataacctaaattccaaaaaggacaaccctccccacacaaccccctcaaaggcatagatcatatgcattgtttcacttttggcagaacacaagagaaagagacggctactgtaaaagtgagtaagaggaaaactcctagagttttaactaaaaggcctttaactgcaaggccaactatggcctaatttggaatgtctgggggcctcagacagaatgggagtttacactttcttgcaaacacttttccttggggctccacagagtactcccaattaagaggaggcaaaagcaggagactacagaaagccatctctgtggtgtagggatgaaggaagtgatgatctgcagctgcagagagagaatgatgcagagaggcctttgtgcctgggagacaggacaaaggccttcccatttactcagacccttctcctttaagcctcaaaccagtgggggaggggcagaaaaccttctgatttcatacgtttctgaagggagattagaagtcaaacccctgtgctgcttagaggaggaaccctcctgtccccaggatgcaggcagagactcattgatgccggggaaagggtagaagagaaaaccctttacttctgaaagaggcgcagaaatcattttaggcctcaggattctacactgataccaaggagaggtcttttactactaggggaagagtaggaaacttctacctaagaccgatacaaatacaaggcagattttgactgccacaggaagaagagccagagggcctacctaagactgaggctggaccagaacaatggagaatcctagctgcctcaaccatgaactttctactgtttgggaaaggtcaagagcacagagggatatcctgtggtattggtatgctggagtggttgaaaactcagaggaaaggaaaaaaaaagagagagaaactctctggctcctaagcacaggacaatggtagtctcccagtagaggaatttgaaacctatagtatacttaaggtaactataacaataaaatccattccaagctcaattcctgactagattaactaaactctttcacactaatgacatgacagaaaaataagcataccatttttcaggtgtaaataatacttactgttgttcagcataccgtgttcagcattcaagcaaaaattaatagactttaataagcccatctattgagagagaaactaatcattagaactaatttcagcctttgtgacttctatgcaatagaaagatgttcttagaaaatataccattcaaatttcattctttatataccttttttaaaattaattaattaattaatttttttgagacggagtttcactcttgtcgcccaggctgtagtacagtggcgcgatctcagctcactgcagcctccgcctcccgggttcaagcaattctcctgcctcagcctcccgagtagctgggattacaggtgcgtgccaccatgcctggctaacttttgtatttttagtagagacagggtttcatatatacctttatttttaaaattacttgaggtatactcctacagactacaagatgagtcaaaccaagaactcaaaaacaacacacactcttaacatctgatccagcagttgcacttctttgtatttacctgaatgagttgaaaagttatgtccacacaaaacccctcaaatgtgtttgtagcatctttattcctaattaccaagatgtccttcagtaggtgaaagaataaataaaccgttgtacatctagacagtggaatattattcattaccaaaaagaaatgacctaccaggccaggtgccgtggcttacgcctgtactcccagcactttgggaggtggaggtgggcagatcacttgagggcaggagttcgagaccagcttggccaacttggcaaaaccccgtgtctactaaaaatacaaaaattagctgggcgtagtggtgcatgcctgtaatcccagctactcaggaggatgaagcatgtgaatcacttgaacccgggaggcgaaggttgcagtgagccaagattgcaccactgcactccagcctgggtgacagagtgagactctgtctcaaaagaaaaaaagaaagaaaagaaaaagaaaaaagaaatgagctgtcaaaccataatgcacttgaggaattataaatgcaaattaccaagtgaaagaagccaatttgaaagggctaaaaaccgtgtgattccaactacatgacattctagaaaaggcaaaactatggagttagtaaaaaaattagtggttgccagggtttgggaggagagagcgatgaataagcagaacacagatgtttatggcagtgaaaccactctgtatgatactataggggaggatacgtgtcataaatttgtccaagcccatagaatttgcaacatcaagagtgaacactaatataaactatggactttgggtgataatgatgtctcaatacaggttattcaattgtaataaatgtaccactttagtgggggatgttgataatgggggaaactatgcatgtgtagggcagaggaaattttggtaccttatgctcagttttgcaatgaacctaaaactgctctacacacttattaggatagttaaaatccaaaatactgacaacaccatcaaactctcacaaggatgtagagcaacaggaactcttattcattgttgctgggaatgcaaaatggtacagccattttcgaagatagtttggcagtttcttacaaaattaaacatttttatcataaaatttagcagttgtgctccttgatgtttacccagatgagttgaaaatttatgctaacacaaaatttacacacaaatgtttagaagaattttactcattattgccaaaacttggaagcaaccaaaatatcctttggtatctgaatggataaacaaagtgtgatacatctatacaatggaacgtcattcattgaacagagcatctaagatgggacaatatcagaggctataacataagtaaattataagtaaatgggagtctcacagggaaaacagaacaaggacagggagaaacaaatgtttgaatagataatggccaagaattttaaaaaatgaattagatcaaaccacacaaccaaaaagaagctcagacaacccccaagcaaactaaataccatgatgatgataataataataataaaaagaaaatatgcctgtacacatcatagtcaaacttctggaaaccaaacatgaaaatatcttgaaggcaattggaaatttaaaaagaagaaagacacattacatacagaggaacaaagataagaattgcagcagactttttgccagaaaaaaaaaaaaatgtgagctagaagacactgagcagtagtttttagtttaaaaaaaaataattaaggggccatggtaatcttcactgtattgttccaattttagtattagtgtatgtgctgcccaagtgagcacagagcaactttttaagtccttaaaaaaaaaggcaaccaaaaaaaaggcaaccaaaactatacccagcaaaaatatctttcaaaaattaaagtgaaataaagaccttttcagaacagaaactgagaatttgttgctgacatacccatgctacaagaaatgtgaaaggagaaaaacaaagtgggctagagtgtttttaaagtaaatataaaaatatatttttaagattaattgctttaagagataattgactgtctagacaggcccacaaaatttttttcttctttttttttcactctaaatagtttatttccaccttcacaaactcatgcacctctggccattatgcaaggcaccatgaattaaatagtcatatcagtatatatttgtcttacatgattcaagataaagtgaattttaaaagcaaatgggtgccaatgatggggaggtgaggggaatagggcaggcagcaatagggtaacacgcaacaaaattttctgtaaagggctagatagtaaatattttaggcttaatgggtcagtctctgtcacagctacttaactctaccattctagcgcaaaagccaccatatagatcaaacaaccttggctgctccggtgaaactttgtttacaaaaacaagtagcaggtcctaatatgcttactctggtctaacacagaaatagttgataacatgaaatttagaagtgtgacagaatggtatatgtagtgtagtccgatgtgtagggtagaattgaaaataaactattgtaagattattactgcacacaacaatactgtgtgtcgaagatgctcagatactttcaatattatttttaaacaagactcatgaagataacaactattacaaaatatttcctttttcaataattcactccattatttttctagttaagctcagatagtgatcacagagatatgttagtaaactatctgtagtttgtagttctccctttaacagttcctttttggagtgactagggcacatttcctcctcattattcatacaccaagtctgactttcttcacttatccttatattcttcattctcctgctccctgtttgcctttttttcctcccactccttccccctttttatttaaaaaattttaagtgaaacagacatccactgatgagaaataacttagaatcacaaactatcacggctgaaagatacgtatcatgtagtacagtggttggcaaactttctgttaagggccaaagaatagatacttcaggctttacctgacatttggtctctgtttacattgctcacctctgctattataagtttgaaaaccaccacagacagaatacagacaatctgtaacaaatatgtgtagctgtgttcctgtaaaactttatatacaaaagcaggaagtacactggatttggcctgtgggcacagtttgcgaatctcaatctagtccatcttcccttgaatatccttacatcagtgtttcccaaattgtgccctttaagatgtattaatgggtctactaaaaagcaaataaaatgaacaaaaaggatgctccacagtccaacagattttgggactgctatatataaacattatattctacgttggaaattcgcaatgctaatgaacacaaatggaaagaggctcaaggtgggccagttttcatcatttctccttcaggctgcccaagcgtctgcctttctcctaccaaatccagacatatcagtgaagtctgtcagaatttgctatatttacttcttgcaagataacccaattctcctgtgaaaggaattgtttgtagactcttaacttctgtctgtcatgtttttggcagaaagtcatcaatgttatatctggtggcttttctaaattttaccactgattaaaaggtgagtttagtatttaaaaaaaaaaagactttactaattatataaaagtaatacatgattattttagaacactgagaaaaatatcactgcccaaagataaccagtgttaacattttggtatggaaatgtctaaatgtgtatatacactttttaaaattaaattcagattatttggtatatattgttttgtatcttgtttttctacttgttgttatatcctgagatcttcctgatatcattacaggggttcaaaggcatggtttttaatggccaaaaaacttttccatcataaggttgtactataattattttaactacttcctctattttgggacatttaagtcatttcctattcttctgttctttatccctgtctgtttttcctttttcaattactaatgctcatattagtagtctttgtccaaatctctgattctttccttaggaaaaattcctaaaagaacaattaatggttcgagtcagtaatttatgtaattgtcaaaatggttttagtaaatgatgtaacaatttacatttttactaagagtgaagaaaggatacaaacctaatcacacattagccaactattaaaaagtaatgttcatttaaaaatacaaaatttaggctgggtgcagtggctcacccctgtaatcccagctgggagctgaggcaagaggattacttgagcccaaaacttcaagacttgcctgggcaacatagtgagaccccatcctcacaaaaagttaaaaaaaaaaaattggccaagtgtggtggcacacacctttggtcccaggtactaaagaggctgagatgggaggattgcttgagcctgagaggtcgaggcttcaatgagctgtgattgcaccactgcactctagcctgggcaacagagcaagaccaccaccctacccatgcaaaaataaacttcattattaggcaaaaatgacatcttacccattgaattttatatctttgattgtgaagtggaatatttgtcatatgtttagaaatacagttactccttggtatacatgggagattggttccaggacccacacatatatgcccagatctgtgcatattcaagtactgtagtcacctctgtaagacctgagtacatgaaaactaggctgcctgtatagtcgggttttgcatcctgcaaataccgtattttttgttgcgtttgtttgaaaataaaaatcaccatgtaagtggaaccatgcagttcaaaaccggcttgttgaaggatccactgtagtctgtctttgctcttctgtgagttgtattcttctgttagttattgaaaaacgaaatcaatctcttgtgatggtgcttatcttcaaaaccttctttaaaaataatgttgaaagtatttgactgtgcatctttgatagttttatttctgtagggagagttttctgattcccacctgaagtgtgtggctatatatactggccataggccagctggctagtgctgggctgcaagaagctgcgttggagcgtccacagtaggcctgtggtatacttaacatgactattaggttaattatcagctttaaacattaaatgaaacttaataattatagttaaaatatataaaacatttttgcatatcactggaaaacagaatttctgagcaaattgtgaagtagaatttgacttttgttcctagcatgctttcttaatcaaaacatttaaaatacaacttttaatatttaacttcacttttatgcattttcggtaacagcagctcttgattttagaagatcttgtatcttttaaaaatatttaactgaacataaaacaggattatttttatttgctgccatttcagattaacattgcctgtcattttatgctaaaatcctttgttttttataattatctattaaattacattttcaaaaaaaagcattggcaggtacattgttattattatttaaattattactggtcaattaagagtagtaggaattaaggtaaaatgtctgtatcttttgtccattaactttttattggcctttcttcctgtcagttgaatttaaaaatagattgcgaaattatcatgtgagactggaatgtgaaaacatagaaatacactttctttttctgtcctttcataccacgtctgataattgccaaattttagttctagtaaaggaagaaggattcatgaaaagggagtaacatcaacttgtttttagtaaaggaaacttacactttaccagctccttaaatgactgctgggatgttatggccatagtagataagaatacacactgagcatcccccaccctttttttgacagaaatgtttgtaaaaaattccaaatagtatctgaggttagcattgaataatagaagttctggaataagtgactaatggcctggcatgattaaaagttggctagatagcaggaaattgttactcattagtggaatattttaatttcaaagcactaggatgtacagtagttggtgttgatgttaattaaaggataagttctaatcagttattttgcttttttgtaacggtaattataactttagggagagttttattcaaggtaactggtgtaatttgacttcttaatcatgaaattcatgtctaggaactttctaaagactgaatatgtatctgctgtcactgcttgggttctagttcatgtctgctgttaatgactggattacatattgtaattctgtgattttttattttctataaaataaaggaattaaatttaatgatctcttaggtcccatatcactccaaatactctgttaaatgcagttgttttacaaacatatgcatttaatgtaaaatgtgcttcagaacgctttttccgtataggtattgaaatagatatgttgtttgcagacagattgaggcatttccagttaatgattttatgtaacctgtcataactcgtataatgaaacaaaccttgtgctaaaagtctgacatattggattaatgtcccagtcccactgtggatgaggtgattaacctctctatgcatcagttttgttacctataactctaaacagtcatctctgcacagcacacctttgaggggcaaatggaataatatatgtaaagcattttgtaaattgttaagtactctgtaactttaggataatagtaattggaaagaacatagaaagacagagtatcgatgagaattcaatagtcagcattaaaggagattaaaagtgaagataaaagcttaactttatgaagcaaagtttgaaggttttttcaaaatagacaacagaaatctttaggataatagtaactttaggataatagtaactttaggataatagtaattggaaagaacatagaaagacagagtatcgatgagaattcaatagtcagcattaaaggagattaaaagtgaagataaaagcttaactttatgaagcaaagtttgaaggttttttcaaaatagacaacagaaatccatataatattcagttagatcatttaaatttgcaaaattagaaaatcttctttatatgaccagattgtaaggcatctgtaatgatctggttaaaactaaacttgcactaaaatattttaaagcaaatgtaacacatgttcattgtcaagaataagaatacataattgactgaaataaaagtaaatttactttttaacccttctcttaatattactttctagagataaccctcattaacaaacattctgtgtatttgtgcattcagaaataaattgttgagcaaaattctatatggcatatacaattgtgtattcattgtgctaagtggtgaggatgaaacagctaacaagcagacatgattctctgccttcatagtgcttattgtctgttagtagagacagacaataagcaagtaaatgaataattataccttttattgtctacttaaataaaagtactactctgataaagaattattggggtagagtggaagttattttaaataggttagacacagagggcctttctgaagtgatatttaagttgagacctgagggttagaaggagcctatgcgtgtgtgttttacacttacacatacatatacacatattcatgtataaactttttatttgcagaagtgaaatcatatttttctgtgacttttgaaaacagtgtcttatggacatggtagtccttatattacaggtttatctttttcattttttttaaactgatctatacttctcagactagagtatgaggaaacatagttttgagttcttgaaacattgtaaatttttttgagatgcagtttaagaataatttaaaattcacacaccctttcatcaaacaatcctatttataataatttatcttacagatatagttactaagtatttaaagattcatatgttagactagcataaatctctaagtaacctaattgatccaaccaataagggactagttaaatacagaatagagtggaatactaggaagctgttaataagatgtatggaaaaatatccaatttatattattaataaaaacaagttgcagaaaagtatgtatactctgatttcatttatggaaaagagaaggaaagatataaatgtctgtgtccttgtatgtgtaagaaagttttgcaagtctacacagaaatctattaatgatggttatagctgaggaatgggattggaaaaacctgaagatgaggaggaaggcaaaaataatacatttgaaatttttggaaagccaaataaaaacatcaattagaaattaaacttggaatatttaaatctatacctggtgatttctaccttgttcaaggtagttataaactttttgagtttttatttcttgaaacaaaatgctataggagaaaaaatagtttaataaaagtatttggcaacagtctgcaaatgttagttaatatagcatttttttcctagaagatgaatcatgtcatataaatgctgaggtggttaagtataatttattaaaattttaaaaactaatttgttttgttaaccaagtacttaatatgttgagtacatgtgctgtgtaaatagagattcacagttatctagcagataccctattatataggctattaggggagataatgtaaaattatagagtctagctagaatagaccttagagagctgagtatttaatttagctgagctggaaactcagttaagtgacttgccataaaataactagttggcatcagagtcaggactgatatcttggttttcaatttcaaaattcactgtatcactttagcaagtttaatgttttcaagacaaaaatttatgttcttttttccgcttatgttctcttaatttcaagttcagtcttttaagtcagtataaataagtgttattacttactgacaaggttggtcagatgtatcattttgctaggatgaccatacatctagtgtgcctaagacaatcccccagcataattaccaaaaagtgtctcctttcacttttagtagtatctggttgtggacaacatattccatggtcaccccaattgttgctaatttattgaatctgaaagattctacacagtgccagggtaaagattttggattatgaatctaaataattataatgcaagctgtgctgaatgccaaagcgctactctaattctaaactggaagaaataatttctgctaggtttgacaggcaagggaggctgattgaagaacgtggcatgtgagccgagcctagaaggatggatgggattatagattagtcaggttacatgaagatgggaagaggtgtatatgcaagaaggctcaaagtgcatttggagaatagccagcatctcggtttaccagtgttgagagaagtatgagtacaggaatatacatctgggaaggtgtgcagagaccagattatttaataccaagtcaaagggttggaatttgttgagcagttggaggactccagcagttttcagttatgtagcactttaagaggattaatttattagagatgtgttgagtggctttagagaggaaaatatggaatctgtcctaccatttagaaggattttgtaccaaatcagatgtgatgtttaaggccctggactagtttatggcaatggagagagagaggctttctttttattccctaatggctttgtattagttcatttgcattgctataaaagaatacctaaggatgggtaatttataaagaaaagagatttatttggctcctggttctgcaggctgtacaagaagcatggcaccatcatctgcttccaatgagggcttcaggaagatttttaatcatggcagaaggcaaaatgggagcaggcatgtcacatggtgagagaggaggaggttccaggctcttttaaacaaccagttctcaaggaaactaaccgagtaagaacctactcagtgcaagaaagacatcaggccattcctgagggttctgtccccatgacacaaacactctccactaggctgaccctccaaattggagatcaaatttcaacatgaggtttggaggggacaaacatccagacgatatcaggcttatacatggtacatatttattacatgttggatagatgtttctacaaaagaagatggcacaagatttatgatttattggatacttaggataagagagaagaaaacattagagttttacactaattaaaagtagagggattttctgtataagtgtaaggatatgatctttgttctacttagcttaaggaggtttgtctccattaattttgagttatgctataatgaatgctgtttttagatagctttgaagaggtagacatataattaaagtatgaataatttgtttgatgttgaacatcaatttcatctttgccaaaggtcatggactttaagaccagaatttctgaggtccacataataatttaatgactcaatgataatttttggtgttaaataaaagtcctgcagatgacctttctggacacaaagttgaatttagaattatcaaagagcaagcttgaatttgaatttgatgctattattttgttataaagaaagaatctattatgcagtgctaaaacaccagaaggaagatagtatgtctgaatatcttttaattggtagttatatttaaaagatgctaaattatacaataatgtcatagttggcaaaatatcatttgagtctgaaagatatcactgacaatctggctgcttatagactagctttcatatagtttccatgctgcgtctgtgtgtttttcattttaggttatagtgttgttggcaatgagaatatctcccaattgatgcatgcttaagagactaccagaaataaaaagtataatataatttgatatgcatttagagaaatgtttttctttagtattaacattttaaatgttactactgcctcataactgctgtaatagtgttttaatattttagctgtatgagtatttctcataaaaacctttatttaccaccagaattattgcctgagtttccccttatatagcatgtatctgaacattgtagaccccaaatgataaaataaattaagagactttttggctagattctggtttggtgatgattttttcctaattttagagttcctcttcattttacactcttttacaaatttgagtagttgtagtttattatagaatagttttgttaaaaatctcaattagggactacttttcaaaataatctcaggaaataaaaactgcttgaatttggacttctgcatcttaaaaaatgctaatactatttctctgtcaactacatcctagaaaattggtttatgattagatgtcatgtaaatcactaagctcattgaaagtcagtttttcttttttattggactgaatgggtaatgagcagaaatacctttctgctttttgtcttcctcctttcctctgggatgtgggaatcacattgaggagacagcatttggtttaggatgaaaggagagaaggctatcttttttctgggcccactgctgtggtaggtgcgtcattaacatctgtcacaccttttttaatgagtgcttttgatgtcaggaaaaagtcagatgacttccttaaaattaaaacatctctcttgcacgcaagaatgggaggagtattttgtgttcattttattttataacttcctccaattgtttatataagtcatttgttgaaatcagcagttcactgcaagggctgcttatcagaacctacacatatttaaaactccccagtagtgtgttcctatcagattagtacttctctgcctttgagacttggttccttagaggagaaactccagtgtctgtgagattattcacatgcactttattcccttgccagtgaaattgtttgaatactcaaaacatgtagccttggctatttttgtgagtttatgttcacattgcattttggccctaatgagtctcctagctattcatcaaccatgctcatggacatttcaggtattagagtagctttgaataatttcattttgaagtgtgttattctctcaccaccagggagactacaaaccaaattcagaagcaccaacttcagttaagctgagactgctggcaaatcctattaggtttccctagtctacttcctctcccttctctgtatgtcaatatttgaaaccttcttgcctctcaagcctataattctcttacttcggcagatgatcccacatttcccattcattggaatttaagatctttttacgatctcatgcgtggtcagtttttttggtgacagttctatgggtgttaagtttgctgcatattatagtttgtaaatatctattggattaaacttaattgtgttcttaaaattcattaaacgcttacctaatttttgtctaccttatctgtcagtttctaagaaaatatgtttctaagaggccaggcaacggtggctcacacctgtaatcccagcactttgggaggccaaagtgggcagatcgcttgagctcgggagtttgagaccagcctgggcagtatgttgaaacctcatctctataaaaatacaaaaattagccgggtgtggtagcacgttcctgtagtcccagctgctggggaggctgaggcaggggaatcacttgaacctgggaggtggagtttgcagtgagctgagattgtgccactgcattccagcctgggtgacagagcgagactccatctcaaaaagaaaaaaatatacttctaagaaagtatgattggagatttgttcaatgttttatttatattattgctttatatattcagaagctatgttgttaatgcattaggaattatgacttaccttcctggtcaattactccatttcatcaaatctaaggtaccatgcattatgagatacaacctgattgcagagatgttaaaatatggaaaaggatcaagaaaacatggtatttgttttatcagcaggaaacatttgtgttgtcctagttaattcttgttgctttcaactttgttttgtctgatactgacattattatacctacctttttttttttttttttgagacagaatctcattctgtcacccaggctggagtgcagtggcgcaatttcggctcactgcagcctcttcctcctgtgttcaagatattctcctgcctcagcctcccaagtagctaggattacaggcacccactaccatgcctggctaatttttgtatttttagtagacacagggttttacaatgttggtcaggctggtctcgaactcctgacctcaagtgacccacctgcctcagcctccctaagtactgggattacaggtgtgaacccccatgcctgtccatgcttttataatagcattgactgaaatatattttctattctttcattttcaaacttttggtgttcttttgttttagggttatcaactgtagaccactttatacttactgtccttaggagttctgccatcttgattttttctttctatttatcaaatggctgcctttaaaaattcaacgtatttagccatttttttttctagcagcactcaggattcatcatgataccttttccctcaccaaacaattaaaaagaacttcatcctttcactgccctgtttctcatatactgtacattgtcctaaactatattctctgggctataatttctactttcttggattcatcgttctttatttcacttgattatattttatgataaatttctcagagtatgtgagaagtaaatattcaaaactttgtatgtctgaaaatatattatttgcccttatatacagtttcatcatcttttagcctaatgttaggaattcagtttctcattcatttcttgattttagatgacttagtttattctctgaaagcttttggtttttttttttatttgaatttaaagaataaaaccgccagtttcatattgtccagattgagtggtttctttaaagacttgtatctgtttaggtccagaaaaatcttatgatgtatctgtttgattattgttcttgctacttattctgttagctcctcttagatttttgcttttcatgccatctgctgctcttaagtgttgtatcctgggaaagtccttagaattactttctagtccactaatttcctcttttttctttttgagttcaatgtgcttttctgtctatattgttaagaaactttatcttaggattatattagatttatagaaaaattatgaagataatacagatagttctcatatatcctacaccattttcccctatatttaacatcttaatatgataaatttgtcacaaataaccaacattgatacattttttacttacaaaagttcaaactttattcagatactgttagcttttctttttctgttccaggatcctatctaggatgccattattacatttagtcattgtgtttcattagattcttcttggctgtgacagtttctcagacttatccttgtttttgatcaacttatcagttttgaggagcattggtgaggtattttgtagaatattgctcaattagaatttgcctgatattttcttaagagtagactgggatatgggtttttgagaggaagaccacagagataaaatactgttctcatcacatcacattgagggcacatgctctcaacgtgacttatcactatagatgccatccctgatcacatagctaaggtagtgtttatcagatttctccaccataaagttacttttttttatcctttccatactctatactttggaaaaaagtcattatacactgtctacatttaaggattggagagttatgctctacctccttgtgggctaagtatttacatagactattttgtattctacacagaattgtccatccttccccatttactcatttattcaatcatttgctaatattttcttaaggattgttacaacatagatgtctgagttttctggtaatgtctttgtctggttttggtattaggataatgttggctttcttggtatatttgtgctgctataacaaaataccttagactgggtgatttataaaggacggaaatttatttctcacagttctggaggttgggagtctaagatcaaggtgccaacaggtttggtgtctggtaagagcctgtttaccacactctgtaagagtctaagtccttgtttccaagatggtgccttattgctccaccctatattggggaggaacactgtgtcttccgtggcaaaagggggaccttcaacctcaaaaccttttataggggtgctaatctgatgtatgagacagagccctcatgacctaatcacctcccaaaggccacacctcttaatactgctacactgaggattaagtttcagcatgaattttggagggaacactgtcattcagatcatagcactggctttatagaatgaggaaatgttccctctgtttctgttttctcgaaaagattgtagagcttggtattatttatccttttacggtttggtagaattcaccagtgaaactatctaggcctagtgcattcttttttttgaagatctttaattattgattaagtttgtttaatagacatagggctattcaggtattcaggttatctgtttatccttgtatgaatttttgtaatttgtgtcttttaagaaattggttggcccagagtggtcgcttacacctataatcacagcactttgggaggccgaggtgggcagatcacctgagcttaggagtttaagaccagcctgggcaacatagcaaactcctgtctctaccaaaaataaaaagaaattaagagagagagggagagggggagggggagagggagaaggagcaggaaagggaaggggaaaggaaagggaaaagggaaagggagtctctagagagagagagagagaggactgaaagggaagggaaatgggaaagggagtctctagagagagagagtggaatgaaagggaagggaaaagggaaagggagtctttttcatctaagcgggcatagagttgtttatagtattcccttatcttttttttttttttttttttttgagacagggtctcactctgtcacccaggctggagggactgaagtgcagtgtcatgatcggggctcacggcagcctcgacttcctgggctcaggtgatcctcctgcctcagcccctcaagtagctgggtccacaggtgtgtgccaccatgcccggctaatttttgtatttttggtagagacagtttcgccatgttgcccaggctggtctcaaactcctgagctcaagtgatctgctggtcttggcctcccaaaattttgggtttataggcatgaaccagcgggcctggccttcctttatccttttaatgcccatgaaatgagtagtgttagcccctctttcatatctgatattagtaatttgtggcttctctttctttttcccttggtgcctggctacaggtttaacagtctgttgatctttataaataactaacttttaatttcattttattttctctatttttctgttttcaatttcatttatttctgctctaatttttattattccccttcttctgcttgctttaggcttaattttctcttctttctctagtttcccaaggtataatctaagtttcacttattttcattcagttcaaaagattttctgtttttacatctagctccctctttggcccatgagttatttagatatatttatttccaaatatttggagttttccagctatatttttgttacttatttctaatttaacgctactgtctgaaaacatactttgtatgatttctgtttatttaaatgcgttaaagtatattttatgtcccagatgttgtctatcttggtgaatttccatgcaagcttaagaataatgtgcgttttgtcattgttggatggaatatgctataaatgtctattagatcaattgatatagatgactgttcagatcatctatatacttagtaattttttttccttcttgatttatcaattactgacagaagggtatttaaactctccagttattacagtgaattttgcctatcctcttgcagttctgtcagttttgccttatatattctggcactcttttgttgggtgcatacatgtttaggattgttatgtcttcttggaaaattgacagctttatcattatgtaataccttcctttttctctgataatcttccttgttctgaagtctgctttgtctagtattaatatagctaattaatatatcaatataacaatgtaataaaggtattccatctttcttttgattaattatagcaagctatatcattctttttttttttttttttttttttgagacggagttttgctcttgttgctgcgcagcctggagtgcaatggtgcaatctcagctcaccacaacctccaactcctgggttcaagcgattctcctgcctcagcctcccgagtagctgggattacaggcatgcgccaccacacctggctatttttgtgtttttagtagagacagggtttctccatgttggtcaggctggtctcgaactcctgacctcaggtgatccacctgcctcagcctcccaaattgctgggattacaggcatgagccactgtgcctggcctccctttactttttttgtaacttttagtcatgtggctttttaatgaaagggtatttaaactataatcactaatacatgaagatcttcaaaaaattatataatagagatcctcctattcagaattttgaagtccttgttttaatctgtaacaaagagctgttttgaactcagctgagcctccttggatggggcataagaggagcatctgttatctgctttcaatccattgcccctttgtccctttacaagttaccttacccagaattgcctgtgctcatgattctttcgttctagctatctttgttttctacctcctcctctctgacttactttcttctcctgctaatattttcccccattttaaaaaattacagtaaaatgtacatagccctaaaattaactatcttaactattgtgtgtatttccttggcattaagtgcattcattctgttgtgcagctatcactgctatccatctcaagaactcttcatcttgcaaaactgaaactctgtgcccattcaacaaagactccacatccttccctcttcccttttaccttctatttctatgatcaggactattctagccttatataagtagaaatcatacagtatttatctgtttgtgactggcttatttcacttaccataatatcctcaaggtacatccatattgtaacatatgttagcatttccttcctttttaattctgaataatattttgttacatctatataccacattttgattatctgttcatccatcattagacatttggattgtttccacatttcagatattctgaatatggatgtacaaagatctctttgagaccctgctttcaattctctagtgtatactcagagtggaattgctggatcatatgataattctattgttacttttgagaggaacttttatactgttttcacagtggctgtaccattttacatgcccaccactgatgcagaagagttccaggttttcagtatcatcaccaaaacttattactttcatttttcggggtgttttttatagtggctatcctagtgggtgtaaagtaattatccctttacttttactctgaatctttatatttaaagtgaattttcttgtagacagcacatagtttgtcttgttttttaatttactctgataatccctgtcacttaataggtatatttaggccagttacatttaaagtgattgttgctgtaaccagattaatatctaccatgtttccaactgttttctttctgttcattgcattggttattggtttcttttctccctctttttctgccttcgtcagttttgagtactttatataatcttatctcctctctcaaaattttgattatacttattttaaaaatttttagtggttgccctcagttttacagtatacgtttttaactaacctaggttcttaagacaacactatactgcttcatttgtactataggtattttataagagtattcccaattcttccctcccatcccttgtaatagtgctgtcatttatttcacttacccatatgctgtagctacccagtatattgttactactattgctttaaacaaatcattaccttttaggtcaactaagaataagaaaaataaaagattttattttacctttgctttttccttctccagcactctttctttctttgtaaatccaagtttctgacctatatcattttccttctgcttgaagaacttcttttaacatttcttgcagggcaaattatctgctgattgattctccttatttttgtttgtctgagaaagtttttatttctcattaacctttgaagtgcaattttgctggatatagaatgtaaggttggtgggtttttttttcagcactttgaatatttcactacacttaacatggcttttgacatgctctccactgtaattcttatcattattcctctggaggtagggtggttttttttattctgccgtctttcaagattttcgctttgtctttggttttctgcagtttgggtatgatgtgcttaggtgtagatttttaaaatatttattgtgcttggtatcctctcagcttcttggatctgtggttaggtgtttgtcattaattttggaaaattctcgctttattctctcttctctgatattccaattagatgtacattccactttttgataatgccccatgattttggatattctgtttttttcattcttttttctctttgcattttagtgtaggaagtttctactggctgtcctcaattgacccattctttccacacccacgttgaatctactgatgagcccatcaaaggcatgcttcattttttctttgtagaattccttttgattctttttttacagttctgtctctgtgcttactagtctcttcttgcatgttccctacttattttcattacagcccttagcattctagtcatagttatttgaaataccctggtgataattccaacatctttgtctttttctgatggttgttttgtttcttcagactggggtttttcttgtttggggcatgaaaatattataatttcttgttgaaagcttggtgtcttgtatgcagtaataagaactgagataaataggcctttagtgtgaggatttatgttaatccagctagaagttgggttgtgtgtttaatgtttgttgtagctataggttatcagagacttgaagcttctttagcgtacttgattttttgtctctactcttgacttcggaacttccctaagtattactcctcagagggagcctttttcttgcagttctttcagctaatagttgtttccgctattattcttgagcactgtttgtataatgttaagatgtgagggagaaggacatgctatgatctttgattaagtctcaggttttcagggggcttgtcttatggttgtgaccttcacaagtgtttctccagtagtacagctttcttccccctgttccctattccctttcccatctgtagtgttcccaatctatttcctgaagcccctgtcctctcttgactatgggttgtcgtattctcttctaacccccacttaggtcaaacaggaaagctgaagaaaattggaggaacaaggaatttctttcctctagctgggataagctttcacaattaattctctggaacaggttctgggcatgtttcatgatggttactcttcctctccccctgccagagacaggagggaatcttttggaatcctcgtgatgacaacctggtaaaattcctggagggaatgtccacagaaatgtagtcacccctaagactgtggcccccaggattttttcattctcacaatagtccacactcaacctctagcaatttgtaagattaccttttaagtgttcctaccagtttatgtctcccatggcttctgcttcatgtaagcaaatcttggttgctgtatgtctctgaatgcacctgtctctacagtttggggtggggatttgccctgcaatctcatttctctagtgagtccaggaaagtcattcattttcaattttccagctttttcttgtaagaatgaaaatgatgactttcaagctatttacatgccaccattgaaactggacatctctcctggctatatttttaattttcaacatctgtaattttttttttgtttttttttgagtcagagccttactctgtagcccaagctggagtgcagtggtgcgatctcggctcactgcaacccctgcctcccaggctcaagtgattctcatgcctcagcctcttgagtagctgggctacaggcatgtgccactacgtccagctaattttttgtattttagtagagatgaggtttcaccatgttgcccagggtggtcttgaactcctgagctcaagcaatctgcccaccccagcctcccaaagtgctgggattacaggcatgagccaccacacctggcctgtaaacttttttttataacagcttattcttgttttatggtattctaatattgatatctcttgaagttttctcctgtttccttatttgctgtttcctttattatttctcttgttgaattttatgcctctctttcattgtgttaattgttaattctagattgtttagctttctatacatatttgcctttgattatccctatattaggttgttgataggttgttgacctatcacaagtttattcataaaagtttgtcataagcactctttttggggaaggaggtttaaggttttgtcccaagaaaaaaagctagggtagcgtgtggctcaataggagcagaagcagcagtatttctggctcagactatccaaaaatagtttgtttttgttgttgttgttgttttgttttgtttttttaattactcatgtattttctcatgtcctttactctatggaatatctctggtcttgcttatctgctcatttgaaaacttttttcctctgccagatttagctgtagattttctctatttttttgttttcaccaaaccactttctatcgtttaagaattcttcaacattttaattttaagaatggcattttcttttttctttttcgtgtgtgtgtgtatgtgtgtgtgtgcgtgtgtgtgtgtgtgtgtttagagagacagggtttcactttgttgcccagactggagtgtggtgaagtgatcatagctcattgcagctttgaactcctgggctcaagcaacaatccccccatctcagcttcctgagcaggtgggactacaggtgcacaccaccacacccagtgacatcccttgttatacaagtagttgtttctgtaattttaagagattttggttggaaaggaaggtagacaagtatggctcaatccagcttgatccaatcacattcactttcaattaatgaatagatttgttactattagtagtggtaagttaatattaattgagcatttagtttatgccaggaaacatgataaatcctttaactatattttaatcattacttaaacacagtaaagtagatattgttactatttgtatatatgtttaagaaaatggaaacttaaaaacattaaataatctacacagcaccacacagctaatatatctgttggagctaggatatgaacccaaattctatcccagcaaactcaattaacctcagttcctcactcacctgaaacttcctccctcaagttgatttgctaataagatgcctcccttctaccaggccaaatcctgtgtatcattcaaggcccagctttaaatgccacctcagcagcagtgctctgggcaatattccagcagaaagaaaactcttaacttttaatttaactttacatttatttgacctcttgtctagcactttctactttatatgtaatacagtcatttgatgcatagtttcgtccctactgcacaatgagatcactaggaaaagtgtcaatgtccttgtgtcacttatttttacaattcccagcattccccagcatgtaccattttaataaatattattaataagtaattatatttattcagtttaacttctttaatttataaatgcatccttattggctcattataaatatttgcatggattttatttaaatatgattaaaggatcttgagcatatttgttttaaacctgtctttgggattaatatttatgaatatccaggaaatggcaaatagttttagaactaattagatagaggcttctcattatacttacgtcaataaagatatctgaatatgtatgaaaatttcaaggagattcaggatatttgggagccatttgcatactaactaaacattttgatttttccttctggaagttaaataaaatggattacaatatggaaggtgattcccaaattaaaagtaggcatcaaataaatcattgcttttgtcacataaaccttgaaggaaaatagcatatctgtcaagtcttaaaattcatgtcagaatttcacaaagcaattgattataagctatctttcttttaaatagtacgtagcaaagaagtttgtgccatttcaaataagtgacatgtcagacatggagtccctgagatttattagcaagaccattttgttctgtttcagaaaattacagaattttggaattacaaattttacctgtacagtggttatctttacagtaatccttaccattttctagtgatagggtattctttctcacaagacatcccattctagtgtttagtagaactttattttttttaaaaactgttccttattttaaactaaaatctgcctgttttctaaagcttcttttttacctatactttgaacttacagaatctataaaaatcttaagattggctaggtgtgatgactcatgcctgtaatcccagcactttgggaggcaggggcacatggatcacttgagcccaggagttcgagaccaacctgggcaatatggtgaaatgccgtctctacaaaaaacacaaaaattagtgggacatcgtggcacgcgcctgtagtcccagctgctcaggaggctgaggtgggaggatcacccgagcccaggaggtcaaggctgcagtgagctgtgattgcaccactgcactccagcctgggtgaaagagtgagaccctgtctcaaaattaaaataaaataaaataaaaataaaaacaaaaaaccttaagattttcatgctaactcccatgacagcagttgtcaagcataatgggatagggcatagggagtggggatatagttctttctctgagtctcctgagagcagatgtttataaactagattgtgacaggataagtggatgctaattctgaatcatcaccaatgtgtagtattattcctctgctttagttttcttttattcattatcattatattttaaatttggaaaaagttatgaattgtattagcttgggaagggaagaataaatatgtcttttcttatacttctcatttatgagcttcatgaaatatgactaatctgttgagagacaccattgggaacaacctgtgtacagcctgaactcattgtatctgccatgtatttttcagtggctcctttacatgacagattactctcaggagcaaataatatgcagctcttctcacattttgttagtgtttttatttttaataaagtgctatgattaatagcctagtgttattgttgtttccccattgagtgtaaatgcttcatttgaatgtctttaatctgaaggaacagttgttttattggactcttgttatttttctgtgcttctcaaggttttttgattgctttctttgagctctttgcaatggaggaaatgaactctatcagaatcatggagtaggactccgtagagaaattttgaggatgaatactgagatacttgaacattcatacatacatttttatgataatttcagaatggtagacacaccattagcaattctgattgactctccagtggcaattataaaagtagcttggccgggcacggtggctcacgcctgtaattccagcactttgggaggccgaggcaggtggatcatctgaggtcaggagttcaagaccagcctggccaacatggtgaaatcctgtttctactaaaaaacaaacaaaaaaaagcacaaaaattagctgggcgtgggtggcaggcgcctcccagctactcaggaggctgaggcaggaaaatcacatgaacccaggaggcggaggttgcagggagccgagatcgcaccattgcactccagcctgggcaacaagagcgaaactctgtctaaaaaaacgaaaaaaagtagcctatgtctggcctactggtattgtgatgacattgccatatagatcctatctgaagtgccatgtgctttcaataagtctttctgttgttgttgttgtttgcaaatcagagttaaagtataagacaagacaagaggtggacacaaaaggactattgaaaagttgagaaattgtgaactgagcttttacaagaatatggtgcccacttaccaagaggacagctcttcttgttatttttgcccttgaagtggtgataccctttagcctagtcatttctgcatttactcccaggagcctggctgtgattagaagtgtttcctgtagccatagaccaattttccttttgttcaagaatccagaaggcaagttgggcctcattggcaccaaccatcaaggacttcattagccctaaccaggggccaactaaattgtcaaattggaaatgaaggactttacatgaattcaaagccactgataagagagcttgaaggcttatcttgtgaaactgagtgttgaatgcataacttttatttgagaaagcaaataacttgggtggaacttctacaaattagagcaaaataatttaggatttatttggaggtttaatagcttgttaggtgtagccttgaatatgtagcataacatatgcatttatattatatacttagaaacattctggtctttttggttaataagagtattacttttactggctcttagattgtttcagaggaattagagctgtctagttttgtataatcaagtctttattttcatgtaaactaagtaagttctgtttagaaagtcagccccagaaggtttatttacgcactatataagctcatgttttaagattctccatatccccaaaattaacatttttgtttgtaagtgttctgttagtttttagtcattgaagaagcatttattgaatgtatagtaatattactttctacaaagaaaacgaatgtcataacataaaaatacataaacattttttacaatgaccagagcttagaaatactttaaatacagcattttttaaaattacagtggtacttctttgaaagaggttgtctgataattattgtaatatcttaaaagcacttggaccttacttctggccatgaccgaataactagtactggactaggcctcttgctgtaaacagctagaaaattagacaaaatatatggaatacatgtttgtagacatttgaaaacatgcagaaccatgatccctaagactaaggaaaacaaatgggatgagccccataattgccctcccagctttccgcttggagccacttttctgtagcataagatgccccatttatgaacaggcagaagggagcagacagcccagcagtctcagtgagactgagatcagagtttaggtgtagaaaagtaggtggggccgggcgtgttggctcacgcctgtaatcccagcactttgggaggccgaggcgggcggatcaggaggtcaagagatcaagaccatcctggccaacatggtgaaaccccgtctctactaaaaatacaaaaattagccaggcgtggtggcacatgcgtgtattcccagctactcgggaggctgaggcaggagaatcacttgaaccagggagtcagaggttgcagtgagccgagatcgcgccactgcactccagcctagcgacagagcaagactccatctcaaaagaaaaagacaataaaagtaggtggaatttgtgcagcaggctactggagagaagagaaatatgcagagaagaagcccaaggaagctatatagggttccccttgagtcttttgggtctcacattacatttagtctccttcagtttgtgatagttcttcagtctttccttctctgccatacccttgacacttttgaaaagtattggtcaggtattttgtccagtgttctcagtatggatttgtctgatacttttttgtgattacattgaggttatggattttttttggaggaataccacagaagtgatgtacccttttcaatacattcgtatcggggtacatgatatcagcatgtcctgttatttggtaacgttaacactgatcatgtggttaaggtggtttttgccagtcttcttgcagtcatctctgagcccagagcctctctgatttatttagtttctcctgagtgtaaatctcctattgccaagggtgagggatttggagatttaaagctcttcttacaggagctttcaaataattcctccatcccccatatcatcctttcctcctgaagtgctgctgattcctgaaggtcagttggcttgaggctcacctgtctgtccctttggaggtacttagattgactctttcccgtgaaataatttacttttcttctatccaccttcttctttcatatattatagattaggattacaatccaaaatatctctcagttttatcagaaatggagtttgtgttcctatttcttgtcctgtttgttgtttgggtgtatttatgaagtggtggacccagaaatgtattcgaccttccatgctaaaactgaagctaaaaatagctttttcagaagacagtatttggcatcatttctcaggcattcaaatacaaacttttgactcagcatttccacttctagcaatttgtcttacagaaatatttacacatggacccaaagataacatgtataggaaagtttatagaagcattgctgatagtagcaaaaaaaaagtaatggaaacagcccaaaaaaaaaggaaaaacaagggaatgattaaataaatggtggtatatctatattgtagaatactattcagcaattagaaataatgaggtttgtctttatgtactgttatgggaacctcctaaagacattacatcatatagcagtttgtaaagcaacatgtttggtatcatttcattcccatatttatgtgtatataaaagtgtgtcattgaaatgaaaaatatttgaaagaatatgcgccaaactattaatagcagtgttttggaggtcatcaaaagggaaccataatctttgtatacttcttaaactttgtatacttctgtaccatatgtattatttttataacaagcatattgcattttgatttttcaataaaaagatgaaatagactacctacagcagtagttgagcaaccactggaggttttcaggcatgggctctttttgttgttgttgttgttggttgaatttgaatgtcattcctgcattggtcatttattggatttctctgtagcatttatttattttcatttttccgtaagttattagggtacaggtggtatttggttacataagttctttagtggtgatctgtgagattttggttcacccatcacctgaacagtatacaatgcaccatatttgtagtcttttgtccctcgcctccctcccaccattctccccaagtccccaaagtccatatcattcttaatgcctttgcgtcctcatagcttagctcccacatgtcggtgagaacatttgatgtttggttttccattcctgagttacttcactttgaataatagcctccagtctcatccaggtcactgcaaatgctgttaatgcattcctttctgtggctgagtagtattccatcgtataaatataccacagtttctttatccactcattgagtaatgggcatttgggttggttccacgattttacagttgcgaattgtgctgctataaacgtgcacatgaaagtatctttttcatataatgacttattttcctctgggtagatacccagtagtgggattgctggatcaaatggtagttctacttttaattcttcaagaaatctccatactgttttccatagtggttgtattagtttacattcccatcagcagtatagaagtgttccctgttcaccgcatccatgacaacatctactgttttttgattttttgattatggccattcttgcaggagtaaggtggtagcgcattgtggttttgatttgcatttccctgatcattagtgatgttgagcattttttcgtatgttggccatttgtgtatcttcatttgagaattgtctgttcatatccttagcccactttttgatgggattttgttttcttactgttttgtttaaattttttgtcgattctggatgttagtcctttgtcagcttgttagtcctttgtcagattgtgaagcttttctcccactctgtgggttgtctgtttactctgctgactgttacttttgctgtgtaaaagctctttagtttaattaagtcccaactatttatttttgtttttattgcatttgcatttgggttcttggtcatgaaatccttgcctaagccaatgtctagaagggtttttccatgttatcttctagaatttttatagtgtcaggtcttagatttaagtccttaatccattttgagttgattttcatataaggtgagagttgaggatccagtttcattctcctacatgtggctagccaattatcccagcaccatttgttgaaaagggtgtcctttccccacttcacgtttttgtttgctttgtcaaagatcagttggctgttaagtatttgggtttgtttccaggttctctattctgttccattggtctgtgtgcctatttttttagcagtaccatgctgttttggtgactatggccttatagtatagtttgaaatcaggtagtgtgatgcctccagatttgttctttttgcttagtcttgctttggctatgtgggcttttttgtttgtttgtttcatatgaattttagaattgttttttctaatttcgtaaagaatgatggtggcattttgaatggggattgcattgaatttgtagattgcttttggcactatgatcattttcacaatattgattctatgcatccatgagcatgggatgcatttccatttgtttgtgttgtctgtgatttctttcagcagtgttttgcagttttccttgtagaggtctttcacctccctgattaggtaaattccaaagtattttgagttttgcagctattataaaaggggttgagttcttgatttgattctctgcttggttgctgttgatgtatagaagagctattgatttatgtacattaatcttgtatccagaaactttgctgaattcttttatcagttctaggagctttctggaggagtctttagggttttcagcgtaaactatcatatcatcagcaaacagtgacagtttgacttcctctttaccgatttggatgccctttatttctttctcttgtctgatttctctggctaggactttccagtactgtgttgaaaagaagtggtgagagtgggcattcttgtcgtgttcctattttcagagggaatgctttcaacttttccccattcagtattatattggctgtgggttagtcacagatggcttttattacattgaagtatgtcccttgtatgctgatttgctgctaacaattttaatcataaagggatactggattttgtcaaatgctttctctgcatctattgagaagatcacatgatttttgtttttaattctgtttatgtggtttatcacatttaattcacttgcgtatgttaaaccatctctgcatccctagtatgaaacacacttgatcatggtggattatctttttgataaattgttggatttggttagctagtattttgttacggattttagcatctatgctaatcaaggatattggtctgtagttttcttttttggttatgtcctttcctggctttggtattaggctgatgctggcttcatagaatgaattagggagggttccctttttctcaatattgtggaatagtgtcaaaaggattggtaccaattcttctttgaatgtctgatagaattctactgtgaaatctgtcttgtcctggacattttttttgttggtaatttttttttaattatactttaagttttagggtacatgtgtacaatgtgcaggctagttacatatgtatacatgtgccatactggtgcactgtacccactaactcgtcatctagcattaggtatatctcccagtgctatccctcccccctccccacaccccacaacagtccccagagtgtgatgttccccttcctgtgtccatgtgttctcattgttcaattcccacctatgagtgagaatatgcagtgtttggttttttgttcttgtgatagtttactgagaatgatgatttctaatttcatccgtgtccctacaaaagacatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcggcatgatttatactcctttgggtatatacccagtaatgggatggctgggtcaaatggtatttctagatctagatccctgaggaatagccacactgacttccacaatggttgaactagattacagtcccaccaacagtgtaaaagtcttcccctttctccacatcctctccagcacctgttgtttcctgactttttaatgattgccattctaactggtgtgagatgatatctcattgtggttttgatttgcattgctctgatggccagtgatggtgagcattttttcatgtgttttttggctgcataaatgtcttcttttgagaagtgtctgttcatgtccttcgcccactttttgatggggttgtttttttcttgtaaatttgtttgaattcattgtagattctggatattagccctttgtcagatgagtagattgagaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtaatgcctaggttttcttctagggtttttatggtttcaggtctaacatttaagtctttaatccatcttgaactgatttttgtataaggtgtaaggaagggatccagtttcagctttctacatatggctagccagttttcccagcactatttattaaatagggaatcctttccccattgcttgtttttctcaggtttgtcaaagatcagatagttgtagatatgcagtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattgccttgggcagtatggccattttcacgatattgattcttcctatccatgagcatggaatgttcttccatttgtttgtatcctcttctatttcattgagcagtggtttgtagttctccttgaagaggtccttcacgtcccttgtaagttggattcctaagtattttattctctttgaagcaattgtgaatgggagttcactcatgatttggctctctgtttgttattggtgtataagaatgcttgtgatttttgtacattgattttgtatcctgagactttgctgaagttgcttatcagcttaaggagattttgggttgagacaatggggttttctagatatacaatcatgtcatctgcaaacagggacaaattgacttcctcttttcctgattgaataccctttatttccttctcctgcctaattgccctggccagaacttccaacactatgttgaataggagtggtgagagagggcatccctgtcttgtgccagttttcaaagggaatgcttccagtttttgcccattcagtatgatagtggctgtgggtttgtcatagatagcttttattattttagatacgtcccatcaatacctaatttattgagagtttttagcatgaacggctgttgaattttgtcaaaggccttttctgcatctgttgaggtaatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttgtattgattggaatagtttcagaaggaatggtaccagttcctccttgtacctctggtagaattcggctgtgattccatctggtcctggactctttttggttggtaagctattgattattgccacaatttcagctcctgttattggtctattcagagattcaacttcttcctggtttagtcttgggagagtgtatgtgtcgaggaatttatccatttcttgtagattttctagtttatttgcatagaggtgattgtagtattccctgatggtagtttgtatttctgtgggatcggtggtgatatcccctttatcattttttattgtgtctatttgattcttctctctttttttattagtcttgctagcagtctatcaattttgttgatcctttcaaaaaaccagctcctggattcattaattttttgaagggttttttgtatctctatctccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagcagtcattcaagagcaggttgttcagtttccatgtagttgagcggctttgagtgagattcttaatcctgagttctagtttgattgcactgtggtctgagagatagtttgttataatttctgttcttttacatttgctgaggagagctttacttcccagtatgtggtcaattttgtaataggtgtggtgtggtgctgaaaaaaatgtatattctgttgatttggggtggagagttctgtagatgtctattaggtctgcttggtgcagagctgagttcaattcctgggtatgcttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatctctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttgtaattggagcatttagtccatttacatttaaagttaatattgttatgtgtgaatttgatcctgtcagtatgaggttagctggttattttgctcgttagttgatgcagtttcttcctagtctcgatggtctttacattttggcatggttttgcagcagctggtaccggttgttcctttccatgtttagtgcttccttcaggagctcttttagggcaggccttgtggtgacaaaatctctcagcatttgcttgtctgtaaaggattttatttctccttcacttatgaagtttagtttggctggatatgaaattctgggttgaaaattcttttctttaagaatgttgaatattggcccccactctcttctggcttgtatgtagagtttctgccgagagatccactgttagtctgatgggcttccttttatgggtaacctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccctgtcattttcaggtacaccaatcagacgtagatttggtcttttcacatagtcccatatttcttggaggatttgttcgtttctttttattcttttttctctaaacttcccttctcgcttcatttccttcatttcatcttcatcgctgataccctttcttccagttgattgcatcagctcctgaggcttctgcattcttcacgtagttctcgagccttgctttcagctccatcagctcctttaagcacttctctgtattggttattatagttatacattcgtctaaatttttttcaaagttttcaacttctttgcctttggtttgaatttcctcctgtagcttggagtagtttgatcgtctgaagccttcttctctcaactcatcaaagtcattctctatccagctttgttccattgctggtgaggaactgggttcctttggaggaggagaggcgctctgctttttagagtttccagtttttctgctctgttttttccccatctttgtggttttatctacttttggtctttgatgatggtgatgtacagatggatttttggtgtggatgtcctttctgtttgttagttttccttctaacagacaggaccctcagctgcaggtctgttggagtttgctagaggtccactccagaccctgtttgcctgggtatcagcagcagtgtctgcagaacagcggtttttcgtgaaccacgaatgctgctgtctgattgttcctctggaagttttgtctcagaggagtacccggccgtgtgaagtgtcagtctgcccctactggagggtgcctcccagttaggctgctcaggggtcaggggtcagggacccacttgaggaggcagtctgcccgttctcagatctccagctgcgtgctgggagaaccactgctctctgcaaagctgtcagacagggacatttaagtctgcagaggttactgctgtctttttgtttgtctgtgccctgcccccagaggtggagcctacagaggcagacaggcctccttgagctgtggtgggctccacccagttcaagcttccgggctgctttgtttacctaagcaagcctgggcaatggctggcgcccctccccaagccttgctgctgccttgcagtttggtctcagactgctgtgctagcaaacggcgagactctgtgggcgtgggaccctctgagccaggtgcgggatataatctcctggtgcgccgttttttaagcccgtcagaaaagcgcagtattcaggtgggagtgacccaattttccaggtgccgtctgtcacccctttctttgactaggaaagggaactccctgaccccttgcgcttcctgagtgaggcaatgcctcaccctgcttcggctcgcgcacggtgcgctgcacccactgacctgcgcccactgtctggcactccctagtgagatgaacccggtacctcagatggaaatgcagaaatcacccatcttctgcgtcgctcacgctggaagctgtagaccggagctgttcctattcggccatcttcactcctccccctgttggtaatttttttttttttttttttttttttttttttgagacagagtcttgctctgtctcccaggctggagtgcagtggcgcaatcttggctcactgcaagctccatctcctgggttcatgccattctcctgcctcagcctcccgaatagctgggactacaggcacccaccatcacacccagctaattttttgtatttttagtagagacggggtttcaccgtgttagccaggatggtctcaatctcctgacctcgtgatccgcccgcctcagcctcccaaagtcctgggattacaggtgtgagccaccgtgcctggcggtaatttttaaattaccatttcaatctcgctgcttgttattgatctatttagagtatctaattcctgattaaagctaggagggttgtacttttccaggaatttatccatcccttctaggttttctagtttatgtgcataaaggtgttcatagtagtcttgaatgatcttttgtatttcagtggtgtcagttttaattattcctgtttcatttcttaatgagattttttggattttctcttttcttggttaattttgcttatggtctgttggttttatttatcttttcgaagaaccataaataaattgttctttgatgtaaaccaaaataaattttaatttatcttttgtatttttttgtttgtttcagtttcatttagttctgctctgatcttggtactttccttgcttccaccgggtttgggtttggtttgtccttatttctctagttccttgaggtgtgaccttagaatgtcagtttgtgctctttcagtctctgatgtaggcgtttagggctatgaactttccttttagcactccctttgctgtatcccagaggtcttgttagattgtgtcattattgtcattcagtttgaagaattttaaaatttccatcttgatttcgcttttgaaccaaagcaggttttgaacctgctctttcaggagcaggttatttaatttccatgtatttgcatggctttgaaggttccttttgaagttgatttccagttttattccactgtggtctgagagagtgcttgatataatttcagttttcttagatttattgaggctcactttatggcctatcatggagaaagttccatgccctgttgaatagaatgtgtattctgtggttgttggatgaaatgttctgtatatatctgttaagtccatttgttccaaggtatagtttaaatctattgtttctttgttgactttctgtcttgatgacccatctagtgctgtcagtggagtattgaagtcccccactattattttgttgctgtctatcacatttcttaggtctgttagtaattgttttataaatttgggagctccagtgttaggtgcatatatgtttaggattgtgatattttcctgttagacaaggccttttaccattatataatgtccctctttgtctcttttaactgctgttgctttaaagtttgttttgtctgatataagaatagctacccctgctcgcttttggtgtccatttgcatgcaatgcctttttccacccctttaagttcatatgagtccttatgtgtcaggtgagtctcctgaaggcagcagattgttggttggtgagttcttatccattccgcagttgtgtatcttttaagtggagcatttaggccatttacattcagtgttcatattgagatgtgaggtaccattacatgcatcgtgctatttgttgccagtgtaccttggttttttgttttttgtttttgctttttaacttgtacttttgttttatagatcttgtgtgatttatgctttaaagacgttctgctttgatgtgtttccaggatttgattcaagatgtagagctccttttagcggtctcgtagaggtggcttgggtagtggtgagttctttcagcatttgcttgtctggaaaagactgtatctttccttcatatgtgatgcttagtttcactggatacaaaattcttggctgataattgttatgtttgaggaggctgaagatagggccccaatcccttctagcttctagggtttctgctgagaaatcttctgttaatctgataggttttcctttgtaggttacctggtgcttctgtctcacagctcttaagattctttccttagtcttaactgtagataagttaagcacactgatgacagtgtgcttaggtgatgatctttttgcaatgaatttcccaggtgttttttgtgcttcttgtatttggatgtctaggtctctagtaaggccaaagaagtttccctcgaacattttccaaatatgttttccaaactttcagatttctcttcttcctcaggaacaccaattattcttaggtttggttgtttaacataatcccagacttcctggaggctttgttcatattttcttattcttttttctttgtctttgttggattgggttaattggaagaccttgtctttgagctctcaatttctttcttctacttgttcgattctattgctgagactttccagagcattttgcatttctataagtgtgtccaatgtttccagaattttttgttttttctttatgctatctccttgaatatttctctcttcacttcttgtatcattttttggatttccttgcattgagcttcacctttctctggtgcctccctgattaacttaattaacctcctgcattctttttcaggtaaatagggatttcttcttggtttggatccactgctggtgaactagtatgattttttggggggggtgttaaagagcctagttttgtcgtattaccagagttggttttctggttccatctcatttgggtaggttctgtcagagggaacatctagagctgaaggttgttgttcaggtactttggtcccatggggtgttcccttgatgtagtctctcccccttttcctatggatgtggcttcctgagagccaggctgcagtgattgttacctcttttctgggtctagccacccagcaagtctatccagctccaggctggtactgggggttgtctgcacagagtcctgtgatgtgaaccgtctatgggtttctcagctgcggataccagcacctgttccagtggaggtggcaggggggtgaaatggactctgtgagagttcttagctttggtggtttaatgctctatttttgtgctggttgccctcctgccgggagtttgtactttccagagagcatcagctgtggtagtatagagaggaaccagaggtgcgcggggtcctagaacttccaagattatatacccttgtcttcagctaccagagtgagtaggaaaggaccatcaggagggggcggggctagatggtgtctgagctcagactctccttgggcgcgtctccctgcggctgctgtggaggatgggggtgagttaatggagttgtgtacctaggagcattatggctgcctctgctgagtcatgcaggttgtcagggaagtggtggaaagccgcagtcacaggcctcacccagctcccacgcaaaccaaagggccagtctcattctcactgtgccccatctaacagccccgagtctgccagcagttggggagccaggcttgagaacttgccccaggctgcctgcctcccagctgtgaaagaaaagggcttgattcttccccagcctgtggagtctgcacacctgattcgcaccctttcccgagttctggccaggagggttctccccagcttcaaattgttacaaagttcagctggagatttccttctccctgtggtgtttttccccacactcctccggttgccctcccaaaggatccctgtggtgccagttaggaatggcctgcctggggacctagtgagctcccggggcctttctcgctgcttcctctacccctgtattttgcttggctcgctaaattgactcagctccaggtaaggtcggaaacttctccctcaaacaaccttcagtttctccagtggggatgtgtgttcaggagaggagaatctccctttcccacttccacagttggggcacttggggcactcacagtatttggggtgtctcccaggtcctgcatgagcaatccactgccttcagaatccacttcctgtgggtcctctcgggatttctggtttgttcttgcagtcaatctggagcttaaattcacagtgcgagcctccgcacactgctctgtccgtccaagtcggagctgcagtctagtcctgcctctcccgtctgccatggtgatccaaagaatgcctgcatgggctcttttaaagcggctctctgctagacagtatctcaggaagcatttaattcagggatggatccccagactggattactgtttggggaaatagggatttcatgatcaaataagaatgagaaatgctaggttaacaaacagaagaggtgctaggagtcattaacatactaatatgcatggcaaatctctacaatctcccaaatttgattgttgttctcttttttattttacggtatatgtgttaacatttcccaaaagtaatattctgtggaagtatacttttgttcacactgttactatgtttggagtaataagcaccatgtaaatctgactccgttctgaataatgaattctgaataatgttagagtgaacattcctgggaaataacaatttagtagattcctaatgaagggccagagagaaagaatatttcccatgatactttcctacctttcaaatgagcttagaaatttttaaagaaatttcaaaactattttcaaagaaaggttatgaaaaaggaacaaaatttggattccaaaaagaaaatgtaaatgtacctactcacagctgtagttggtgtgagtgggcgtcaaattaggataactggggatctgcttaaccaagggtgcaacatgcctagtgcagaatttaatgatctccaccttcagaaactttcaaatacatgtattggttaaactaataattatagactgttactaagtgacactttatcagtcacaaatctaatgtattgaaactggaaccgtcaaccacagcatagctagattttgaaagttaattctcagaaatattaggagcagctctgatgacttactcaatataaagccgggtcaggccgggcgcagtggctcatacctgtaatcccagcactttgggaggccaagacaggcacatcacttgaggtcaggagttcgagaccagcctgaccaacatggtgaaaccccgtctctgctaaaaatacaaaaattagccgggtatggtggcgcatgcctataatcccagctacccgggaggctgacgcaggagaattgcttgaacccaggaggcagaggctgcagtgagccgagatcacaccactgcactccagcctgggcaacagactccatctcaaaaacaaacaaacaaaaaagccagatcaggagaaacgtcatcattctttaggaacttccacggaacaattcaatttctgctacttacaaccctgtgcaggcccttaggtttcagcgactgggccagtgtgaagctgctgccaagcatttgagcagcaggtcagagcggacagcaatgctcacatttgaaaatgtaataccttttctcaaatagatttcccagtggcctttggcttgattcagatttacatggtgtttacatactgttctaaacatagtagcagtatgaacaaaggtataaaagctgtaaagttccttcttgttaagtaaccaagcaaatcaagagcacatcctgtttaggaaataagcctagaaagcgaggatgggaccagtctggaggactttgaacactgtcctgagatgtttagacttattctggaggctgtttggtacagttacaatgggtgaactttatggtatgtaaatcatacttcagtaaagctgttgaaagaaagactggatagttgaaactattaaacatccttttttttcctagtgtaaaacagcaatagttacacagtcctaggacatttcttttgctcaaaacacctgagcttaaaatctgtctgaagtcttcataaaattaaagtgtccagaaattatcaaagacttttataaatgccaaccagtcatcaagggcccaaagcaaacatgaaaaatacagatctgtaggccacatgtagtaaaaacctttgtttcttagagtcaggctggttgctttcccttctgccaccagagtagttatctcattgcgctcttaatttacatttccctaatgactaatgatgtcattttcatgtgcttattctatgttttctttgatgaaatgactattcaaagctattgcctttttttttttaactttggttgttttcttaatgagttgtaagagttcattatgtattttgggtataagttttttttttttttatcagatacatgatttggaaatattgtctgccagtctgttgcttttcatttacttagttttgggttgttttttgttgttgttgttgtttttgttttgtttttttctgggttttttttagtgcagaagtatttgtttttaatagaatccaatttatcagggcatactttcttttatgtcttgtgcgtttgatgtaacgtataaaaattctttgctaactcaagacatgaagtcttctagaagtttagttcttagattaagactatgagatattttgttaatttttatatatgatgtgagttcattactttgcatgtggatatattgttgtcccagcaccagttgttgaaaagactgttcttcccacattgaaatttcttgacaccttggccaaaaatcaattgaccacaaatataagggtttatttctggacactgaattatctcattgatcgatgtgcctattcatatgtcttgattactgtagctttacagtaaattttgaaattagtaaattttgaagtacagtaaattttgaaatcctccaactttttttgttctttttgataattgatttggctattctaggtcttttgcatttcttctagcattttgcatttcttctagcatgttaatagttgccttattaacaactttgagttgttcaattcatgaacatggactatctatttatttagatcttctttaatttctctctgcaatgtgttgtaattttttctttgtaccagtcttacacttcttttaggtttattcctgagtatcttaaaatttatccctagatatttttgttaaatttatttctaagtattttaattctttttgatgctattgtgagtggaatttgtgaatggaattgatttcttaatttcatttttggattgttcctaaaatatagaactacagttggttttcatatcctccgaccttgctagccttatttattagttttagttgtttttttttttttcagtagattcatgagggttttctgcatagataattatgtcattcacacatgaaaatagtgttatttcttcctttcccatcagtatttcctttttctctttttcttgccattttgcacttgctaggacttttagtactaaggaatgagaaactaatatccttgtcttgtttctaatcttagggaaaaagcatttaatctttcaccattacatacagtgctcactgtaggcttttcaggttgaggaattttacttcttttcctagtttgttgagagtttttatcatgaatgggtgtttcattttgtcaaatgctttttctgtgtctagtgagataactagtggtttttcttttttctcttaatgtgatgtgtttaattgattttggaacattaaactgtcttgaattcctatgataaattctacttggtcatggcatataattttttaatgtgttaccaaatgtggcttgctaacattttggtaaggagttttatactatgatcataagggatactggtctgttgctttcttttcatgtgtcgtgtttctttcttttctttgtcgggctttgataacagagtaatactgaacgcacaggaatgagttgggacatgtttctccttctctatttcctgaaaaagtttgtgaaggattagtattatttctcttttcaaatatttgataacatccagcagtaaagccatttggacttagaattttctttgtataggaagatttttacttactaattcagtttctctattataggtcgttcagacttcatgttttttcttgatagatttggcagtttatgttcttctaagaatttttccccttcctctaatatgtctgattggttggcaattttttttcccaaaatattccattaaagcttttttagttatctgtagggttggtagtattgtactattgtcccttcttgtattcttgatttgagtaacttgtgtcttctcttagtttcctagtcttctacctgagatagaagcttaggtaattcatttgagacctctcttctttctgatgtaggtaaagcactacatttcccttaaagcaccactctagctgcatcctgtaatttttaatacattgtgtttttatttttatagtgttaaaaaattgtgtttttgaggcagagtctcacaatcacccaggctggactgcagtggtacaattatgacccactgcagcctcaacctcctgcattcaagtgatcctcctgcctcagcttctcaagtagctgggactacaggtgcacaccagcatgcctggataattctttgtattttttgtagagatggggtctcactatgttgcccaggctggtcttaaatttctgggctcaagtgatccaccacttcagcctcccaaagtgctgggtttatataggcataagccaccatgcctggcctgttaaaaaaatttttttaaatttttcttatgatttcttctttgaccctaggattgtttaagagcatgtttaattttcaaatatttggggttttctcagatttctttttaattctgtcattttttgctttcatattttggggcttttttgttagatatgtatgcatttataattattatattcaaagaagaaataacataattcaataataattgcagatttcaatattctgtcaaaaactgctaaaactattagacaaagttaggaaggatataaaatagttaaataacgctgtcaaccagcttgacctaactgacattatgaatcttcataatcttctttataagaatctgcagatacagatttttttcaggcacacatggaacaacctccaggatagaccacatgctaggacacaaaacaagtctcaatacattttaaaagaccaaaataatatatagtgtgttctctgaccacaacagaattaaattagatatccacagtaagcctgctgtttgtctggggcctgcttcctcttgctataaaagtagtaaacaggtcacatgtggtggctcctgcctgtaatcccagcacttttgagaggccgaagtgggtggattgcatgagctcaggagttcaagaccagcctgggcaacatggtgaaaccccatctctactaaaagtacaaaaaattagccaggcgtggatgtgcatgcctgtggtcctagctgctcagggaggctgaggtgagcctgagaggcggaggctgcagtgagccatgattgtgccactgcactccagcctgggtgatagagcaagaccctgaatatgcaggcatccatcctggcccctccgtattgccttcatgggactttgggggcatgggaaactgaccaaaacaaacgagaaactctagctgcctccactgccatgagtaataaagttctttgtctctgatgcagcacttgtaccatctgccagcacccatgaatcagtaataagctaacttgttagcttatcaataaggtaaactctcagatcctgcttagttcctgacagtttctttagttcttagaatatatttaaatagccactttgaagtctttgttaaatccagtatctgaggacattccaagaaagacattttgtaatgactgcctttgtaatgactgccttttttaccccttgattatgagtcacactttatttctttgcatgtctcttcacttttgttgaatattggatattttggataataaattgtagcaactgtggattctgactcttcctcccaccccctagcagtttttcttgttttgtttgtttaataacttgcctgtactaaatctgtgatttctgcctctcccagggtgtgcaaccacagatgtttttgttgagtatttagttttgattatctttttatttgcattttctaaaagtctctgtttagattttgccctgtgtctgtatagattagtgctgaaccaaagattagtcagcagttatgctcaaatacctcaagccaataagcctaccactttgagctgatgggtctttgtgtggtttggggagtgcattcaaaatctggattattttttagtttgcccagcctttgctttctaccgggctctctcagttgtcttgtgaacacacacacacaggtttcatctgccgggggtgtgtgagtggcttgggcctgctgcagtccctagggtacatacacatggccttcagtcaacctaggatatgtgcagaggttaccaagccttctcaccactttctcacctcatggaataccttgttccatggctagtctaccatccattgcttgcctcaatgagatacaacctcaggccagcagagcactggcccttcctattcacttgccaccaggattgctcctctaattgacaacactccatatcaaatgagctcttctggcaacagcagcaaagccactggtttgtagggcctgcgctagcctggttgaacaatcactctagcagagctagagggggatgcctcagacactgtttgtgtgtgaagtctggtaattttcatgaacagatgcttctcagcttgttatatgtctttggtcagtttccagtttttgacagtttttttccgctttatagttgctttgggggaagaggatttgtcagtctcaaaccatcatgccaggagtctaaagtcccaatctacatcatcttgccattgatgctagtgtaacttaactgcctgtttgatactctgtgataacataagttgctttctcttacctgctcagctaggatatggaacagcagcaatagaatcaacctggggaaagctgatagagaacactggggccacagtgggcatggatttttcccatggttaattaggaatgatttacaatgatcaggcattttttatacttttattccctgtataactaataaaacatttgctttacaaatggtatatcattatataaatgttatttatatacactttgtgtcaaccaaagagattaaaatattgccttttgtaatgagattctagaaacattgtcttcatcgtactcatgttctccctgaatttccttccatttattaattcaataaatgtacacttggttatctaaagtatacagaggcatgttgagtgattcccagatgaaattgatacatattttgtccttaaggagcttatagattcgtggaagtaatacaatgtaaacatgaaaaatggaaatagggtgtgctggatgccgttaaagagttatagatctgtgctatggaagttcagtagggtaactgagttttccctatctaagtgattctgttatcactcattactcccatcacctcgtcctccctgcttgcattccctccccagctgctttcctactgaaatccttatgttgttactcattcaagctagtcatagtaaataacatgtacgcagagcttccacatgcacttttcttgtttggtatttgtctggttcatatcagcttggggtttaggtagggagcattattattcctaatttacagataaggaaactgacatcagagtgatttacccaacctcgcatattagaagagtcaagttttgaacataagtctttgtactcgaagtcctgggctctttccggtatgctctgctgcctctcacacagcaaactttctctcctctctagccagtagatagttgggaagaattaagtttggtgagttgggtcagaattggaggcagcttagtgtgtttctagatggacatgcaaatgaggctgcaaagcaagactgttcaggctactttttgaatcatttcccaataagggtttttaatgacttttaattttacaataatcggagatccatattttcatttgcatctcatttattccataggtgttgaattgtgactttaaacacagcatattcaaaaccaaattcataatctccccctcaatctgttgtcttctctgttaatgacacctcaggctccacagtctcctaagctagtaacttggaagtctttgactccttcctaacctttatctcagcatctaatcctatcgtttccagcctacctcatagggttattgtgtgagtaaactgacaaaatatataaagacaaactctgaaagctgtgaatgagaggtatttatttcctctaaggcagtgcatctgttgatgtgtacagtactacaaggcctcagcaaccattcagagttaatgttttgtagtgttgacacttgctttagtgaagcatgtacttaacgtcggggctaaaactgcattatcttacattcttataacaatctgcactcttaaaagcactaccaagggaggagaaaaaaaaagggagcatgagagagaacaaggctctcttttgtgatttgcacaagaactggaagtcaagttttcagactctgcttggctatatccagaggtcttttaaactgaaaaccaaagttgattttattaataccactccaccactcattctctgtgacctagggcaagtgatttagcaatgtcagtctctacatataagttagagataatgattgtacctattttatagagctgctgtaaggattgaatgatctatatagagagccagagtgccatatgtaaggtattcaagaagtggtagctattggattactcttctccctttccacctatctagagattttaggttggtcctcctttgccatttccctgagatagataatttatttcacgtggcgtatttatttagactgcatcacattacactctcgcagttcacagacatttccaggaggttgttgctccaccacttcattcaaaactaggttcacggttttcatgttttcctctctacatctctcctactaatttcccttttaatgttcgaacatgattctgatgaagtctttcagttaaaaattgtgagattaaacttgtactctctaactccgaagtgaaagagattttaggttcaatattaggaataaaattctactatcaggactgttgtttttgtttttcatcagtagcatgggctgccttggaagttatgaagttacccatggctaccgctatacaaaagtggcttttgactagcagctttgcctcgccactgcttcctttctcccatccagtccttgaggtctgcaagctgtttcagtatacatcgcagtgaagagtgtaacaaacagattagctacctgacttgcaattttttggctttggaatttttggttcaggattttatactgtcctagctaaatgaattgacaaaacagcaaggtataacttacaatgaagaagtttatcaaccttcccccgcaggattaccaaatacagaggtgcagggtttaatattagactaaagttgaagatgtggccctcaattctcctgcaaaggagctctgcagtgaagtcacaatagccatgagcctctcagtgtaactagggtcatccatactattccatatgttaaagtagaagaaaatagtgaagtcttgtcatttgcaagacttttatgcaaagtttgacagatgttgcatgctgctttcaggattaagaaaattacatgggcactgctgtgccttctgtgagaagttttattctcagctgtcaccctccttgtcccttgcccataaccattatagtggccagaaagtctgcttgctctacagtgatgtgttttgaatagtgcccattagttttcagtagttaccctggcctgcatgttagccttcagtttaatggccttttttatgttcattcattttattttatttcccatcgtggttttgtttatttcttttttgttttttgttttttctgttctcttttttaaaaccgtcgtggtttgcccttcatattccccaatgtttgcacatgacaagatgttgccatcccaacattacctcccacttcactgaccagtgccactactgaccatctagcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctaggtaagtgcctgtgtgtctgcagccagttggctgcctcttggtcacggcagccttgtcatgctcaccctggctcttggtatctgtaccaatttttagtccagaaaataagatcactgagatgcaccttccctaattttaggtcattaaataaactcccaaacagactaaagtcctggtagtctctccttttctgggatgacttagggagagggtagatacagctattgaggtggacgtatttaaatgtaagaaggagtgcccttttttcataagattcagtcagtataaattctagagattaaggtagacttaatttattaaagtaaacttaaatgaatatttgccacacccttatgtggtgtgggctgcggagctccaggggttctccttgatggaataagagtagttagtgatgacttttcctaaaatagcattttcattacattcctcttcatttccaccccctcaggagctcacattgctcataggggaagatctataatgtccaggctgctttgtgccacaggctggcttcactttatctgtccaacttgcttttcctttttccccaatgtaactgactttctagtgaaaccagtctaatcactatagcctttttttccagtgtgtcctcttcagtcacttcttgcccctttctcagctgaaggtaaattcagttaatccttcttggcccaggttaagccccatgaagctctcaaagatctttacccaccttttcagcacatagagcatttcccttgtacgtgtatttgtatccctaatattggcacttgattatggtaatatgtgatattttactaccttaagctgttattcttcaattatgttctatgtatttgtgctgttttcccaaccagattataaactctttggaaggaaccatgccacatgctgactgttcacacattgccgagtagtaaattccttcactgtgctcttccaaccagaataagaaagctaagatacgtgttttagtaggagccctaatacatcagctaaagcttgtatttccattagcatgcttatagttgatgtacattgtagttaataccagactggcaagtttagcaagtgcaggaccctttctttaatactctcaagaagtctaagtggcataatttaacaccaacagatgggagttacctgaatgctatactgtgtgttttgagttttacaagggtagagaaacatagttctatacataaaaaaaggtaagacattcctaccaaacagcaagtttcaatatcaccattaaaatatcttcaatagactttgaaatctcattgaaaatctcataagctttcacagaaggaagaaaccatttagtaattctgcgtaataagctttatttctgcagtaggttttttgctcttattgtgcgttctaccagaaatgcattttcctcacatgagttacatctggcttcttatctatcatctttagatgacatctcctcaggccttccctgaataccaacccaaacttagcccctcggtgactgtcacacagtggggtatcagagccagcctgttcccaagctaattgttaaatgctcgggaaattttgcaaacctaatgacatgacttggcagcttgaaattgggcatggtgggagtgtttacagtgacaaatgctgcaaaccagagccaattgttaaacattcaccagaacaccactgctgtcacatcaccctattttttggtatgtgtgtggtatttttttgtttgtttcgcttttagtttgggtttttttttttttttttttttttttttttgagagcacttactactctctgaaattttctcttttattagcttatttattctgtctgtcttgttcaataaaattctccagcacctggaacagagcctggcatttagtaacactcagtaaatatttattaagttaatacattaatttcaattcgtggagaaataatagataattcaagtaatcatgttgagattgattatccatttggtgggaaaaataaaagttatgtctctgtcttaaattatagatggattaagagataaatatttttaaaatctataaatatattagaagaaaatatagaaatgatttttatcatttggagaacaggaaagggcttttaaagggagatagcaaatccagaagccataacaggaaagagtaacaaagttacaaattataaataaaagatatcccaagagacaaataatacaagcagatgattcatagtactggaaagcccattagagttaaaaaaaggttttcaccatctcaggcgatcttggaagcaaaatgatgggggtttttttgtttgtttttattttgttttgttttgttttgttttggagacaaaggtctcgctgggtcacccaggctggagtgcagtggcactatattggctcactgcagcctccgcttcccaggttccagcgattctcctgcctcagcctcccaagtagctggaattacaggtgcctgccaccatgcctgggtaatttttgtatttttagtagagatggggtttcaccgtgttagccaggctggtatcggactcctgacctcaggcgatccacttcagcctcccaaagtgctggaattacaggcatgagccactgtgcctggccaagttatcatttttcatctataaagctggcaaaaattttaagttgataatatccagtgttcaatgagttgacagctaggaggaaaaccactctaggttattggtggcagtataaattagaatagtctagggaaggtgatttggcagaattttaaaatattttaaatatacatagccttccatcacacttctaggtaactgtcctatagacatacagatatatgtatgcattgggccctcatacaaacacgtttatttatagcattgtttgcaagattataaaaggagactatgtaaatatccactgatagaagaatgggcacctaatatacaatcgtgcatcacataacaacgcttcagtcagacagactgcgtatacaatggtgatcccataagattataccactgtctttttactgtaccttttctgtgtttagacacatagacacttgccattgtgttcgcattgcctacagcgttcagtacagtaacatgctgtgcaggttcgtagcctagaagcaataggctatcccatacagcctaggtgtgtgggatatacacctagctataccatcgaggtttgcataagtgcattctgtgatgttcacacgatgaaatcacgtgatgcatttgtcagaacatatccctgttgttaagcagtgcatgactgtatgtatacccgtaagtatggtggcagcagttttttttaaatgacctgtctgtatattttgatgtgtatgtaaatgcctaaagcagtgatcctcaaccagggacagttttgccccctcatccctcgggatatttggcaatgcctggtacagcgtcagtaagtaccagtagaggtacttactgacatctagtggatagaggccagggatgctgatgaacatcctgccatgcacaggacagtcccacaacaaagaattatcctgcccaatgtctcagtagtgccaaggttgagaaaccctggcatggagactgtctggtgagatatgcgtcaatatgtgccacagtcagctctcagggcaggacaggttttgacaaaagagaattgagacttatttttttttaactgtgtgtacttttatatttaaatgttttcaatgagacacacttatttaaattttatgatagattgtgggttggagtaagcaggaatgattagtaaattaatttgtagttggaagagatacagaagttgagttggcaggggcaggtgggcatgactagtgtatgtaaaggaagaggaagtgcaaggtaaggccatctgtgtgtatgctgtgagaaggatgcaaaggcaagaaagctggccaaactggcccagagcttttggcagaaattagtaagagattagaataaagtggacgtttggagccagatgctggaatgccagtgagaatttggacataatcagataagaagggaccatttttgactgttaagaaagttgtacactgtgattttattaaacagtactttgggaacactacccaagattaaaggagagaaaaaatagagtcagggagacaaaattgggtagtaattatgttagcctagatacgtgctagtcgtcggcttggatgaagatgaaagcagcgacttgaagtggataggacaaatttgggaaatatttaaaaggaagattttgggagaccataatagttttttgttgcttcattactttatgatttctgaatagaggcaatgaaggagaagttaatttttttaagtcgtaagactatatcctggctaattgttacataaacaaaactttcttattaatcttatcggcttaaattttctcatctaaaaaacaaaagtaatatatttacttcacagacgtgtggtaagaattcaatgtgagaatgtatgccactacctgcatttacaaattcacccacttcctgcatttgaaaattcagccaccaggtggcaccatatgccttggtcatgagctgtaattcttatgggtacctgagttgccagagatttcagagggtccttcctctctgccttttcagctatgaaaatttcatctttcttaaaaaagcagtacttttctatattaaccattaagtgggaagtggaaagtaaggtatttctgctattcatagcactttaaagttggattgaagccttagagatctgttagtctagtcaaggggttagcaaaccatggaccctgtgccaaattggagcaattatttatttttatggccccggagctaagaatagtttttacatttttaaatagttacatttgaaatgttacataggtaactatataatatcctccattttgcctcttggcctataaatatttactaccaggccctttaagaaaaagtttgcccaccctgtctcattttttcgtttaatacataaagaaagtgaggcccagaaagcattagtgacttttcctcacaagctagtagcattgccagaactagaattgcatctcctaacttccagcccagtgctttctttctataaagtgtgcccttttctttcccttttgattcttagctttcacattctaacctgagtcccactgtaaccccacacacttaagagaattgttgtttcaaatgctccttgaatcttatcccaaaaccaagggtggtttttctgcacagtaacttgtttctgggacctcagaccaatagtgtcagatcacctatgactgattttttttaatggtaatgcttctatagaaatttgatgtgggtattagtaaccttcacttatttctcccattttttccctttcacatagaagcaaacaaaaaatatatatatgatattagtatacaagatttacatatcagaaggcagattttcgtttattcattcaatgtatgtttgggatgcagcttccctgtatgagcattctgctacgtgcttctgtcgtacacgaacatgaatgagacagtcttttacttcagtttgaagtaaaatagtccccctcctgtgtctttctagaagaaaacttgtttcaactttcctgtgtggggtgaacaaaagagacctgatctgtactctctcagagagcctttagtttagtgtaaaatacaatacagttgactccccagaacttaaccactagtagcctactgttgactggaagccttgccaataacatcaacagtctgttagtacatatttttatgttatatgtattatatacggtattcttgcagtaaagtaagctagagaaaaaatgttattaaaaaaatcataagggaccaggtgtggtggttcatgcctatagtctcagcactttgggaggctgaggcgggtggatcgcctgaggccaggagtttgagaccagcctggccaacatggcaaaactttgtctctactaaaaatacaaaaattagccgggcgtggtggtgtgcacctgtagtcccagctacgtactggaggccagggcacaagaatcccttggacccaggaggtggaggcttcagtgagccaagatcacaccagagcactccagcctgggtgacagagtgagaccctgtctcaaaacaaacaaacaaaaaaatcttaagagaaactatttattgtacattaagtgaaagtagatgatcctaaaggtcttcaccttcaggttgagtagactgaaaaggaggaagaagaagaaaaggggttggtcttattgtctcaggagtagcagaggcagaagaggtggaggaaatggaagcagggcaggaaaggcaggcgcactcggtgtaacttctgttgaaaaatatccgcttatacgtggacctacacagttcaaacctgtcttgttcaagcatcagctgtacttccctttaagacagggatcatccatgatcagaccaagtgtcagaaaccttaaattgtaagaaatcagttgatccttccttataaatcctgtgattgagagatttagccgaagagaaaatagtattaggtatctcaagtatctctgaaaaataatttttgttactacagtattcttttccaggggacctagctgattatagagaaaaaatcctctgtaaatattgtgtgggtactattgttggattttttaattaaaataaagtaacttaaaagaactatagaaaattaccaaaaagcacttctctgcagtgcaaatgctcacaatcagacaaattggcatatggtcatgtagacctacacaaattttaatctgcaatttgaaggcaaattatcagtattttaaagtaagaattttaattcaataaattagaataatttcttcaatggagtagtttgaggctctttaattactttctcaagacaggtatagctgtttcctcacatgaatgacagttcctaaaagccaactgtttgtctaaaacaaattccttcacaatatttgttgaaaactcttgattatgcagtctggttttcattctagtgagtacagtagactgagcatgtttgtggacctgtgttggtcacacagaccccaagacagaacctggaagccacctttagtaaagaacctagataactggttttaagctttcatctcatgatattaaatactagaccgctggatttgagttgtttgtgataaagtttgtcaaacatttcatatcatttcatatcagcttcaaaatcaatgaagtgttaattttaagaaattataaaaatcagtattgtaatcagtttattttatagactgggttacacttaggatttatttaaatgttttatgtttttatttccaattttaaaagatgataacctctagcattctttttattgagagtctcttagccaaaatatacacagcattctttgatattttctgtgaaatatcattaggtcataccaatatccaccttccatcaatttccctaaaactcagtgatttctaaagcctagaaagttgatgactagctgccccatttgaaatggcattgagaagagccctgtgtcttctctgaaaggaagttgtgattatggtcagcgatatcagtaacatttcagcaagaacatcactgatttgtcagatacgtatgcccttgctcttttgccagtccccatcttctttgcactgtcctacccccaaaagcttcattgtttgagagctaatttgacttacactgatagatttttatgtggagtggaaaatgaaactgtacattctggaagtattcctaattaatgctatctctctccaaatcctttgtctaaagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgagggtaagtcttccacctgtctgtcagcaccccctagaggtagacctctctgaagttctacctttgtttagccttgcacaccataggggagcagaagataacagttccttactttcggggtccttatcaattaggggaggcaaaattaatttacatcaaaaaacagcaagtagggctgggtgtagtggctcatgcctgtaatccaagcactttgggaggccgaggcaagcagatcacctgaggtcaggttttttagaccagcctggccaacatggtgaaaccccatctctactaaaaatacaaaaattagccgggtatggtagtgggtgcctgtaatcccagctactcgggagaatagctgaggcaggagaatcacctgaacccaagaggtggaggttgcagtgagctgagattgcaccactgtactccagtctgggtgacagagtgagactctgtctcaaaaaaaaaaaaaaaaaaaaaaaaaaaaacaacagcaaatagtataagacaatatacttctgttggtgcttttctacgtgttcatattttactgaccctttaagacttagctcagatgccttctagaatctttcctctgattctaatattgttatctccacagtctaagatatttatcacgtttttccttcagttatgattatgaacttaccttgctgattttgtagcaaagacagagcctttgtcatccttacatttcccacagtgtctaatgtaatgccttgcacatgaagaaggtatttaataattgttcttaactggattgtctgtctttaggcataccatgctctttagaatctccttgaggctttattttggacctgtggtctttcgtgctaaatagggttacttctaattacatttctaagattttcagtgacgtgagtgtcaatcaggtttatttatattataaatgtgttgtatatcttaagtttggattgtaaactaactataggaccgaaattacaagcagccagatcttaataaatgcttttcctacttgaggcttttgtctagacttttgctttcttttaacacaaattactgtttttcctcagtgtattcttttttttttttttgaggcggagtctcgctctgtcgcccaggctggagtgcagtggcacagtctctgctcactgcaagctctgcctcctgggttcacgccattctcttgcctcagcctcctgagtagctgggactacaggtgcctgccaccatgcctagctaatttttttttttttgtatttttagtagagacggggtttcactgtgttagctaggatggtctcaatctcctgacctcgtgatccgcccgcctcggcctcgcaaagtgctgggattacaagcatgagccatcgcacccggccacctcagtgtattcttcagtctaattttattattaacagcattagtttttctgtattaaaaacctccagtaataataaaatattttactttgggtagagagtattttagatatatttgtagaggctactgaccaggcagctgaacagaataaatgactttaccagtggaactatagaaataatttaagaactttacctgacgggtagaataagtgaagaagctgtagaacttcactttctaatgctatggcatatcattcacctgtcaaatatttattgagtatcccctatactgggtaatgtgcaagatactggagatgcaaggatgaacaagcttggtcttcttcccttaaagaaggagcaggcaaggtaggagacctttcatcatttcagtgacagagattgaagataagaatcaaacccaggcaagaacaagagggccatcacagagtcagggggttgatttaagggaagagtgtgttctcattacaggcagaatgttgaattttacagttacctatgttcagacaagagcaggaatactctattaggtttcaagctcagttacccttcatcagctttcatatagaggcatcattcatgagagatactaggatacagaatagagaaaacttactgtaaaagatagaaaagtcaaggcaggatcctagggaaagatgagacctgaggctggccttgaggcatttgacttagagcaagcattttgtgggaaggaatttgcatgacccaaatcccagaaatagaatctaacagtgcacatgcaaggtaagtcatgacaaaaatgaaggaaatgcaagggtcctatcctgaggctgtgaaccttctgaaactgcatgaaaataaatatttgtgtctgtacatattcacatttcccttggaaaggatctgtagttttcattgtcatttcagagctcatacatcagattgttgagaaccactgcgagggtcattgtcaaatttagagatgaaagaaaaggggtgaagaagagtggatttattgagtgcccaccatgtgtcagccactgtgttaggcagtcaggatgtaaagatgagtaagacttgacttctgtccacaaggagcttacggtctggtaccatagacaacagtgtgatgtgttatcaccttaaggaaaataggcagcataaccatttattcaaggagtttggctaaaagaaaatagttgtaagaatgtaggtagaaaaggcaacaggttctggtgagggtattttagggatggagaagagactataacatgttttggcaaaagagaagcagtttctgaagagagatttggatttcatctggaggtgttcagcttgtgtgggggaggcataaatgttggaaccagcccttggaaaatattttacatatttagtttcacaaaccaacttaacattttttccatttattatgccactgtacagctgaaatgaaagaattcattagcaccttttttaggatcatatttgcctacacttggccaatgaatatattgaaaatgatttcaagagaatttagggactgttttgtttttcttctcctttaataagttagaggaaagttttccatagcagcagaagtgtgacaaatcccacctgtcaggctgcacaaaatatgcccttaactgaagtgaataacgtgattcataactaaagcaaacaactgttagagtaaccatattcagatttctctactttgatagcaaaattaatcttaagctgtggtgctgttattcaggaaagccagtgtgttttacattttgttagctttttttcccttcccagtttttaaatctaatgaatgtctattacagaaacactagtgccagagaaattgttttcaaatatagaatgtctaccaaagtgtaggcatagacagccacacaggatttgtgtataaattggaactggaacctgtcagtcagacaaaaataatacagtaaaagggtaggtgtgtgagccattgtaggagatagagccagctagacacttaagcagtcagccagtgatccagtcttccagtcacatacatcctatcgtgggtattgtagtaatctccttacgggtcttcttgagcccacgttttagaatcagcaagtactcgactcctgggtccaccgctagctaactttcccatcacttgggaaagattgttaacttcataacctcacctgtaaatgagggtgataatattcatctcacttggtttagtgcaaagattatatgagaaaatacatgtcaagtatttagtgcttgactgactgtaaccattcaataaatggtagctgttttacaattattattattttatctagtcttgttcttttactgtttttcttccatgcatgtgttcacatgtcctttctaaacacagatctgatcatatcatgctcctgctcataatttttcagtagtcacctaacacctactagagaaaatgtgagcttcaatagcaggacattagagggttcttcactatctgactagtcattgttttcaacattctctctcccatatccactctgtttcaaccaagctgaaccacttaacactgtctttttgtatattctccctattgaccccattgactggaatgattttccccttggtatctgaggaaagtgttcattttgcttgactccaagaattcttcatcaaaggggtttccctcccaaacccctcccaaagcagaattgtgtgctctcatctttctgtttttgttataaccgttacctaaatctgttagcacttacgacattttttgtaactgtttatatgtctgactttcctgctagactgggagttctttgtgggcaggattctattcatcactgtatccctagtggctaccacaatgcccggcaaaagaaggatctctttctgtggtggttgccttttatgtcttgtgtaggcccactgcaaaactgggattttataaatcacaaggaaagtttttcagtgtaatttctggttttgatttgaatcataaaaaggaaaatgtgtttatatattattctaaaaccacttcaatcaaatccattgttttcttagcttctattattttaaaaacgtggccaatatgacagtattgccaagaatggttattgaggagtgtagcatttcatttatatcttgctttctcgaacttttctttctagttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggtatgaagtgaagcaacttttcaaaccattgattggaatagtagagttgaaatatatttccaaaactcagtagttgcttgactggaaatgtgagggggaaaaagaaacataggaaatgaaaagttgacagattctatttctttgtaccaagatttattgtgtagtttttaccagcagtggtcagtgaacatcaagcagtatttctaagtaaattgtcaatttatgattcatctgctttgactattgaagaaccttatgtagaagggataaaatctgtttcatgtagaatatagaatttgtgtagctaattctttaattttcaacttttcttttggcttgagtgcatatgtataaagtgttttattttattcaaggatgttgatgtttcaagtcactcttacaccattaatgggttgaaaaaatatacagagtatagtttccgagtggtggcctacaataaacatggtcctggagtttccacaccagatgttgctgttcgaacattgtcagatggtgagtctttcttcctctggaacgatataccacacttggtgcccctagtggtttagttgtaagatcatgagctttgatgtctagaagattcagttcaaatcccaattttacctctttctggtaatatgactttagtcaagtctgaacatcttttttcacgtgtaaaatgtagataataccaacttcattgagttgctgtaaagattcagtgagaaagcatagagcataaagtgcctcttactggataggctctcagcgtttgtgtttttagcagaagcttttgtgtaagtaaatactattgcttgttcataacacagaccattccagggcttttggaagactagccttattctacttagcaatgatatttgcatgccaaattagtctttctagttcctccgtatttgtgactgttttatctctcacctgtgactgaatttctaaattaagttatatatatatatacacccatatatatgtatatacacccatgacctagagcagtgtttttcgaactacagcttgccaaagagattaagtaggtcaaaaccagcatttaaaaaaaatatatttttagaatagaacagaaaagattagagttcattgcacttagtaagggtatatgttgtttcatgaaactcagctaaatcttatgttttagaaaaatgtctttttaaaaaaacgtatttatgtgtataccgctcttacgtaaacacacatgctttagaaggtaaagtttgactcccttaagaaaagagtcaaacttaacatcaccaataaaagaacagactgacatcacgtgcccccttatgtgatacatggaggaagacacaatattacttctgttatatcagtaccaaaaatatttaacttgaatctgatcatgatgaaacaatcagacaaatccaaattgagggaagctctgcaaaaaaaatttttattttaactgacttggattcttaaaatatattagttttgtgaaagaaaaaaaaggttgaggaatcattctagaatctagattaaagaagagtaaagacacatgaaataaaatatgtatgatctttggatcctgcatctggagataaaaaaacagccataaaggacactattggtataattacttaatattagatacatatggtattaggcaatagtaaatattagatatgttattagctatattagataatatttttgtgttaaaatttctgaatgtgattgttgtattgtgtactttgttggagaatgtccttgttcataggagatacatggcgatatacactgaagaattttggagtgaagtatgatgactgcagtcatctctcagatgattcagaaacaatatgtagatagataaatctgtatacatatacataatagtaagataaataaaacagttgttgcagaatattagtaattgtgaatttgaaaagaacagccattcattgtactattcttgccactgttttccatgggcttgacagttttcaggattaaaaagttgggaggcttggtgcagtggctcatgcctgtaatcccagcactttgggaggccaagtcgggcaacttacttgagcccaagagttcaagaccagcctggacaacatgacaaaacgccatctctacttaaaaaataataataatagctgggcattagtggcacacacctttaatcctagtactcaggaggctgaggtgggagggtcacctgagcccggggaggtcaaggcttcagtgagctgtgattacaccactgcactccagcctggatgacagagtgagaagctgtctcaaaaaaaaaaaaaaaaaaaagttgggaaaaagaaacaaataaattacaggcggttataccttagctagtgaactacataagccagttaggcaagatactggggaaaagttaagggaaaaaaatgtttactgtaggctgttaaatctacacacgagccaaattttaactgcattaagtgtgttggcatgttgactacagtacctgtgggaactgaacacatctcagcatggtggctaggggcagcactttggaataacgcaaatcttggttccgatgccaggtgaaacaaatatcttggacaagttaacttccctgaacctcttctatagttttctgatctacaaaataggaatgagaatagaaactccgtcctgagattattataaggaataagtgtctgccatgtaatgaccatgcagcaaatctttgctatgatgttgataatgaagacaatgatgacagatatgttggatacctctgcaacctcagtcacttcttaacatggagatgactggaatcattaatgtaattttttcaaaacacatgtgcctgggtcctactccagactacctgaatctctgagtttaggcttgaggcactttgctaggcacaagttacagaaaggagcaagacacattctcttgtcttccagaagctatagcacagtgggcacttagttgtatacctggtcaccaaatgttagagacagaaaaagagaagtttccacgggtggattaggagagaagggctaaagtcagcaatttgtaagtgcagagaaaacaaatccggtttactttgcttgctctcaccaatatgaagggagatactagagaatgtgtgggccacacactgagataactctggattatgttctaaagtgaggaactaaagttacgtggctgtttaaccaacagtcccaaacttctcacatctaaatgagtattttctggtatctggttgcctcaggaaaccagatggttcactttaccagttgtcattgcttaaatatctttgctgtacttgggaactgccttcaaaaccagcttagaaactccacaagaaagccaggcttactgatgtatgtacatctcattttgatccatcatgtcattacccagttcagtcacttgccatattccttagacctggttccagaaaaacctatggttgtctgccaagataaagatagaccagggccaggcacggtggctcatgcctgtaatcccagcactttgagaggccgaggcagatggatcacctgaggtcaggagttcaagaccagcctggccaacatggtgaaaccccgtctctactaaaaatacaaaaattagccgggcgtggtagcaggcttctgtaatcctggctactcaggaggctgaggcaggagaatcgcttgaacccaggaggcagaggttgctgtgagccgacatcacgccattgtgctccagcctgggcaacaagggtgaaacttagtctcaaaacaaaacaaaacaaaacaaaaagataaaccatcaccaataatactcaaaagaatacatttaaggttctgagtacatatggggtctagaaaagttgagagtctttagaagagttcagagctactgtacatccttgaaataaatatctgacttcccaaaggtacagcctggcttgggtgtaggtgctttcccatatgaaagtgtcttatgttaaaaattgaaccaggcatggctatatgtcatccacatagtattgtcaacatgagggcattggcagctagtttagatctggtcacgtaatcagtgtttgagatgtgcatttgtttaaagtccagccaagatgatcacatgatgggtgatgtatgggtgattaaaaaaaaaattttttttttttttttgtttctctagttcccagtgctgctcctcagaatctgtccttggaagtgagaaattcaaaggtaaaactgtatgatgctgctgttcatttttactggtatactgttgcgcctcagaggggcttatagaaagggagattctgtaggaaagcatcaaaataaatgaatggcgatgtggtaataatctgcatttaaaaataccaaacctataaattagaacgtaagtgaaaaaaatcacaagcaaagaagtaaaaagacatagatattacacttgcattaaagctgggcttaaaaacccactcatttattctccttaattttgcttccttcctctgacaccaaaactgctttaacatttctgcaattaaattgctctttttctgtaaaacattacattctagatgttaactgttcagaaccttagtggtacggcagaaggaaataagttgtttataacatggttccttagtgctgtgagatgagccatgtgaatcaaaggcagacctctgtcagattggttgtatctcctcaaactgtccttcctatagccaagtttgctgtgttcttaggggccatgtttgcctctcagaggcccagagcccttctggactacgcagacaactaagataatcagtcctttcaggaagtactgtagagagccaaatgcagtggctcacgcctgtagtcccagctgctcggaggctgaggtgagaggatcacttaagcccgggagttgaaggttgcagtgagccatgattatgctactacactatagcctgggtgacagagtgagaccccgactctaaaaaaacaagaaagtactatagggctcctttttttttttaagaggcaaccagctgttaattagttgtcccctttttaaagagttttatatggaaattgtctaatttcagctcttctgcactggacacgggaaagaatctttatacctaataatagttagttccctaatccatgtgcttctggccttcttatactttccttctgaaaacttttctgagacttttatccaacatcatctttctggcaaaacaaccaggagatcaggggtccagagtgtactactcgaatatataatcttcccatttgatcattgagggttttagaatttaaaggtatttttgagtgattattaaataactttgtaaaactctgagtaccttgctgcctctatgttttttctctttaaacagtaaaatcaggataaaaatatttaaaacaggaccaagcttttgatatattcagccttttttctataattctgtcttgtgcagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtaagctaccgtgcacaaaggcaaaaggtacactgtgtctttctcagatattgaattatgctagtctaatgactgctctgaactgtcgacttatacaaacaaatttaaaatggttcagaaaatttttaatggttcaatccacttctgacttgatagagattaatggaaaacactcttaaaggttctgctatttctgagtggtgagatcgagtttgatttttcctttcttgtgttttctgcattctccatgttttcatttttgagtgtatttattgcttttttgtaatcttaaaaatgattaaagaaagttatataagcatagaaattaccccactcagtatagttggtaactgaggtctacaaagtggtttttgtaacaccgaccaccactcgtgtgtacgtggcctgaaacagtatttgtgaatagctgcatcattgcaataatcatacatgcgactatggacacgataaagttttagaaaatactatcaggcaaagctccttctatatagttttcccttcatatgcaacagaataagtggcatacctggtaaaaatggatccacatgtgtatctaatatggtttcaccctggagatcacagagaatcctcccgtcttcctcaaggaggggaagtagagttggctaagcaaggggaaggttcttttgcaggagaaacatgggaaccagattgagtgctttcaccctgtgaatgttgagatcatgcctacgaagaattgagacagatgccccaagctgtccttgttccattgggttttcatagatgcttaatatggctgcagaatcgactgtagtctgagcagaccccatcctgccgactcctttattagtttagcagtgccaagactctgtcctgctcagttatacatgcctcagcttcagcaccatcaccctacctctgtcctaggagtaaactcacatgggctgggcctgttggagtattgcctcagctgcatcggcttagttttgtcactcaatagagcccatctgttttgcaagcaaacagatgaatttgagactagtacatttacaaccaaaaggtgtgagttatctgtagctgtaacagtatagtcacagggcatgtttaatctcgggacaaaagctctgactcgggtaatttttttgctaggaaactccaaagcgtgttggtagataagaactataagaatgtgagatattgtcattattttctaagcccaagaattaatttcatcaccctttggaaactttaactttctttatattttatctctcctgggtagacattgaaaggattacagaagcttggcatcacccactttcctgtgaccccagggacagggttcttgagagaaccaagatctggggtcaaaaagtgtcacgttttccagccaggtgcagtggctgatgcctataatcccagcactttgggaggctgaggcagttggatcacctgaggtcaggagttcaagaccagcctggccaacatggtgaaaccccgtctctactaaaaatacaaaaattagctgggtgtggtggcacccacctatgatcccagctacttgagaggctgtggcatgagaatctcttgaaccggggaggcagaggccgcagtgaactgagatcatgccactgcactccagcctggacaacagagtaagactctgtctcaaaaaaagtataatgtttttacttgtttatgggtataagtttctaaaaattgagagagccattgatagtgaaaaactgtgctctagtaatcagcaagcttctcactcctcacctcacaaatgggattgacttccttcagaataggagaaggtgaatgtttgtctccaggggcatgtctttcagtcttccagcttcttcacaagaaccccacatctcttagctgcagtccatatcatgactgcagtagatggtgctgagaaatatcactaagggagcattggccacagatgttctcaaagtcattttcagctgagcgtggtggctcacgcctgtaatcccagcactttgagaggctgagacaggcggattccttgagcccaagagtttgagaccagcctgagcaacatggtcaaactgtgtctctacaaaaaatacaaaaactttaatggataagcagaggctgaaaaaaaaaaagtataaaaattagccaggtgtggtggtgctcacctgtggtcccagctacttgggaggctgaggtgggaggatcatttgaacccaggaagtggaggttgaagtgagccgtgattgtgccactgcactctagcctgggcaacagagagagactctgtctccaaaaaaaaaaaaaaaaaaaaagtttcatattttactctacattcagataaataacatttgccatttgtaaggcttttcattttgaatatttagttgtatttattatatactaggcatcattcttgttgctgttaaaaaaaaaaaaaaagagtatagtccttgcccatgaggagattattcattttctcaatgaaacatttgatgtgtaagcaaaatagaatttttatggtaaaaatggctttatattaagaaaattcttacattttaaaatcatatctggatttattcatttaatagatttcattgaacttttgttggcatgttctggcactgagtatacaacgttgaacaaaaatggagatgcttgcactcttaaagcattaacttgaagcctgataagtattagggagcagtatggatcaccaagatcctttaccaacaacacattatatgattaaatttgaagcagaagtaattattgttatagcactaaacagatcttgccatatctttatgatatgtattgtataccttagttgtagtctataaactctatagggtacttagagggagaggaactcagcctctttgcatagtacctcatttttgcttgctctctcttacatcccagtggtccccaaaggacagggaatgattggttggattctttcaagatcttcattgagtagtgtttgctagtaatccagattatcgtctgtcaacaaacactctagtactttctggttcattgtgtggggagacaaggagataaattgacttgggcccaggcattttgctcctgccttttgtcttgctccttgctttgtggggcacacagatgtcaggatgggcctaccaactcttctcccctaccacgggacaggattagctaaccaaaccagggcttttctcatgtcctggccaagttatgttctcagtactgttgccctggtttgtagaatagacttttctatgtgcatgtttgttgcgtttgatacattggtaagtcatgtactttattagctggtagtaaattaaaagttgcataacagaaaggtttgggtcattttccacttttacttactatataatatatgagcaattggttgttaaggaatagattttgagaccgtatttggtgcttaaaatttttctgccatgattatgaggtggctcagagaacagaggtaactcaataggagttacatctttgcattctttcctaggttttagtgccttctaagaccagatacctttgttccttttttataactctttcattgttcttggcctcttttggccttagctttctttgtaacacaataaagggattgcattaaatgatctctgaggtgccttcaagctcttaaacaaaagtctgtaatctcctgggagcttcagtcatttctgttttcctcttagattgtgtgggcttcagtctttgctttatttggagatggaagctactctatgttgtatttgcattttgcctacactgtattaacttaaactgaaactttgccaagctatatactgagttggtgactgagatgtttgccttaatgagggattattaatcttttgtttttccaaagctcttgtttcagttgtcttctttgtcatttggtctcaggtcttgatcgggggactgagtataatttccgagtggctgctctaacaatcaatggtacaggcccggcaactgactggctgtctgctgaaacttttgaaagtgacctagatggtaagaataacaattggcaagactggaacacaatagatactagctgtagtcaaatgagtcaaactggaaagccacagacttggggtggatatggctcaagtctgtgaactttagtgcatcacgctgctgttgttcctgtattgcatcgaggctgctggaatggattttttgcagtgccttgtagagaactgtcctttcaagcagaactagagcaaataaaaatgtgtatgtgctataagttggattttttttttaatcaaggccattaagtagatggatgatctaaaatttaaggctgagccacataaatcatgcctttatttcaactgcagtttcccttttcttttagtcctggacaccttgccctttttctcacatgtttattcagtgagtactcccaaatgggtgtgtataggtagcacctttatcagtgataggtgctggacttgggaggcaaaagacctgagttcttgttctgagtctcattttactaatttttttttttttttgaaaagggatctcacactgtcacccagtctggagtgcagtcatggttcactgcagcctcgacctcccatgcttaagcacgatcctcccacctcagcctcctgagcagctgggaccacgggtgtgtgccaacacacttagctatttttttttagagacagggtctcactatgttgcccaagctggtcttgaactcctgggctcaggtgattctttctccttggccttgcaaagtgctgggacaacagacatgagccaccatacctggcctcagtttactaatttttaaattaaggtagtaacttatgccctgaaaacagtgtatgtgaaagagcatgtaaatttcctcctttgtaagcctcttagtctctcaccaattgaatcaactgtggctccaaactttcatgttttctgacttaccatactacttaggggagtaaataattggtgctattgctataatgtgatgcttaaacacctgttaacaacaggcttcccactactcagtttatgcctttctcattccacctggtagagtttgggaatggatgtgggaccaagagagatggtaactattgaaaggcaatttatttttctccattggggcagaagaggttcttgtatctctttgttttctcttccaaattaatattgcagtgtcttgtatttaaagctgttcaggtcttttttttttttttttcttagaatgcagtaaaatcatgggctgtatttcactatacatacagattctttttgaactcttgggcataatgtaaaaaacttagccccaaacagtgtggtaggaagctaaacaccattccccaaggatggtgagatattttaaaggacagtatatctcatcttgcttttccacttttccttcccagaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctgggtatgtttgctaagtagagaaagttaattgtgtgggagattcctttctttttaaccttttatgtaatatttttatttttacaagaaaattgcgaaaatagtacaagtaatttctgcatgttattcacctgaattccccaaatgttaacatttaaccacatttacagctatattttgcagaatgcccctcaatttagacttggcttaatatttcttcattacattcaggttttgcatttttggaaggaatagggtagaagtgttgggtttctgtcagtgcatcatatcaggaggcacattacagcctatattgataatgatgttaactttaatcagttggctaaaacggtatctgccacattttcctgctataaaattgttatttttttccttggtaattaaaagtatcttgtggatgagatactttgagtctttataaacatcttgtttcccattacactttcactccctagtttcagcatctgtagtaacagttattagaatggtgtttccccagtggtgattttctaattccatatttcctctacacgtgttaacatcctgtgataaggaagaactttctttcacccctatgaagagaatggccaatgggaatctctttataactggttcctgtgtccatttgacatcttccatctttctttgagcactttcttcctttttgacaacatagtaagatgttcctggctcatctagtatttcactagcctcggccctggaaccagccatttctctaaggaaccctgatttattttatgaaaaatgattttggaaaccaatatctgggcactatatctattcattgtaactagggtagaaaatcctaaggaatctacaaaagggccacaagatacaaagtgaatatacaaaaacagtaaaatgattttggaaaccaatatctggtcactatatctgttcgttgtaactggggtagaaaatcctaaggaatctacaaaaaggtcactaaaactataagtgaatttagcaaggccacaagatacaaagtgaatatacaaaaacagttgtatctccatatactaataataagcagttggaaattggaattaaaataacaataccacgtagaatagcatcaaaaaatatgaagtacataggagcagacttataaaatgtgtgtaatatctgtgcactgaaaatagaaaattgttactgagagaaattaaagaatacttaagataccatgttcactggttggaagccgtgatattactaaggtgacaattctccccagtgcagtccaagaaaagtcacaataggcttttttgtagaaattgataagctgattctaataatttttatgaaaaatcaaaggaactagaatagacaatttttttaaagaataaaattagaagacccatactagctgatttcatgtcttcttataattgagacatagtggtggtattgtaaaggaagatgttatacatcaatggaacagaatagagtccagaaatagatccatatgtatatagtcagttggtttttagaaaagctgcttagataatttagtggggagaagacagtctttttaacaaaagttgtgggaatacctggatatccatatgagaaagaaaaggaactttaacccttgtcttacgctatatgcaaaaacagacctaaatgcaaatgacccaatgactttgggacaacaattctagaagaaagtgtaggaaaaaatctttatgactttgggataggcaaggacctcttaggttgtaaaacagcacaaatcataaaatttaaaaattgataaattggatttcatcaaaattttaaaacttctacttttagaaacataccaataaaatgaaaaggcaagccacagacttggagaaaatacccaccatttaaatatctgacaaagaatttgagtccaaaatatataaaaactcttacaactcaataataagaaggtaacccaataaaaagtgggcaggagatttgaacagacactataccaaagaaaatatatgagtggacaataaccatatgaaaagatgctcggcaacattaatcatcagaaaatgcaaattaaacccacaatgaaatgctattgcacacccgctagaattgctaaatgttagtagactggcaataacaaatatcaacaaggatacagaactggaatgctcatactagctggtaggaatgtttgacagtacaaccactttggaaaacagtttagaggtttcttgtaaagttataacccagtaatcccacacgtagataattaaaagaaataaaaatacatgtctgtgtaaaagcttatatacaatgttcatagtaactttatgaacaaggggaaataacaaattttcatcaacaggtaagtggtaaatcgtgatatatccatggagtactactcagcaattaataggctatcaagacacaacagaaattaatctcataaacatgctgaccaaagacgtcaaacactgttatattttgtgaattacaaaataggcagaatttatctatagtgacaaagcaagatcagtggttgcctggaaccaggggtgttaggaatcaactacaagggcaccagggagcttctcggagtattggaaatgttctatatcttgattttggtggttatgatgcaaggtatatatatttgtcaaaactgtaaatgtacagttaaatggatacattttattatatgctaattatacctcatagttgactttttttttttttttttttttgagacagcatctcactctgttgcccaggctggagggcagtggcgcgatctcagctcactgcaacctccacctcctgggttcaaatgattctcctgcctcaacctcctgagtagctgggattacaggcttgcgccaccatgcccagctaatttttgtatttttggtagagatggggtttcaccatgttgccccaggctggtctcaaactcctgacctcagatgatctacccacctcagccttccaaagtgctgggattacaggcgtgagccactgcacccggcctcattgttgattttaaaagcaaaagaatttgagaaatatttatattttataataaataatttattttgttaggtataattacttttccaaattggattatcgttatagatcttttttgaaacacttgtttctaaaattaaaatctgccctgaccaaattttcattcagatcgtttctttgtaaacatcttttctaagaacaacttcaagtgcctaacagaagagttatattcatcctttctgttaaaaaataagctgggatttaaatattcaaaaaaaaagtaacctttagctttttccttacaaggaagaaacagtacagttaacctaggaaatgtatcccccacgtgaacatcttttaagacaattgttagcaaaaggaaagctttgctggtagaataaaaatgtctggccaggcacagtggctcacacctctaatcccagcactttgggaggctaaggcaggaggatcgcttgagcccagacgttcaagaccaacttgggcaacatattgcgacctcatctctacaaaaaatttaaaaaattagctaggcatggtggtgtgtgcttctagtcccagctactcgggaggctgagataggaggatcgcttgatccctagaggtcaaggctgcagtgagtcctgattataccactgtactccagctgggtgacagagcaagactttgtctgaaaagaaaaaaaaaaaatgtccctgtagtgaccagcttcatactgtttcctttatgcaactactgatgtgaaactcctttgcagtattgacaggacatggtccttgatcttcaggtgctttcagtctaacagaacaaaaagaaaacacaagaaacagtgaagtgagttgaagtgaattttgttcagagaagggagaacgctatagcaagacacagtagagcagtcagggaagaaacccctgagcttgaaagatagaatcaaaatagcgtttgaaatagagagatgagaggagtgctgcatgtgcagaagagagtaagcagatagaatttattagaaaatggagtgcacattgcagagtagcaaaaaaattaatgcagcataaagtaaaataagcttgagctataattattgacctagatagatctaagatgcctatgatgttgagtaaaagaagcaagtgagaggtggagaaatgcagttagcaattcatctattcatcatcctggaactctcccctgaccttcagatccatataaacatctgcctactgggtatcagcacctggatatatctcatattccatctggcccaaaattaaagttaatgccttctccctcaaacctgttgatcaatcagcaaatatttaataaacacttacaatgtcccagacactgtgctagagatagagcagagaatgagacagacgttctcacaattattagaaataatacaattcaaaaataattgaaattgttcacggtgctgagggagagaaatgggctgtgtaactagagaggctagtccagtgtggaatgagccctttgagatgaataggcgcttacctaggtaaacaggaagagtgggatgtgaccccagcatagggagcagctgcaagcgagaaggccctgtgttggagagaacacagtgctcagtgaactgataagtggccggtaatgatggagcacagagaactaggcaaagagtggtgggagaagacaagtagtagattcaacaaaacttgattgtttgtctggaggggatgagggaaaaggaggtcttaataactcccaggtttctggcttgagcagcagggttggtggtagtgtcgtttactaaaccaggggacactggagccgatctgaagctggaggcagggtgggaagggaaagatttgagacacccaagaggaaatgccaaacagacaattgaacataaaggtctggtgctcataagaaagatccagactagagatctgtatttgtaattgatgacacatacatgctaatcaaagctaaggaaatgaatgaaagtgcatagggtgagagcgaagagtgggaatagaagaggacctagaatcaagccttgcacatgtgtattatggttgctcttgccccttttcccaatctcagtgaatgacactgctatctactgtgttgcccaaagcactttttccttgccagtcacgaagtaagtcttactgattccatttgttgttagttctgacacaggaagaccaggtgcctctatttgttgccctctagtggcaatctagggagtgggtgggccgccaagaaaagcagctgttttaagcttttgagccacatgaggcatggctcatgaggcatgatggctaggtgaggtttggccatttctggatttggaggccacttggagagtcaaggacattgagcacttaactgacttaacagtttatctccttcttctctaccttgtctgttcccatcgctgtccttccaggaatgaaaggggtttgtttaattccaagctccatctatagacttcagcacattaaatcttatctcttcattctcagccaagccctacaccataccctgaacatcactaaaccataggagagaccaagagagaattcaaacacagcccacctcctctactgagactaaatccgggaagttggtcccagccagtttttctgtactgtgtgtacttccatctccatatctccctacaacctgaaataatcccccataaaaatttttaaagttgtctttcttgaattcttctgtggttaagattatgcacagccacccttgaatttttaaaattctgtagtgagcatttttttaatgtgtgtttcttttttttcagatcccagctctcactatgtgattaccctgaaagcatttaataacgtgggtgaaggcatccccctgtatgagagtgctgtgaccaggcctcacacaggtaaggtatcctatctttcctagtctccagcacttttcctagcagcttaggcagaatattggcatgaggcctatcccataggtgttagggaagaaaaagcatatggcagtttcgggtgctgacttcaaatgggaaagtgggctttcagcatggaaagttctgttaatttgttttgcttttttttttggaagattctaattctgccacgtaagccattctgtgtagatatatacacgtttttaatctgttaggatgtggaaagcagagtttttagataattaaaagtgattttccgtcttttgggcatgtgagttgaaactaaagtgagtcaaaaacaaaaaatgtaggttactgacggtggcaataaatgcatgcgattcgtgaacccaacatcatttggttactagccacctgagttggttaggaaagtgtttttctatgtgccttttgtaagcttgagtataaggtcagaggtactatccatttgatcagttatacatttattacaaacgagaccaaatattcattgtttttctttgaattatctacttaaaatatctctaaaggccgggtgcagtggttcatgcctgtaatcccagcagtttgggaggccaaggcaggcagaccccgaggtcaggagatcgagaccatcctggctaacacagtgaaaccctatctctactaaaaatacaaaaaattagccaggcgtggtgctgggcgcctgtagtcccagcaactcggaaggctgaggaaggagaatggcatgaactcaggaagcagagcttgcaatgagccaagatcgtgccactgcactccaggctaggcgacagagagagattgtctcaaaaaacaaaacaaacaaaaatctctaaaataaagtaatatacatgtcatgtaaatttttctatagatatataagacatctaatttagatctgaaagagaaagtttattgaatatgttagagttataaattttttttcttttttttattatactttaagttttagggtacatgtgcacaacatgcaggtttgttacatatgtatacatgtgccatgttggtgtgctgcacccattaactcttcatttaacattaggtatatctcctaatgctatccctccccctccccccaccccacaacaggccctggtgtgtgatgttccccttcctgtgtccatgtgttctcattgttcagctcccacctatgagtgagaacatgcggtgtttggttttttgtccttgcgatagtttgctgagaatgatggtttccagcttcatccatgtccctacaaaggacatgaactcatcattttttatggctgcatagcattccatggtgtatatgtgccacattttcttaatccagtctatcattattggacatttgggttggttccaagtctttgcttagagttataaattttttaaaagggcactggaaaccaaagaatttattttcggaaatgttctttttcatttatttccaaaaattttgattctttattgtccagtgatatctgctggatatgttgcataattgtgcagatttggtaacattcttaaggaaggcttacctttcctgaaggaagagtacatccttgagttccttttgctttatttgggtgtgagctatgtcactctactgccattagacccagaacatcagggggcctaatattctctgtccttttttttaagcttctatttaagactactacatgtttggtagttctgttctgtcttctatatgcttacagtttataatttcttttagaaatagctttagtattacaaaaaggagcaaaaattaagtgaaaaagtatttaaataagtggtctgctactttctaaaatcaggctataatagtaaaaaacaaatttgacattacttccttttatgtggcttaaaaatatagcctactagctagaaatacacaagaaaatgttcctaagtcatgtaatctagatatgttttctaagggttgctacatataagaaaaaaaatttctacaagaattctaatgacttctacacctgaaggtgcattttctgtaactaattggtatgtgtcctgccaaactttgaacaaagctcttggttatataatgtatgctactcctctgttatttttagtcctcattgcacaggaaatacacaaatggagactattactttagcttagcaattattcataaacaaggtccatgccattccacattttgagtaataagggctagtcaccatgactatgtgagaaacccattgtaaactgtgaacttaaatcagtatgtgtaaacttagaaaacctaagcatgaattgggaaagcccgtatggattctgctgtattgccctgggcccatggtgcatggtgcttttgtgctcattctggcctcagagaaggtgtctgttgtatatggcacaggacagctccatgagtatagactttccatcaaataagtactgtacagtactctgatttctaaagtttgtgaagtttgttacttggaactgtgataaccatggcatttccgttaactgatgggaattcatcactgggttgttctctgactctgtggaagaaactatggtagatagtccagcatggtgtcagcttacctttcctgaaggaagagtacacccttgagttccttttgctttatttgggtgtcagctatgtcactgtactgccattagacccaggacatcaggaggtctgaacttgaccctttgtgggtatcagataccgtcaatacccatggctgacattcaagactcaggtttgagtgttggacccttacatgaatagtgatatgcacagataactcttgtcccaaaaattcagccacattcactgaaatctcaaaccatgaggtttgtattgcttgtttagaaattgtacccctgattctaaaagcagtttttgtcttcgtgagcctttttggttttggggtttttttgttttctgagacagagtcttgctctgtcacccaggctggagtacagtggtgcaatctcagctcaccgcagcctccatctcccagattcaagcgattctcatgcctcagcctcccgagtagctgggaccccaggcacctgccaccatgcccagctaatttttgtatttttagtagagacaggtttcaccatattggctaggctggtcttgaactcctgacctcaggtgatctgcccgcctctgcctcccatagtgctgggattacaggcatgagccactgcacctggcctcatgaggctttttgaacaggaagtagaattttcaagttattttaagaaaattcaagcacgaatacattaatataatcactggattataacattttaatatgcctatagaatgcagtagagaatatagtttattactgcttctcttaacatttttctgtaattttttcctgaaagaacacaagtggaaatagtcttttaaatgaatggtggttatctattaactctgaattttctttctttttctccatttctcacctttcattccattatattaccctgcatttcccttttattttatttttgtttacattaaaatgccacttccctttttaaattattttctgctcagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaaggtactgacacatttgccctggctgaaaaaagctaatcattgatactttctaattttaaagtctcaattcatgtttttttcagaatgcaaatgcaaccactttgagttatttggtgactggtttaaagccgaatacactctatgaattctctgtgatggtgaccaaaggtcgaagatcaagtacatggagtatgacagcccatgggaccacctttgaattaggtatgtgttgtcagaagccatgtcacatggctgcttttacttcccaaggaaagaattgagtgcctgaattgacatatttacaaaacacagtgagcaactacatttggaattcagtgtttgctatttcagctgacaagttgtgtgtttttaattactgaacaagaacattagcaaataacaggatactacagggaaaacatgataaattacaaagcactgggtagatgtaagggattattgccattaatcctgctttactggtaaactgagatagaaaagatgaagtgacctgcccttgaccaggcagttccaatgccatgcttgcttggagcctgaacactttgctgggtgaccccaaagctgcctctgcagtttgcttgcaagcaaattagcgtcttataaaatcttccactgaaataatccttaaggtctttgtaagtggacacgagagggaaaagatgactaagcaaattaaagagagaacaggctatctgggtttgagattctgtttggtttttgctgacttttagacatgcctttctgctaccccctgggctttcctagtctagggatatgcataaccatttcaaatctctgtctattttggcctcctatttctctcctatatgaataatggagttataaattctccacaaactgggcttggcctcagtgtctttttgtcttctgcacagttcactggactttgtacagagagaagggttggatttgaagagttagaaatacagtacatcaaagtttaaatagaccttgagtttgctttctttgccaaccattttaagaaaatgtttttacttcaatcctaacccattagataacaaatgagattgtgttttcccttaggatatttgcatttcaccaggcttccttacattttatactaagagaattctagtattttaggaagagttgagtaaatttaaggatgtacttaatttgctcattttcctactagtgtgttaaaagttttcagctatcacatggaaacacaggaaacgtattgtcctgttgcataaacgaacagcttcactttagagctgtaacctcaatagttggcagtatgtttgcagaataaactcatagtgaaaaatattaatctgtaaatcatctattctttgaagaaatagggcttttaaaagttatatttggggctgggagtggtggcttgcacctgtaatcccagtgctttgggaggccatggtgggcggatcacctgaggccaagagttcgagaccagcctggccaacatggcgaaaccccatctctactaaaaatacaaaaattagctggatgtggtggtgcgcacctgtaatcccagctactcggtaggctaaggcacgagaatcacttgaacccaggaggcagaggttgcaatgagcagagattgtgccactgcactccagcctgggtgacagagctagactccatctcaaaaaaaaaaaaaaaaaaacagctatatttggtttggagagccaactataaatgagagagaaaactgttttacaatttacagtattctaacaaaataatccagtgtgacagggaagaagtcatcttggacgaattacataacttctctaattttttggtgtcctgatccataaagcagagatagtgataactacctttcaaattttctacaaatactaagtgagatactatgtgtacgttacctggtatacggtaggtacttggtacaaatgccacttgactttcctacctaattatcctgtttatccctgactcccagccaagatgccaattctgtatcttcatagtatggtatttcctctttggtactctgaatattcttcttttgattggaacttttgatagacaaactgtgatttctttgaagccagaagctttatcttttttgccttgtgccctttattttgccttacaagtggaaaaggttgaagaaatagtgaactaatttgaaatggacagaaattattaaaaattttgttattttgtagttccgacttctccacccaaggatgtgactgttgtgagtaaagaggggaaacctaagaccataattgtgaattggcagcctccctccgaagccaatggcaaaattacaggtaaaatgcaatcaagtgtgcatttctttgtgcgctcttcctgcctgacaggagtattccaggagagtaccatgttgctgggagaagtgggagtctgaaggctggcttggtcattttatggtaaggtgtgagtcatgatggtccttgaaattggggtgaggctgtgctggtcgcccatagcggcataaaatgggttgcctgttggtggttctgactgcagtcggggatgggaggcactagacagcctttggctatagtgggactttgtagacatttattttccttaggaaagctgctcttctctgtctccgcctagatggacagcttcagaattatataccccctccctggttctgtagagtaatacccaataaacagagattctgctcttgtaccctgaagccacaaaaaaaaaaaaaaaaaaagcccattagatatttaattccttttcactgccccccgagacctgctacttcaagtacctgtgctcttataattagagttaaaagtgaacttgcctaggtctttgtagggacctggaattttttccttgtactttcagaggaaaaccttccacagtagaggggacactctgccttcctcagccttatcagggatggaagcctgatggggttcagctgctcttacttcctttggcgcctctggcccatgtaggtgtgtgctgaggaactggggtttgccctgaagttcctctgtatgaataggtggcctaaggaaatggaaagtgtttcttagcactgtcctgcttcttgctttcagtaggaatctctttctgtacatcctggtctttatgtcatttttttaggttttgactttgcctcttttgtgaaagaatgaatcatgacttgacttggattacattttactttgtcttttaaaaccggcaacagcgcagtgcccttttgctgtgggtcagatagattcatggttgtgatgcttcccttctcaatgtggggattaagtgccccctggtggaagtatcaggtgacagttcactgtggctctgcccaggagttcctaggagatcacatcggtaagagctaaaacagcctgtcaggcaattcctggttttcaaaactgaattattttaattgtagacccttgagggtacattattcaaatattatgctataatattcatatgatataataggtacttattgatttactgaaggcaaaaggaaaagcaggagtgagatttcttttcccattaattcctttggacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaaggtaatgctccccaagctgagggttttgttgtgtgtctctttagtggggctatgctgacactatcacttgagcatatagagtctgtggatagtatatgaagtcttaatgatgagcttgtgagccatgatgtgaagatttatcccagaatgattcctcacctactcattgaccaaatcagtgctccctgggttaccagcctaaacatatcatataaaagaggacactggttccaggctatttggggcagatcaattgcagtgatctaaaagtttttactggtcagatcagatatgattcttttggttcccatatagagaaagagtagtgtgttcttgtgatggatagttcaactcaggcaggctattaacctgaaagacttatttgtggacgttacagagaaaaagagactaaaaagagccttttaaataaaaccctagataagaaaatgaagataaagcactgaaccaagtaagcctagcctaataaaatttaactggggactgaatctaaggaattatggaagccctgtatgaatttaatttctgttagtactaaagtcaagtttcagtttgtttggaagtttgtgggggttttagtttttttcctttaaaaagttctgcctgtcccatcttcaaagcttgtgatccttgctcttgttttttcttcccctgtgcttggcctgttagcggactcctctgataaaatgcctaatgatcaaggtaaatgagtagatggcctctcttttctttcctttcttttgtgacctattattagcttttggtttttgtttcttttttttttttttttcctgaaaaatcagcaccatgtgttaaaagccacacagttattggccaaagtagagttgagtccatgttctgaaaagctggggaatttatgtagaagctaactaggctggcagaagaaaactgaaccagtaaactggtcctgcagctgtaggagattcgtcttaagtgtggatcagatcatcctttgtgctgagatattgaagttctgtgacaacgataagcatttaagtcatgattagaccgatcataccaattgttcatgtttgcagcagttgttcatatttgatcataccaattgtttatatttgtagcatctagaattttattagtgtctttaagtggaaagttgtatcacattcagtgaataccctattttcctcttcccacaaagaatccacaaatttaccttactcaatgttgtgattctgtgtgactaaattactgctttgtttattctgttaccataaacttaattcagagctcttttttcatttctccccttaaatatatctgatcatattaaaagaggatcaaaactatttgaaataaaaacttaggccacgtacggtggctcaggcctgtaatcccagcactttgggaggccaaggtgggaggatcacttgagcccaagagttcaagactagcctgggcaacaaagtgagaccccctctctacaaaaaataggaaaaaaaagttagctgggcatggtggtgcgcacctataatcccagctactccggaggctgaggtgggaggatggtttgagcctgggaggtggaggctgcagtgagtcgtgatcacaccactgcactcctgcctaggtgacagagtgagaccctgtctcaaaaaaaaagtaaataaataataataatagtgataattgaaatggggacctagcaaacaggggcctccatgtcaccattcttgaaaccatctgtcaatagtctttacactgtaactgccatggtggagggatagctatattttgtgatttttatctctaggaagtcagctaatgctagtatgttttccatactgagaatgaacattaaaagtaaatttaattattgctctcttggtttaagagtagttgttagaattgcaagttatttggatcttggctaatggcaaggaagagtcagaacttgaggtatcaagttttccagaacactttggaaatgtgtttgcattcagtgagtcttttgcactacattggagaaactgcaaacatactttctgttgtgtgaaagtgcaggaatataaaaatacccataatatatatatgcacagaatataaatgggctcattgttttctcacttgattccatagccagagtgcaattcttagctgcctgacacctctggtatttaaaattctttactcattgatatttttggtgctcagttcatccttggaatttcttgttcatagtttacattcaagagaaacaatgttgggaaatacaggaatataaaccatccagtttgttagcaatgtgtgttctttgacaattaggtacataatccaatgctctggatagtttggcttaaatgtagcctagctgtcaactaagtacacttaaacctgaagagccttgcaggtgctaagccatctccaccagctagactttgtcatagtgaaaagcatatgaggaacaactggactcttaatctatggtgtgtgtcacttgggagaaatgatggcatcagaagtaaggagataaagtaatatgtgtggacaatggaaaaagggccagggactgtgagtaaattctagaatatgcccttttggatatccaggaactcctgttaccttcttttggtaggttttcagtttctggaagcatagcattgttttagtcactggatttattctgttagatgaactgcatacacaaacttcagattttaatgttttcatttcattgaatatatgtatctcctgataatttatggaagtacttgacattagctctaatgttttgcagaaacacctagtttatacatttctagtaaggctttatttgtagaaataactctcatttataagtgttttttgaagcttcatgctctctgcctctttaaagagaagattatactctttcgtgaagattttttatgcttgtaataggagtggttaacatttatggaacatctactatgtgtcagtcagtattaaaaatattttatggtattaaatttccatttaatcctcacaacagctttgtgaagtggataccattattatccctgtgttacaatgagaaaactgaggcccaaaaagaataaataacttgcccaaagtcaaacagttgtatatgatggaggtaatatgcaagtgcagtctgtctattaaacaatgtgctatattaacctcatagttaacttcataaaacagcttttactttgcaattctttcagacctctttttcaggagaagtatgatattgctttctgggtataaaccttagattgacacctttgctttattggaaaaaggtcctcgtatttgcttttcccaagcagcttttcctataaatgtgaagagcaaaattcaaggccaagtataagaattttttaaaaaactgatatttgcactttctgaggcctccttctggggtggtcctaggcctgaggtcagcagcctcacttagtatgttccctgatgatggattaggagacagtgtctttttgagcaactaggaggaagactgtttttttcagcctctggaatgtttaggtgactgagcaggaactgagaacctgatttgaacttccatttaccttcctgctcctgcttagcttagggtaactttatattcagaaggacaactttgtaatttgagaaaagaatctaaacaatactaacacctgctaggtcaggtattagtatccacatagccaggtcccttggaagagtatagttctttaatgtagacattaacctaattagtccccttggttgcttttctaggagaagctacttttgctgtaagtcctctgagcagtcctttgggaactgtttcctaagctagagaaatagcacctactgtcccagcttctaaacagcagtgacagtcagctcacagccgtgagacaagcgtgtcagtctttcagatgcctcattacatagaaagctataccttagtttgctttccacacatagactatagattcccatgatttatgtgctactttattttctcatggacagaatagactaaaaattgtgttttttgtttaaaacactccctagctatgaagtggactgtcacgccaaatgtgtggggtcattattgacatgatttcttctcctttagcctcagggtctggagggaaaggaagccggctgccagacctaggatccgactacaaacctccaatgagcggtaaagcctttcccatggcgttttttgcttactatggacatgaagcacttttgcttaaatttttgaaatgtcctttatagcttgtgtgtggtgggttgtagcatattagcctgttttcttttattgctagatttaagtgtttgccaaatcactccaagcccatgtgtcgtaggacccataaatcaaattgtttccccagttatccaacttaagattaattcctaaacaatttgttcatcctgttgcctactgcctctagaaaagagttagagtttcgctttcaaaaataaaccctctagtgggattagccaccatccaaaccaagccaaacaaatgcttttagaatcattaagttcttccagtgctactacatactgcagtgtttttagtttagcaattctagaaaattcttccactctcctagccatcctgagagctggtgccttctaatttaatgatgacacccccgtctttacagagcttcaccatatataagctactttcacacatgaagtcacaattgattcttacaacatggtgaagcagggagaacagataccgttattcccgtttaatacattcagaaactaagtggagaagtaacgtgcctggggccacgtgctaattgtggcagtcctaggaccaaaacccagggcttctcatttctgattgtgcttttcccactgtcacattcagcctaaaaaagcagtgggtgctgtaccagacgtgggaacctagagtggaaagtgtccacagaagtagttactaggaatgacccttactgtctcttcacatgtggaagagagagacatatgagagaaacgcctgtcccctagtaactcatagtctaattgtaggaatacgatgatgtcttaatctccagctatctatttaaatcaaaagtggaactgcccagactttaatgaaatcagccttaaaagaaccagacaaacttaacatccttccagaaataattgtgctccaggttctaggactctgtttatgagtttcttcttctccatgtgtatgtgacatttatattgtgtccacagtataatttttaaggctgtgaggaaggtaattactcctttgtctttctttcattcatgtattcactcatgcatgcatgtttttttgttgttttggttttggtttttttttttttttgagatggaatctcgctctgtcacccaggctggagtgcagtggcatgatctcagttcactgcagcctccacctcccgggttcaagggagtctcctgcctcagcctctcgagtagctgggattacaagcgcctgccaccacgcccagctaatttttgtgtttttagtagagacggggtttcaccatgttggccagactagtcttgatctcctgatctcaggtgatccgcccacctcggcctcccaaagtgctgggattacaggcgtgagccaccacgcccggggcccgcgtgcacgtttttaaagatgcaggctctatgtgacaagctgtgggagcaagaggagttaataacaaactacctgataaagggaaagcttcctagaagaggtgccgtctaacccggatcttcaaggatgctagaagattgctaaatgtcaagaaagggattggacattccaggaagcaatatcagcatgtgcagaggcatggcaatatattaataaaacagcctgctctctccaggagtcacactgcatagagaaaggatagagattgagttgaaaatgcaggttggaatcagcctgtcaaaaactcaagtaccagtgctaagaaatatgagctttatcctacaaataacatgtgaaatatctgacaccactggtacactatgacatccatcttttattatcaactgttattactctgatagcagtgaagaataagttgggggctaagagtataaagtcaggcaagaggggttagggagctgttacaggccaggcgtggtggtatgcacgtgtaatcccagctactcagaaggctgaagcagaagaatcacttgaacccgggaggcagaggttgcagtgagccgaggtcacaccactgcactccagcctgggcagcagagtgaggttccgtctcaaaaaaaaaaaaaggaagctgttatagtagtccagatgaggcataaagaaatggcatatatattgtccctggtaggactgttctttggcagctcactcttgctgtatcttagaagaaaacttttgtccagctcattcgcaagaggtcagatgcgagtaaatgagaatttgtcagtgaaatgcaggaaagaaccacctccacctctgcctgcctcccatacttcagctccccagcctctaatttgcaatgcctgccctgccaagtacccaaccctgtagttcagcactgctattaataacagtgttatggaaagccctactctaatatgaacagtatggtccattttagtggccccagtaccatggtctttcccaaatataaaaacattattttattgaaggtcagtatgtacagtttaagttgtctgtctgcttacctttttctcataaatgaaagataaaaatgattgaaccaaatgtagaataggctcttaatcccttctaaatcagccccagatttagcactgtacttagatgtagtctgtaaaatcaaagaagcaaagttggagggtcagttaatccggcgttgtggaagggattcccacaatgagtgtaagtttggattagaacataaatttgggccgggcgcagtggctcatgcctgtaatcccagcactttgggaggctgaggtaggcagatcacgaggtcaggagatcgagaccatcctggcaaacactgtgaaaccccgtctctactaaaaatacaaaaaaaaattagccgggcatggtggcgggcgcctgtagtcccagctactcgggaggctaaggcaggagaatggcatgaaccagaggggcggagcttgcagtgagcggagattgtgccactgtactccagcctggacgacagagcgagactcaaaaaaaaaaaaaacacataaatttataagccaggttgttaggagaaccacttcaggagattttttcccccctagacggagtcttgctctgtcgcccaggctggagtgcatggcgcgatctccgctcactgcaagctccgcctcccaggttcgcgccattctgctgcctcagcctcctgagtagctgggactacaggcaccgccaccatgcccggctaatttttttgaattttttattagagacgaggtttcaccatgttagccaggatggtctcgatctcctgacctcgtgatccacccgcctcggcctcccaaagtgctgggattaacaggcgtgagccactgcgccaagccaagagatttttttttaaaacacacattccaggccatactttgatggtaggaacttcttccacaacatcccacgctggcaggatgcctcttaagtacttccaataactaaagatgcatttcttggcaaggcagctcatcccattattgtacacctctgattgttagaaaattaagagagagagtagctagaaggaaagagattagatatccatggtggttagacatgtgtggtgggatttgccacattttataatatgagcatacataaataatgagtagggaggcaaagaaacatgtttcaagaaatggaagacagtaagacttagagctaaattacaaagcctagagctcatcctttcagcaatggggaaataataataggaaaaggaaaagaaaatctgaatttccttcttcagggtcctaaatggtccagcctctgcagcttttccagccttatcccttttttcctcctcacttccttccttctgacttgcatctctctgcttaaacaacactggctgcatttctcttccttgagaagagcttgttcctgcctcagggtcctttcccttgtatgatggaatctttcttactcagatctgaactcaaatgccatcttctcagagaagctttttctaaccattcaatctaaattggctacccagacactctgtatcataacccctcattttctttttttcacaccgttagttattaactaataatttcatatttatcgtttatcccattcccccgccaaacgttcacatctttgttgttcaccattgcaccttagtacctagaacaatgactgacacatagtaaccattcagtatttgtcaaattaagccatacttcagacctactgtttcttgaagttgaacaagagaattaactctgcgtaggctgtgtatttataaaaacagactttacttttcatgcaatttttataatctcagatatctgcctgttggggaaaacttctgctttgtatgaatgaacatttttaaatggttttgaaaaccagaaaactaaatgacttataagtggtgctttacaaaatgagtttatatatcacatgagacaccagagagccaagactctttatctgtctaagtatatctcaacctttgaaagctcttgaatgttcagtacaatttgagaagctttaattaagtactatctttgagcaggctctgtcctgagcactgttcataggacagactcttagctgtctaggagctcatcatctagagaagagagccatgttcacgcggcacttttatataagtcagagcaatgagtgttatcaagaagttcacgtgagatattaatggttctgtagcttgatagtatgcatgttttaaattctctaaccctaacacatgtaccatttctctctctgcaggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagtaagaagccccagatgcaccccttagatttttggcatcttatcttttgcttccatgtgacttctgtatatggagtggtacacaaagttaagacataaaaatacatgaaaaggaatttaagatattttaaaagaaaatgggaagtggttcctcttatcagtcagtgtcctggcagaaaagagctggcacatttaaaaggatttcaaaagaggtaatttacaaagtcataggtggggttagggcaaactaggcagggatattcagaggctagcagctatgataagacaccatcatccttgggcctgaaagggcaagaggagagagctgttttcagaaatctgaagcagtaggagagggcttcctgacaaaagcaaagtgggtgctagaggcatgcagccattgccagcctcctcccagcgggcagtggcaggaaaagaaacacctcctaccctccagcctcttgccagtgtctagtattagctatacccagctggaagccaggaaacccagcaggattgccaagtaatagttaatttagctcaacctctggggtcagagggccaactagagaatagatgtggtgagaaaagtagaaagtgtctggcattgctggtcaccccctttggagcaccatctgtacatgcccacagtgaacccgatgcccaggagtctgtggacattcttacaggctgtgtcacagcacaaatgccagcccagttggaagaagaccataggcctgtcattctaaatctaagtttaagaatatttttaaagaattgctaccaagtgtagagttgggggtgggggtaggattgctttaatgaacaggaaaggatcattgataatcaatttatcagtttctcagagcggctgaatggctgctagccttgaactcctctgggattttgagggttgtggctaatggtctaagtgcagatagcaagggggctcagttatgtagtgcttgctaataccatacagtcctacacttgaaagaatccttgatcctaaattacattcaactcagatatctggttagcaaaatagatagaaaaaaaaaaggagattcctgagttattcctaatagcagtaccataatgtgcataataaaatgactttagttgcaatatcttgaaagatcataagatgggggtgttgctccgctagagaaagagaaattcatgtttatgtgattatccatgcagacttgatctgcccaaggcaagaatgcatgtatttaataatcataaatttgttcattttcactgtacagggtaagtacaggccaccctgtaactgctactggtaatgactttatgtcattttttgtaagttatgtgatattttaaatctctctttcttttgcccaaatgaaatagctttccatagcttgtactgtatcacttttccaagaaaaatggaggcttcttttataatccttctgaccactgcctcttatagctcttcctttttttttttttttttttcttttgagacggtgtctctctctgttgcccaggctggaatgcagtggcacattcttggctcactgcaacctctgcctcctggattcaagcgattctcctgcctcaggctcccaagtagctgggattacaggcacccaccaccatgcctggctaatttttgtattttttaagtagagatggggtttcaccatgttggccaggctggtctcgaattcccgacctcaaatgatccgcccgcctcggcttcccaaagtgctgggattagaggcatgagccactgcgcccggccctgtctacttttaatagtggaaaactattatttttaaagcctcaaagactacatttttttttctactctagaacttttcttcaagcctctttatttggcatttaatatttatctatctatgaacttgattttatatcagttttagaaatattgggatctttatttttctgttattgaaataatttgaaaaccaaaatgacagaattccttagtgctttggaagacttcaaattcaaagtaaatttttttttagacaggattttggtctgtcacccaggctgaagtgcagtggaacaatctcatctcactgcaacctccacctcccgggttcaagtgattctcctgcctcagcctcccaagtagctgggattacaggcatgtgccaccatgcccggctaatttttgtatttttagtagagacagggtttcaccatgttggccaggctggtgtcaaactcctgacctcaagtgatctgcccacctcagcctgccaaataaggtactcagtcttcagattgaaagtaagaagatgagttgataataggctctattctctgtattggcacgtcctacagatttgggtccctttgttgaaaatcatcatatcagatcttcatggggttttcccctcccccacttccccagttatctgctttgcaagtattccattgactgttgaaaaatataagcgagcttttcttactacttttcttcctacttttcttcctctgtaatacctgaggttcatttagatggtagctgtttacagagtcttacaacctcaaagttgatagagcatttagagaatctaaaccctcgttggttctcagcacattcccccttagcccctgactggcaacaggtaagctgggcttctccttcatgaagaaggcagaagctgtcagataagaacaacctcagcacaccaccatcaaatctgacacctttctacactggtaatcatcgtttcctcctccctcctaagtgtacttcccctgtttgaagcccgttctaccctttaccccctgaatctcattgtcttccatttttctaagaccttttacctgctgttattcctctctccagcatagctgacctcttactcgttattggccgcctcttcagtatttaagtgtgctctaacttcttccagcttaaggaataattataattataacctcacccccacccccaccccctgtatggtccttttcaccggctgcttactaacctttcttctccaccacagaattccttgataacttgcttatactcttatgtctgttcactgcctacccatgcatcagccctttctaatctttattctgcccctaccacttcaccagaattgcttttgtggaggtcaccagcgacctgtgtattgctaaagccaaagaacatttttcagttctcatcttagtctctcagcaacatttcacacagtcaaccattccttccttctggaaacattttcttcttttgtatccatgacagcatgttttgttttgttttttgttttttttcataggtcctcctgtctacctagccatcaaatacagacattcctcagggcctgggcctggacttactctcttctccttctgtgttctccccaagtgatctcatctgctcccgtggcttcagcattccagctacttttgtatttctgtctccagccaaggcctccctcctctgagtatcagacttgcacacacagttgcctcttctacatttcctcttgaatgtctcagagacatttcaaattcagcatgtccagagcagaattcatcatcttttcaggcaaacccgcttctgctcctttattcccaatattaagtggcttaaatcagaaaccttagcatcatcctgtactcctctttcttctttactcccacctcaccctacatccatttatttaccaagacctgtcatgtctgcctcctgaataactttcaaatctgcctcttgcctctactcccactgtcccatgccatcagttatggctgagattgcagtagcatcctagctggtctcctcttctatccccaaccccacagagctattcttcacatcacagctggtataaagttttaactcaaaagtgttctccttactctcttgcttaaaaccatttaatggtttctcattactcacaaagggaagttcacactcttagcattgccctaaaagctctttatgatctggtccctgactacctttctagtattatttcacatcattctctgcagggttcactatgtccccaccactcaggatttcttaaaatccttctaatataccaccagggcattgcactctgctttagggttttgacataagctgatttcaccacctggaatgcactttctgttccctttaggtcttagcttaaatgtcacttcctcctctaggtttttcctgttcagcttaagtccaactgttaagaagttactctaacacttgacatttcagtaagctcagaacattttaaaataatagttcaacgtctgtattcctcactttatcaaaaattctgagggcacagcagtctagcacagggtctggcatatactgggtacccagtatgtcctcattaggggtaagtaagagagtgaatggagaagctaaaacacagagaagtagacattgttgtccccattcttgactccacctagttggtagtcctagtttggcagtcttcgaagttgttccggccaggtacagtggctcacgcctgtaatcccagcactttgggaggccaaggcggcagatcacctgagttcaggaattcgagaacagcctggccaacatggtgaaaccctgtctctactaaaaacacaaaaattagctgggtgtggtggtggacgcctgtaatcccagctactcaggaagctgaggcaggagaatctcttgaacccaggaggccaggttgcaatgagccgatatctcgccattacactgtagcttgggcgacgagcaaaactccatctcaaaaaaaaaaaacaaaaaaagtttttgcctccctcctttataagccacagactttccctctactccattgttatgtttctacattgctctaattagaaacttgtggatgaaccttctggttatgagattatataatgaaaaatgctatcttaatcttttaacagtcaaaaaaagtagtcacaaggcaggattcaaacataaagaccctggtaagtatctctaaatatgtgtggacaaaatagagatacatttactctccccaggagcaaacttgttgttgttgttgttgttgttgggggcaggaggtatgtttttagtttttgctttttttgcttgaaacatctctcagaaaggaagttttaatcactcaagccttttgacaaatacgttcaaatgagttactttttaaaagctcctctgaacttcgtgcctaggaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagaggtaccattttaagtgcaggttttttctcaaatgttaggaaactattttcatttaaatctttttttttttccctgagtttgccttcatttggcaattcctatatgagatcagatttagagaaatgtgtatgataagatttgggaacatatgatgaagaatacctagcttcttatgggagagagattctgtagccatacgagacaatcttgcagatcttttaggtctctcatcaggcttcagcagcgtgatattcaaggatttgaggctagctagcccatgtctgtgcatttcattctgtgtcttcagctggcttccagcttgcattgtggtattcagaacattcttggtctggaggctcttatagacaccctgtgaagtatggtgggcagcattgtgacatccacattgattcagcaggaactcttgtaatgctctaatgatcattttcctctttatttcacttcttacagaaatgtcttgtccccattatgctgtttgtgaattctgaatcccctactagaaatgtttcactgttgaggctgctcagtggcatagggcacatgctggtaactaacctccacgtttaacatctagggcatgagtcagaggacagcatgtctacactggctggaaggcgaggaatgagaccaaaaatgatgatgccctttgactcccagccaccccagcgtaagtagaagcatctcttttcctcagtgctaccaatctgttcagtcatgtaggggaacaactatgaatgatctttttgacttcacttgattctaacacaaagataatctaccaaagctttgacaccttgaaggaggaagtaccaaacacttgccatattttgcaacaaacattattcttgaggctagcgtcgttatgtttatggtaaataagctgaaaagccaatgtctccagattcccaggaataggggagtaactagtctccctaaaagtgcatcatatctctatgggagagatgggaaagcttccctcctccagactagagctaaggatggtctgatgttacaagttttcattacgctgcctgacaccagtgctgatgagcacctgtgaaatttatttttttaattaatagatttgaaggccaagcaagatggcccacacctataatcctagagttttgggagaccaaagtgggaggattgctggaggccaggagttctagaccagcctgggcaatgtagtgggaccccatctctaccaaaaaaaataaaattaaaaattagccaggtatggtggtacatgtctataatcccagctactcaggtggctgaggcatgagaatcacttgaacctgggaagcagaggttgcagtgagccaaaatcgtgctgttgcactccagcctgggtgacagagtgagactctgtctcaaaaaaaataaaaaaaataaagccaggcatcgtggcacacaacctgtagtcccagctacccaagaggctgaggctacccaggaggctgagatggaaggattacttgaacccagcgtttaaggttgcattgagctatgattttgcaccattgcactccagcttgggcaacagagccaagagccagtctctaaattaattaattaaaataataaaatttaaaaataaaattagtagactttatattttagaatagctttaggttttactgtgtggaattttttttttttttttttttttttttttgagacagagtcagagtcttgctgtgtcgccaaggctggagtgcagtgtcacgatctcagctcactgcagcctccacctcccgggttcaagcaattctcctgcctcggcctcccaagcagctgggattacaggtgctcgccaccacacctggctagttttttgtagacacggggtttcaccatattggccaggctggtctcaaactcctgacctcagatgatccacccaactcggcctcccaaagtgctgggattacaggcctgagccaccaccacccgcccagccggaattttttaaacaacatttttcattcttgattcgtgcctcactttgataagcataaaggtttctgagcctcttttaataatagttgaaattcaaaataaatatcatgattaaaccagaaagcagtgggacaaaccgattctttcaaactactatgtcctctctcgtcactgttttcaaggaagtgaagcctttcagactagctagcacagtggggcttgcagttgagggaattctcagccatctgtcaacaaacgatgcgatttaatagccatgaatatcatacatgcaacgaggtacaccatgacatcgtgcacttggaaaagttcctcaaatccccaacctcttggtggaagcttcaagcacgtggatgtctgcacacgcattccctctcccacaaacactgtacacaaacatgtaagatactggattacaaaaaccatctttgaaagagtaataccctatttgttaacaggtaatttcagctcaaagtagcttatgcttgtggtccttgatggaaagaaaagcctggacttggaaatgcaggggaaaaccatggtttccctcttacaagaggtgccctggatggggttcccaggtttaaagatacaaatgcccaagaagagtaaattaatccatcccagttgcttctgattgatcaagaagatgctagcactatactcttatttgtttgttttgtataagacttgagttcctacctgaactggcttattttgaaaacttgtaaaattttactatctttatttctagatgtattacttttaaatatgttaagtaaaaaagatatgttgtccagttgatatcattcttctttttttgatgttggggaaggagtttgcaccaatatacaatattatttaatttgtgccttaacagttgggtgggtaagtggaatcttttaaaaacctgcaaccataagatccacttgtggtctttaggttttcagatactgtttttaaaacccgcatggctacagttctgtttcacaagctggtattccctgagctctgggccctggaatgctgcaggagccatatacccactccccaccttccctggtcttaaatgactgagcagtgccaggaagggtttgctggtgctgggacatggctccatccagggccatgcactgaagcaacaagttcagagtcagctaacagctgctgatttcctactatatcctaggcaggcacattcacactgctttatttttttttatttacttacctagaaagactggaaatgccttataaaagggaaaaagtcaattttgtttttcccttgtgagagtcctaaaatgctttcaaattgtactttcctaggtaaaaatcaggtttattccccctaccccagcctgaattctggaaaacactgagtctgaagcacctacttctaaaaactacctgtcttcccctagagttgctgactccccagttacctcaagagccctcctcagacagctttcctctgttgttttattcccgggcacaacctggagcctctggtccccaagagcagcacctgagggaaagccccttttttgttcctcaggccttgagaagggaaggaagggtcagcagtgctcaagggtcccagtcatgccacctgcttgcttgcatgtggccaggacaagggatagctggaaagtaaaggcacccattttgttgaccaggatttcttttcaccagagtaatgttgaatagccccacaaagactttagggagatccttggggacagaagacatttcaataggccactaagtgttaattaagtagtattattaagttcatgaagcctttgtttggagaaaaaaagattcccagtattgttagtcagctttggcctatttgcctgtttggtgggggtagagctggttatcttgatcttaaacgtgccatttctacaaccactccaagggagttcctcagaaaagtttattctcagactctgggcttctaattttatctgtttccatctcagatggataatgaagcctcatagaaagtagtacatggaatctctgtcttcatagaaagtagtatgtgaaatctgtgtggaaatttcagattctttagctaaacgcagttaattgaatccttagccagtgtgggaaggaaagagccatttattctcttacatgcagatgggtatgtctgagtccccagactggaagcagtaaaagatggtgccatcagccagtggttcatgcttttagtactagatgggaccatcagagttcaattccatttgcatttattttaagacatgaaagccgattaaacagctacttatttatttggcctaaatacccattaaatgcttcattcagcagttttaacaaaggcagaatgaattaggaatgtactcgaaaaagaagggacttctttctatccttttagcaggacaaaatagaaaatttatgtgttggcttatggatttatattttgtgacatattcaaatagatacttgtaataactcatgtaatccatgtttattatagtagaattggaaaatacagataagccaaaagaaaaatattattttaatcctgaccactcttccctgcaagataataactgttaacattttagtgtatattcctttttttctatatatatgtagacatatgcaaaagagtatcttcatttttaaaaaacaacgtaaaaatcaatggctaattgaccagatctagccagctgccaccaaaaaaccaagggagtgtttggattgtatgggaggtgggaagggggtgactttgctcttaaactgtgatttgtgtgtgtttgtgcaagcatgttaagcatttctctgtcttgtgttcattcacagctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacaggtgagagatgaggatcaagcccagatggaaaccattccaaaagagtcggcaagcagaaatggggaaggacttgccctacttagaagagggatttggaatttttctgttttatttaacttagcataacatttctgtgactgactcaaatttgtttctgtaaaattcaccccatatttctacttaagttttaaacattcagtgcaaggttttcttttagtaaaaacagtatctctaatcacataagcatcccttgttccataaacttgcactttaactcagtcttttttccaatttctttcttttaatcctctagtttgaaaggaaaactcatcctgggtgatttcagacactagtggttgcctttgcctggcagtcactgtaacattgggtaggtccaaaggttaactgttacatacaggttacttccaccgtggaccaaagtgcaaacaacatccaaggagcagtggggccaccagccacgaggagttgtgtgtattgtaaaccacagggtgcctgatgtaaacctcaggattattaaaattaggaagcgatgcacaggaatagatcctctctgaagaaacagaaaattacctctgaagtgtatttaaagaaatacgttgctagacaaacatgtccccagtttggaaatcttaggaaaccgcattatcaaacagttttaaggaggaaagaaatagtgaaggtgtgaggacagtaagcggcataaatattcttcattaattgaaaattaattttcatcctcagttttaaacggcaagcctagtaacttcccatatattcaacatattatttttccaccatttgaaacttgcctattaatagttattatgttactgatagaactgagttttgctggtctggggaataagggaatttcaagtgagttccattttaaaagaacctcaaaactttatgctggaaatttgggtttccagtaatatccccattcttttaagttttttgtttttctttggtttctttgtttgtttttgagacagagcctcagtctgttgcccaggctggagtgcagtggtgcgatctcggctcactgtaacctccacctcctgggttcaagcgattctcctgcctcagcctcccaagtagctgggattacaggcacacaccaccacacccagctgatttttgtattcttagtagagacagggtttccccatgttggccaggctggtctcaaactcctgacctcaagtgatccgcctgcattggcctcccaaagtgctgaaattacaggcgtgagctaccgcgcccggtccccattctttcaagttttcatcaatcataaacatacccaaaacatcaaatgaagctttattaaggggtgcctaataatttccaacattagctactcccaaagctattacctgatttggagaatgctgcttgaactcacatctaaatttggccttccaggctgagcagtgtggctcatgcctgtaattctagcactttgggtggctgaggcaggaggatcgcttgagcccatgagtttgtgaccagcctgggcaacaaggcaagatcccgtctctactaaatattaaatatatatatatatatatgtaaaaatttggcctttctactatctccctccaaatcccaatttggagttctgcatttaggaaagacggtttccaagatggacagttactccagccagctgcatggagagccaaagtctgccttacagacatagtctcaaatagaacagaggaccagaaagcagcctccacacctgctcttagaaaggaggttttgtgcccaaccctgtttctccatctttaaggccaaggaatctcacatgctaggatgtggtcctgcctgagtggatggcaggcaccttccaatcaaatcagccccttcctccttcctcctgggtttggggattggagagaagcatggcagctcctacccagccctctcccttgtgatctagtattggtaagcattccctgctctacggacctaggcagaaagtgaagagagggggaaagaataatttgcattactgagagaggccatgctttgatgactagttggataatagaaggtaaaactaaagtgatagacttactgaagactgatttgaaatatagagcaagtatccagaaatgatcaaagttctttttcacgattgtactttgctaagctcctgtgtctctggagctcagagtgttgccacagcttggtatatatgggctaagcagggccagtctctgctctaaggagcattcactatgtcaccaccacttgacattggaaaagcactttcctcttgtccaatcacttggccagtgtgaactctgtgtgtcttaactctttaagaggcaagtcagtcaggaagtagcccccttgccaaagcaggaattttacttacagcatggattctaagcaggccagtgattttgcacactgtcagggagcacccttcatgataaaagcaacgtgcctggggcccccggagttgtgcaaggcagccctggtctgtggtagcaggcctgggtgctgactcatgtaggcaaccccattttcctttttcaccttttgcgccatctctttggccctcagaagcttatatatccagttacagaccgttgaggcagtcaggagaggccggtttgcccagagctgacctaacatatctgtcagtacaggctgacatggcctggacatgagtctactgttctctctcctcctccctgctacccttcctagccagctcctaccctgcccagcttctccctggcccaggatcacagagggggaccaccagctcccccgccgtggggatggctagcttgagcaagcctaagaagatcctcagcacacccctttaaggggtgaggagtgacctaagcctggtagggccaacatagttaggcacacttgggagggtgtacgagtccctcatccatggacccaagatcagaggtgccactcgtgactggtgtggcctgacttctcagagcccaagggcacagattcactgctacttcagcaacaaaggcagggaaatgtgttggatttctgcagattgctcatgctttacagtatccccatctgcggggatacattccaagaccctccccctccccccgcagtggaggcctgaagtcgcatatagtactgaaccctttatatctgttttctccatctgataaccgagacagctactaagtgactcaagggcaggtagtgtacgcagtctggataggctggactaagggatgaggcacatccccagtggaatggcgtaagatttcatcatgctactcagaacggtgcaaaatgtaaaacttatgaattatttatttctggaatttttcatttaaatttttggacagcagttggccacagataattgaaatcattgaaagcaaaagcatggataagggggactactgtacttgttaaggttgaggactccagaagtcagaagaggccttcaggccacctggtacagtccattgccctgagctgtgtccccatccctctcctcacaggtggggaagctggtcaccagctcatgctgttggaagggtcttccttatgtggtctccccgggccttggtgctgcttctgccccacagggtgggggcaagtggtagtctgggtgtggaaaggtgtgtggtggtccagagcatgtgtgtggaagtcggaaggcagggattcagattccaccctgctagttcttaactgtgcaaatgggcaatttgcttaacctcccagtgccttctgagttactttgaggatctagtgaactaatgaatgtaaagcagctggcatagtgcttggcttaaagtaagcacccagtaatttacaaagaaaagaatcttaatagatagatattcaagcaccgtgttcagcacttttcatacatctcattcaatcctcaaagaattatgtgttattctccctcttttgtagatgaagaaactgagactcagagatattcagtgactttgtcaaattcacccagctagtacacaaagattggagtccaggtctgtctgactccagagtccgtgcttttctaccctgctgtgctgccttccagaacaactctgccccttcttatattttgagattgttatcatgttcttcctgagccttcccttctccaggctaatctacccccatttccttctctgaatcaaaaatgcccttcatttggtgtgatctgaaagctgtgtgcagacctctgggctgctctgtttgttgtccaattctcacttgagctatgggttttttgctgtgatgaggccatgcacagtccctggaggcacgaaggcctgtggcattggcctctcctgcagtgaccgccaggccttgtcagcagagctggctactgtcaggtacccggccagccttggtggttagccatggttgtctatgaaaggccactgtctaagattccagtgagtgaagtttttaattttcttttatacttatttatatcttaatatcttagtcatctcaggaacctttacaagtgcttcataataaataatgaggagaactttaaatctacaaaattgtgaccacttagctgtgaggtgaaaaactggaatagctggttgagtacaaaattgttcgagactccattcttatccctggcagtggtgctaatccatgttctcttggactagcactgatcgcaagtgctattgagctggtttagggaacccctagaagtagccaaactgtgggactgtcacatatttaatggcaaaagaaatgctaacatttagactttcctgctgtagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaaggtgagtgaggatggcagcacacctggagggagcacacctggagtgaccctttggctcaagcttgggacaaagccaccccttctttgaagtatagcaaagcaaatatcctccaagcctatcttagcaattctgttagcgtagcagtgtgccattgccccgcccaggaagtttatggcctccccttttctgggaacacttacaaaccggagaataatttgctgggaaccaagggctgaccttttgaattgtgttttatgtgcagcacctttggtggtaagtccaatggcatgggaatggatagcagatctagtctgcccagacccctggaatcacctcacttcgtaaggtccctgcaaactagagaagggatcagggaggccaaggcttggactcatagggtggtgaaagcagaagtaacctcagaatagggaaaggaatcctgtgaagggaaagtcatttacccaaatccacacagctcagtaacagtcccctgacctcaaaggcatgcttgctttctgctcttccaaattgttacctattcatttgctttagaataagccagtggttttcaaaatttctggtctcagtatccctttatagcttaaaagctattgagcacctaaaagagcttttcttcatatgggttatatctatcaatatttaccatattaaaattaaaactaagaaatttttaaagtattttattcatttaaaaaagcaagtatctatcatgttaagataagtagcatatttttatgaaaaacaactattttcctttttttttttttatttgggatggagtctcgctctgtcacccaggctggagtacagtggggcaatctcggctcactgcaagctccgactcccgggttcacgccattctcctgccttagcctcccaagcagctgggactacaggtgcccaccaccatgcgcagctaattttttgtgtatttagtagagacggggtttcaccacattagccaggatggtcttgatctcctgacctcgtgatccgcccacctcggcctcccaaagtgctgggaatataggcgtgagccactgcgcccagccgaaaagcaactattttcaaaacaaaaatatagtgagaagagtcgttttattttttgcagatctctttaatgtctggcttaatagaagacagctggattttcctatctgcttctgcattcaatctgttgcaatatggtgttttggttgaaatataagaagaaaatctggcctaacagatatgtaattggaaaagggaagagtatttttataaccttttcagataattgtggatattcttttttgatactacagcaaaactcagcaagttgtagttttttaaaggtttgtttgtaaagtgaaatctgaaaccttatctatgaaatattcatacttcattccattgaaattcattcatctgtcttgcatttaatgcatgatactaaaatatcacacatcggtcatttagaaaatattggtccactacattatgcaaattctgcaaatagtgatacatttcattatccagtatctaaaaacatattcattaatatcatcaaaatgtgtaagtattaagttctcaagaccatggtggcggatgcaagttttccaaaatcctgatttttacttaaaacttaaattttatcattggcaagaaacactatccattgtgttccttgaattgacaggctcactttgttcattttctaaaagatgtctcaagaaccagtttgtctgtctttgaactaacagtgatattccatgataaaaacattcaactcaaaactcaaaactatcacaagtacctttatttaagacagctgttggccgggcgcggtggctcacgcttgtaatcccagcacttcgggaggccgaggcgggtagatcacctgaggtcaggagttcaagaccagcctggccaccatggtgaaaccccgcctctactaaaaatacaaaaagttagccgggtgtggtagcagacacctgtaatcccagctactcgggaggctgaggctggagaatcacttgaacccgggaggtggaggttgcagtgagcagaggttgctccactgcactccagcctgggcaacaaggagagactccgtctcaaaaaaaaagacagctgtcatactttgcacacagctgaagtactttatgcatactttccattttgtcacatacagtaaggtcaagatttagtaaaataaaaaatatgtattcctttattaaggatggttcttagtgaaactggcttttttaaactgcacgtgcgtgtcagtgaatggctttacagtttggcaccactgccttaatttgtgctaaggctccagcagctcacccactattgcctttgtatcctcagtgcaaaggcaaacacagtggaaaggcaaataatgtcttactataaagagagctttggccttccagatatcctgcaagggtttgtggactaccacactttgagaaccactggactaggatattggttttctagagacagtggaatattttctctggcctcatgaatgccctgctatctccctccttccctcttattccagtaacttttcagagcagtatccctgcactgggtctgtatgtctctctcaccccgaagcagcacttggaccttagggccttcatgaggtctaggggaggcaggcttggccacatatctgatggtgccctttcccctcagctctgaaccatcacattcactcagtgaagacagcctccatcgggactctaggaaggagccggcctcctatgccagtggttgttcccagtgcccctgaagtgcaggagaccacaaggatgttggaagactccgagagtgtaagttcgtggggccatcagtccagccagattgcctgggaacatgccccagggcctgagactgctggtcaagctgataatctgtgcataccaggcccgccacccagaactatgaagcagatacactcattcattcagtagatacagtgttgagcatctcttctgagccgggaactgtgctgaggacttggtgtgctttctttcccatatccactcttttttttttttgagacagaatcttgctctgtctcccaggctggaatacagtggcatgatctcggctcactacaacgtctgcgtcctgggttcaagggattctcctgcctcagcctcctgagtagctggaactacaggcacccatcaccatgcctggctattgttttgtatttttaatagagatggggtttcactatgttggccaggctggtcttgaactccctacctcaggtgatccacctgcctcagcctcccaaagtgctgggataacaggcgtgagccaccacgctcggcccccatatccactcttgaacatcttaaattagcttttcacactagcccagctaatggccccttcccccacatcctgcctgccttttagttctgtcccttctgtcattgttcttttcttggtttgaaccatccatacattccctcagttctactctgtgacctttcctgagcaagatgctggaggagaaagtgcctgagtggttgttctcgaaacaaaaatcaccagggtctttctttgatctttcactctcaaactccagtaaaaatgttttgcctctgaatttccaggtacaggattctctaagcggaaagcttggggcccagagatccagggacataccaactgtgctgactggggcagagacctagaaggggcaagcagtgggccttctggcctgtgaagtcattgtgaccctggggagtatgtgttgggagaaaggcattgtgcattatcaggaaacgggatcctagtgaccttgggtctatcctgctactttccactcttctgagccaccctgcgtgttagtagccagttttctggggccatttgactactgaccacatgaggctttggcctctctctgggctctcctttctgagctgctccctggatccagcccagtaacagtgttttcttttccatagagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaac

SEQ ID NO: 934 - DNA, 252724 bp, Homo sapiens; identical to SEQ ID NO: 933

SEQ ID NO: 935 - DNA, 252724 bp, Homo sapiens; identical to SEQ ID NO: 933

SEQ ID NO: 936 - DNA, 52011 bp, Homo sapiens
tttgggaagagaagtacctttttaatagatatataaattatagttatttaacttagaaaacaataactttagtgtttctagaaagtagatggcatttctaaaaaatagttacatacacttgataaagaacagacattccttctgaatttagaactttatgagttattgttataattagtaaggctaaattttaacacaaaggactataataaaacattctttgaatattaaaataattcccccaaaacctatattaagctttacaaatttcagacaagtcattccatctgaaactctgtccaagatatacatggctgtgagtaatgtgtttctgtgaaagtcttttggatgaaaataatgaactttgggttttagaatatttgatttactgcctttgggttcctctgctgcctgtttctcttgctaaatattcagactgagactttactatgactaatcttactccattcttggacgttctgcctctgcagtggggaaggagaccctcctggattatggtgaatatttagctctgaatcaaatgaatgtttaaatctctaagacttgcagtaatgttgaatttggctggataccctgtggttataatattttaagcctttaaaaatatacagattctcaaatagcgacaagcttttttcctgattttttttcctgcctagcaactttgttattatcctcactgtctacttcaaacaaactgtatgcagtttacaattcttgtagcatatggttgctgcctacaagcactttgtgtgccttggcaaacagccacatgcaacattgaagaatggtttcctggatgagtactagagaattttgtttctatccatttttctacttgagttcaactttcaagatagggttgggttagacattgtttctttcttcccttctccctccttcctttcttccttccctttcctctctctccctctcttctttcctgtttcattgttgcagctatcctttaccctaggtaatttatgttgtcagtatcattagaggttctcatcaagcaatgttaatgtaatactcatgttgacaaccccaagtgtttctagcttttgccttctcctgaatcctcacctatatttcaaatcattttggttaaaatccattggtttttttgttttgtacttctggcctaaagagaaatcctcatggcagaaaacgtgttggtttgtaagcctcatcactgatattgagacccagtgtagatttgtgttttggaaaaacaatagctttatttagcattaattgagatgagggctgggtgtaatttcctgctacaaaggagaaattgggaaggaaggagcagaagcttttagaatatagaatgggtctgacagcaagagatgaatattatgtcttgagacattggtagtgcaagaggcaggggatcaaagcacagccccttcttagtgtgaggtcccttaacccctcaatccctagctcccctttcccacttccaaccgtttccttgcaggaagcctggaatgggatgccctggcacatgagggggtggcaaagcaatgggctgagaagtgtaggagaagcagctccaagaggtgagcttgtgtttctcttttctgttttgggccccttgtggtcatctttgtgtccatgctgtctgcacagattgtagtctaactgcttttctgccatttgatcaactggttgaattcatttatctaccattgggttacttatttttgcccaacataatgatagcctaaatacttatagtccgaactctcttcggatttatagagcattagtcaaccatagtctcaagtgcaagtaagagatcatttttttgattagcatctaaatattctgcattgagaaaaatgcattaaggggtgagagaaatgtatgtgtaataatgcatttatatatacatatagatacgtgcatatatgtatataaacaaatattcacacatctatacatacgtgtatatatacatataataagtacacacgtatgtatatattatgtatatgtatagtttaaatgtaacctgggcatccataaattactatggaacttgttaaactatatatccaaataagcagaacatcacattttcagtatttatatattgcagtggaagtctttaaacatcaaatcttactggtgattaacaaatttaagtattatcttaacagaaaaggaatataaatttgctatctgtatgttttgttgccctttgggaaaattatactgtcaaccagtgttaaatagaaaaccttcaaatcagctataaattgacaacaaatagcaaagtctgaatgaatgtgttctgcctaacattaaaaaatgtcttgatcctaagtctcttccatttgacatctctagcccttaatgcctttttcggaagacaagctgttatgctgaatatgcaaagaggcaggaagaagcctctgaaggcacggtgaggcttagtcgacgccttccagattggtgtcagccacgttgcgcggctggggcccagctgaggcccctactggcagctcctctgctgctgctcgtgggggctgcctactgggctcgcatgcaggcaccatggctgcaacgtgctcttctgctgcgcatgctggagcaggcacatctgcctccatcttctgtagggaggcctcggtgggagcctgtggggcctgaccggaagcttctgcctctggcttccaggacgcctgatcagcctgtgctccaacagggagaccctcgcattgggtttctgctcccaacccggcaggagaattactggccttggagggaggttcagcatcactgcctccttcggcttcagcctgaggagttaggggaggcaggggactctctgaatcccgtgaagggatcagagggggttgctctggctccttgagagcggcgtcagcactctcctgagaactgcctatttcgggttgggtttctttggactggtgcggggttgactctggatgatgaattatcatgaaggctgtggccagatttttcacggcggtttggacactattaacctcctctgcgtcaatctcttgatccacagagacgtttgactctggctcttcatcggagttgtgctgactttggtcatccttttcagatatttctgcgtctctgatttttttgtggagttcgtttctctcttcttgtaaagcacggcagaggttctctagcctcccgattttcatcacaaagcactcatattctttagctctcagtgctttctgtgatgtgaaaacacacgcacatacacacacagatgaaatgacatgataagcaaaatgtccaggatgctttctggaaacaagcaaaactatttgtcccagaatttgtctactaggctctgggacctggctacagagtaggggctgaacagatgcttggtcatggacatcactttccttttttttttttttttttggcattgtgtactagactggtagattctttaatcaccataccctgttcattgggaaagaaagatggtcaggcttccttctgctttggtccatagcctctcaaatcttatggatgaattttctgcttctgagacttagaaggtagaagcaagacttgcggcaagataaatgagatggattgggacttgggtttcagcaatgccttccttatctgttctatgaataaactgctatgtgctaatcccagcagccatttgatttatgttgatgagtaatatctctttggaattggttgcaatttgagaagaattgttagagcagtaattataaccatagaaattcaccatatactaattcacgatgctggctgctcaaacggttcagttttttcctctagaaatgtctatttgtgcatgaaaatgttcctaattatctcactccttcacctcacctctgagctactctgtccctttgagaccttttttcccccactcgttatacatggagagaccttcacctgtaagccctacctctcaggtcaggggccatgtatctttgcctttggactctcaaaacctacttggagcctggcatgagatcagtgtttaaatgtctattggaggaattaaaaagatatctccatatctgtttatattagaaaatagcacatgcactggactcttgggctggtgtcttctcgcagtatgttcaaatcaactaattaatttattcagcacctgttatgtgtcagacactggggaaatttaaagtaaaataagacactcatcctacctttaaggaattcacagcccttaaaggggacagctgccctgggtacagctattgaatcaacaggtaagcatgtgacttagggtcacaaaactctttctgagtctggacctgattctaaatgacctttgctcttattatacttattacaatttaaaatgtcacatcctgccaccccaaattcaactctttttcacacataaccatttgtactattaccaggttataattgtatcgtaagtttgaatgttttgactagacagaggggattaaagctaagggagaaacttcctcacctcttcaatcatgtccaacagagctttgttacagttctcaaatcgggctttccatgtggctgtgtccttttccagcttcttcattttcttagttgtctacagaaattagagtgagtgtgtgttaatcttgaaaagttaatatatcaaggaagctattagctccatatgtgagaccaggagaagcccttttgttaccagatgctgaagcaaacaaatgttcaatgtcaagaatgaagattgtagcagagtcataatttatttctgagccgtctagggcagtggcaagcaaacttatttgcacctgagccaattcaggaaatgggaaatgacttaggggcacatggttttgtcactgctttttctttcatttaaaagaagaatatctttatggagttccatgaacaagcctgtaatttaggatatttactgtattgaatagaagactatcacagtgggaaagctggcatggcctttttagccattaaaatgttgataatatctgggcacatctgagaagttgctgcacaaaagcagtctctgtattttctgggtctttacatttatagagtgaggtagagttcacaaaatgtgattacatgcattatttgtttcatccttgaaacagtcccacaaggaaggttctattttcacccccattttataaatggggaaaccgaagttcggagaggtagagtaatatttaggtgaattaacagaacagtggggctgccattcttttatttcatttaatgaagcatatagaatgtctggtggtcaccaggccctgggctgggtacgaggaagtaagaagtgaataaaatgcagcctgtgtttttcgaacctgaggctactcacattcttgtttgtaggatctcttctttgcttagatgaagtggagaacgaggcatgtactcaggtgcagttttcctggatgaaacatagctgggcactcgctgcttggtgccaagctgcctgaagctgggtacccacggaggccagaggctgggcccaagactgtcagcccctggctctacagacaagctaggtttttaattttgatcatattttaaattagttagtagtttgtaaacttctttgttttcttcttttttgttgttgtttgtttttcactcttttgcccaggctggagtgcaatggcgtgatctcggctcactgcaaactctgcctcccgagttcaagcgattctcctgcctcagcctcctgagtagctgggattacaggcgcctgccaccattcctggctaatttttttgtatttcagtagaaacagtgtttcaccatgttggccaggcggtcttgagctcctgacctcaagtgatccacccgcctcagcctcccaaaatgctgggattgcaggcatgagccactgcgcccagccagttgtttgtaaactttaaggtcatcaatctttttaagaatgtggtgaaagctatgggaccacacttcacaaaaatgtgcatatgtgcatcatttttttttatggtaatttctagagagttctcaggtcaactactaacgtccataaatggacccaagattaagaactcctgatttaatatttattccactcttaaaactacataattttgaaaaacatgttttcctgttctaatttattccaatcttaaaatgctagaatttcaaaaaaaaattaagcaaatggatagttccattctgaagtgggagaactgtaacatttaacaagtgccaatcttcttcaggttgctcattgtaaaatttgtcataatattttaaaaatatattttaagaggatgttttctacacctcaaaaccattaatgccaatccctgttcggaaacacagttctgatggctgattttgtattgggaagacactgaacaagctttaaacattacattaaattataatactggcaccttatatttgaaaaatacatgtaaaaagttaaaatcccttccaaaatgtattaatttaacttcacaatcttgtgagttaggcagggaaagtagtatctgcatagattaaaaaaaattagaggccaggcatggtggctcatgcctgtaatcccagcactttgagaggccgtggtgggtggatcacatgaggtcaggagttcgagaccagcctgaccaacacggtgaaaccccgtctttactaaaaatataaaattaaccggacatggtggtgcatgcctgtaatcccagctactcgggaggctgaggcaggagaattgcttgaacccggaaggcagaggttgcagtgagccaagatcgcaccattgcactccagcctgggcaacaagagcgaaattccatctcaaaaaaaaaaaaaaaattagattcaggaagttaagtgaattgatgagtaagaccacttgatgagcaagaacacaccagaattgaattcaggcttccatcttctcattcaaggctctgtcagttatattacattacataagttaaattctcttctaagaaggttcttataagatggtatttcctattctaacattctacttttgtatattcatataaaagttttttggttttttgtgtttttgttttgagacagattctcgctctgttgcccaggctagagtgcagtggcgtgatctcactcgctgcaacctctgcctcccaggttcaagcgattctcctgcctcaccctcctgagtagctgggactacaggcgcatgccaccacgcctggctaatttttgtgtttttagtagagacagggtttcaccatcttggccaggctggtctcgaactcctgatcttgtgatcctcatgccttgggctcccaaagtgctgggattacaggcatgaaccaccacgtctggacaaaagtttttgtttttttttttttaattcttagaaggttatattttgagttcagtatatacaccatcatgttaaattgctagctctggtcttcttttttttttttttttttttttttaagttatccatgggttagaaaaagaactattcttcttcagagtgaaaatgaaacctagaatttttggactcctgctaagattaattcactagatacttaccaattaaaaaatacagcccaaacctcattcctacctataaacatttcattactttgtgaaatgcaccaaaatatcttagtgagagaaaaaggaaaccaaaggaaatttgcctgtcaaaatagaaaatgtcaatattttgttggtgataagcaatactcactttgtccatttcctgtttgaacgtggcaaacacctcgttgcttttagttagtgtgctctggaattcttcaaaccttcctgagtagagagtgagctgtaaacagaggaaagagtggatctttcagaatacttccagaagaaaacatgtcattgttcattatttaaaggaattctcaatatagtattagtaatatgtttaattattttatttactacaagattaacctaggccagtgagcatgattgaaatgcttctttaaagaaaaatggaaaaatagtctgggcgcagtggctcacgcctgtaatgccagcactttgggcggccaaggcagatggatcacctgaggtcaagagtttgagaccaggagaatggcgtgaacctgggaggcggagcttgcagtgagccgagatcgtgccactgtactccagcctgggcgacagagcgagactccgtctcaaaaaaaaaaaaaaaaagtttgagaccattctggccaacatggtgaaaccccgtctctactaaaaatacaaaaattagccgggcatggtggtgggcacctgtaatcccagctacttgggatgctgaggcaggagaatcgcttgaacccaggaggcaggggttgcagtgagcagagatcacgccattacactccatcctgggcaacaagagcaaaactctgtctccaaaaaaaaaaagaaaaaaatgaaaaaagaaaatatgttatttcattatattaaaacttttatcaacattgattgagtactacatgcatggactgtatgtacagaagtatttaacacatggatctgcatttgagggacctgcacttctaatgggaagaccatctcaaagacaacttgactatgggacaatggctacatagtcaagtcagttaaggacagtgggtgatcggagaaggtgagcatggcaggtgatcatgtgagccacatgtttatggagaaggtgaacctggaacttggtcttgaaggaagggaaaaaatagacaaatgaaaagacgtgataaaggcaatgtgggctggacacggacaagggccattgccatgacacaggttgtacaccactctaggcagttgccatttctgtttcagacatcagagttttgtatgtttatgaatatagcattctagccaatagcagttaaatgtccctttttatcaaaatcagtttattacatcagttttccacagatggaagtaatgagtcttgaaaaagagatgcctttttctaatttgcagagaagcattgtatgggttagcatttgccaagtgtatggctcaccatggagatatagcgaggagcatttgtatcgccaagtccttaattcaagtgcttgcattcggggtggaaatggggcaacacagggaaggagagtgtgtaaatacttgatcagtgatataatgacagtgataaaataataaaatcttgtctttgaaaataatattagggtagcatgttttgaataagagaggatttagtatggatgattcagattggtcaagcctcaattttcaaatgaatctttggtactcttgagtgtccagaatagtcccaagtcttcaaatgggtataacattttcatacaacatagttttttgtatgaagaagcagacttgcagcatccgtcaataaacaagggccctggctgcactggatagaccaggaaggctgggttatcagctggaaggaaggcaccgaccggtgttatcagtgagactgtcttttttaaagtacagaaagcaccctgaatgaaagctggcagattggagagtttccagtcttggggtgtgggtgtgagagggagtatgtatgagtcaaacaacccctagagcccagaaaattgcttatctagaatgggttttccccaataatttggagtagtagagattttactgcagtagacagcaataacataaatcatttcggtagaatacagattatccaaagaaaagccaaatgacagctgattatcattttgaattctctcattagtactgtatgtgacagaaccgaaatttgtttctcatgattccttgacacacagattaaagaagacagagtaaaggggcatcaaggaattcatggccaagaaggggctctagggttttacacacacagagagacacacacactctgtctctcacacacacacgcatggtgcataagacaatgtttactgtggttttttttttctttcttttaagagacagtctgattctgtcacccaggctggagtgcaattgtgtgatcctagctcactgcagcctcaacctcctgggcttaagggatcctcctgcatcagcctccagagttgctaggactacaggcacatgccccatgtctggcttttttttttttttttttttaacacaggctggtctcaaacgcctggcttcaagcaatcctcctgcctcaacatcccaaagtgttgggattacaggcatgagccactgtacccagccaatcatgtgcaatgcactctgacatattctgttcaactgtgttttttctttctttctttctttcttttttttttttttttttcaaaatactggctggaatccactgtgggccagaattaatttcagggcccacaaatgggtcagacctcttggtctgagacactgtgccctagggttagctcctggggactggctacctatcctgtacatcatccattggcctagggtgggaacaactacccccagcagatcctggtcaccttctatcacaaaatcttttcatttgtattctcagcccggcctcttttgttaacttttttccttaatttctccccattctttttccaacttatcagtaactctagcagagttacatagaggcctcagacactgtggtctcctcagctggtcctcccgatccctcttgcagccctgtagttgcaggctgcagacagacggggcaggagtgagcacatgtctggtccatctcacagatgcagccttgctggaatcagcaagaacaaccacccccaggacttcagcctcaacatgagctaacaggcattaaaagccctcaggtttgattgtcttcacttaactgggtaaggctgtcaccatgtcttacttttccatgtgtacctgttatattttttcattatgtctcaaagtaaaggctttaaaaaagaaaaaggcagaatgttctttgtggtgtattaattgggcagattttgtttccttttcttatgttttcttgttgctggctcatgagcatggagaagacagacacacccagagttctgagaagtagtgtcttgattcatcaccagctcttctgtgctttttctagttatggttttcatttttgctttctattaaaaaaattaattgtagtaaaatacacatagcacaaaagttaccatcctaaccatttttaagtgtatagttcagaattgctaagtatatttccagtgtggtgcaaccaatctctggaactttttccatcttgcaaaatggaaactttatacacattaaacaacaattccctatttcttccttccagtgaccagtctaacattttgcttttcttcctatttgacctctctgtctggtggcaaaaactatggatttctcagataactctaacactctcctacttactaaatgtttgtgcttcttgtttactaaatggatatttgtttggtagcgtcttccctctcactatcgtgctgacaggatacatgtttggtttcatgtgtcatattcccagtctcactttggtatttcacagagccagggaaggacatccagaggtcatgcacagcatttcccctgccagaggcagaaatagaaacaaactcttctatgattagaacaacaacaaaaattgcctcaatatttcacttttaaatgggccaagtgacaaacacagtcttttcactgagcaccaaattttaattacagacactcatagacatgggaaacaactgtgtccaggaatcatcttggtgaacctgtgagatttggtttgggagttaagtcctatgacaagaacaggtgcagcagtgctctcctctcaccctgtagaggtatggggaggacttcagactttaaagactctgattacatgctttccacaatttacccactcatctttccccttgggtagtattttgcgtccacatcagatattgctgacttcccacatctgctactgtcttcatccttgttgatccaatgaacactcgattttgtagtgacaattgtatcccattgatcatctctgacatttattctgttgccttggcttgtataattgaaagccagacatcgcttccctaagtgagaagcctgcccccaattggccagcagttgtcttatgactgaaaagtgacttctctaggaaaataacacaatctgtccttgataattctgttgcccagaccttagaaatggggccttggccttggcctcctgctactcccacccctttaaaggcagcgtaaaaccaaaggaagtgttggagtgttatgcaaaagaatctgtgatagagtttgttttcaaagtttagaagttttagaaatataatgttgatactttttaatgaggagcttgtttaaacatgattacgcatagggattcaggacctctattttattcttgaggcttaagtaattattggaatttcaaaggtaacttggagacaaaaaagaaagacaaaggagggttcttgcaattagtgaggctgcctgcactgtggaacactgcaggcaatggacaaggcggggtcaacttagcttagggccacacttcttcagctctggaagttctctatgctcatgaactacagctgaatagcatcttgagatcatcttttccagcggttcttcaacttttttgcaacttaagactcctgttgggccgggcgcagtggctcacgcctggaatcccagcactttgggaggccgaggtgggctgatcacgaggccaggagatcaagaccatcctggctaacacggtgaaaccctgtctctactaaaaatacaaaaaattagccgggtgtggtggcaggtgcctgtagtcccggctactcgggaggctgaggcaggagaatggcgtgaaccccgggaggtggagcttgcagtgagctgacatcatgccactgcactccagcctgggcaacagagtgagacaccgtctcaaaaacaaacaaaaaactcctgttgtctcatatttccttctcatatttccatatttccttatatgaaatccttacctatgaaataatactactagttcatacactaattaatagtcaagcagagatttttctctctcttattgatgattatatcgccaaacctagaaccatgcctagcacttagtagatgctcagtaaatattggttgaattaattatgcttattttgggccagacactgagcaaaatgctttggatgcatgatttgaaaaccaactacatatattacatatgcattaactgattttccttttaaaaacttaaacataggcataatttccatccacagttgctgagcaagaggtgaagtaataccagaaacaactacattttagatagtagctgctaccttatgtgctgatgttttggaaacgctgaaaagtcataggcctctcaggggttgcacgactccaggctggggtcattgattcattatagcattttcattttgcagacaaggaaatttagttccatagaggtttaggtgggttacacagggtcacacagcttctcggtaaaagagccaggactctgacctggtgccttgactcagggatgaatgaggaacaatagcaaatctagaacccctggttgatggttttttaagtttgagggggtataagggggaaattagatcaaaactttaatatttgtattgtacaggtcattaaaggcctcgattctgatgccagctgagtgaatcactctgtagcccacagtttaacaatgtaatctactctgctcaagttgattgtcttcattttgcatggaggagtagagattgcatgtagcagatgatgtgaacagtgcacagcttcaagtattatttattgttcccctcaaggctctgtgtggtgaatgaggcacagatagaattagaggccttggcttgattccttgaggtcacaccccctttccttctgctagacagccagcagtcagccacccaccctacaccatgatgtgatgagttccgtgactgcctaaaggatgatcttgagtttgtaactctgggccctttgcttcagacacattatggttctaacttctatgtatctagtgtattaagacaattcttctttattatcagagagtagttcatactggagaaaataatttattattgctttgctatatatgcattgcagaaatatactttaagaaggctagatatgaaaatgttccctgtatttttgtctgtgcagtagtataatctgtgattttaaatttcttatttgcttttttcttttacaatgaacacgatttgtgtgtgtgtgtgtgtgtgtgtgtttacagtgaacaagtactcagctgtcagcatataaacatttacaaatcttaaattaatgctgcccagcttggaaggtttctgatttccttgccttcggtgaatttctccctgtgacctcacagtccctttagcacttgggtgtttcccagggcagtggaagtctgtggcctgtggcaggatggtactcctggaacccacagggaccattatttaggacaggcagagccccaggtaggggtaagatgggtaggtctggctttcttccagagtcagctgtggcataaatgtccagaatggtcccccctttttttgagtctgaaataggaacccccagagtctaacagaagcacataaaagttgtcacgcagccaaaccaaaatggttcctgacttgcctgacacttgtatccattcaccactgacaaggccaacctctgatggcatagaaacttgagtggtgactatttttctcattttcttttcttttctttctaaacagatggagtctcactctgtcgcccaggctggagtgcagtgatgtgatctcggctcactgcagcctccgcctcctgagttccagtgactctcctgcctcagcctcctgggtagctgggattacaggcacatgctaccacgcctggctaatgtttatatattttttaatagagacggggtttcaccatgttggtcaggctggtctcgaactcctgacctcaggcgatccgcccgcctgggcctcccaaagtgctgacgttacaggtgtgagccactgcgcccggcctcattttctttttatgataaataatatcaagacatgaggacatcttaagaatcgccagtcatagatggtgcatctgagcagtttacgttttcttcttaccttaacagggcaatgagaggggaagtacggtggaaataagaagtgctagatgggaacctggacactggctgactctcttgaccactgtactgtcatccattgtctgtcaacaaacctttgactggatgttgccggcgcagaacatttctttttcatagatataatattgtgcttttatttttacttgaaaatatgaataaatgtgaagttgttcttcatttccaattcccatccccccatcccctgccacataggaggacttctgctgcccacctttggccccagcctttttatctggggacagtgaggacagcacccccatgcctcgtccacctggcctcacctgagcctgcaggactgtctcttgctccttcagcactttcgcctgaagtttccactctgctgcctggttcagcaactatgagaagagagagtgtgtggaaagatggtcagatttgccttttagattactatttggctgtaatttgtctacaaaacttagcaacctgctcattaacctccttaagtaattttttggaactttgaaaagaatctaagaaagcttaaaaaaccaggcccagcatggtggctcatgcctataatcccagcactttgggtggctgagctgggaggattgctggaagccaggagtttgagaacagcctgggctatatagggagaccttgtcactgaaaaaaaaaaaaaaccaaaattagtcaggggtggtggtgcatgcccgcagtcccagcaactcgagaggctgaggcaggaggatcacttgagcccaggaatcccaggttgcaatgagctatgatggcactgctgcactctagcctgggcaatagagtgagactccatttctaaaaaaataaagaaaaagaaagctaagaaaataattggtctaaaaaagttggattctcaactataaactagtggttttaataaaaaaaatagtctctagctcaagtatgaatcacaaaaaattcaacttcccaccacattctggaaccttctctagtaatcttggccaacaatcattcagcctctgctggaacctctccagaacatccccacttggtgcacttttgttagcaactgtttcttttcttttttcttttttttctttgagacggagtttctcttttgtcgcccaggctggaatgcagtggtgtgacctcagctccctgcaacctccgcctcctgggttcaagcaattttcctgcctcagccttctcagtaactggaattacagacacctgccaccatgcccagctaatttttgtatttttactagagacggggttttgccatgttggccaggctggcctccaactcctgacctcgtgatctgcccgcctcggcctcccaaagtgctgggatcataggcgtgagccgccgtgcccggccaacaactgtttctttagagtacatccagaatcattctcctagaccactgttctccaccatagcacacttgatacaataagaactatgtatgtccttggtctttgtccctgattcctgacacagagcttctaacatgcatcagaatctcctacggaacatattaaaaatgcagatgcctctcagataatatgatttaggaagtacagagtgtgactgaattctatgcttcaagaaaatacccaaaatggtctggatatcggtggcctgtggattacattttgagaagtatgggttagaagtttgacctattggtctaaatcctggcccctgagagctgatgggttaaattggaaaggggatttgggcatacaatgacacattcatatataagcttgtaattttaacttaagatgaatgcctatttatcaattttgaggtagggctgtggtctttgttttgggtatggatcttctgattagagttcagagggttttttgtttggtttttattattatttttaaaaatcacatccacagtgtgccatgtaagatttctaggttgttaggcttgtgtgtgtgtgtgtttagcgatagtgctagaacctaaaaatacttatgaagcagcttgtctggataattctctagagttttccacttccccccagtcttttatagctactcatatctagtttgacagttgttttttgccatttgcttgcatttggtctttcaaagcactaagcataatttgcacaaacagttttttgttttcatacttatatttcatcagtttatgtaacatcctgttgatttacacaaaagcaagtgcaattggaaagaaaaggtttgtgcaaagagctgattcttggtaagctccaccttactaaactggggcaaattttgtagcccttccagagagtggctgggtagacctgcaagtcagcatgctgtgggcatcggtcagtgcgttttacagagaaaacagtgaacgcagagatcaatctggctagtcagtctggaggctatcaattaagaagtttctcttgtatttgaagataagctgattaaaatttcccacttttagtttatccctattgtaaaaaaaagtccacgaggtctatgtattatataatcagaaccaaaaaaactaacaataaaatcattacttttaaaaactggaaagcttctttttcctcatctaagtttgtctttttcccatgacccagcctctccatttgtaaaatgggttgcatttgttcctctatgcctcccagggtgcaatgaagattgattctcatagaagtgcaaccaaatggtcctatgagaggactggggcagctgtggagtagaagccctacagtgtcccctctggccatctgaggggagtggtggcactgtgcctgcttcttgtgagctggctatgcagctttgttgtgattggtgacccccaacctcgagggaggctggtggctgcctattctgcctgggtgacttgatatctcatcgcttccaaaaggaggtgccccagctgcaagccaggtaggtggctagcttcgaagaagtgagatgagctccctctctttgactcaaatctgttttgctgaaccaaaacaggtgctagtttcttgctaaggctgggtcgtctcaaatctgctctccaatgtctctcatgtgcatctttgtcttgttctttctctttcatgtctcgtgttatacagcaaagtaccaatatactatgggaagcatattttacccaagaaggtaattacaccaatggtggaatttctattctcttggattgtgaataataattgaatgttttatttcttgctttcagagctaggttgtagatggatttcataaattaatctttttcttaagagaacatggacttctgatttgaaattatccaatgtccaccagattatgttgctcaaaatttgtctttttgttgccatgtttgaaaatttattttaaaattactattctaatcaactgaattgattctggtctgattttaggtaaatgaaaatctcaagatcaaaatgtgacatggccaaatttgaataagtggtccatggaccatgttttacctctctctcaccccagcaacagatacatgcgtcaactcatacctctgaaacacacgtctgagtgtgatgcaccgtcacagagagtgtgggctttgggaacagacgcacataagatcaaaacacatcttgctcagtcagcagtgtgcaaccttaacaagttgcgtatcttcttggagcctcaattctctcatctgtagaatgaccctacagctttttggggagtgcttggggttaatgagatatcaataaacaccaccactcagtttcctcagcccaaaacttaggagtcatccttgactttctccttttctctttgtcaccagcttcaggtctgtagcactgtctgttgatttcacattgaaaacaactttcatccatctccacccctcttctctgctgccatatccctaaaccaagtcatcatcatatttcatctgattgctatagtagcctcctgtcttcttgctctcttgtccctctgcagtctattttccatccaggagccaaattaatcttagaaaatgcagagcagatcatgccatcacttcctttgcagaagcacccagtactttcccattgtatttagaatgaaatccaaataactttttaagccctacaaagctacacagtttggcacctgcttacctctccaacttcattttgaacctctcccccatgctcttgcttccctgaccttttcctgtttctggagcacaccaaattggttccagcattagggcgtttgttgctgctgcagatgctggagacgatgctccaagtagcagctcctcatctggcagggcttagctcaagcattcgcccctccaggaggccttcctggtcactcaatctaaagtacgtccccttctttggccccttctcagtttctccttacttccttagtagtggtgattattgtctgaaatgacccttccctgtttgcttgtctattgcttgtctctttccagttagactctaatctccatagtgggagatgccccttctctgtcttgttcacggctatgtccccgcacctaacacggtgcttagtagataacaggcacttgaaaaatatgtgtggaatagatgaatgactattttatgtagaaagtagtgtagacatagtgcctcagactgggctggctaatttagttctccatagaagctggggctctttctccatcagtctagtgctctttgaccattataaaaacaacttgcgtccaggcgcgatggttcacacctgtaatcccagcactttgggaggccgaggaaggcggatcacctgaggtcaggagttcaagaccagcctggccaacatggtgaaaccctgtctctactaaaaatacaaaacaagtagcctgttgtggtagtgggcacctgtaatcccagctacttggggaggcaggagaatcgctggaatcctggaggctgaggttgcagtgagctgagatcacgccactgcatttcagcctgaatgacagaacgagactctgtctcaaataaataaataaataaataaatacaaaacaacttgctcagagtgtctctgacactgaggtagaccagatatgcacaacgactaaaatgataaatacatattccttttctcgtttgtgtcgctcctccgcttccttcatcatttcttgggcctgctcaagctttgcatccaccagcttctgctgcagttctctgtgtttaaatattttgtccagatgctaagaaaaataaagtgtacatagaaagcttggtttattattggtgcttaaaaatgcaaagtaaaataattcacattaatacacattccccaggttttaagatttaaaagaagagagggataaatgcattggcatcacttacagctttataataaagctgtaaattggtgaacccctccccctgactttgcaccacacacacaaagctagctataaaaggtagaggcaccagagttcagcagtgtcaatgccaaaagatccatacaatatttttctacgtttggtaactattagatatgatgctatttattatgctagacagcacagacaatgatgtatcagtatacaatatacaggggctacagttgtatcatttggtattttggctctttctgtgaatataaaaccacttttaattgcaacacttgtgcaatttatcatgatgaattctctgcattcttgcctctggcgttgtgagaaagccttggggtgccagcatgtggtccgaggtctgggagtgaggcctgagcccccctgaattctactctgttgctctggtggagatgacaaggccaagggtcatagagaaattgagtcgcaaatgtgcagagctcgccacaccttttgacctctggactagtttggtcaagagaaacttccaactctacctcaggatggataaattcctggtcactgggaggtccaatcagaaacaggacatggaattctccccttgggctttacttagaaccagtcccaggaatatacaactagcatagcagcccattcccatctgagatctctctgaagaatatggacattttcctttcactccttcctatcttctttagtctgaacctccattctggagcgggattgatccttatgacaagataaaatggtagcatggcattttggcttactattaggagtttcttgatttacctaaccaccgcgaccatatgctgttggctcagttttgtgcttgataaaatcttagcatgttaccaacagagccgctttgactatgttatgttacattttaaagcagagatttaaaatttgggtgggatagggaaaggaatatgatgtgtcaaaatcctgagagggtatctggaatcttaaaaatatattaaatattaaaatataatttgggtataacaaaagaccttgatcatccccctaatataacctattcaaagtaaaaggcttttgcctcttgtgactgtgggtaagtggtttaatctcttagcttctgcttctcatctataagatatggataatatattattatctaatgcataagattgttgagacaattaaatgccatatggtatgtaaagtacagcacttagcacattgcctgatacaaactaaccactgaataaatgatatcattattattacaatgattacattattaatactattattggcctggtagggtacatagaatacagactcttttttttttttttttttttgagacggagtctcacactgtcgcctgggctggagtgcagtggcgtgatctcagctcactgcaacctccacctcctgggttcaagagattctcctgcctcagcctctcgagtagctgggattacaggcgcccaccaccacgcctggctaatttttttttgtatttgtagtagagacgggatttcactatgttggccaggctgctctcgaactcctgacctcttaatccacctgccttggcctcccaaagtgctgggattacaggcgtgagccaccgcgcctggccagaatacagactcttaatttagatgacatggcaattcttaagagggagtgcgtgagttatttttggctatagagagaggatttttaaaaggctgagaaatattattttcaaggaaaactgtgcccacagcctatcactttctatttattgcctttactttgtagtgatgccagttttgaagaaatcccatatgactttcagtcaggtattttgtaagaccatctgtcttcattttggctcgtcaaggaaatccaatcctaaatattaatcagttgagagggctggctgtaactgtcttattaaccaagttcccacctttagctcccagatccggatctatgtactgttctaagttgtttgatgtggttctcacctcctctctgagctcatactgatcgatgatgcttttcagcttttctgcaagctctgtgttctcctgacagagcttcatatttcgctcactctgctgctcgatctggccctggatgtccgtgagggtactctggaaatggcttgtgatttccttccttttctcttcttcctcacgtgcccgctgaagcgcctcttcctgcggataaaaagcaaaacattttgtttaaatgcaccccgggtttatagaactcagcattaggtcacctaaaggagataagtgtgcagagtaggtgggatgttttttctcagttctctagagctaaagctgctcagccccaaaataaatgtatgagtaaaggtttcagctgtgagtacatagttactcagaacaggtgctgtgaaggccttgaatttgtagtcagtgatgaatagacttgttttaaagatgatgcgtctcttgctgagtgaatgaactgcagcgatttctaacaaacacacagtcacacgattttgatctcttggctgtggcctgaaaaaaaggccacttgagtttactgatggatgagacagatcatgtgtttctctggtttggtaaagggagaacaatagatcttatatttccctgtaaaaaccatggcatattaaccacataattatattaccaagttttgtaaatataagtgatcacaataaaaattttctatttgtgagaaaaaactttcatcaaaaagctttaaaaaaggaaactaagacagcatagctcaattacagccattcaagaatataaaagggaatctttccaaacatgctggatattattttgtttttgaaagaacaatcattaaatgtgtcacatagggtaattaaaatgttcaatgtaaattttgaatctgaaagcaatattaagtttcaaatcttctttaactctaaagtgaaacatctaattttccttcttccgctttgttaacattgaagaattgcaaattaacttttatatcatttctgttctcttttctcctaaatcaaaactctccattcattgctagccactaacaatgagctccaatttcctccatatctatattgagaattgctttgcgattgttattctttttgaataaaagggtttaattttgctacatcctaccaaagatagagacatttacgtggctgacaaatgatacagacattttaggattcctttcagttctgattaattgttaatatgaaagcttgcttcgttgttggcaagtaaaattatactgaatttgattgcctaccaagttcaaattatgtaacaggattttttaaaagaaataataatttttaacagaagtaattgtacagacctttatcataacagaataatgtgatccaaataaaaactgatgctgagaatatatgctctgaaaatattttatcattaggtttcttctttcctctataataacaacacatttcccaactctaatgtgactcctgatgtcagaatcataatttattcatgttataaacctttattaagcaacaacttctcaggggtattgaagatatctgtacttcttaaactgaagaaataaactatccgagatgttatttccctgaactttgtatactaacacttactatatgtgtttcgctaaaaataattatggttaccagttaggagcaactaaatatatgtgtgattatgattgtttcctcactggtcctgattagcttagaagtcagcaagtttggaatcagaactacagaccatgatttgaataccgtttgtatttataaatattccatgaatgaataaatgaaacaccccatgcaagtctgagttgttgttttttttttaattgggaactggctatagaaagaaggtacagatgataggatggcactaaataaatgtcaaacaaacaatcataaccgccaatcctggcccaaaagatgtaatcttgcatatatatatattttttgttttgttttgttttgttttgttttgttttgagatgaagtctcactctgtcgcccaggctggagtgcagtggcatgatctcggctcactgcaacctccaacacccgagttcaagtgattctcctgcctcagccccctgagtagctgggattacaggcacgcatcaccaagctcagctaatttttttatttttagtagagacggggtttcaccatgttggcgaggctggtctcaaactccagacctcagatgatctgcccaccttggccgcccaaagtgctgggattatgggggttgagccactgcccccggcctatattgtttttcaatgagaccaaaagaaatctagcaaaatcttataaaatttgagtccattgttagaaggattttcaatcatttggacagtgtctgagataaaattatcttttctttatcaaatacattattcaaagtcaaaataatgtcaataaaattgagggatgaagtctgagataacaaaaaaaccttgcaagcatcattgtgcatcttacaactggtgctgtgcctggcacataatccaaaggtattcagtaaatgtttatttaatgaatcagtgaattattaatttatgtacagacatatgagtagcttggactagatcattcctacagtcctttccacattaaaattctgtgatattctgacaacaaatgcttctcatttctttaggaaaatcatgctccctgagacacttacccctctcttactaggcagttctttttcagcatagtttgaggctcagatttatcactttgaatatatgtatgattttgttgaaacaaacccatgtctcagacttttatcaatcctttcttaagttatcctaaattgtgaggttgtatgtgtgtgtgtgtgtgtgtctgtgtgtgtgtgtgtgcgtttgactcattaaagaagcggttttaataaagaaaagtaaaagctaaaatttgtgatggcggaaatacctagttatacattgtctttctatatcttcccaagctcccagcgcatggattttagatttaggtacacttaaggtgtttcactagtgtggccaaggaagctcatatcaagttgacccttttgcaaataacaactgtaaactctggatgaaatgcaagaaacaatgatgacactagagagtaaacaaaatcagacagactctagagggaagttggcacttgtacatgagtttcctattctttatagcttttagcttgagggaaatctgcagttggcaggagtatgaggtgggcaaaattctcatataaaacataccatctttcatattagaagaataagaatacagagttctggacaactatagtccctcaacagtgaggggaagatcacccaaaaaaagagagagtcagagaaatagagcccagatcctgtgaatgaactttacacaaatctgattggccttgagccacacatgtgcaaagcagtctagctaagtagaaaagaactgaactgagatttcagctgctgctcaagagacaaagtttatggtttgaatctaaccaaattaattgtctgcttaaaaaaataaaaactattcatcatatagtagaatccagattctccagaacataatagtcacaatatccaggatccaatagacaatggcttgacatatgaagaaccaagaaaatatggcctattctcaaaagaaaagacaattagagaaggctttttctacaatgctgcaaatgtggaattagcagacaagtattttaaaacaggtattataactatggtcaatgatgtaaaggaaaatattatctcaatgaatgagaaggtagaaaatctcaggtgagaggttacatacaaaaaaagaaccaaatggaaattctgaaattaaaaatcgcaaaatctgaaacacaaccatcactggatggatttagagcagaatgaaaatgagagagaaaagaatcactgaatgtgaagatagaccaatcaaaataagataatctaaaaataaaagagaaaaagtattggtgaagaatgtgaagactgactcgaagacctgtgggacaatatcaaaaggtctacacacacagagttagaatcttagaagggaagaagatggagagaaagtggagcagaaaaactatttgaagaaataatggctgaaagaaattcaaatttggtaaaagacatataattacagatacaaaaaagcttagcaaataccaagtagggtacatgtgaaaaaaaccactcctggccttaaagcagtaaaagttctgaaaacgaaagatcaatacaaagaccttgaaaagggcagagaaaaaggacatatcacatatgggggaacaataattcaaatgattgttgattttcatgagaaattttaaaagccagtatagtggcacatttatttaaggctaaaaggaaaaaaaaaaaaaaaacccacgaataggttctctcaatgcagaattctatatccaatgaatttagccttcaattaaaaaaaaaataaagatgttttaaagataaaaggcaactaagagaattgattaccagcagatttgtactataagaaatactaaaagaagtacttcaggctgagggaaatgacatcagacagaaatgtgaagctacagaatgaataagaagtatcaggaatggtaaacatctgggtagataaaagggatatagttttgcctttaatttaagaagaaatacatattattgtttaaagtaaaaattataacaatgtctcatcggctttacaaaagtatataaatataatacatataatgatgatagcttaaaggctgagggagtaaattgatctatttagttgcagtgtttctacatgttatgtgaagtaatacaacattaactccaggaagactatgaaaaattaagaatgtatattgtaatcacagagcaactactaaagataatgtgtagtgttataatttcaaaatacaagagatgaaatgtaatttttaaatattcaaataatccaaaggaaggcaggaaaagaacaagataaacaaagcagaggtgacaaataataaataataaaatggtagacatatatcaaaccacatcagtaagtacattatatgttaatggactagtactgcaattaaagggcagatactgtaggaatgaaaagaagtaagatccagctatatgctatcttgaaagaatgcactttaaatataaagacccaggctgaaaatgaatggatgaaaagagatacaccaggcaaacaataagagtaagaaaactagagtggctaaattgatatcagataatgtagacatccagacaaagattattactggtcgggcgtggtggctcacacctgtaatcccaacactttgggaggccgaggcgggtagatcacaagctcaggagttcaaggccaacctggccaagatggtgaaaccccgtctctactaaaaatacaaaaattagccaggcatggtggcgggtgcctgtaatttcagctactcaggaggctaaggcagagaattgcttgaacccgggaggcggaggttgcagtgagccgagattgcaccaccgcactccagcctggacgacagagcgagactccatctcacaaaaaaaaaaaaaaaaaaaaagattactaagggacatttcataaaggtaaaatcaccaattcatcaagaggacataataatcataaatgtatatacacctaatattaatgcttcaaagtacataaagcagaaattgacataattaaaataagcggacaattccacaattatatgaagagatttttaactctcatttctcagcaattgataaaaaaattcaaaaaaggcataaatgatttaaagctaattgttacttatagaacactacacccaacatctgaaaaacattgttttgaagtacatatggtatcaagataagaccatgtatgatcggctataaaaattaaataacacttctaaataatccctgggtcaaagaaaaaattagaaagaaaatttgaaaatattttgaatttgaattcaaatttcaaatattgattttgacatttaaatatgcttgatcttggacaaccaatttggattgctgagtgtcagtttcttcaccaataaagtggagatattaaccttcactgggttatcatgaagattaaatgaaataatgtatataaagcacttagcataacttctggcataataataatacttaatgtcattgttcataatgagaagccattactgagggcatatgggcacacttacagggtctcctgctactttgatcattctgtctttgtttttttggtgggggagaatctctagccagttggatggtattaataagatctctctctctctctctttattttctgagacattgctctctgtcactcaggttggagtgtagtggcgcaatcataacttactgcaggctcgaacttctgggctcaaatgatcctcctgcttcagcctcccaagtagctggcactgcaggaacgtgccacactcagctaattttcctgatttttggtagagacaatgtcttgctctcataaatgttgcccaggctggtctcgaattcccaagctgaagtgatcctccggccttgggcttccaaaatgctaggattacagatgtgacccactgtgaccagctgaacattctgtctttcaatactacccaagaagaccacgctgtatcattctactctttatatctctttgttgataaatgatcccaccctatctgatttaattttatctccttactgtgtaacattactgacagacagtggatttacgcaggcacacaagagatttatgcatcctttgaatccaaaccttgagttgaggacgatgcttccatcctcaggcccccattcggcctgggagtctgtcttcagtactattgttgacaagacgccagtagcacatctaaaacctgccatttgagactttgacttcatcacactggttctccatttcccaaatatcaaaaaacaatttgggaaaatgaggaaccatgattctcttctatttttcttcctaactcaattgtacaaattcagcagtgattttcatgtactctgtttcttgaagtatctccttttaaacgcttataataataactaccttacaggaacactggtgtctgattaattattatttgtcaaaagatttaggatcttcagctggaaaggggattggggatgcacacagtatcatcttggagagctctgcatcttgctatattgaatggagctagtgtctctgtgtaatcaaattaaccacactgctagggcttacgctgtaattaatgaaacccgtgcagaccaaatgaagtgatcagtctattatttttagattgaataattaaacctgaagagcttcagtgctttttccaatagcttcctttttttcagatgactattgacattttggttctcaatctcacttcactgtgtcaattcggtgtgtgtccatttgtctcatgtcatgcagaattcattataacaccaaaaatgctgaatctttacaaatgtatttttttaaaagaactaaggcccaccttagaaacaaactcaacataatagaaaggtaaggggaatggtatgcattttatcaagggcctgcactgtgtcaggtactgtgcgggtaccttacctattcaacttcatctaattttttcccagccacacagtgaagctggtctaatctccattttacggatgaagaaagtagctcaaggaggtaaaattatttaaggttacaagcaagcaaggggcagaggcagtatttgaacccaagcctctctgattctaaaattcacactctttccatgagtagcagaggcctgtctctgtgccccattcaagaaattatgttattctgaggcatggggacataccttcagagtcttgttgtgtctctgcagctcccggcacagactctccaatttgcttcgagcgaggatagctctgctgtgttcaccttgtaactggtccttttctttttgaatttgtacctgtttcttttggaggagctttaacttcttttgctcagtacgatgttcatccagctgtacacatggagatacaaacatgaaagaaaatggcagggatctccttggagtggatagaaaaaaagcaaacctaaagattactctgtggttgtttggaaacattttttgctattatctcttcctctggaagtaaatgaaattcacaaacgtcacctttgtagtacttgaaggtatatagtttttagaacacagcattgataggtttttcattattattagtctctttttactttgatctatttttggatggtctagaaatatttttcctgagtctatctaaccaatattgaatagccagacaaaatagaaaggcatgtctcagaatctgtaaactgccagagttcatgacgatgccttgcattgaggcaatgatctaaagtctgtctgcttgggttgcattgagttttcctaattcttccttgaaacaagcttctagcgctatttttaaaaataggaaagagaaatgcagcctcctggtaaacagaagatgaagttctcttctttataatgttgggctctgagtgtggattgtttatgtgtgggaaaggagaagagaaagtacccttccactacctaagcattgacgggttttcaccaaagcatcagaaatagcttctgcatgattcaacagcatgaatagcaaatatctgtaacacgccttgttgctccccacccgcacccgctctgtgcttataacaaataaatcattctgctggtttctgctgagcccagttgaactcttctcatgttcctccagcagccacaactaaagtactgtatcaggactgccttggaacatgaaaccaacttaccgctgtactttccatcttggatgctgaagttctagggtagggttgtcagtaaaatgcaggacacccagttaaatttaaatttcaaataaataagaaataatttttagcgtaagtattaatatattccaaatattgcatgagacatatttttgccaaaaagttatttgttgtttgtctgaaacgtaaactttgtatttttatttgttacatctggcagcattattatggagttgtagacctggtgtggggagtatggggatcaacctcagaagcctccagagagagattggtggactctaggagtgtcgatctcagactgaccatcgctggggccacatccaagcagcagccctttgtccagagccatttcctccactggcctcagtttctgtagggcccagatggtgctgaagtcaggtaagtactagtcctaataacgactttgttggtgaacggaaaggaaaagccctggttcttctggacctcaggtgttctggtgcctcacagagcctaatgcaaatggatacagatgccacatgagtcctgacacgtgcctcagtttccccattttaaaaaagccattggggctgggcgtggtggctcatgcctgtaatccctgcacttttggatgctgaggcaggcagatcatgaggtcaggagatcaagaccatcctggccaacgtggtgaaaccccatctctactaaaaatacataaattagccgggcgtggtggtatgcacctgtaatcccagctacttgggaggctgaggcaggagaattgcttgaaccagggagatggaggttgcagtgagtcatgattgtgccactgcgctccagcctgggcaacagagcaagactccatctcaaaaaataataaataaaaaataaatagaaaagcagttgttctttctgagcaagatgaacacctgtcacactttcttcggttcacattttatttctttcctctctccctcctgccaccctaaaataagcattttaaacccttgccagataaagctaaggatatgtatatatgatattctatcttcatacttatgtgcaatttctagctactagtggaaattagcattgtaaaaacaaaacccatattactaaaaatattgattgaaatagatatcctccttggaaaataaataatctgttattaaatatttctcatgctaagctgctcatagtatagatgtgagcctttaattttgcaccatagttattagataggcgtgaaatttcttgtacatatatttggatttaaaatgactattgtcctttcttgaaatttatatattgtaggccaggcacggtggctcatgcctgtaatcccagcactctgggaggctgaggcaggcggatcacctgaagtcaggagatggagaccagcctggccaacatggtgaaacctcatctctactaaaaatacaaaaattagctgagcctaggggcgggtgcctgtaattccagctacttgggaggctgaggcaggagaatcacttgagcctgggaggcggaggttgcagtgagttgagatcgtgccattgcactccagcctgggtgacaagagcaagactccatctcaaaaaaaaagaaaaaagaaaaagaaaagaaatttatatattgttattattattgccattctggcgtagactttaccttctgaagattaaaccatatgtcagggcttctgaaccccagcacaagtaacatactgggccagataattttttgttgttggggctgtcctatgccttgtaagttgctcaacaccatccctagcccctacctgctatatgccagtagcactgcccaattgcgacaccccaaaatatctccagacagacatgcctattgtcgcctggtgaacaaaactgtccctgtttagggaactctgcactatgtggctttatctgagtgtcaggaggaagacaccctacaggtgtttcataaattggaaagagaaatgatttgtgcttgctcattttccatttaatgttttatttttatttttaattttaattttttagagacagcgtcttgctcagtcatccaggctggagtgcagtggcacaatcattcatagttcactgaagcctcaaacgcctagctccagccatcctcctgcctcagcctcctgagtagctgggacaacagttgtgtgccaccatgcccagctaatttttttgtagagatgggttcttgccatattgtccaggctagtcttgaactcctgagctcaagcaatctgcctgccttggcctcccagagtgctgggattacaggcatgggccactgtgcttggcctattttgtttctaatattaagccagataatactccagaactttcctttatatttaaaaaaatttaaattattaacaaagtaattcagccaatattcaagtgattcttggcattgaagacaatgaaaaatacacattccctgccctctaggttcttactgcctagcttcaatcaaatgctggctttgtgatttaacttaggcatagttcttctgtacaactgtaataggcatatagaatttctgtctgtaatttctcttgttttctttctctttttttactaagttaaaaagtaaaattaatgctaagtactaaattaaaatcctattactgatgttgtcttaactacataagaattgaggaaattaaatgtgaaaaatatttctcccaggccatttcctaatttagtcatgaaatgtccttacttattaatgagcttatctttatttattaatgaatacaatgtcagataatattacaggatttagactctgcaaggatgagtgagctagagtggcagtttgattcacagctttgaatttgatgatttattctatgtgaacacttatatttcagtcattttctatattaatatccaaatcagtgagcaaggaaataggctttagtctccacgtaaaaaattgaaattcctcataatttttcttttctgaaaaggaaatgtgataagttttttgggttaatcttctcctattcattttttctaaggtgatctctcaggttcgaaagttttttacgagagatgatacaaatgccaaaatatagcaagtaaggcttgaattgaatatggtctctggaaaaacaatctcttgtttattgggggtgactgctttgctaggaggatgagtaggtacagggagttccctgagaccaggatgaacaaccctggctcatggagaaaatatcggtaagtctggaaaagtgatgcttccccagtgcactgtcgtgggaatgtaacaccacacatcacttcctgtattagtctagaatgctgcccagtcccctcaagtatagaacatggcgctggaaactaaacatgaatggccttggtatgagttggtaaatcgaaggggtaaaggaaaaatgactcagaaaatactaaaaagagcaaggatggataggtgagaatcgcatggaaacgtgagagtgggggccagatttggggagaaaatattatttttgacacctaaattatttttatggtattgaaattgttaatagccaatgcaatacaagttgcaagaaaattgatacactgatacttgctttgtgagtttctactgctcttttggaaagcaatatggccataaagtttaaaaaccagaaagcactcatcttgtttaatttagtaagcctatttctggaaatttttcttaaaatcataaaaaagaaggaaaaagaacaaagctaatacgtgatgatgttcaatgcagaaatatttggtaaagcaaaacagtgagaggaatttaaatatattcaaattattgaatcagtagatacagccacttaatggaatatgacacaacttttacaaaatatatttgtgaagactatatattatatggaaaaatgcctgtcacgtaagaaaaccagatatcaacttatatgtaccttatgactgtaattataataaaaatctgcatacacagtagaacaggaaaagaatatgcatagaacaaagtttgtattttacatgagggattagagattttttgtttattttgtgtattcagcattatatatcttcgtgaagtagtttgtgtgtctaaaaaataatttaaaaatactgttggcagggttaagcaaacagccagtcacgcagagtttcagaatttttctggatctactgcataatagttcagcataacaggacacattaggtagaagaacagaaagattacaggactagattcagagtgaaaaacaaagaaaacaagtcacttactaaagtgtgctccatcaacagggatgaagagtttgtgggcctgaagcttattcagttttggaggccctcttcaaaataaaaaattaaagagaattaggccccgggcctcaaaggggcccatgcaagtgagatgtcctgaggtttaagcttcctcagctgcaatggtaaatctactgttgggggcagttcaacttactgcctggagggattttttgctatatgtagtctcttaagttgcattctcctgtcactgtttctccaaaagaagtaagtgaaagaatttttgttttgcctcaaactaccttttatttgcaactacatgatttcatgcaattcttctaaacaacgacataaaatagatttccttgtttataaataacttaaatatgccccatatagtacatgctgaaagttgctagaacagttcatccactcctatagtattctggtatccaacagagttgatgcacatatataaatgccaagtccaatattaaaaactcaggcaactgactaactttaataaagtttcccaaactatgtcaatatacctaaaaatgcgtatatgtacaaaagaaagattattctcaataacttctataaaaataaattcaattgtttgttccatctaacttcactactattagtatgaatttttagtgtatggtaagatttattttacctttttctcaacatgacaccaacacagtcaaaaggagctagtgaggtgctaacatgcgagaattaacccagtgattctggtcacaatgcatttcaggtagaggtacctatgtcactgggattgggtgatatggtttattttcattccctgatttagataaccaaatggatcagatagagattctgatgggcattccttcaaaagaattttttaagaagcagaaataaaggagaaggccactgcctagctttactagagagaatgccacatcttagctgtgggtctcataatctgcagggttagcgcacagacctcagatgttgctgtttacaattcattctcggattggcaggtgtttgttgttccttgaagctagaggcactgggctcactaatcgttctgagaaaagaagctaatccaagatcttaccaattcagcatacttcttgaataaaaaatcaaacttttcttccggtgtttgcaacttgttcagattttgcattagcaggttggcttctttgccttaaaaaaaaaagacatgaaaaaaataagtgttgaatttacagtcaggtgataagggctggagtctcagattgaccacttgctaattattcccaaccttggctaagccattcatcttatcagatgtaattttctttcctatagaaatgatgacacctaccttacagagtgaacattagttgggaagtttgtgaatgtgtggtacggtgtgaggttcatggcagactctcaataaatgtttgctataacagaagtctcccagttttcatcacaagaatccgttcttatttctcctccctgtattcttcagaatcaaaagattttatacatcaaaaatactttctgaaagaatacgtcacccgttttcccacttgaattaacaaaaaggaagcaaaacagccaatcaaaatttccgactagtatgaaacagcaacacggagttgctgggattccagccagaagcagagaagcttgatgaagtagcctgcccgttttttcccctgtgttttttgttcttttggtacttcttttccctcttttagggggaaccaagtttctcttttttgtacataaacccattccctggcgttggagtgggaataactctgatcctgtttcctaccaaatagaataaaatcattatagaaggaaaaccaagtaaagacatggagagcctttccacaagcctttttctgtctctgtgataatggacacagccttctctggccttcctttcccccacctaggccttaatatccgttggcagtttcattttgtttccagttggagtttatgctacactaaaaaaaaattaaccctgttaaataatcatgaaagggtggggcatttttcccatccctacctatctatgaaaaccactctgtttaatcagaatagggtggtcaagccacacaacaaagcccacacttcctgacataaatctgcttaagaaaattgacaacctttcccccaagaacagacatttccccttggctagagtacttgctttcatcttggagaggcatatatgtcatgaaattaggattgccagatgaaatataggacatggggcatatttgtactaaaaaatgattcgttgtttacctgaaattctaatttttctggacatcctgtattttcctttgctaaacctggcaactttacatggaatcaaggaattttaggtctagaaggaatttcaaagagcatccagactaaccggttaattttatgcattttagtatttaaggcccagaaaagtccaaagttacatgattagtgctggcagagagaaggcttgaatccaaggctagcctacttgttctaagtcactccactctcatgtggaattctgatgctagagagacctagagaaatagaaggcaactttttttttaaatgacctcattcccaacagttagttttgtctatctttgcctagtgagtcagttcagattagcctaaaacaggggaaggtgggtgtgagtagggtccctcccagctctccaattatggcctgtggcatttgcagctgataatcactgacgcctcgcccctgccaggcatgtgctttgggttatccctctactgacagggatggatttgcattggtcaggccatcccttcacctttgtcttcagtccagggaaggtgcccacatgaagactacaatctcaagttagagtgtcatctattaaagtcaagagactactcttgatcattcttggcccaggatgcaacacagtgtttggcccatggcaagtgctcagtaaatgatgataataatagaataaaacaaagctggccaggcacggtggctcacgcctgtaatcccaacactttgggaggctaaggcgggcggatcacgaggtcaggagatcaagaccatcctggccaacatggtgaaaccccatctctactaaaatacaaaaacttagctaggcttggtggtacatgcctgtagtcccagctactcgggaggctgaggcaggggaatcacttgaacccaggaggcagagattgcagtgagctgagattgcaccactgcactccactgcaaaaaacaaacgaacaaataaaaaaatcaaagccaactagctcaaactcgtatcatgtgaatcaaataaacactgtcatgaaaacaattttttgtgaccaactagaggaaaaacaggtcttactctcacctgtgatgttttatgtatcctggaatacctctcagtgtgtgtaccgacatgtgaaaccattacctgtcttgtttgggagagatagaaatgagtgagtccaaaggttcttgctttcttcccacattaagtatcttctcccctttggttttattttctgtgactgtgagaagaggtttctttttggttttgtttgttttgttttttactcttcacactcactgaggtctctttctgctctactgtgttattttgtatagaaggttaacatccaggtgcatcaatatgccttcaaaaattattcttcccttcaacaaaaaatccaggaaacagaatttctatttgtaagtctcacaggaaaagcactaaaactggagattaattaaaaaaaatccaggaaactggagatgggcatgtgcagaattcataaatttacaacatcactgacctcagtttttaaacttccattggtgttgtgggactagggtgctatgtgaagtaatcatggaggaggggagtagacagagacttgctcatcatctacaaaaggctatcattacatctccatggaaatagggtcatttggtgacagtgtcaaacaaaagaggaaaaactgactttattcagggacgctttatcaggaaggaatcacctgccttctccctaatgtgttcttccaaagcaagcttcatttcttcctcatgaaagctaggaaggcatgtgggcatgtagccaccacactgcgaaatgctcagcgtggtaggaagtctacatgaaagtggaaccacctgtgtagcagacacagcgctgttgcataaggctgtggtcactggcacagttttattggaaggtggagaaattatttttacatcaaagaaacaaaaaaactggccgagcgtggtggctcatgcttgccgaggcgggcagatcacgaggtcaggagatcgagaccatcctggccaacgtggtgaaaccctgcctcttctaaaaatacaaaaattagctggtgtcgtggcacatgcctgtaatcccagctactctggaggctgaggcaggagaatcgcttgaaccagggaggcagaaattgcagtgagccgagactgtaccactgcactccggcctggcaacagagcaagactctctctctaaaaaaaaaaaaaaaaaaaaaaaagaaagaaagaaagaaacaaaaaacctgaaattaaaggcaactaagccagctgcagaaatgtggaccaggatttttctgaaacttttagcatagtaatgattgtttatactaagtttggtgacaacttatgcagatttaatgtgttcaaatcaccagaggtcgggagaaccagcctggccaatacatagtaaaaccgcgtctctactaaaaaatacaaaaattagctgggcgtggtggcgcacgcctgtagtcccagctacttgggaaactgagcaggagactcgcttgaacctgagaggcagaggttgcagtgagctgagattggccactccactccagcctgggggacagagcgagactccatctctcaaaaacaaaagtatgccttttctcttccaaaattttttttttagaactttggggttaaatttcattataaatacgtacttgtgtacctctctaaccaccttcctgatttccatgaattgtggcagaaacttaaagccagaaaagactgtgaatgtccctctttcaaatgttagacctagatttatatttcactgttagttttgtttttcttctaataggatatgatttctaaaaataagcatgagataaataattcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaacacagagcaattttattatgtttttccatgttccaaaacactagagtgattccaaccctgcactttggaacttgaagatacttaaaagttattatctgagttcttttaattttatcctagttgggtgaagtatgctacctgaatgtattatttaggccttcttgaaagcattgtagcaatgggttttagcatcatagcgatatctgtaggaaaatagccccttgcatggcaagagtgatgccatcgtaaagcaaacctgccatgatgaccaatgtttgactcctccataccaaggtgttctgcagcagatatctccaaccctcaggccacggactggtaccagtcattgtgggctgcataatgggaaatctgttttcatttctttcatttcagatgccaaggggaaagtgactttacccacgagagagattttacccacgagaggcctctatcagtttcgaaaataccacctagcctgtgttttcttgtcagattttgttccctttggcttacattttctatttcttatctttcagtggccttgtcatatttgtaggggaactttggcctctcactcagtaggagagtggatctggagttcttattaggtcaacagtgatgatgtgtatacactattaccaataacaaaaataaaaatattagaaaaaacagtaaaatattcatccatccactccctaccttggtcagaagagagtactaataattttcctcaaggtttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcagtggctcacgtctgcaatcccagcactttgggagggtgaggtaccagtccgtggcctgttaggaactgggctgcacggcaggagatgagtggcaggcgacagagcaaaacttcatctgtatttgcagctgctccccatcactcacattaccacctgagctccacctcctgtcaggtcaacggtggcattagattctcataggagcgtgaaccctattgtgaactgcacatgcaagggatgtaggttgcatgctccctgtgagaatctaatgcctgatgatctgtcactgtctcctgtcacccccagatgggaccgtctagttacaggaaaacaagctcaaggctcccactgattctacattacggtgagttgtataatcatttcattatatcttacaatgtaataataatagaaataaggtgcacaataaatgtaatgcacttgaatcatcccgaaactatccctccccagtccatggaaaaactgtcttccctggtgccaaaaaggttgacggctgttctgcagcaaggtctttaaacaatgcctgtgacatagacaatccctcagaaagatgcttatctaacgttcccagtggtcatgacttttggcaagaaagttggagatgtgaccagctgcacatgactttacctaaaagcttgctatgtaaaggacactttctggagagtgggtgtaggaattcactgtctcactgctgcccaagacagcactactgtttgtaagcccctattaaatatttctttctgagaaagtggatttgtcagcctctgtttttggccttcagctcccttggcctttgtgggtaggtttgtatatacctgctcactgcagaaaaatattctactccagtttgtgatatatttgggtttacagatagtctggttactggagtttgaacccagttctgactccaatgctcatgatctttcactctaccacatagtcttccagaaacaaatcatatgtggtctctgcccttgatagattctccatctagcatgagagatgggtatataaacaaatgattgctgcagaaaatttaatagaaaactaaggaaggtgatgctaactctacctgggcatgtcagggaaagtatcacataggagggagtattcgtagtgagtgtttccaccaggaaagacaagcagagggactttcctatgtacagtaacatgcttcactcatagttttaaaaattaacgttctcacccttttttcccagccatcgttggtgtcaccaatctcccatgctctcctaaaaaattttccttttcccgtttttgcacttctcctatataattaatttacatgtcttctgttttctctatacttacagctccttgaccaaaagaccatgatttatttatctttgtgcacctagcacagtgccttacaaagactaggcattaataaacactcattgggcacctgaagataggtacagatttctaggtaaagaaactaggatgtgcacaggccttgtgggcgatggagcatagcatgttcaaaggcctgaaagacaagatcagaatgactagctattaggcagtagtggtggtggtggtaatagaggcagagtgttcaggaaggtgatgttgtagggtagagtaatctgagataaaactgggactggttggagttagaccattaggatcttagagaacatgttaaagattttggtcttcatcctaagagcagtaggaggccacggaacaaagggtcaatgggtaacacactgaaaagttcacctgagctccattgaggggtaagggctggggacaaatacaacaagggaaaatatagaaggctactacagtcatccaaatattggatgtggcttttagtgaagtttggaagaagtgccccttttttaggaataccatacagaaaagtcacatatttgaacataactacttgcctaatccttttaggattttcttttccaatttttgctccttattgctgacgggctctttgacagtgggtggctctccagaagcaacgggttctcttccagcctcttcagttgtttcctcacagtccccatcctcgttgtcaggtgattctgcattctcaggctgctcactggccctggcagagccctctttccctgctgtgctggcagcagacccataagtgttaatgatgtcttccagctgtcgattcagctcttcagagatatcggggtgcacacttgcctctttctctggtggttggactggggttggagaatcctggccatcttccttctccaggccattgtgactgggtaatgatgaactgtcacctggaggtgttgactgtcgttccgctgagagctgttcagagtgattagcctccatcttgggagtagtatctagtggtaagcacagttaggctttatgtagctaacctacttgctacatatcaatgctacatttcaatggtaaggatatcccccaagtgaataccaactaattatagtctctaacgtagagaaaggcaatgtcctttcacaaaccattgatgttactaagggaggagaccacccctcatatcgtcttatgcccaatttctgcctccaaagaagaagtaaaaactaaaacgcagacatgaaatccacaggcagacagcctggtgccgcgccctgagcctggtagttaaaaattgacccctgacctaataggttatgttatctatagattacagacattgtatagaaaagcactgtgaaaatccctatcctgttttgtttcgatctaattaccggtgcatgcagcccccagtcacgtaccccctgcttgctcaatcaatcacaaccctctcacgtgcacgcacttagagttgtgagcccttaaaagggacaagaaatgctcactcagggagctcggctcttgagacaggagtcttgctgacgctcccggccgattaaactgcttccttctttaactgggtgtctgaagggttttgtctgcggcttgtcctgctgcattacaattattaaagtagggacagtggaaagttgtttttccaaatcaagtcacactgctggcatatttttggttttgatcttcagttttcagtagcattccttattattcacattaagaaagtaattcatgctatttttctttgtggccatatttgtcattttgcttacactagtcagtttgtgttaccattttcctgtataattctatgtagattaacaatcactgggggtacatgactgtatatatttaaaatgtttaaatataaagtggtattagttttctttcaaagttaaaatatttaatagaagagccattgaatttatttaaataactcataagaataacatctctaagctctatttgatccataaatcaatattttgcttagtgtgaatattttgatgtaaatgcattattacactggatagaggagacatttctcacttttctggcattttctttttcagataagcaacacgaatgctttttttgaggcttaaactggcatcatttttagattaagacagggaatgagggaaggtataaataaatagacaaagtagtatggaaacacgggccaggtgctgtggctcatgtctgtaatcccagcactttaggaagccgaggcgggtggatccttgaggccaggagaccagcctggccaacatggtgaaaccctgtctctactaaaaatacaaaaattagccaggtgtggtggcgggcaccggtagtcccagctacttgggaggctgaggtatgagaattgcttgaacttgggaggcggaggctgtagtgagccaagatcgtgccactgcactccagcctgggtgacagagcaagacttcgtctcaaaaactaaacaaaacaaaagcatgatgatacttataacaacaattccttaaatttctataatactcttttattccaatatataaaccaattttttaaaagagaaaaacagattacaactttctcttctaagtcaggaagctctagaaaaacttaatgatttttaagaagtagcaatgtttcataaacaaggaggagaccaactcgagaaataattcagcaataataagggcccttaggaaagggtgagagatggtactgagtcagagattccagggtttctgactattaccacttctagagttgcaatagatttggtttaggcctttaagttatggtgcattttatttgtaaataatatttaacagtgatgctgctaaatagcagcataaaaatgtggcaagatcctcataattcacaggttttgctgttgtggtaacatgaaagtgaaaacaaaagcatactgttctacaactgcacagcttccttttcctgttctcagggcagtagatgtcaattgaatgctcagacaccaacaagaacagaaaattcaacacacagatgttgccactgacttgtgatgctcaccaaacactcataacttagaggaagtactttttttctttcactggtttgaattcaccaacttgattatcaaataatgcagcagtttcattattttcatcactgggatttcttttcctgacctcacttgttgattgcactcatctatatataacttaggcctcccctgaacacggagaaagacacacggcacctgctgtccagccagaagttattttaagctattctaaaatgagtcatgccgtttagcacttcatccttgaaaatcaagagaatcgtttttcagtcaaattgaaaacagtaaacatttagtggcttaaatccatacatgggttttaaagtcggggagactatcttaggatgaaataaaatctcaagtaaaatgaacttcaaaataattaatttaagataagctgtccataggagttttacttcggttagtctaaatgcaagtggctgtttgtatttgatttattcttcatgagatgccacaatcattgattttttaaattcttaattccatggctattctttaaactcctgttccacatttactttaaaacagaacagtcattataaagcccaggacaattcaattcccaaaagtagcctcaagacaagttaacaagagggaaaaaaacaaagtcagagaactttgttacttttcaatcatccattttatattatgtggcaaagaaattatttctaacttttatcttatataaactttattgccttattttcccctccccagggagagaacttttcacttgtgttggctattccagatgactatcacagacacatccctccctaagcaacacattttatttataaatacaacaatgaaaagttctccaacagttcactggcaatctcaaagttgcaagtttcgaacaccacaaaccgcaccctataccttctcacagggcttgggggagtgtttgtcatacttaccagaaggcaagaagctaagcaagaagagagaggagaggaaggaggcaggaaaaagcaagtcagagctgcagcaacagcaggagagggcgggctggctgtgttcttacaagggagagagaaacccaatacacacacacacacatacacacgt

SEQ ID NO: 937 - DNA, 64172 bp, Homo sapiens
tgccatgttgatttctgatccttggtatatgacttgttattttctatctgaaagtgtttcagatcttctcttcacccctgatagtctgaagtccagtgcttccatgggtctctatgctttcatcaccctggacacctttttaatctagagacttgtatatttcagttctggatattttcttgtgcgtttttctttttaaaataataatttcttttcctttgttctctctttttgaactcctttcgtttgaggttagacttcctggattgatcctccaaacctgtttcctttttgtttctttctctttttttttctcttctctctagtttatttccctcgatttcaatctacgatgcttctactggatggtaactttcaactctcataattttaatttcccagagcttttctgtgtttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggtaagctgggcccagggggtaatgataaaccagggtcagctgagggtggctgtaaggaatatggaaggacagagctggagggggcgagcaggctaactacaaaagatctggagagaggccaggcacggtggctcacgcctgtaatcccagcactttgggaggctgaggtgggcagatcacgaggtcaggagatcgagaccatcctggccaacatggtgaaacctcgtctctactaaaaatacaaaaaattagccaggcgtggtggtgtgcacctgtagtcccagctacccaggaggctgaggcaggagaatcgcttgaacctgggaggcggagtttgcagtgagctgagatcatgccattgcactccagcctggatgacagagcgagactccgtctcaaaaaaaaaaaaacaaaaaaaaagaccttgagaggaagggggaaacccggtgggatggaaatgggttgaccttgactgctgaacaggaattaaggggcgggttctgggagcgggacagggctacaatgtgagaagggacggaggaggtgcagagctggaagacagatctaagcctaggagagaaggattgaggggtcaggccctcaggaaacggacaagacccagggtggacccagctgatgagagagacttaagtacgaggcagcaaagaaatgacggatgacaggccaagcgcggcggctcacccctgtaatcccagcactttgggaggccgaggcgggcggatcacctgaggtcaggtgttgagaccagcctgaccaacatggtgaaaccctgtctctactaaaaatataaaattagccaggcatggtggtgcatgcctgtaatcccagctacttgggaggctgaggcaggagagtcacttgaacccgggaggcggagactgcagtgagcggaaattgcaccattgcactccagcctgggcaacaagagcaaaactccatctcaaaagaaaaaaaaaaagaaatgatggatgtcttggtgtcctgcagtgtgtttgggagaatttgaacaagtagaacttcaacaacaacaaaaaacagagggctgagcacagtggctcccaccggtaatcccagcactttgggaggccaaagtgggaggattgcataaggccaggaggtcatgaccagcctgtgcaacatagaaagaccccatctctataaaaaataaaaataaattagctgggcgtggtggcatgctcctgtagtcccagctactggggaggttgaggtgggaggattgctggagcccagaggtttgaggctgcagtgagctgtgattgtatcactgcactctagcctgggtgccggaaaaaaaaaaaaagaaaagaaaaaaagaaaaaaagtcaagtcagacacattcactgcataaacactgatcatccttacgtgaccactcagaaagctcacagtcactgaatcttataattcttgataatgacacgagttgcatttttgctttcttcaaacgacccccaaggaaagagaagcctccggaccagaagctggttgttcgcagctctagggacaactgtgagttggaaaccaggagtgctaagatttctcctccctcctccgaacccacattctgccaccagaatgccagttcctgagttcctagcaggagcagccacctccagtcccctccgggcatcagccaggactacaaaatgtgtcctgccaggccaagtccagccctccaacctcagttcatgaccccggaccttgtcattctgtccactctcccagccccgaatttctcctaaaagattctctctttcaaatctctgctctgggccgggtgctgtggctcacacctgtcatcccaacacttagggaggccaaggtgggaggatggcttgaggccaggagtttgagagcagcctgggcaacatagtaagactccatctccacaaaaaacagacgagcaatttctgctctggaccccaaggctttgcaacagctttctttttcttttctttgagacggagtctccctctgtccctcaggctggagtgcagtggcgcgatcttggctcactgcaaagtccgcctcctgggttcaagcgattctcttgcctcagcctccccagtagctgggactacaggtgtgcgccaccacacccggctgatttcatggcagctttctctaagtgtagcaatcttgctacttccctctccctgtgtggctctgggccctgcccctgccctctctgaaacctcactgtgacccattcttcctagatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggaggtgaggggctatggtttccaggggaccatgagcagggaggtggctgggaggcgggagtggctagatggagagagaagggaggcagccagacctggatgcctgggctctgagaaggggatgggtgggggcagccctcagaggtggctgggcctcagtgtcttgggctctgcctcccccagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccgggtaaggccggggacaaattgtgggacctcgggggggagtctgggtgttggagagcctgagggtgggggtgtggcaaaaagggattgtgggggccaagccatctgaattcaggaagaaaactaggagccaggaggcctggctgaggggctcatggggttggggtccccttatcctcttgcagctgatgtttgagggaacacggggtagcactgcctacctggacatcgccctggatgccctctctatccgccggggctcctgtaatcgcggtgagtccctgtccctcctcccgcctgccctcggacccttttctctccgtccttgcacaacaagaagaggatccagggcgggcgcggtggctcatgcctgtaatcccagcactttgggaggccgaggcgggcggatcacgaggtcaagagatagagacctttctggttaacacggtgaagccccgtctctactaaaaatacaaaaaattagccgggcgcggtggcgggcgcctgtagtcccagctacttgggaggctgaggcaggagaatggcatgaacctgggaggtggagcttgcagtgagccgagatcgtgccactgcactccagccttggcgatggagtgagactccgtctcaaaaaaaaaaaaagaagaatgagaaaggagatgaggagctggctgtattgggtctgccaggtagagctattagggctttgactctggaagcagccgtgcctaaagagaggtctcggcccagcacagtggctcaggcctgtaatcccagcaccttgggaggccaaggtgggaggatggtgtgaggccaggagtttgagatcagcctgggcaacataaggagacccccatctctacaaaagaatttatttatttatttatttatttatttgagacggaatttcactcttgtcacccaggctggagtgtagtggcacgatctcggctcactgcaacttctgcctcttgggttcaaatgattctcctgcctcagtctcccaagtagctgggattacaggtgcccaccaccatgcctggctaatttttgtatgtttagtagagccggggtttcattgtgttggcaaggctgttctagaactcctgacctcaggtgatccactcacctcagcctcccaaaatgctgggattacaggagttaagtcaccgtgccaagaactttttaaaaattagctcggcatggtggcgcacacctgtagtcctagctacttgagaggttgaggtgggaggaccgcttgagtccaggagttcgaggccgcagtgagctatgatcacaccactgtactctagcctgggtgacagagaccctgtctctaaaaaagaagaaaacattatatcttcccttctttctttcctctcagtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtgagtagcggccatgcttctgtcccttgactttctgggcaccaagcaccctacgataattgccctgggacggtctgtcatgaacacctacagcttcaagcctcttaccagctcaagtttcacgcaagaagctgatttcaagcacccagccagcctcccccaccaccgccctacaagctctacctggcagacccaatacagccagctcctcatctcctttctgtggctcttcttcttcttctttctcttcctcttcttcttctccctctccctctccctctccctctccctctccctctccctctccctctccctctccctctccctctccctctccctctccctctccctctccctctccctctccctctccctctccttctccttctccttcttctttttctttttttttttttgaagcagagtctcgttctgtcacccagtctggagtgcagtggcgtgatctctgctcactgcaacctctgcctcctgggtttaagcaattctcctgcctcaacctcccaagtagctgagactgcaggcgtgcaccaccatgcccggctaatttttgtatttttggtacagacagggtttcaccatgttggccaggctggtctcgaactccggacctcaagtggtccacctgcctcagcctcccaaatgctgggattacagcgtgagccattgcttctggcccctttcattcttcattcattcaagaaatactgagcacctacaatatgccaggtgctgtcctaggcacttaaaatacaccagtgcagaaaacagacaaggaagagtagggtgtggtagcgggggggcagttaccgacacaaagtaaatatagttataaagtgagcgatgctactgggaaaataaaaagtcaaacaagtttggagccaagtgcactggctcacgcctgtaatcccagcgctttgggaagctgagacgggaggatcacctcaagtgatctgcccactttggcctcccaaagtgctgggattacaggcgtgagccactgtgccccgccgtgagttatcaattatttatttatttattttggagacagagtctcgccctgtctcccaggctggagtgcagtggctctatctcggctcactgcaagctccgctgcccaggttcaattgattctcctacctcagcctcctaagtaactgggactacaggtgtacaccaccacgcccagctaatttttgtgtttttagtagagacggggtttcaccacgttggccaggctggtcttgaactgctgacctcaggtgatccggccacctcggcctcccaaagtgctgggattataggcgttgagccactgtgcctgggcgagttaccgattttaaataggctggtcagagtaggtcacattcaggacacatttgagcacgaacttgaaaaaggtgaggtagtagcagaggacattccaggctgaggggccagctgtgcaaaggtcctgaggtagcagtggggctgtcggggaaggaggggatcaaggcacagcaaagagccatgtggccagcatgaagagggtgacctgagatccacaggagcggcagatcacatagagccttgaaggccattgtcaggactgtggctttcctattctgtgtgaatggggagcctttgcaggattttgagcagtgacttgatctgacttatttatttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgaccccccccacctccctcccggatggggcggctggccggtcggggggctgaccccccacctccctcccggacggggcggctggccaggcagaggggctcctcacttcccagtaggggcggccgggcagaggcgcccctcacctcccggacggggcggctggccgggcaggggggctgacccccccacctccctcccggacggggcggctggccgggcggggggctgacccccccacctccctcgcggacggggcagctggccgggcagaggggctcctcacttcccagtaggggcggccgggcagaggcgcccctcacctcccggacggggcggctggccgggcaggggggctgaccccccccacctccctcccggacggggcggctggccgggcaggggggctgaccccccccacctccctcccggacggggcggctggccgggcggggggctgacccccccacctccctcgcggacggggcggctggccgggcagaggggctcctcacttcccagtaggggtggccgggcagaggcgcccctcacctcccggatggggcggctggccgggcaggggggctgaccccccccacctccctcccggacggggcggctggccgggcggggggccgacacccccacctccctcccggacggggcggctggccgggcggggggccgacccccccacctccctcccggacggggcggctggccgggcagaggggctcctctcttcccagtaggggcggccgggcagaggcgcccctcacctcccagacggggcggctggccgggcggagggctgacccccccacctccctcccggacggggcggctggccgggcagaggggctcctcacttcccagtaggggcggccgggcagaggcgcccctcacctcccggaccgggcggctggccgggcggggggctgacccccccacctccctcccggatggcacggctggccgggcggggggctgaccccccacctccctcccggatggggcggctggccgggcggggggctgaccccccctcacctccctcccggacggggtggctgccgggcggagatgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaagcgctcctcacatcccagatggggcggtggggcagaggtgctccccacatctcagacgatgggcggccgggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggttggcggatcactcgcggttaggggctggagacccgcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagacggagacggagacgagggagagggagggggagggggacggggacgatctgacttattttttaaggattttttttgtgttgagaatccactgaggagaacaggcaagggtcgatgcagagaggctgtttaggaggcttttgcaaaaatccaggcgacactctttctttttctttctttttttttttttgagacagaatcttgctgttgccaggctggagtgcaatggcacgatctcagctcactgcaacctctgccttccgggttcaagcgattctcctgcctcagcctcccgagtagctgggattacaggtgtgcgtcaccatgcccagttaattttttgtatttttagtagagatggggtttcaccatgttggtcagggtggtctcgatcttctgacctcgtgatccacccacttggcctcccaaaatgctgggattacaagcgtaagccaccatgcctggctgatattctttctttctatgcacccaagtctatccctagcttctttccaccacctccctgtgcactcagctgagcttctttctctttctactgttgacttcttccttttctctctcacacaacattcactttctctcttaatcttctcacacagcccacatttcaacccctcactgagccaagcactgtaggtcaagcatagagggttctgctccctaatttcctgagtttataattcttatttttgaatttaaaaaaatgtttttaaaaactaggccaggtgcagtagctcatgcctgtaatcccagcactttgggaggccgaggtgggcagatcacttgaggccacgagttcaagaccagcctggaacatatagtgagatcttgtctctacaaaaaatacaaaaattagcccagtgtggtggcacacacctgtagtcccagatactcgggaggctgacgtgggaggactgattgagcctgggaggtggaggtggcagtgagctgtgatcgcactactgcactccagcctgggcgacagagtgagattgtgtctcaaaataaataaataaataaaaatagagatggggtcttgctacattgcccaggctggtctcaaactctgggcctcaagccatcttcctgcttcggcctcccaaagtgcttgaagtacaggtgtgagctgccacgcccagcctatatctctttgttcttcttttcccttaatacttatcctttctcaatccatttcctcccttccactttaccatttccacactttattttattttctttatttgtaaagatggggtcttgctatgttgcccaggctggtctcggactcctggcctcaagtgatcctcctgcctctgccgtattttcttttctgtttttccccatcttttcctctctccactccatcagtgtccacttggactcctgcactcctgtctctgatctttcctgctgcctaaactttgttttctagaagggccctggccaggcgtggtggctcatgcctgtaatcccagcactttgggaggcggaggcaggtggatcaccagaggtcaggagtccgagaccagcctggccaacatagcgaaacccgtctctactaaaaatacaaaaaattagctgggcttggtggtgtgcacctgtaatcccaacactcgggaggctgaggcaggagaattgtttgaacctgggaggcggaggttgcagtgagccgagatagcgccactgcactccagcctgggcaacagagtgagactccatctcaataaaaataaataaataaatacgtacataaataaataaggccttaagaagccctggccccaccttcactgaaagccgaccagccctctctgcaacccctcagcatttagcaccgtgtaccgcgcccagcagcttcagtaaatgctggttggctttttatttttcctttctttccctttccttttccatcttgctcgcttccttatattttcttcacctttcacttctttttctcccatttctcctcttctgtttctcataggtctccttggttttttttttgttgttgttgtttgtttgttttttgagacagtctcgctctgtcgcccaggctggagtgcggtgacgcgatctcagctcactgcaacctccgcctcccgggtttaagcgattctcctgcctcagcctcccgagtagctgggattacagatgcccgccaccacgcccggctaatttttgtacttttagtagagacgggatttcgccatgttggccaagctggtctagaacccctgacctcaggtgatccgcccgcctcggtctcccaaagtgctgggattacaggcgtgagccaccgcgccagcccgtgtccttgatttctctttcatcattttcccacttcctttcctttcccttccctcttccttcccggttgtttcctttcttctccttcctcccgcccattcccgccattccagcctcttcgccgccgctcaggatcccaccttcggcaggagtgagcgcgcgccaggcaagactcccttggactcgggcgtgagcacgcacgcgagcgcgctccccacgagtggcagccgcttacattttctttttcgctaccagttgcgtcacctagcgaggtccacgctgattggctgtctgagctgggggccgaggtggtgttgggtgagagggggtttgcctcttgctcctctgtgtcagagccgctgtatctctcgccagtttgcgtgaataggttatgtccagcgggtaaagaaaaggaagaggcaatcgggtgtagtggctcaagcctgtaatcccagcactttgggaggccaaggcgggaggattgcttgaggccaggagttcaagaccagcctgggcaacatcgtgagaccgcccatctcttaaaaaaaaaaaaattagctgggcggactccaggtccgcacctggagtcccagctactcaggaggctgtggcaaaaggattgcttgagcctaggagtttgagacctgtgccactgcactttagcctgggcaacagaaccataccttgtctcaaaaaagaaaaaggaaaaaagaaaaggaacaggctatgactctagtggaccttaagagttagcacccaggccagatgtgatggctcatgtctgtaatcccagcactttgggaagccaaggtgcgtggatcatttgaacctaggagttcaagaccagcctgggcaatgtggtgaaaccctatcttttcaaaaaaaaatgcaaaaattagcagggcgtggtggcgcacacctgtagtcccagctacttaaggaggctgaggcgggaggatcacctgagcccggggaggttgagtctgcagtgaaccatgagagccatgattgcgccactgcactccagactgggcgacagagtgagactgtctcaaaaacaaaaacaaaacaacaacaacaaagagttagcacccaaaggtcaaagttctagttgctgctttggagaaggtgtccgccgcttcccatggcagcgccgggtccttacccagcccaagcatttctaggaaaagttgaagacctcagtcagttgggataggaccacctcagtgctgcctgattctaggctgctgttggggatccccagagacaagtccacagcctcctcagggccctatctctgctgccatcttccctcaattccatccaccccagttccctggccttttgcttcacaggtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttgggttagagcggagaattaatgggatttacactgatctgggcgcatctcccagggttggcttgatggggaaacatggggcatccctcagggtctagggaggtctggaatatgtgcgagactattccatgaagtggaaatcatggctgggagggcactttgggaggccgaggcaggcggatcacgaggtcaggagatcgagaccatcctggctaacatggtgaaaccccgtccatactaaaaatacaaaaattagctgcctgtagtcccagctacacgggaggctgaggcaggagaatcgcttgaacccgggaggcggaggttgcagtgagccgagatcgcgccactgcactccggcctggtgacagagcaagactccctctcaaataaaaaagaaagttgtgctggcctggcacagtggcttatgcttgtaatcctagcacgttgggagggtgaggctggtggatcacctgaggtcaggagttcgagaccagcctggccaacatagagaaaccttgtctctactaaaaatacaaaaattagccaggtgtggtggcacacgcctgtaatctcagctactcaagaggctgaggcaggagaatcgcttgaacctgggagacagaagttgcagtgagccaagatagtgccactgcactccagcctgggcaacagagcaatactccatctcaaaaaaaaataatgaataaataaaataaaaaagaagattgtgctttcatttggtggtaatcgtccccagctatgccctctgctcctcatcctcctaggtatagttcaaagtcgtttcccagtccccttaagctcacttctccttccaattcctttcactgcagggagtatccggaaacacactctcttctcaggacaacctgggcccaactggcaggctgtttctgtcaattacacagccgtgggacggatacaggtacagagaagcaaggggtcaggtccttgcacatggtaggcacacccaatgttgaaataaattgaggggcctggtgctgtggctcatgcctgtattcccaatactttgggaggctgaggagggaggatcgcttcaggacaggagttcaagaccagcctgggcaacatagaaagaccccatctctacaaaaaaatacaaaaattaggcgggcacagtgatgtgtgcctgtagtcccagctactagggagcctgaggtgggaggatcacttgagccctggaggtcaaggctgcagtgagctatgatcacaccactgtactccagcctgggcaatagagcaagactctgaaaaaaaaaaaaaaagaaagaaagaactgaattgagggtctgggcacagggagtagggattctgggtcctggaatggagtcgagttagatcaggggcttgggggtgtgggctgtgtgctcactcctgctccatctccctttctctccagtttgccgtggtaggcgtttttggaaagaccccagagccagctgtggcagttgatgcaaccagcattgctccttgtgggggtgagagcaggccctgagaggcccggatctctcagaatccggggtgggctgggggagggctggagagcgtcactcaacttgctcaaatatcctattttgatcccccagagggttttcctcagtgtgactttgaagacaacgcccatcccttctgtgactgggtccagacttccggggatggtggacactgggccctcggacataaaaatggacccgtccatggcatgggccctgcgggaggtttccctaatgcaggtgaggagattgaggagcgctcacgccaagaaatcactcagtctgctcccaggtagcaggctggctgctgtgactgatgggagacgttgtttcaggcagtgggaagatcagtccacaggtgttttttcggaagtttccatggtactggaattgtggagatagcagagtaacttaaagattctcagggctggggggtcactgaaatcctgagaaaacccaggcatctcacttcatggagcccaaagcttcaaaacccaccacctcattttcagtctagacgtttatgagtggctcatgcctgcaattccagcactttgagaggccgagacgggaagattgcttgagcccaggagtctgagctcagcctgggcaacatagtgagaaccccatctctagaaaaaaaaatttttttttaattagctagatgtggtggtgtgtgcttgtggtcccacctacttgcgaggctgatgtgggaggatcgcttcagctcagaagtcaaggctgcagtgagctatgattgaaccagtgcactccagcctgggcaacagagcaagaccttgtctctaaaaattaaaaataaaaaaataggccaggcatggtggctcacgcctttaattccagcactttgggaggccgaggcaggtggatcacttgaggtcaggagttcgagaccagctgggcaacatagtgaaaccctgactccactaaaaaaaatgtaaaaattagccgggagtggtggcgtgcacctgtagtcccagctactcaggaggctgaggcaggagaactgcctgaccccaggaggtggagactgcagtgagctgagatcgcaccactgcactccatccggggcaacagagtaagattctgtcttaaaaatatataaaaagaggctgggcgcagtggctcacacctgtaatcccagcactttgggaggccaaggagggcggatcacaaggtcaggagatcgagaccatcctggctaacacggtgaaaccccgtccctactaaaaacacaaaaaattagccaggcatggtggtgggcgcctgtagtcccagctactcgggaggctgaggcaggagaatggcgtgagcccgggaggcagagcttgcagtgagccgagatcacgccattgtactccagcctgggtgacagagtgagactccgtctcaaaaaaaaaaaaatatatatatatatatatatatatacacacacacacatatatatacacacatatatatatacacacacacacatatatatatataaagaaataattttttaaaaagacaataatgagggtggggtgcagtggctcacacctgtaatcccaatgctttgggaggctgagacgggtggatcacttgaggccgaaagttcaagactagcctggccaacatggtgaaaccccacctctactaaaaacacaaaaattagccagacatggtggtacacacctgtaatcccagctacttgggaggctgaggcaggacaatcgcttgaacctgggaggtggaggttgtagtgagctgagatcgtgtcactgcactccagcctgggcaacagagcgagactccatctcaaaaaaacaacacacacacacacacacacacacacacacacacacacacgacattaatgaatgtaatctaggttgctggtttgttattccctttttttcttttttgagatggagtcttgctctgttgccaggctggagtgcagtgacgtgatcttggctcactgcaacctccacctccggagttcaagcaattctcctgcctcagactcccgagtagctgggactccaggcacgggccaccacgcccagctaatttttgtatttttagtggagacggggtttcaccatgttggccaggatggccttgatctcttgacctcgtgatccgccagcctcggcctcccaaagtgctgggattacaggcatgagccaccgtgcctggccgcttttccctttctttgtgatcccaccttctttagttagatgtctaaaatgagcagaaaaaataatgctacgacctgggaaatttgagtgtttgctcagattcccgttcagaaagcaaagctttgctaaagcagcagttggcatgtcctgtgcaggcttcttaccttgcctgttcccttcctttgcctagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcaggtgagagacggaggcgggggtcctgtctgtgtgaggtgagagggccaatgcctgggatctgggggcgccaccagtgctgaagaggtggaaagctggaaagagagccgagaaaaggggaacttcgtgttacagaaagtgagaaaggggccgggatggggctggactgttgaggctggaacaaggcgacattttggcagagaacagattctatgcccagtggaatcacagagttgctggagattcatttttgtttctctctccgtctctctcccttgtcgcctttagcttattttcaagggcatccagggaagcaacacggcctctgtggttgctatgggtttcatcttgatcaatcctgggacttgtccaggtaagaccaaagcccaggctccaggaagggggcggtgccctgaggttccctggagttctctctatgaactgcttaaaatgtgagtcctccctggagcccgaattctcacccagctggctttgttttccatcttcaacacacctctccttcccctgcacttcaagatgtttgcctgggtgaatgtggcttcgataccatggattttgggggctggatccagaactccttcctctgcagtcttgaaggctggacccatatcctattcatttctggcataatatctgacatatattagtgttcgttgagtggatgaaggttggggtttgggagtagaaagagaggtgtgaataagccacccatgggagcccactccagttagatggcagtaaagagggtggtggtatggttttgactaaactccagggattcttatttttctttgcagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacaggtatgaggtggatggagcgtgggccaaggctgaaagtcagagacaatgactaggagacagtcagggaaagggatgcttctggtagaagccttctagttgcttctagatgcttctagtactctcagaggagagctgaagtagtccatggcgacttcagaggaaatggggaggactgcccagagcgagagggatggcagggctggagtgggtgggggtgtcaggactgaaccacgaggcttccttctcgttgtttgttattgagatataatccatatttcataaaattcacccttttaaagtgtacaattctaggccgggcacggtagctcaaacctgtaatcccagcactttggggggccaaggcgagagggttgcttgagctcaggagtttgagaccagcctaggcaacatagtgagaccctgtctccactttaaaattaaaaaaaaaaaaaaattagctgggtgtggtggcgcacgcctgtagtcccagctactcgggaggctgaggtgggaggatcacttgagcctaggaggctgaggctgtagtgagccatgattgtgtcactgcacttcagcttgggcaacagagcaagacatcgtcctaaaaaaaaaaaaaaaaaaaaaaagcaaaagcaattctgtgggttttagtatattcctaaggttgtgcaaccatcatcactttctaatccaaacactttcatcactccaaaaagaaatcctatacctattagcagccactccccactccgccttcccccagcccctggcaaccacacatttctttcctatatccatggatttgccagttctggacagttcatacaaatggaatcatgcaacatgtgagcctttgtgtttggcttctttcactgagtgtaatgttttccgggccatccatactgtagcatgcatcaggacttcattcctttaaaaaaagtatttctggccaggcacggtggctcacgcctgtaatcccaacactttgggaggctgaggcgggcagatcacaaggtcaggagatcgagaccatcctggctaacacagtgaaaccccgtctctactgaaaatacaaaaaaattagctgagcgtggtggtgggtgcctgtagtcccagctactccggaggctgaggcaggagaatggcgtgaacccgggaggcagagcttgcagtgagccgagatcatgccaccgcactccagcctgggtgataaagtgagactccgtctcaaaaaattaaaaataaaaataaataaataaataaatggagtatttcttattttttatatttttgagacagggtctcgctctgtcacccaggctggagtgcagaggtgtgatctcggctcactgcaacctctgcctctggggctcaagcaactatcctgcctcagcctcctgagtagctggggccacaggcctgcaccaccacgactggctaatttttgtatttttagtagaaacggggtttcaccatgttggccaggatggtcttgacctcccaaagtcttgggattacaggggtgtaatcctgtaattacgcctcagcctcggcctcccaaagtcttgggattacaggggtgagccactgtgcccggctctagggtttcgccctgttagccaggctgttcttgaactcctggcctcaagtgatctgtccgcctcggtttaccaaagtgctgggattacaggcgtgagccaccgtgcctagcctaaaattgttttatttttaaatttgttttgtagggatggggtctcactacgttgcacagcctggtctcaaactcttggcctcaaacagtcctcctgcctcagcctcccaaagtgctgggattataggtgtgagccaccgcacccagccttcaggcctttttatggctaaataatatggtcctgtttcctagagaagaacttgagtttgggggtagaggagagacagggagactccctgagaaagccatggaatgaaagcatgacagaggctgttttccccttagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgaggtaagccccccgggatgctggggtcccatgagggagattgatggcagaacacctgggttccagctccatctgctccccatgtgaaggcaacagggatcaccggatagtcccaaggggtcagctcagaagcaatggttacatgatggcgaagttattcattcaatcttttctttttttttgagacagggtctcgctttgtcgctcaggctggagagtagtggcatcatagtggctcactgcagcctccacttcccgggctccagtgatcctcccacctcagcctcccaagtagctgggactgcaggcacatgccaccatgcccagctaatttttgtatttttggtagagacagggtttcaccacgttgcccaggctggtcttgaaatcctgagttcaagcaatcctcctgcctcagcctcccaaagtgctgggattataggcataagtcaccgtgtctggctgggcacatttctttttttattttattttattttttttgaggcagagtctagctctgtcacccaggctggagtgcagtggcacgatcttagctcactacaacctccacctcccgggttcaagcaattctctgcctcagccccgcaagtagctgggataacaggctcacgccaccaccctggctaatttttgtatttttagtagagatagggtttcaccatatattctttacgtctttaaatcttttatccatatttataaagtgtacacagtaagattttctacctcatataagattattgtaaagatgaaattaagtcctaacacatacaattacttaataagtgttaattattatcattagcaatttatgataaatatatgcaacctattaattaaaagtgcattaaagggcccagcgtggtgactcacagctgtaatcccaacactttagcaggccgaagtggagggattggttgagcccaggagtctgacgctgcagtgagctatgattgtgccactgcactccagcctgggcgacagagtgacaccctgtctcaaaaaaaaaaaaagaaaagtgcattaagctattcattaatgtgcagagcctcttcccagctgcaggtgttcttcccattgacatcagagcttctgcttgtcccttttgggactattatttctttcccctgcctcctttaaccagtctcctgggtctctctgagttgctgctgagattagcttcagccacagcctgggcagaaagatctgtcacaaccattggcaccaagaagctcttccctctgccctaggaggcatgtattcacttttgtttttttttttttgacaaactattcactcacagttctctattgatgcaaaaaccattctagccgtgtttgtttgtctgtttgtttttgagacagagtttcgctcttgttgcccacgctggagtgcaatggtgccatctccgctcactgcaacctccgcttcccaggttcaagcgattctcctgcctcagactccggagtacctgggattacgggcatgcgccaccacgcccagctaattttgtatttttggtagagatggggtttcttcatgttagtaaggctggtcttgaactcccgacctcaggcgatccgcccgcctcagccttccaaagtgttgggattacaggcgtgagccaccgcgcctggctgtattcacttctaatagattcatttatgcattcaacaaatgtttatttagtactttcttcaaaggtgtgtttttttggtttgttttttggggttttttttttggtagagatggggtctggctctgttgcccaggctggtctatgaactcctgggctcaacccatcctcccacctcagcctcccaaagtgctgggattacagtggtgaaccaccacacccagcctacttagtactttctactctgctggcactggggtcgccacgaataggctgtggtccttgccctcataatgccctcagattcagagagacacatggggtcttggtttactccttcattcagcaagtatttactgaatgagagcactcatgggagggctaagatgttgggtaaagacagatattggctgggtgcagtggctcatgcctgtaatcctagcactttgggaggccaaggcgggcggatcacctgaggtcaggagttcgagaccagcctggccaacatggagaaaccaagtctctactaaaaatacaaaaattagccgggcgtcgtggcgggtgcctgtaatcccagctactctggaggctgaggcaggagaatcgcttgaacgctgaaggcggaggttgcagtgagccaagatcacgccacttcactccagcctgggtgacagagtgagactccgtctcaaaaaaaaaaaaaaaaacaaaaaaacagacagacataaggctgggtgcagtggctcacgcctgtaataccagcattttgggaggccaaggcaggagggtcacttgagctcaggaattcaacaccagcctaggcaacacagcaagactccatctctccaaaacgttaaaaaaaaaaaaaaaaaaaagtcgggcatggtggcatgtgcctgtagtcccagatacttgggaggttgaggcaggaggatggtttgagcccagggggtcaaggctgcagtgagccatgattgcgccactgcactccagcttgggcaacagagcaagactccatcacaaataaataaataaataaataaataaataaataaataaataaatgaaaaagaaaggcaaagggagaagtactctaggagctatatgactgtgtgacctcacatccctttctcccagcctggggcagagtggttcagccccaactgcacagaacattgccgctgctggcccggcagtcgggtcgagtgccagatctctcagtgtgggacacacaccgtgtgccagcttaagaatggccagtatggatgccacccctacggtgagagcccctccccatgctgtccctgcctgccagccagttggagtagacgtgacgccaggatcccaatccctcgcttgagcagaggattgggggcctgccaccgggcagcgggtgggccagcatgtgcggtccagcctggaggagccacagaagcagcttcgcctgttctccttccccctcccagcaggcactgccacctgcttggtctacggagaccctcattatgtcacctttgacgggaggcactttggcttcatgggcaagtgcacttacatcttggcccagccctgtggcaactcaacaggtaggccctggagatgccactgcggcctggggggagggtctgtgggcagcgctgctaggcatggggcatggtgggtggcaggaaggggcagggcacagatgggggaagaggcaagataggagcaagttcttctgtaaggtgagggttgaaggccaggcacagtgactcacactggtaacctcagcactttgggaggctgaggcaggaggatcacttgaatccaggagattgagaccagcctaggcaacacagcaggactctcatctccatgaaaaaaaaaattaaaaatcaggccgggctcagtggctcacgcctgtaaccccaacactttgggaagccgaggtggggggttcacctgaggtcaggagtttgagaccagcctggtcaacatggtgaaaccccgtctctactaaaaatataaaaaattagccaggcttggtggcaggcacctgtaatcccagctacttgggaggctgaggcaggagaattgcttgaacctgggaggcggaggttgcagtgagccaagatcgagccactgcactcctgcactctagcctaagcagcaagagcaaaactctgtctcagaaaaaaaaaaaaattaaaaaatcagctgggtatggtgggacacacctatagtcccagctagtcgggaggatgaggcaggaggatcgcttgagcccaagagttggaggctgcagtgagctatgatcacaccactgcactccagcctgggtagcaaagtgagatcttgtctcgaaaaataaataaatacacacataaatgaagttaaaaacaaaaaagcaaagaaggcagtggtagtggttagggagcacagacgccctggaggatgttccagccactgagtggagacagacacgctgcggctgcaggctcttctggaagaggcagtcgtggtctgctcctgtgtggatccggcctcccctactggactttggggctggtgtctcggtggcgctcatctctccctgcggcgccaggctcagggcactgctcgcggcagatgttcagaaatgagccactgggctctcttcattcctctccctacccagacccattcttcagggtgacagccaagaatgaggagcagggacaggaaggcgtgtcctgcctgagcaaagtctacgtgaccctgcccgagagcaccgtcaccctgcttaagggcagacgcactctggtgagccccattccacccccaccatccttgcagggtctgactgtgtgtcctggccaacccttccaatccctgaacctttccacggatggggttcaacaagacagtgacctgcaatcccagctccttgggaggctaaagtgggaggattgcttgaggccaggagtttgaagccagcctgggcaagatagcaagaccctgtctcttaaaaaatagaaaaaattagcctggtgtggtggcacttgcctgttgtcccctctactccagaggctgaggtgggaggattgctggagcctgggaggtcgaggctgcagtgagctgtgattgcaccattgcactccagcctaggcaacatagtaagacactgtctcctaaaaacaaaaacaaaaacaaaacagtggtgaggaagctccagtccactcctggtggatgagattgttaggccgctgtggatggtgtcctgcctcccagctatggaaatgaaagtctgctggggtcctccttgacccccagctctgtctgtctcttgcctctgccctgccttccaggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccaggtaaggcagtgtcccagccaggcagctgccacttcttcctgctgcctcttcctgctgcctcttcttcctgctgcccaccctgcccactccccttccatccctggcaccactacttgatcctttatgcattcacggatgggaagcaccctgcttaagtggcagggatccctttggaccaggagacaggagaaaatggtttcggggcatgtgatagatagcaggatggatgtacatgctttgggaatgtgctagaaggagcactagtgagttctggaggctttctgaagggcagtcacctggtcccattctcgaaggaagagtggctccccagatggacaaaacaagggaaagcaagattcttcttcttcttttttttgagacaggatctctcgctctgttccctaggctggagtgcagtggtgctatctcggctcactgcaacctctgcctcccaggttcagcaattctcctgcctcagcctcccaagtagctgggattacaggcgcacaccaccatgcccagctaatttttgtttttagtagagatgggatttcatcatgttgcccaggcttgtctcgaactcctgacttcaggcgatcctcctgcctcggcctcccaaagtcttggaattacaggggagccactgtgcccggcgaaagaaagactttataaaaatactttatagaggccaggtgcaggggttcccgcctgtagccctgaactttgggaggctgagacgggagaatcccttggggccaggaattccagaccagcctgggcaacatagtgagaccatatctccacaaaaaaatttaaatattagccaggcgtagtggcctgcacctataatctcagcatgctgggaggccgaagcaagaggatcacttgaggccaggagttccagaccagcctggacaacatagtgagatcctgtctcttaaaaaaaaattagcttctcgtggtggtacttgcctgtagtctcagctactcaggaggctgaggtgggagaatcgcttgaacccaggagttggaggctgcagtgagccgagattgcaccactgtgctccagcctgagccacagagggtgaccctatctctaaaataaataaaaaaataaataaataatttggccaggcacggtggctgacacctgtaatcccagcactctgggaggccaaggcaggcagattaggagtttgagaccagcctggccaacatggtgaaaccccatctctactaaaaatacaaaaaaattagctgggcgtggtggtgtgtgcctgtaatcccagctactcggaaggctgaggcaggagaatcactagaacccgggaggtggaggttgcagtgagccgaggttgcaccactgccctctagcctaggtgacggagagagactccatctgaaaaaaaggataaataaataaataaataaataaataaataaataaataaagtgggagtgttttagggccagcaaggggtttgctgtggctggacaatgaacagaggggaaggaggcttgggggagggccatggggtcctcttgtccagtccgcacctcttcatcctcctcacgccctctgttttaggatcccagctccttgccttctctgccactgcccctcgaggaccgaggctgcttctctccattaacgccagctcctctcctgttcccctagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgagcaaggagccctcccaccggggccctgggaaggttccgtccccttcctggaactctcttttttttttttttttttttttttgagatggagtctccttctgtcgcttaggctggagtgcagtggtgcgatctcagctcactgcaacctccgcctcccaggctcaagcaattatcctgcctcagtctcccgagtagctgggattacaggcacctgccaccacacacagctaattttagtatttttgtagagatggggtttcaccatgctggccaggctggtctcaaactcctggcctcaagtgatccacctgccttggcctctcaaagttctgggattacaggtgtgagccaccacaccaccacgtccagccctccacccgccctttttttttttttgagatgggatctccctctgtcttccaagctggagtgcaatggcacgatcgtggcttactgcagcctcaaactcctgagctcaagcaatcctcccttctctgcctcccaagtagcttggactacaccatgcccagctaactttaacaaaattttttggtagacatggggttctcaccagatggggggttgaccaggctgctggccctccccaacggtttttttttttttttttgagatggagtcttgctgtgtcacccaggctagagtgtagttgtgcaatctcagctcactgaaacctctgcctcctgggctcaagtgattctcacgcctcaatcccaatgagattataggcacatgccaccacacctgtctgatttttgtatttttagtagagacggggtttcatcatgttggccaggctggtttcgaactcctgacctcaggtgattcacctgccctggcctcccaaaatgcaaaatgccgggattacaggcatcaccaccacacccagcctgtgccctccctttaaaaaatgactggcattgcccctttctcctctctaccctggagacttcaagttgttctttcagttgctcaatattcttttttgtttgtttgtttgtttgtttttagagacagggccttgctctgtcgcccaggctggagtgcagtggttcaatcacagctcactgcaggctccaactcctgggctcaacagattctctcacctcagcctcctgagtagctggggctatggacgtgcgccatatgaaatatgaaataaataatttcatatttatttttaaagagatgggatctcagtgtgttacccaggctggcctggaactcctgggctcaagcaattctccctgcctcggcctcccacagtgcctggccagggctcagtggtcaaacatcctctgggaggggtttcccagctgacaggctggtttgccggtcccggcctgccagccttgctgcctgctgggttagggatgagctggaagcgagctttgtctttagggagtttggggtgggtctcttgcaggtgtcagaagtaccaggtggtgaattccccgtcttgtgattcatctctgcagagcagcatgtcggggccagggttctgtggacggctggtcgacactcatggcccatttgagtatgaaggagggcaggcagggtcgcacaggggcgatgcttggcacctgggctcctccaaggctctacccccttccactgcattccccctgacttggtcactcccctcaggacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgccgtgagttgtgccaaactcagaggagaggccgggcacggtggctcacacctataatcccagcactttgggagtccgaggcaggtggatcatgagatcaggagtttgggaccagcctggccaacaccccgtctctactaaacataccaaaattagccaggcatggtggcatatgcctgtagtcccagctacactggaggctgaggcaggagaatcgcttgaacccgggaggcagaggttgcagtgagccgagattgcgccactgcactccagcctgggcgacagagtgagactccatctcaaaaaataaaataaaataaataaataaataaataaaaatacagaaattagctgtgtgtggcaacgggtacctgtaatcccagctacttggaggctgaggcaggagaattgcttgaacctgggaggcggaggttgcagtgagccgagattgcaccactgcactccagcctgggtgacagaatgagactccatctcaaaaaataataaaaataataaataaataaatatacaaaaattagctgtgtgtggcaacgggcgcctgtaatcccagctacttgggaggctgaggcaggaaaatcgcttgaacccgggaggtggaggttgcagtaagcagagattgcgccactgcactacagcctgggcagtgagagcgaaactctgtctttaaaaaaaaaaaagtgtttctgtgcagcccaagtcatcacacgcaggcacacggtacaggccctaggcaggggaggcaacgaggctgcctcccagctcctggtgtggcccagctctttggggaagctgctttagggcaggcctatcccctgactcagacctcacaggtggccccggtcccctgcgggccaacagctcacctggggcatgtctacacagcagcgctgccagtggtgggtccatctgctcccaccataggtctatctaagtctctcagggccggcgccttagtgctggccctgcagccccagggagccagccaggctccttggggaagcttctcacagtcactctctcttctcgagattggccagaagcctggagctggggcccttccgaacgtgtccttcctgtttcccacccagccccgtggcttgttcgtctccttctcacccaagcttctccctccaccagcaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtgagcggctgcgtggacctctcagccctgcagctagaaagggcctgctccctgctctcacaccccctgcaagctctttcttttcttttcgtttcttgttttgttttgtttttgagacggagttttgctctgtcgccaggctggagtgcagtggcacgatctcggctcactgcaacttccgcctcctgggttcaagtgattctcctgcctcagcctcccgagtagctgggactacaggcatgcaccaccatgcccagctaattcttgtatttttagtagagacggggtagggggcggtttcaccatgttggccaggatggtcttgatctcttgaccttgtgatctgcccacctgggcctcccaaagtgctgggattacaggcatgagccaccatgcctggcccttgttttttggttttttgttgttgtttttggtttttgttttttttttgagacagagtctcgatctgttgtccgggctggagtgcagtggcacggtctcagctcactgcaacctccgcctcccaggttcaagcgattctcccgcctaagcctcccaagtagctgggattacaggcgtgcactaccacgccaggctaatttttgtatttttagtacagatggggtttctccatgttggccaggctggtctcaaactcctgacctcaagtgatccacccgccttggcctcccaaagtgctgggatcacaggcgtgagccgccacacctggcctcggatagatcaattttggttgaaatgatgaacagacccagaaatgatgtagtgactgaaaaaacgaatggatgccaagcttttgcagcgaatctcggagcttcaggaagagaggatgtctccccactattaagccagtgatctgaacagctctggtgagctctggtgtcagatctgggaaaaaacaaaacaaagcaaaaaaaaacactttctcttccttccctgctgtcttccccaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgagccatcagggtggaaggtgagctgggggctgcccaggcaacaccaggcaaggtgatgggtcctgcccaaagcagcttccccagacagctgagtctccaccagggcctgggaggggcagcaggggcagcattttcagggacccaaagggtgaggttggggacgtcagtgtttctcttaggcagctccaagccaagccaaccacacttcctagggaaacaccacatctgtgggtgggccgtggggaccatgccaatgtgggctctccaggatggcagctctgagtcaaagcttccggggcatggaggagtgagactgtgaactccatcttcttctccacaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatggtgggtgtcttcctcctgcctcctggaccctgaacacccagcctgcttgcttctctcctgtgcccctccttgcccggatgcccacctctctggctccttagagcacctgggaagcacctgcagctgacccagaccctcttctctggactccctcctccctctgtgaaatacccaccagcaccagcccctcctgctcccagttttttgccgttttttttttttttttttttttttttgagacagggtcttgctctatcacccaggctggagtgcagtggtgcgatcatagcttattgtggccttgaccccctgggctcaagtgatcctcccacctcggcctcctaagtagctgcaactataggcatgcaccacctgcacggctaattttttttttcactttttgtagagacgggctttctccatgttgcccaggctgatctcgagatcctgggctcaagcgatcctccgcctcggcctcccaaagtgctgggtttgcaggcatgagcccccgtccttgcctttatcccgagttctttcctgactctcctttctacgtcctccctgcctctgcagctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtggtgagtttcctgggcacctgcggggaaagctgggacaatgagtaggcgtgtgacctggtcccagctcccccaacatctctgtgaggtgttctaagtacttgtcaactgactaattcgttgaggacattaggcatgaaggtaggagttaagggaagacggagatgaagagacagaaaggggccaggcgcggtggctcatacctgtaaatgcaacactttgagagcccgaggagggtggatcacttgaggtcaagggttcgagaccagcctggccaacatggcaaaaacctgtctctactaaaaatacaaaaattagccaggcatggtggtgcatgcctttaatcccagctatttgggaggctgacgcgggagaatcgcttgaacctgggaggtggacgttgcagtgagctgagatcgcgccactgcactccagcctgggtgtcagagcaagactccatctcaaaaaagaagaaaaagagacagaaagggttaaccttgctatgtagaatgaaaagtgagggtgccaggaggatggtggccctggggcctggcctgctggggggccccttcttgcctgttttaatgactccctcctctagggaactacaacaacaacagcttggatgacaacctgcgccccgacagaaagcttgcaggcgattccatgcagctgggggccgcctggaagttacctgaatcctctgaacctgggtgagctgggggtcaggggagccaggcaggaggggctgggcctgggaagggcctcggggggcagcttggaagtgtcctctgtgtgtccccactccctctgtgctgtacctcccaactggcaggaaactggcaatctctcctgtttagactctccaagattggagttggtaagaagctgttctgacttcccacgcccacgcctgctgatttctcccatgcttagtgatctctttggagggcccacttgggaagttcaccctgaggtctagcctttttccttcctgctgcatctccttgccttgctacttgagggcaccgttttgtcctcttctcctgtatccctctctctttccctgtccactttttgttttgttttgttttgttgtttttgagacagagtcacgctctgtcacccaggctggagtgcagtggcacgatctcagctcgctgcaacttccgcctcccaggttcaagtgattatcctgcctcagcctcccaagtagctgggattacaggcactcgccaccacgcccggctaatttttgtatttttatttgagacagcgcttctccgtgttggccaggctagtctcaaactcctgacctcaggtgatctgcctgccttggcctcccaaagtgctgggattacaggtgtgagccactgcacacagccccctgtccacttttgcttcggtttgggagatggttcctcaggccctcaggtcttgtcttgtctttttttttcttttcttttctttcctttcctttccttctcttccctttcttccttcctttcttccttcttcctttcctttcctttcctttttttcttttcttttcttgagacagggtcttgctctgttgcccaggctggagtgcagtggtgcaatcatagctcactgaagcctccaactgctgggctcaagccatcctcccaccacagcctcctgagtagctgggactataggcacatgccaccacgcccggctaatttttaaaaattttgtgtagagataggatctcactatgttgcccaggctggtcttgaacttctggtctcaagcgatcctcctgccttggcttcccaaagtgctgggattataggcatgagccactgcacccaacctgtagccctcagtttctattctctctcatttagctgtttccttgtgggtggcaagccctccagctgccaggagaacagcatggcagacgcctggaacaagaactgtgcgatcttaataaaccctcagggtaagacatgtccctgctggccctttttcctccctgaaggacaggaggctggggagggagtctagtcagggagggagaaacaacaagaccagaaacagatggaaaagcatgaggaaggcaaatgggaacacagggccagccagcagtcaccttcttgggacctatgactgatgggtctgtatttgtgtctcaggcagtagataaatccgggatttctttttttttttcctattaaaaatgttttaataggctgggcgcagtggctcatgcctgtaatcccagtactttgggaggccgaggagggcagatcccgaggtcaggagttcgagaccagcctggctagcatggtgaaaccccgtctctactaaaaatacaaaaaattagctgggcctggtgacgggcacctgtagtcccagctacttgggaggctgaggcagaagaatcgctttaacctgggaggcagaggttgcagtgagccgagatttcgccactgcactccagcctgggcgacagagtgagactctgtctcaaaaaaaaaaaaaaaaaagtttaatagagatgggggagtctcactatgtagcccaggctgttctcgaactatggaccccaagggatcctcccccttggcctcccaagtagttgggatgacaggcataagccaccacgcctggccgttttttcttttttcttgttttttagagacaaggtctcactctgttgcccaggctggagtgcagtggcacgatcacagctcactgcaggcttgaactcctgggctcaagtaatcctcccgcctcagccttcagagtagctgggaccacaggcatgcaccaccatgcccaactaattttttttttctcactctgttgcccaggctggagtgcaatggtgtgatctcagctcactgcaacctctgcctcccaggcgcaagctattttcccacctcagcttcccaagtagctgggattacaggcctgtgccaccacacccggctagtttttgtatctttagtagagacaacatttcaccatgttggccaggctgatcttgaactcctgacctcaaatgatccacctgccttggcctcccaaagtgctggtattaaaggcatgagccatcatgcctggcctaatttttaaatattttctggagatgaggtcttgctatgcagcccaggctggtcttgaactcctgggctcaagtgattctcctgctttgccctcctaaagtgctgaggttataggcgggagccaccacacaaatctgggttttgtttgtttgttttgtttatattctctgttacccaggttggagtgcaatggcacaatcatagctcatcctcctgcctcagcctgctgagtagctgggactacaggtgtgcaccaccatggccggctaatttttgtacagacacagtttcactgtattgctcaggctggaaaatccaggaggttttttttttgttttttttttttgagacggagtcttgatctgttgcccaggctggagtgcaatggcacaatctcagctcactgccacctttgcctcctgggttcaagagattctcctgccccaacctcccgagttgcctggactacaggtgccctctactatgccctgctaatttttgtatttttagtagagattgggtttcaccatgatggtcaggctggtctcaaactcctgacctcaagtgatctgcccacctcggcctcccaaagtgctgggattacaggtgtgagccactgtgcctggcgggaaaatccaggttttgactgaagtggatgtcgaatcagccccagggaagccacatggccctgttccttcccggcccctcccctggctcatctgccttctctcttcctgcaggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccgtgagtgactggccacctgttcccacagcccataggcaccctccagaattctgccctccctttcttcctctaaattcttttttttttttttgagacggagtctcactctgttgcccaggctggagtgcagtggcgcaatctcggctcactgcaacctctacctcctgtgttcaagccaagatgggtgaatcacctgaggtcaggagttggagaccagcctggtcaacatggtgaaaccccgtctctattaaaaatacaaaacttggccaggtgtggtggcaagcacctgtaatcagctactcaagaggctgaggtgggagaatcgcttgaacctgggaggcagaggttgcagtgagccgagatcacaccactgcactccagcctgggcaacaagagtgaaacaaaaaacaagagtgaaaaacaaaacaaaacaaaaagttctggcagtagatggtggtaatggcagcacgacaatgtgactgtacttagtgctgttgaagtgtacatttaaaaaattgttgccgggcgcggtggctcatgcctgtaatcccagcactttgggaggccgaggcaggtggatcacgaggtcaggagatcgagaccatcctggctaacacggagaaaccccgtctctaccaaaaatacaaaaaattagccaggcgtggtggtgggcgcctgtagtcccagctactcgggaggctgaagcaggagaatggcgtgaatctgggaggtggagcttgcagtgacccaagatcatgccactgcactccagcctgggcgacagagcgagactgtctacaagaaaaaaaaaattgttaaaattgtagattttatgtctgttttttttttgtttgtttttttttttttttgcttttgagagtctcgctgtcgcccaggctggagtgcagtggtctgacctcgcctcattgcaacctctgcctctcaggttcaagagattctcgtgtctcagccacccaagtagctgggactacaggcgtgtgccaccccaagtagctgggactacaggcgtgtgccaccacgcctggctaatttttgtatttttagtagagtcggtttttcaccatgttggccagcctgttctcgaactcctgacctcaggtgatccacctgcctcggcctcccaaagtgctgggattacatgtgcgagctaccgctcctggccactactaggagcttttgatgccccaaggtttgggggctggacatgccaccccactcttcctaatgctctcattttctttagctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtgagaggccagctaggaggggccccgccctttccaggcccacatgtttggggtcagggcaagctcaggagaggcaggaggaaggctcagaacctgggaggggcagggctggccaaggctggggggcgaggaggaagggcagatgctgcacccagcttcaactggggcgttggcccatctcccaattccaactttctgttggctcagctgatccctgtggcccacaggtcggggagcgctggtacacagagaacacctgcaccaggctctgcacctgctccgtccacaacaacatcacctgcttccagagcacctgcaaacccaaccagatatgctgggccctggatgggctgctccgtttcgggcctcaggtaggaggaccacggtgatggggggactccacagccctgaggcccactctcccaactccccaacagactccctgctgcctgtagcactgggtttcaggttttgactggtaactctgctgcaaccaagagcttctggtgggtaagatgacctccaactgctgagaagggaaccttggggctcacccatccttctcctgtagcggccaccaacttagatgggatattataaatccttccctggggccagacgccatggctcacacttgtaatctcagcactttggaaggccaaggcgggtggatcacttgagaccagaagttcaagaccagcctgaccaacatggctaaaccccgtctctactaaaaatacaaaaattagcctataatcccagctactcgagaggctgaggcaggagaattgcttgaacccaggaggcagaggttgcagtgagcagagatcgtgccattgcactccagcctgggcgacaaaactccgtctctaaataaataaatcttttcctggaggccaggcatggtggctcatgcctgtaatcccagtggtttgggaagctgaagtgggagaatcacttgaggctagtagttcaagaccagcctgggcaacatagtgagaccccatctctacaaaaaaataaaagctaaaaagttaaaaagtaaaattaaagacattgcacctgtagtccctgctacttgggaggctgaggtaggaggatctcttgagcccaggaattagagtctgcatgccagcctgggtaacagaacaagaccctgtctctaaaaaaaattttttttaattagttgaatagggtactttatgcctgtagtcccagatactctggaggctgaggtaggaggaccacttgagcccaggagtttgaggctgcagtgagctatgaccatatgccattgcattccagcctgggtgacagagagagaccatgtctcaaataaaaaaaaaaaaaatccttcctccaaagaatcatgcccctcctccacccgtaaacctcaccacgcctcctagccctggccctggggttttttgtttgtttgtttgtttgtttgtttttgatgcagtgtctctgttgcctgggctggagtgcagtggtgcaatctcggctcactgcaacctccatctccctggttcaagcgattctcctgcctcagccttccaagtagctgagattacaggcacacgtcaccacaccctaatttttttgtattttttttagtagagacgggtttttaccatgttggtcaggctggtatcaaaccagcccaccttggcctcccaaagtgctgggattacaggcatgagccactgcgcacagccggacctggggtcttgactcttttctggaaggcagggagaacccaggactagtttcccagggaccctgtacctgccagaggagcgtcatagcccagctgtctctctgtcctcccaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctagtgagctgggtgtggtgaccggggctgggagggagtgctggggaggggactcttgtccctgctcctactcaccgtcactgtcctcctgtttagatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtgaggaaaacatctggctcttctcgctggggaggcagccccagggagattggtggccggcagggatggggggcagtgttcgcatcgtgcctgcccaaagaggccactcctcaggatggagcagggcagtggaggagtgcgcctttctgtgtagggtggacaagagtgtttccaggaaaaaacaggaaaaaccattctgcccgggcatggtggctcatgcctgtaatctcagcactctgggaggccgaggcaggtgggtcacctgaggtcaggaggtcgagaccagcctggccaacatggtgaaaccccgtctctattaaaaataaaaaaaaaaattagttgggggtggtggtgcccacctgtaatcccagctgctcgggaggctgaggcaggagggttgcttgaacctgggaggcggatagtgaagtgagctgagatcatgccactgcactccaggctgggtgacaagagtgaaacttgaaggaagggagggagggagggagggagggaggaaaactgctctcgtgagggaaggaaagaaggaaggaagggagaaaaactgttctcgtgcttccccagcaccgaaaaaccactctcccccgccaggtctgcggcatgtgtgggaacttcaatgatgaggaagaggacgaactaatgatgcccagcgatgaagtagcaaatagtgacagtgaatttgtgaacagttggaaagataaggacattgacccaaggtagtggtcccctaagaccctctaggttttctttctttttctttctttgtctttctttctttctgccttcccttcccttccctcccctcccctcccctccccttccttcctttcttcctttctctctttctctttcttttcttcctctcctttctttttttttttttttttttttttttgagacggagtcttgctctgtcgcccaggccggactgcggactgcagtggcgcaatctcggctcactgcaagctctgcttcccgggttcacgccattctcctgcctcagcctcccgagtagctgggactacaggcgcccgccaccgcgcccggctaattttttgtatttttagtagagacggggtttcaccttgttagccaggatggtctcgatcttctgacctcgtgatccacccgcctcggcctcccaaagtgctgggattacaggcgtgagccaccgcgcccggcccctctcctttctttcgttctttttttttctgagacagaatcttgctctgtcacccaggctggagtgcagtggtatgatctcggctcactgcaacctccgcctcccgggctcaagtgatactcctgcctcagcctcccaagtagctgggattacaggcacccgccaccacgcctggctactttttgtagtttttagcagagacggggtttcaccatattggccaggctggtctcgagctcctgacctcaggcaatgtggccgccttggcctcccgaagtgctgggtaatcatgagcgactgcacctggaccctctagcttttctttttttctttttctttttgagatggagttttgctctgtcacccaggctggagtgcagtggcgcaatcttggctcactgcaacctctgcttccggggttcaagcaattctcgtgcctcaacctcccgagtagctgggattacaggtgcacaccaccacgccccacgtctggctaatttgtgtattttaggtagagacggagtttcatcatgttggtcaggctggccttgaactcctgacctcaagtgatccgccccactcagcctcccaaagtgctaggattacaggcatgagccactgtgcctggccacccctccagcttttcatagcaacatgagctagggagccagactgtagggcacacctggggcaggaagaccagaatgttccttttttcttcttcaatttttaaattttttgtagagacagggtcttgccacttttgcccaggctggtctcaaactcctgggctcaaatgatcctcccgcctcggccccccaaagtgctgggattacaggccagaatgttgctttgtgtgtgtgatttgagggcgatgacttctgggcattctggggcgatgtgtgtaattgatccatctcaaggctgctagaacccacttgaggaaatgtgaaagcttcctttcctcgcttagaaaccttggaggaggagcaggagcagaggctcatgcctgtgattccagcactttgggaggccaagactggaggatcacttgaggccaggagtttgagaccagcctaggcagcatagcaagaccccatctttacaaaaaaattaaaaacaaaaattagccagccatggtggcacatgcctgtagtcccagctatttgggaggcttcagcaggaagattggttgagtccgagatttgaaggctacagtgagctatgattgcatcactgcactccagcctggatgacagagcaagatgctgtcttaaaaagtttaaaaacagccgggtgcagtggctcacgcctctaatcccaacacttcgtgaggccaatgtgggaggattgcttgagcctaggagtttgagaccagcctgggcaacatagcaagacctcatctctacagaaaaaaaaaaaaaagaaaagaaagaaaaataaccaggtgtggttagtcccagctactcacaaggctgaggtgggacgatcccttgggcctgggagattgaagttgcagtgagccttgatcacaccactgtactccagactgggcgacagattgggaagcaaaaaaggaaatctgagagaagacgaggccgatggaagattggccagagctcagaccagcttccctgtgaacaccagaagggttaggagggtggggaatccctgagaggtctctctgggtcatttgggagcaccagatcattgtcatagggccaggcgtggtggctcaggcctgatatctcagcacttcgcgaggccgaggcgggtggatcacttgaggccaggagttcaagaccagccttgccaacatggtgaaacctcgtctctattaaaaatacaaaaactagccggtcatggtggcgggtgcctgtaatcccagctactcaaaaggctaaggcaggagaatcgctttaacctgagacgtagaggttgcagtgagccaagatcacaccactgaactccagcctgggcgatacagtgggaccttgtctccagataaaccaaaaccaaaaattagctaggcatggtgccgggtggctgtaatcccggctactcgggaggctgaggcaggagaatcgcttgaacccgggaggcggaggtctcagtgagccaagattgcactactgcactccagcctgggtgacagagtgagactctgtctccaaaaaaaaaaaaaaaattggtcgggcgtggtggtgggtgcctgtagtctcagcaactcggaaggctgagtgagacaggagaatcgcttgaacatgggagggaaggcagaggttgcagtgagctgagactgttgcattgcactccagcctgggtgacagagcaagactccccctaaagaaaaaaaaattttgtgtcatagtagggggacggctgtccctaggctgattcttttcccttcccagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccgtgagtgtgccctgctgtcaccccaaacccctcccaaaccccctttccctctctgcttccctgagagctccctcactctccttcctgttcgttcctgactaactcagccctcattgtttctttgacaaggactattttttaatttttatataaaattttttttgctgggtgtggtggctcacgcctataatcccagcacttggggaggccaaggtgggtggatcacctgaggtcaggagttcgagaccagcctggccaacatggtgaaaccccatcctactaaaaatacaaaattagccgggtgtggtggcacatgcctgtaatcccagctactcgggaggctgaggcaggagaattgcttgaacctgggaggcggaggttgtagtgagccgagatcgcgccgttgcactccagcctgggcaaaaagagcaacactccatctcaaaaaaaaaaaaaagtgtcttttagtatcttgataaagttgtgcaaccatcactactatataacgccagaaacttttacaatttaaaacaggaattcaatagagttttttttaataggtaacacatttgcaggattcaaaaacgtataaagtattaaaaaatttaaaatacttttaaagtattaaaagatacccagtaggttgggtgtgatggctcatgcctataatctcagcaatttgggaggctgaggtgggtggattgcttgaaaccaggagttcgagaccagcctgggcaacatagtgagacccaatctctacaaaaaattaccaaactagctgggtatggtggtgcatgcctgtggtcccagctacttgtgggggtgaggtgggaggatcacttgagcccggcagtgaactgtgattgcatccctgcactcaagtctgggtgacagagtgagactctcagaaaaaaaaaaattctccccaaaaaacaaaaaaagataccagtgtaccgtctccctcccaccctcaccccatgggcctggttcatgtctcagtatttttcccaagaccacttatttatgcatatataaacaaattcaaatttatattcgtggctgggtgcagtgactgacacccgtaatccaagcactttgggagtccaagaagggaggattgcttgaggccaggagtttgagaccaacctgggcaatataatgagacccccgcatcgctacaaaaaaattaaaaaaacaaaagacaagaaaactatatgctctgtgcttttggagttttgccaatctgagaattgaaaaacaacgtcttattatttttttgccagtgtttcataagaaggtttattttatttatttttttattttatatatattttttgagacagaatctcgctctgtcaccaggctggagtgcagtggtgtgaccttggctcactgcaacttccaccttctgggttcaagagattctcctgcctcagcctcccaagtagctgggactgcaggcacgcaccaccacacccaggtaatttttgtatttttagtagagacagggtttcaccatgttggccaggttggtctcgatctcttgaccttgtgatctgcctgccttggcctcccaaagtgctgggattacagacgtgagacatctcaaccggccaagaaagtttatttttctttaaaacactctcgcgttccaggagcaaagcagaggtgcagggggtgctgcagagcttctcagggccagtggaggcaacatgagcacagcagcctgagctggctgaagggtcagggtgaaagcagcacacaggtcccgtgcagaagggggccgctgctcagctgccccacagctgctgggcatcactgtgggtccagtgtgaccagatcctctgatttttttttttgaaagaagctataagcctgagtttttatttgacattgctatacttttttttttttttttttgagtctcactttgtagctcaggctggagtctatgatctcggctcactgtgacctctgcctcccaggttccagtgaatctcctgcctcagcctccgagtagctgggattactggcatgtgccaccacacccagctaatttttgtatttttagtagagacggggtttcaccatattggccaggctggtcttgaactcctcacctcaggtgatccacctgcctcaagcctcccaaagtgctaggattacaggcatgagccactgcacctggtcatgaaaaataacaagacttaatttgagtttttattatgagtgagattggacattttttcatgtacttaggaaccctttgaatttccctttctgtaaactatctgctcttatccagtcaccatttttccattgagtcgttggtctttactgaactatttcatggaagtcctttatctgttatggaaagtagacctttattagtgctctgagttacacaaagttttccagtcctttttgttttcatcttttgactttttttttttttgccatgcaggacaaaaatttttatggggtcaaatatattaatcttgttttatgtcttctgcatcttgagcaatagctataaatgctagccccacagaagctacaaaagagtttgctgattctttgctctagaaattttgtttgtttgagacagagtctcactctgtggcccaggctgcagtggcacgatcccggatcactgcaacctctgcctcctgggttcaagcgattctcctgcctcagccttccgagtagctgggattacaggcacccaccaccatgcctggataatttttttgtatttttagtagagatggggtttcaccatgttggccaggctggtctcaaactcctggcctcaagtgatctgcccgcctcgtcctccccaagtgctggggttacaggcgtgagccaccgtgtccggcctgctctagaacttttatggtttcatttttttatatttaagtgggttttttttgtgtgtgtgtgtgtgtgtgtatttaagtttttgacccatgaagatttatcctgatgtgtaaaatgaggtatgaatcaactttgtttttgtttttctccagaaggctagccagctgttccaatattattaaatgactagtctgtctttgcgcagggactgagataccacaatttatcatatactaaattcccatatatatttggatccatatctgagctttctcctctgttctgtcggtccatctgtatttgcatgtagcagtaacacaaagtcgtaatcactgaaaatttaaaatgagctttgggctgggcgctgtggcttacgcctgtaatcccagcactttgggaggccgaggtgggcggatcacctgaggtcaggagtttgagaccagcctggccaacatggcaaaaccccatctctactaaaaatacaaaaaatagctgggcgtgctagtatgtgcctgtaatcccagctactcaggaggctgagaaaggagaattgcttgaacctgggaggtggaggttgcagtgagctgagattgtgccattgcactccagccagggcggaaagagcgaaactctatctcaaaaaaataaataaatgaataaataaaataaaacaaaataaacgacttatggagggccattcactactgatggctcttttttttagggagttcctggcttttctggtttgcttatgtcttcagctcaactttgaaatcatcttgtcctattaaaagcacacacatatataaaatacttttggtggctgggtgtggtggctcatgcctgtaatcctagcactttgggaggccaaggtgggaggatcacctgaggtcaggagtttgagaccagcctggccaacatggtgaaaccccatctctactaaaaatacaaaaattagccaggcatggtggcacatgcctgtaatcccagctacctgggaggctgaagtaggagaatctctggaaccagggaggcagaggctgcagtgagccaagatcattcctgggtgtcagagagagactccgtccctgcccgtcccccgcaaaaaaaaaaaaaaaaaaaaaaaaaaaaaaatatatatatatatatatatacacatatatatatatacacacatatatatatacatatatatatatgtatattttattgagatcacattaaatgtgtacattcactgaggcagaactaacatcaccatgttgctgaaccttcttatccatgaacatggtatgcatttccatttgttcacactatttttgcttaagggcctttctttaactcccccaacagaattaatacctccctgctctgtgcctccatcatgccttgtatgctcttgctgtcaacacacctactgatcatacacatcaaggtcctgctgccgttgctgtttgaccaccgtccttcatgctggcttgggagagccattcttgttcctttttttttttttttttttgagacagtctcactctgttgcccaggctggagtgcagtggtgtgatcttggctcaatgcaacctctgcctcccaggttcaagtgattctcctgcctcagcctcctgagtagctgggactacaggcgcccaccaccacgcttggctaattgttgtatttttagtagagatggggtttcaccatgatggccaggatggtctcgatctcctgaccttgtgatccacccacctcagcctcccaaagtgctgggattacaggcgtgagccaccatgcccagccgctttttccttgctttcccccaaagcctggcacataacccatactcagtaaatgtttgctgaatgaataacaaaagaacaaaaaaagctccccaagccttgttggtcatccacccatagcttggtttgtacagcccctgcccaccttggccccctgtgaccctctccactgacccactgtctccttcacccacagctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctgtgagtgggcatgggaaatgggactggaggcaacacagcttgagggcagtgctttctccttttctctgcctctctcagcctgggatacccatgacttacagctggcccgggggtgtgaaggctggtgtgagtggcacattgatctccagccaggtctgggctgatggcacatggtttgggttttggatctgaggaatccaaacaagcagcacatggcatggtatagtggaaagaccatgggctcatttcagcctaacctaggattgaatcctgatggtgccactgatgagtcagatgacctctgttatatccgtttcctcatctgtaaaatgggttcagtagtacctcctgcacaacatatgtaagtcaccaagcacaaacacagtgccttttttttttttttttttttttgagacggagtctccctctattatccagcaggctagagtgcagtggcataatctctgcgcactgcaatctctgcctcctgggttcaagccattctcctgcctcagtctcctgtgtagctgggattacaggcaagcgccaccacagcctgctaatttttgaatttttagtagagattgggtttcaccatgttggccaggctggtctcgaactcctgacctcaagtgatctgcccgccttggcctcccaaagtactaagattacaggtgtgagccaccacacttggcctgcacagttgtcttttggatgaccaaatgacactgtggctgcctctggccagcatcaattaagccatttagatggtgggccaggctgctggggcaagaggaaggagaactggccctcccctcttcactcttttttttttttttcttgagacagagtctcgctctgttgcccaggctggaatgcagtggtgcgatcttggctcactgcaacctctgcctcctgggttcaagcaattctcctgcctcagcctcttgagtagctgggattacaagtgtgtgctaccacacctggctaatttttgtatttttagtagagacagggtttcaccatgttggctgggctcgtcacaaactcctgacctcaggtgatccacccgtctcggcctcccaaagtgttgggattacaggcgtgagccgccgcgcccagccccctcctcactctctttctcttcctgtaacttctacagctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacagtaaggggagcgaccggggaggttggagaggggagcacctgtggccagggcggaggtggaggaagaggcagggtgggaaggggcttagcctgaaccccagcacagtcaggggttggggcgggcgactggatcaggaggcctggcctccagtttagctcttgctaactctgtggccatgtgccaggtcctgatcccctctgggaccctccacctgcagggcaaaaagaggggactggtcaaggagatcctccaaagtttttcttttcttgtttgtttgttttttgagatagggtcttgctctgttgcccaggctggagtgcactggcaccatcatatagctagctgcaacctcaaatgcctgcaatcatgtgatcctcacatctcagcctcccaagtagctgggactacaggcatggaccaccacacccagccaattttgctattttttttctagagatggggtcttgctatgttgcccaagatgggcttgaactcatgggctcatgtgttcctcctgcctcagcctcctaaagtgttgggattacaggcatgagccactgtgcccgccccctctaaggtttttaatcaggccaggagatagagaaaattgaagatcaaggatccagggaggctgggcatggtggttcatgcctgtaatcccagtacttgggaggcagaggtggaagaatcacttcagcccaggaatttaacaccaacctggccaacataggaagaccctgtccctacaaaaaattttaaaattttaaaaaattagttaggtgtagtggcttgtgcctgtagtcccagctactcaggagactgacgcaggagaattgcttgagctcaggagtttgaggctgcagtgagctatgattgtaccactgcactccagcctgggacacagagtgagatcttgtctcaaaaaaataaaaaaataaaaataataataaagggcctctaattgaatgtcagtaggtattgaaaaaaaaaagtctaggtaccgggcttggtggcttatgcctgtaatctcagcactttggactttgggaggccaaggtgggaggatttcttgaggccaggagttcaagaccagcctgggcaatgtagtgtggccatttctaaaaaaaaaagaaaaaaattagctaggggtggtggtgcgcacctaaagtcccagctactcaggaggatcactcgagaccaggaggtggaggctgcagtgagctatgatcgtaccacttgtactccagtctgggtgacagaataagaccctgtctcaaaaaaagaaaaagaaaattaaaaaaagaaaagaaaggatccagggagcctgagcctaagagggtggccacaggggatgccaccgtgggggagggactctggggactgtcacacctgggcagggtcccttctcagtcttttgttttgttttttgtttttttgagatggtgtcttactctgtctcccaggctggagtgcagtggcgcgatctcggcgctcactacaacctctgcctcccgggttcaagcaattctcttgcctcagcctaccaagtagctgggattacaggcacgcaccaccacacctggctaatttttgtatttttagtagagacagggtttcaccatgttggccaggctggtctcaaactcctgacctcaggtcatccacccgccttggcctcccaaagtcctgggattacaggcgtgagccactgcgcccggccccttctcactgtctgacttcttggcagagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtaagagctgggccagggcctggtgggtgtggggaggcagctggaccaggtaggccacctggagtagaagtcagggatccctgttccctgggatgtttgtggcaggggtgggctggttgtaaaatcagagtcagcaggacgcagtggttcacgcctgtaatctcagctactcaggaggctaagacgggaggatcacttgagcccaggagttcaagaccagcctgggcaacatagcaagacgcaacatctctgcaaaaaatttaaaatgagctggatatgggggcgcacacctgtagttccagctattgggcaggcttaggctggaggatcacttgagcccaggagtttgaggctgcagtgagccaagatcttgccactgcactttagcctgggtgacagagagaaactgtctcaaaatcaaaaacaaattcagcaacaagctcacttcatgtggggaggcagcagaggctggcaagaaacaagaggaagagaggaggaggacagagcgtgaggtgtgtgaaggtcaatcctgggctgaagaaccaatggcatccactacaccaatgtatttttattttttgaggcagagtttcactctgtcgcccaggctggagtgcagtggcaccatctaggctcactgcaacctccacctcccaggttcaagtgattatcctgcctcaacctccctagtagctgggactacaggtgtgcaccaccatgtctggctaatttttgtatttttagtagagacgtggtttccccatgttggccaggctggtctggaactcctgacctcaagtgatccgcccgactcggcctcccaaagtgctagaattacaggtgtgagccactgtgcccggcctcactgagccaattttttgcaaggaaggacttgggctgggaagggggcggacctcacagaggtttctgccacgtgaatagcaaagcccattggggtatcttattccactctctgcacggagacatatggagatgactgggaaaagtgaagcccagccaggaaatggcagcaggtcaggaggattcagccctgtctgtggctcctgtcttccctctttaggtcaacaaccagaagatggccgtcccctacaggccaaatgaacacctgcgggtcaccctgtggggccaacggctctacctggtcaccgactttgagctggtcgtcagctttggtggaaggaaaaatgcaggtaatggagagaggggaaagaagagcaaaagggccatttctgggaagtgggagggaaaatcctatttaagacaggcaaatcctggtgagcagactcggcccggtagtggggcacccagcttcagaggaggaccaggaggaggtgaggtgagaccaggtggagagcagagggcagagtcttggctgggtgctgtggcactggccagaaatcccagcgctccgggaagctgaggtgggaggatcgcttgaggtcagaagctcaagaccagcctggggaacatagtgagacccccgtctctacaaaaaaaattttaaaggccgtgcacagtggctcacgcctgtaatcccagcactttgggaggctgaggcaggtggatcacctaaggtcaggagttcaagaccagcctggcaaacatggcgaaaccccatctctactaaaaatacaaaaattagctgggtgtggtggtgggcgcctgtaatcccagctacttgggatgctgaggcaggagaatcgcttgaacgtgggaggcggaggttgcagtgagctgagatcgtgccactgcactccagcctgggtgacaagagcaaaactccatctcaaaaaaaattttttttttttaaatgagacaggtgtgatggtgcatgcctgtaatcccagcttctggaactggagaggctgagacgggaggatcgcttgaggccaggcattcgagaccagcctgggcaacatagcaagatcccatctctataaaaaataaaaataaaaaattagctggatgtggtggtgcacacctgtaatcccagctactggaaaggccgaggagagaggatcgcttgagcccagaagttggaggctgcagtgagccatgattgagccactgtactccagactgggcaacagagcaagaccctgctttaaaaaaaagttaattaaggctgggcacggtggctcacacctgtaatcccagcactttgggaggccgaggcaggcagatcacgaggtcaggagatcgagaccatcctggctaacacggtgagaccctgtctctactgaaaatactaaaaattagccaggtgtgttggcgggcacctatagtcccagctactcgtgaggctgaggcaggagaatggagtgaacctgggaggcggagcttgcagtgagcggagatcacaccgctgcactccagcctgggcaacggagcgagactccatctcaaaaaaaaaaaaaaaaagttaattaaaaaaaagagtgagggctaggcgcggtggctcatgcctgtaatcccagcactctgagaggccgaggtaggcagatcacttgaggtcaggaattctagaccagtttggccaacatggtgaaacactgtctctactaaaaatacaaaaattagccaggcatggtggtgtgtgcctgtagttccagctactcgggaggctgagccatgggaattgcttgaaaccaggaggcggaggttgcagtgagccaagatcacacaactgcactccagcctgggcaacagagcaagactgtctaaaaaaaaaaaaaaaaaaaagagtgaggagtctcacttctggggacccccttcctcccgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccaggtgcacggcctggaagggatgaggcgggggaggtgaacaacaatgtctgtgcacggtggccgctagccctcctgtcctcaggagaggatgaaactccagggagagggtgcagataggcctggatcctcccaattccgtcattccctctcatctgactctgggggctcccgctcaatggaaatctctctctgtgcccctgccctgccctcagcctgccttcccagttatttttccttcttccttcttccttctttcctcctcctcctcttcctcctccttctcctcctcctcctccttcttcttctcctcctcctacttcttcttcctctgtcacccaggctggagtgcagtggcatgatctcagctcactgcaacctctgcctcccagtttcaagtgattctcgtgcctcagcctcccaagtagctgggactacaggcatgggccaccacgctcagctaatgttcgtatttttagtagagacagggtttcaccatgttggccatactggtctcgaactcctgacctcaagggatctgcccacctaggcctcccaaagtgctgggattacaggtgtgagccaccacacccagccccagtagttcttatttctttttttaaaatatattttttagagaccgggtcgtgctctgttacccaggctggagtgcagtggcgtgatcttggctcactgcagtttccacctcctgggctcaagtcatcctcctgcctcagcctcccgggtagctgggactccaggcagccaccaccatgcccggctaatcagttcttcttcttcccccacttcaccttccttggggcctcacctgaccccgtggctgtctctactgcagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagtgagtcatgggcccaggacttgtgggaatggcccaggtgcctgctctggtctttccctggggcctcctgcccgcttcctgacccaagctctgtgtggttcactcctccgttctccctgtggcctaatttccttgtgaccctcactggacaccgactgatgtctttctgtttggggttccaggctctcttctgcaggggtgggtctcctcccctccccaaactgactgtgcccttcctgccccctctctgcaccaggcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcggtgaggtgttgcccctccctgtgccgaccctgacccctctgccgtccacctctgctgaacgctcttcccaccattgcctcatctcgggctttctgtcttagtcccatcatccctcgaatttctgccttagtcccaggtccaagtcagcacaaccggcagcctggctccttctctgcccctgcctgggagcctcccaaccccatcccgcatcccgctccttcctgccaaggtccaccttcgctcaaccagttccttcaaatgttctaatgttgcagaccctggatgggctgggcgtggtggttcacacctgtaatcccagtgctttgggaggttgaggctggaggatggcttgagcccaggagttccagccaggctgcagtgaaccatgaccgcacaccaccacactccagcctgggcaacagagcaacatcctatctcaaaaaaaaaaaaaaagaaagaaagaaagaaagaacgaaaaaaagaaagaaattaaaaaaagaaaagactagacaggctggacatggtagctcatacctgtagttccaccactttgggaggcagaggcaggaggatcaattgaatccaagagtttgagaccggcctggggaaccagtgagaccccatctctataaaaatcttaacaaattggccgggtgtggtggtgcatgcctgtaactccagtcaccagggaggctgaggtgggaggatcattggaacccaggagttggaggctgcagtgagccgtgatcacgccagcctgggcactccagcctgggcaacagagtgactccatctctaaaaaaaatttaaaaaaataaaaaataaaaaaaagaccctagatgaagctgcaacacgttctagcttcctgcctatatgcaacgctgagtgtttttgtttttgttgttgttgtctgagacagagttcgctttttgttgcccagactggagtgcagtggcatgatctcggctcactgcaacctccgcctcctgggttcaagcgattcttgtctcagcctcccgagtagctggtattacaggtgcccgccaccacgcccggctcatttttgtatttttagcagagatggggtttcaccatgttggccaggctggtcttgaactcctgacttcaggtgatccacctgcctcatcctcccaaagtgctgggatttcaggtgtgagccactgtgcccagcctactctgagttttatcgggtgaccttgcccctgtttggcctgcccagccccagccagtttctgaccatgactgtccccgcagccatggagtgtccagcaggtaccatatatcagagctgtatgacaccctgcccagcatcctgtgccaacctggcagaccccggggactgcgagggcccctgcgtggaaggctgcgccagcatcccaggctatgcctacagtggcacccagagcctcccctggctgactgtggctgcaccagcaatggcatctactaccaggtctgagctggcagcaggaggccctggggagcagaggcgccaaggagagccagaccagggatggaactggaacgtctcctcctggcccttcccctttctagctgggcagcagctttctgactgaggactgctctcagcggtgcacctgtgccagctcacggatcctgctgtgtgagcccttcagctgcagagcgggggaggtctgcaccctggggaaccacacccaaggctgctttccaggtgaacctgcactcctgcccggttccaagctgccccatgccctggggcgtccatggaccaaggatcgtcccctccttgtcctcaggactcttccacattgatttcaggatgtctgtccctgcctttgtagggagggacaaaggacaaagatctcccgatccctaagcatccatgacctaccgaatccttccctagcgttccttcccatgatctccttcagccctgatggttagcacagcactcctaatttatacataacaaacatggagttcagagaggttaagcagtttcctgctgggcgtgggtgactcatgcctgtaatcccagcatttttggaggtgaggtgggcgaattgctttgagctcaggagttcaagatcagcctgggcaatatagggagacatcgtctctactaaaaattaaagaaaaaaagagctgagtgtggtggtgcactcctgtagtctcagctacttggaagctgaggtgggaagatcacttaagcccaagaaattgaggctacagtgagctataattgtgccactgcactccagcctgggtgacagagtgagatcttgtctcaaaaaagaagagaagagaagggaggaggggagggcaggggaggggaggaaaggaagggagggaggagaggggagaggagaggaagggagaggaggggagaaggagggaaggagagaaggagggaggaaaggaggaagaaaggaagagaggaaggaagagatgaaagagtttcaaaggaaggaagtttccccaaagcccagggctagtgaggcagggttgggagccaggctggctgacccctggccagtctctggcagccgctgctttctccccgggcgtcccagcccccagccaggccttccctcagctgggagtgtcctcccagggcccccctcccacaaccctctctgtccttgcagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccaggtgagggcatcgtccaaggccctgtaccctcacaacctcttcctggccgacaaccacagaatgattctatatgtattatattcacatatagaatgatatgtattataatattatgttacagatattatatattataaacataacaatttgtagctataatggatattaatatattaatatatcttgtatattaattatctatttatatattacatatattattatagtaggaattataatataatccctagaaattcgcaggacaagcatcctcaaaaaaccagtcctggccgggaatggtggctcacgcctgtaatcccagcactttgggaggctgaggtgggcggatcacgaggtcaggagatggagaccattctggctaacgaagtgaaaccccgtctctactaaaaatacaaaaagttagccgggtgtggtggtgtgcgcctgtagtcccagctactcgggaggctgaggcaggagaatcacttgaacctgggaggtggaggttgcagtgagccaagatcaagccactgcactccagcctgggtgacagagcaagactccatctaaaaaaaaataaaaaaataaaaaaaaattagctgggtatggtggtgcacagctgtaatcccagctactcagaggctgaggcacgagacccgcttgaacccgggaggcagaggttgcagtgagctaagatcacgctactgcgctccagcctgggcgaccaagactccatctcaaaaaaaacaaaaaacaaaaaccaaaaacaaaacaaaaaactagttcctgtgcccatctcctacctatatactgtgaaatcttctctctgaagcccagctccccactcctgtgacctgtatctctcacccctgctgcttcctcctcctgtgtccttctgtgcctctccagcaccttccattgtcctttcctatcccaaactacaattcccatgggcttctgggccagtggttctccagctttatcttgcctaagattgaagacggggtaacttgtgtacatgtatattccaggacacactctgaaagatcagatttggtaggtctggagtgggcccaggaatctgctttttttttttttttttttgagtcttggtctgttgcccaggctggagtgcagtggcgtgatctcggctcactgcaacctccacctcccgggttcaagtgattctcctgtctcagcctcctgagtagctgggattacaggcgccggccaccacgcccggctatttttgtatttttagtagggatggggtttcgccatgttggccaggttggtctgaaactcctgacctcaggtgatcctgccaccttggcctcccaaagtgctgggattacaggcgtgagcctttgtgcccaaccagaatctgcattttcaacaagggcccaggaaactatggaagtgactccagggctactctttgagaaatgctggctgagatgacacctggactctaggggacctaagagaaacagctgcccacctaaataggcttaagggagggcaggcgtggtggttcatgcctgtaatttcaggactttgggaggccaaggcgggaggatcacttgagccaggagttcaagaccagcctggtaacatagcaagaccccatctctacaaaaaatcacgaaaattaaccgggtgtggtggcatgtgcccatagtcccagctacttggaaagcaggctgagggggaggattgcttgagcccaggagttcaaggctgcagaaagctatgatcgcaccactgcactccagcctgagcaatagagccagactctgtctaaaaaggcttatggcaaacagaaaacattgcgggggttggggagggggcactaagaccttggagtccctggaggtgagaacctcctggaggaagaagcagacacacctagagatttagagagatgaggtcccctggggtagcaagcaatccccaaaagggagtacccctcagtccccacccttcccgtctcacgttcgacctaatgtctcttccccgcacccagaagcatctaacctggtgggcgtcctactgggactgctggtgcctgtggtggtcgtactactggccgtgaccagagagtgcatttacagaacgaggaggaagaggtgagtcctgggaaggagagaggaagggcgggtggggtgtgcaaaccgggaagcggctgggcccgtaaagggccacttggggacccatgtctattcccccatgccttctagagagaaaacgcaggagggagacagactggccaggctggtggacacaggtgagaaccaaccccacagcccggaacctcggggcctagagttgagtctcctctcatacatggttttcttgctttctcctcagatactgttctggactgtgcctgttaagttgctcagttttgagctgtcttcagacaagaagattaaataaatttatatatttatttatttga

SEQ ID NO: 938 - DNA, 64172 bp, Homo sapiens; identical to SEQ ID NO: 937

SEQ ID NO: 939 - DNA, 1432 bp, Homo sapiens
ccctgtgctgcctgtgactccggtaagaacagagcagggatgctcagaacagagcaggagggaaggaggggcagggcctccggggctagggccatgttgtcagaggtggagagtttagaaaagactgaaggggcgggggccaaaaggggtctggcactaactgggagcaggaaggaaaagaggaaaagagctggcgggctgtgccatgtgcctttgaactctagaggaaacaaactgctctgggatgaggtgggtgttccagagtgggaactttgaagcacagagacctgctccactctggcagcccacaggagggaagcccacctctgaagatacaaccctgtctctgcctgcaagggaagaactggagctgtggacatgggactaaagactctttggggtttatgaaccccacattttcatgggtctgagatttgttcacaaacttcccagcttggttaggacacaccaagcctgagacccaccgtgtcatcccatcagcctgagcaggtggtgagtgaggaagtctgagctccaacctgagatcagggggtcagggttcaagtactagtctgcagaaactgctaagtttatctgtctctattgaagtgagtttactgacctagtagtctccaagatcctgcacaatgctgaccttccaaagtaaaatcgtcttgcaaattatgaccagagagaatgactgcttcttctcctttaaaaataattttctcttaaatgactcataaattagacaatttcagtcttaagatatatttgtaataatttcttcctccactgacaacacatcagaatcttagatgcattttgcaatattgtttagtcttagtttacagttgtctgacatccaaagatatcttgaaaaagatgatgtgagattttgaggaaattattggaaataaaactactgaagatgatgcttttaaacttgagaggtgctaagagtgtcacaggggcagaggtggcctctgcctgggtctgacttgttatttgactctccctcagctcctgaacacccaccaccgagatgtcctgccagcagagccagcagcagtgccagccccctcccaagtgcactcccaagtgcactcccaagtgccccgcccctaaatgtccccctaagtgccctccagtctcttcctgctgcagtgtcagctccggaggctgctgtggctccagctctgggggcggctgtggctccaactctgggggctgctgcagctctgggggtggtggctgctgcctgagccaccacaggcgccacaggtcccaccgtcgcagaccccagagctctgactgctgcagccagccctcggggggctccagctgctgcggtgggggcagcagccagcactctggaggctgctgctgaagtggaccttgacttcctcttccttctgattctgcctgaata

SEQ ID NO: 940 - DNA, 1798 bp, Homo sapiens
ccttgttttagtcctttaatcagcagatgcacgctgcaaatgacattgagtaagctaggggcttagacagagcgtgggagggtagccacaaaggtgaggtccaaggccagtgaatggagatccaggagaggatctgagtttctggactccagggaaaagatatgctcttggcaagttcagagctttcccttggacctgtgagcctctcaggcaggcctagtaggagaagggggatgtccttggcagtttgcggtcctggattctgctcttctaggctcagggtccacttcagcagcagcctccagagtgctggccactccccccgccacagcagctggagccccccgagggctggctgcagcagccagagctctggggtctgtggcagtgggacctacggcgcctgtggtggctcaggcagcagccacctcccccagaactgcagcatcccccagagctggagccacagctgcccccagagctggagccacagcagcctccggagctgacactgcagcaggaagagacaggagggcacttagggggacactttgggggacactttggggtggggcacttgggagggcacttgggggtgcacttgggagggggctggcactgctgctggctctgctggcaggacatcttggtggcggattcaggagctgaaagagagtcaaacagcaagtcagacctaggcagaggccacccctgcctattcttgtcctttccacattgtttctatttcctttattttgatgaactgttcaaatgtcatggtaaatcattaatcactgaaaattttgttgtttcttgtagtttggcaaatgctctcacactgtatcttttgagttcacaatttcatcttaagacagtcaagaattactatatcttttacaaagaaggaaactgaggcagtaagccatatgaaaaaatatctgtcaagattaaacatttagtaaattaaaggaagcagtttttctcattgtgtcaaataaaaccctgaaactgtccagtgtggaaacctggggatataaacattttcttggaaaaagataatgaaggattatctcttggagtaacttcctaggagactttgtcttgtaaaaacctgcgcatgtacaattgtaaatggttttggagacaggctggtctcacaggctccctttgttaaggaagatgctggagaacagtatttttggtgcatagaggggatctgaactcaggtgccctggctctaggctggtgcactgccatattcatcacgcaacggcctcacagtaacatgttggcacagtgatcctcagcttgctatgtctaactactttaagagattctcaattccaatttgaatctagagataagtgagtttcaaaaagccctaaaagatccattaattatctctactccactgattgagaactactatctccagctcaaatttgcaaggagtgtcacagttttgctctgaaaagtaagtgtcctatttgaagttgttctagcagagtctatttgcctgggcttcaactccctctgtccttaaaactcaactagctgaagcacaaagacagagacatctaattcttatttgtgttaccagttggccctctccctgcctcctgagcacatcctccttcaatctttctgaggtcttgacttctatccagatggatctcagccctcaaggtcctgcccagcctcccctcctgcctagggctgagcaacactctgtggaagccccagcaactattctcaaagaacacttaccggggtcacaggcagcacagggtccttcagc

SEQ ID NO: 941 - DNA, 2150 bp, Homo sapiens
tgccgaaggaccctgtgctgcctgtgactttggtatgtgtcctctgggaacagaagcaggggattccacagagggatgctcagatcaggttaggaggagtggtgggcagggcttccatgggggaggagactggtaacaactgggacagaaagaataactggttggctgtgcctttgggctccaaaaaaaactgctgtagggtggagcagtcctctcaggatgggaaaccttaaagcacagagacctggggcactctgacagaccacaggaaggaagcccacctctgaaaatacaaccttgtccctgtctgcaaggaagagctggagccatggacaggggaccagaggctcctttgggcttatggaaccgacacttttatgggtctgggatttgttcacaaatttcccaggttgattaggacacaccaaacctgagactcaccatgcccacccatcagcctgagcaggtggtaagctgaggaaatctgagctccagcctaagatcaggaggccagggttcaaattccagggctgcaggaatttatgggtttgtctgtctctgcttcaacaaagtaagtttactgagccagtaatatccaagatcttttgtagtatggatattgcagagtaaaactaccttgcaagttacaaaaggtagtgattactttttctctttaagaaataattttccctaaatgacctataaatcatataatttcagggtgtgaagacatatttggaataatttcctccttcacttataacactttggactgtcagatgcattttgtaatattgtttggtcttagtttacaattttgtgtagcagataacacacaagggtatcctgagcttgcaaagagatgatgagagaatttggggaaagtattggaagtgaaactactggacatgatgtttccataattacaagtcatgctaagagtgtcagaggggcagaggtggcctctgcctaggtctgattttctgtctgactctccctcagctcctaagtacctactgccgagatgtcctgccagcagagccagcagcagtgccagccccctcccaagtgcactcccaagtgccctcccaagtgtcccacccccaaatgccctccaaagtgtccccctaagtgccctccagtctcttcctgctgcagtgtcagctccggaggctgctgtggctccagctctgggggcagctgtggctccagctctgggggctgctgcagctctgggggaggtggctgctgcctgagccaccacaggcaccacaggtcccaccgtcacagaccccagagctctgactgctgcagccagccctcagggggctccagctgctgtggagggggcagcggccagcactctggaggctgctgctgaagtggaccttgacttcctcttccttctgattctgcctgaatagctgagaggttccagcaaaagcttgaagtcttgcctggagaatccctctgctctggtgtcaggaaacccaaaatctttctccttaatggcatttagagactttcttctgcagatccatggctgccctgggaactccaaagcacacacctacttcctccccagctcacgctgctgtattctgtgctgcctgaactgaagaaataaaatccagaatctgccccccaacttgctaccagcctgcttgattttcctgtttgtgtcatccttgttctgctcccctgtgtctgctggtggctgctgaggccttggtggacagaggatggggaaaggggtcaggaggaaaaagcttgcatttctgtgtgttttgtgttttttcttctttcggtgttttccttttaaaccaagggactgaaatagcattgagaaatatttttctttcaaattctggttcctttcacctatgtaaccgcatccctcaggcatggccaggaggccgacttcatcctccttcccactatcacctcttcattcttgtgttcctcgttccccactccttccactaacaatctccctggactcctcctccatactgtatgtgcatgcattcacacacacatatgtacatgcacatagatgagatgaatctgcattgtaaaaaaattaaatcacatttagtgctgtataatttgcatgcaataaaattcaataaaattaaatgtaaaattaa

SEQ ID NO: 942 - DNA, 99817 bp, Homo sapiens
tattgttttccaggcctgggcagagacagggcccccctgccccatctctccaccgtcctaggtgtgccaagagtcaattgcctcattgctgaccctgtccagctggccatggccctcaacccccaaggcccttccacccacagaccatctcgctgctgagagatccaggacctgctcccacctggccaccctccccctccccccacatccaggccccagggctggtgtgtggcacccctgagaccacattgacctccatactgtctactacccataaggactccaagacgcccaggccagctgtctgggcaggactgattcctgatcacccactgataccaagtactcatccccaagattgttaaacaaggccagacactcctggcctcaagaggatgggactgaaaaacaaaaaggtaaggccaggggcatgggccatgcacctgcatgaatccgtccctccttcaaagtccttccttcaaagttttgtttgctccttaatcatgacaaaagcttcccttccctgggtctcagttttcacagctgtgaaatggggagtgaggtggtctctgtggctctcccaggttagctgccctatactcttgggccacacgggaactggaatgcagtgtacttgcaggtgttgtcaatgctgaccacccttacctggttgtttctgcactcttattgctggggtcacacagtctgagagcccactgagatggttcattacccctgtccaagatctcccaggagattcccaggctgctggcttggcagccctgatgcccccattgcccccatgctctccaatccctggccctgattttctggggcctaggcccctgtcctggaacacagatgcttgggtctctgaagagaagggatttttgtgtgttttgttgatcaccgtatccccagcactcagaacagtgcctggcacatagtgggtgcttaataaaaagctgtggcccagcagcagggctctgtcaggaagggactagaatctcagtgtgatgagatgtaaacagttgaatgtaagggaccccttaccttcctctcactagcaaggctgagcccctgccctagatggtgttaacccacagggatagcagaaggagctgagaccaaaggcacacagatacttgcaaatgggggataccctctttgtagttacactcaggttgaataagccaaatagctgggggtgcccaggccctagtgtgatttccacttcattactcttgattttgatgtctctggttcctgatgttctctgcccacagctgccccccaccccctgcagactctgccctccccattaagcctctttctgtaatgccacacactcagaaccggtcaccaggttgacctggcaccctaagctgccagctggtccccacctgccccacagagctggatttggggatctggggagtgtgcgtgggagtcctgaggaggagccaaggttgctttgattagtagctttgagaagcgcttttgatagctgggtagaatcgcctataaggatgctcatcatggccgggggtggtggctcacgcctgtaatcccagcacttggcgaggccgaggcaggagtttgagaccagcctggccaacatggtgaaaccccatctctactaaaaatacaaaaattagctgggtgtgttggtgcacgtctgtaatcccagttactcaggatgctgaggcaggagaatcgcttgaacctgggaggcagatgttgcagtgagccgagatcacgccactgccctccagcctgggcaacagtgtgagattctgcctcaaaaataaaaggacgttggccaggcctggtgtctcactcctgtaatcccagcactttgggaggccaaggcagaagttcgagaccagtctggccaacatggtgaaaccccgtctgtactaaaaatacaaaaattaaccaggcgtggtagcgggcacctgtaatcccagctactcgggaggctgagacaggagaattgcttgaacccaggaggcggaggttgcagtgagccgagatagcaccacagcactccagcctgagcaacaaagagcaaaactccatctcaaaaaaaaaaaaaaaaaggatgctcatcatgtatatataatacatatttgtgtttcttcttttgtgaatccccagttcatgttttttaaattggataatgtttataggtttcagtgctctttgtatactagggatattaatccttttttaaatatgcagcaaacattttctcctttttttcttttctttgtattgcagggcattttggaccattatagaagttagtatagatttttaaaatgtaatcaaacctatccctttttaatgatttctgacttttgtgtcatcttttggaatgcttctctgctccaaagaacataattcctcttgctgccaccaatggatactcagattatgagttcaggggggcatccactgtggagcagagaagggatccacatccaaggaagcatggttagagcacagcagagacagcaagagtgtggggtcagacagacccagcttccagttccagccctggcctcactagctaagctgtgtgctttcatacaagaggtttactttctctgagtgtgcttcctcacctgtgaaagagctttcccctggccgccataactctcaggcaagtttagatgttgaaactagaaggaacatgggggaccatttttaactgaaagtccttgtgaaactgctgggaaatagccccactgcagtcaagtaacttgcccaaatgacagatccgggcagccaggcaccctgcctcccagcccagccccgctccagctagtgtgacttttcagacacacggcccttctagagggcagaactgggctcagctcctcaggcctcccaggctgctggaggatagggaggagtgggtggaagagtttgtctccttccatctctctccccaccagaaccaagttaagcaccccccaacccacccgcgggagctgaattcaaggaccattaactccctgttgttcctacctcctcctctcaccctagcccttccccccagcacatggatccaaaaatgccctaagtgatgggcagtcctagttcccctgcaacatctgctggctaatcctggcctattgagggcaaggctgcctgtctgtttggataagggcactggagttagcagcttccaatcttgccaggcccagtggagtagctgagagtgctgagctttggaatcaggcttgcttcggtgctcacagcccagcctctcatccactggctgtgtggccttgggcaggtaaactggccaaacccctgcctggaaaagctgcctgctgatctctgcaccctagcagtgttgggtgggttaagtgagagggagcctgagaagctgatggtgagcatccagctttgctcccagccaagaggaggcatgaattccctccccagggctcaccacacccctacagatgagtttgtgcaaactgagagttacggggggggtaccccatcacccccagttccctaccactcatgtaacccagtatatgcattttctgttccctcatcaatcctctagtgcaggccaggggtaacagatgggtcgaggacattggttctgatgcaggacatctctgagggaagcctgcagattcccatccagacatgggaataaaaaagggatagcaggaggttagcagccctggcccaccatcccccttctggccttacccttggccccaagcctccctggccctgggcccagcctgcccagcgggcacatgcctgcaagcctcaccaggaggcgccagcctggcagttggcctcatgcccagaactgaaacacaatagttctcgccaaacttcctgcaagctttattcccagaagggaaggctgtccccgaggggaggtgcaggggagatagaggaggagccggtgtgactcctggccaggtctgcagatgcctagttgggctctggggctgccagggagccaatgagagcccctggacaatggtcttactcctgggccctccctttcatggccctagggagctcatgagaggccctgtgccctcacagcaaggtgaatccatctaggaacatgaatcacccctcccagcctcactgcaggaacttcaggcacagtaaccactggaaaggctgaatcacaaactattccagacattcccattggccaggtgggaaaatcaaggctcagggaggtggtacagagaggtagggccagagctgagctgaaacctaggtcttttttttgttgttgttgttggagtctcactctatcacccaggctggagtaccatcttggctcactgcaacctccgcctcctaggttcaagcaattcttctgcctcagcctcccgaatagctgggattacagcctcatgccaccgcacctggctgatttttgtatttttagtagagatggggtttcaccatgttggcccggctggtctcgatctcccagcctccagtgatttgcccgcctcggcctcccaaagtgctgggattacaggcgtgagccaccacacccggccaagttgaaacctaggtctttttgccctgaggctgccagccttactcctgtgccactaaaccaggagagcaaggctgctggggagtgggggggtcatggtggcctgcatgagggtggatatgggaggaagctgcctacccaggagggcagggaacagcactctggctgctcctcctccttcacctccaggcaggggcatcttcccctcccctcattctcccctgacaggagcatgggggagagaaggaggggcaaccctcatcaacacctctgtagatggtgacaggccctgctgggtcctggaagagggtgggggtggcctcctcagtcagaggaaggagaggggggcctctctgcaggactggcacttctgatctggggggcatgtattctcacctcctaattagccatcttgctaggcaaggaccacagcctgcaccaggcaagccaagggaagtaggggagcaaggcacagggatgacagttctggagtgacacccagggtggagcagaggaaacagctagggcagaggcggggaggcaggagggagcttggtaggtgtgagaaacagccaggaggccagtgtggctggagcggagtgacccacagggcccgtgggacaagatgaggtcagttttctgggccagctcctggagggccccacgggccattgcaaggctctgagagaagcagcaagctacttcagggttctgagcagaggagagagagggtctgggtccaatctgtaaaggctcactctggcgattggatggggtggacggagagtcggagaggaaacagaactccatcagaggcgagtcgggacatacaggtgtctgggacctgagtgctgacctgaggatgctgagaagggtcagagtccagatatagtttgaaggtggagctgacaggatctgctgaagaactggataagggatgtagaggaagagagggaagaatcaggaaggactccaagatgtggggcttgaacaactagaacaatggcatcgccattaactcattaacgagttggggcagacagcaggaggaggggtttgaaggggagtccagagttcgttagctttgagaggccagtagacccccaaggggagctgttgagggggtgtgtggctccgattggtgggcaccccacgctaccgtgagaaatggatgaaataacgttcctaaaactcctcggggcagagcagagcctcaggcactgtgcccttttctttctgtctgcctgaggcttccaggagccaaggctcaaggtaggagcagagcagcttccagataggtcggtccaagtcctcatctccccactggggaaactgactctcagaacatggctggctttggggcccagcatggtgagaggcagagctggtttaaacctacctctcctgacactcagggctcctcaggagccggccattctgagccaaggacccagcctgccgaggctgccaccaaaaccagagcccgtccagggcccaggtccttgctcctgtctgggcctcaatttcctctctatgtaataggacattgttctcaaccccacccaaccagggcctgccctggaatgcagggtctgacaggctgagctttccagagatgaggaacagcctgccagtggcccctcagggccctgcctccaccctgaggaggtccattgctcctctcccagagccaggagtgcccctctatggcccctcatatcagctggagggacaaagggtaggcaagacctcctaccacgggaggcctatcaagggttaatctgtgtcagattaactggaagtggtgagtcagccagccggccagtggaggaccagggccagggaggacaaggacacccctgagccacagcagcctcatggccacacccctccccaccccaccgcgtttatatgcccagctctgccgtcttctctgagtccccactgcctccccagtcaaactgagccacctctgggccttggaaagctctgccccttcccgcttgctgccttcgctccagtgttctgctcctggcctgtcctccctgactccactcctgcaccttctcccaaccctttaaggcctcctcctccctgctgtcttccctgaccgcctcagccggccagggctttgtcttctctcagcagctctcgttaagatggtcctttgggccatgaatccacaagttactaagctgctgagtccctgcttggggcaactggtgtaggaagccccctgcatgggcaggcacctcttcctccctagtccgcaagtttcctgggtagaagacaggtggggcatctgggacagacacatgcattcacctccacgtaatgcactgaatgcccccatgaacgtggagaagctttgtcagctgtaaagtgctgtgcacaggagggacctgaggtgatgggtgagctgaggtgaggttacaagatagactgaagaaggtggcccattgttaggactgcaaaagcaggtgggatttaggaattacagacgaggacacctgcgaaagctaaggcttagaagtgggaccagacttgaaaggtgaggtggcctgtctcatcctgcaggaagggtaggatccaggactagaggagaggcactgagagagacgtgggatggggacagaagtagggagaaaatggggccaaggcgactgccttgcagagtgggcggaagggtgacagagggaggcaggcacttgacggaagctgtgagtggctagtgctagagggtggcagtgaagggaggtgccgcagcagaggaggccactcagggccaggtgcagtaactcatgcctataatcccagcactctgggaggccgaggcaggcagatcacctgaggtcaggagtttgagaccatggggaaatcccgtctctactaaaaatacaaaaattagttggatgtggtggcacatgcctgtaatcccagctactgtggaggctgaggcaggagaattgcttgaacctgggaggtagaggctgcagtgagccaagatggcaccactgcactccagcctgggcaacagagcaagactctgtctcaaaaaaaaaaaaaaacactcagccctggctctccccacagaacactgaagacccagaggagcccctgatcgcctcccagagcacggaacctgagatcggtcacctgtctccctctaagaaggagaccatcatggtcaccctccatggggctaccaacctgcctgcctgcaaggatggctccgagccgtggccctatgtggtggtgtaagtagctgcgtgagagtgggggcaggggatgggttgggctgtgagcagaaaccaggggacagctatttggaatactagcacccaaaggcccaggactgggactgtcatacccagaggggaggagctgctgtgggcactacctggcatctccgctgctgcatgggaagctgctcaccagggctggggaagacagggtgccaacggatccagagagtcacccctccccaccccacaccagtggggcagggattggtcacagctcagctccagtggggcaggttccttgtatgcaaaagtctgggctgggctcatgggcatgatggtcagattggggaaggggaagatttgggacctgcctctcctgacttctgggtgccccaccccaccatacccagccctggggtagggtcctcataaccaccctcccctcctcccctccttctccagtcacttctattatggggactcccctagttctgggcctttaatgcaccccacacaccccctccagccagctgctgtcagggtacacacttccccagcctggcaccaaggcctgccacgccacgtctatgcccacctcacgggtctcacttcttccagaaaggcgccaaggggcaacacaatctccatccagccaaccttcgctggggacactgaatatttgctcaatctttattataaagcaccctccaaggagcatgtcacccctagaccttctatagacagacggcgggagccttggtggcctcccaccaagccaccctatacttcccctcccccaccaatactggcaccattcagttcctgccaagagtctgttgcccacatttccttttggggagtgcctgccccagcccactcaccaatgcctgctgaaatcctgccttcaaagcctcctcctccaggcagccaccagagttgagctctccctcttctggagctccacagcagtggtgaccctggtctgaagcactttatatcaacatggtttatgcactcctctggggctccctgaggacggatctcctcctccatttccctcaacaatgcatccaacataggcctgagcccaaacttaggagccaaggagtgactgaggccaacacctggttactatgataagtccctgcccccccagggcccccactgtgaaaggggggtagaagctgtgccgagagcaacaggtgaaacacttgccttaaaagccccatttgtgccagcccagctcctcggccatccctcccccaactccatttccgtggtgagggaagcacaggtggtgggagcaggcttggcagggaggctggtttctagcggggagctcgccttctccgctcagctatttccataaaccaattatcgccgatcatctcgggagattgaggccctgactgtcaccaatccggcctgggcggcggggcggggagctgggtggctgtgtggctcctaggcaggcaccgcgacccgcgccatcacccggttgccatgggaacgcgcggcaggagcctaggcgacacgagcctgggtgggggttcggagagccgggcacaccccgagtcctcctgcaccctccctgtggctgcggcacgtggggcgggagggtggggacagagaacgcggggaggggggaggggaaagcacttcgctgcacccttctccagctgggagcagcgcccgggccaggctgcagcctgcgtcccagggctccagacaggcgaagctgccaccagctcgaggtggtgctaatgagatgcaaatgatgggagaaggaagggcttctgagaatgtgaaggccgagctgtcaggacctgaagggggctttcagtgctcacccccagccccaggcagaaaccccagagggaggatccagaccctcagaggccatagaacctggaaagaatttatatccctgcacatctgattacaaataaacaagtaacaaagcacacaataggcataagaaagttcatgaaagttttcgttttgttcatgatgaatatttcaatgctttttaaaaatatgtatttgtgaagacttcaatgtaagacctgcaactgtaacacccctagaagaaaacacaggggaaaggctcctttacattggtcttggcaattaatcttcggatatgacaccggaagtacaggcaacagaatcaaaaataagtgagactgcatcaaactgaaaagcttctgcgcagcaaagggaataatccacaaaacaaaaaggcagcctatggtatgggagaaaatatttgcaaaacatgtatcggataaggagttaatatccaaaatatatgagtaactcatacaactcaatagcaaaaagacaagtaacccaatttaaaaaatgagaaaaagacccgaatagacatttttccaacaaagaaatacaaatggccaacaggcacatgaaaaggtgcacatcgctaatcatcagggaagtgcaaatcaaagccacaaggagatagcacctcacacctgttaggatggctgttctcaaaaacacaagagataagtgttggtgcgggtgtggagaaaagagaacgcttgtacactgttggtgggaatacgcagtaaaatggtgcagccattatggagcacagcacggaggttcctcaagaaattgaaaataaaactaccatatgatcccgcaatctcactactgggtatatatccaaaggaaacaaaatcagtattttgaaaagatatcgggccgggcgcagtggctcacgcctgtaatcccagcactttgcggggccgaggtgggcggatcacagggtcaggagttcaagaccaccctggccaatatggtgaaaccccatctctactaaaaatacaaaaattagccgagcgtggtagcaggcacctgtaatcctagctactaggaaggctgaggcaggagaatttcttgaacctgggaggcagaggttgcagtgagccaagattgcgccactgcactccagcctgggcaacagagcgagactcccatctcaaaaaaaaaaagtaaaagaaaaagaaaagaaaagatatctgggcctggtgcagtggctcatgcctgtaatcccagaactttggaggctgaggcaggtggatcatctgaggtcaagagtacccctatattcattgcagaattattcacaatagccaagatataggatcaacctaagtgtttgttgatgaatgaatggataaagaaaaaatgtcatatatatatatatacacacacacacacacacacacacacgtcatatacatatatttgtatatacttgtgtcatatatacacacacaattatatattgtatacatatatatccacatatagacaacatatacacaatgtaatattattcagccataaaagggaggacattctgccatttgcgataatgcagatgagcctggaggacgttatgctagatgaaataagctagacacagaaagacaaatactgcataatcccacttaatggaatctaagataaactcatagatgcagagagtagaatggtggctgtcaggggctggggatgagggaaatgaggaaatgttggccaaaggatacaaactctcagttttgggatgagtaattctggggatttaatatgcagcaggtgactctagttaatgatactatattgtggctgggcacggtggctcatgcctgtaatcccagcattttgggaggccaagacaggtggatcacctgaggtcaggagtttgagaccagcctggccaacatagtgaaaccccatctctattaaaaatacaaaaactagcttggcgtggtggtgggcacatgtaatcccagctacttgggaggctgaggcaggagaatcacttgaatctgggaggtggaggttgcgctgagccgagactgtgccagtgcactccagcctgggcgacagagtgagactccgtctaaaaaaaaaaagatattatattatgtatttgaaatgtgctaagagtagattttaagtgttttcaccacatacacgaaaggtaactgtgaggtgatagatgtgttaactaacttgatcatgatgatcactgcggaaagtatatgtgtatcaaatcatcactgtgtacattttaaatacatctaaattttattttttatttgtcaattatgcctcaataaaacagcgaaaatatgtatatatattatatatattatatataagtttacattctttccaagcattttttctcatctttttgctgcccctgttttttggtaccctgagcttagtctcctggcttggtttcctgccctctgccatcccatcttctctcacctgaggttggggatggatatcctgggaatccctgtctcagcctggattctgtccttctctctgggtttgttgcatccctagcaggcaggaccacagttgcagggatcggggcaggggaagtagtgaagcacagacctgagagtgccccagaactgttcgttcattcatccccttagtggggagctgaagagggttcaggcccaaagatggtgcttctcttgtttggggcatggccatttcaccccttaaggaggcaccaggcttgagcccatatagtaataggcacatcctccagccaaaactattccagaccagcaggcacttggctcatcttgggggtcagcctgtcttcatctaagccactggttggcttccaatctgaccccacttctccaccaatatagcttctctgtagtcaccagtgaccaccatctctgaccctgcatccaacgggcatctcatcttttgcgatctctcaggtaaaggaaataatgtatacagtggtccattgccaagacaaagtgccttaaatcagcttagatcagcaaactacagaagaaaccggatatatactaggcccctgcttggatagccaacgcctgcttgtcggcagccccccaccctccctgcttagtcgccctcaccagaacaagaagtttagtctaaaatgaaagtttattagtctgcaaaatagctcattttgtctgtttttatcagcccgcccagctgcttaggtcataagccaaatacttgaggccgggtgcagcggctcacacctgtaatcccagcactttgggaggccgaggcggatggatcatgaggtcaggagatcgagatcatcctagctaacacagtgaaaccccgtctctactaaaaatacaaaaaaaattagccgggtgtggtggcgggtgcctgtagtcccagctactcgggaggctgaggcaggagaatggcgtaaatccaggaggtggagcttgcagtgagctgagatcaagcaactgcactccagcctgggtgacagagcgaggctccgtctaaaaaaaataataaaaaaataaaaacaacttgaatagcccctgagctaactaggattgcagtgcattgtgggctgcaaaaaatgcaataagacaacccaaaaacaaacaaacaaacaaacttaaagctaacaatcaataggtgacatctgggaaaactgtgaccccgcagtattcaccctatgaggaaccgggggagagacccgtgcactaggggtaaattgcttattgaaactgtgctgggtgtgcctgcctatcagacacccaatcttgcaagacccgtgttaaaagtctcaatttcgctgttccctgggtctctgagtccattctttgggtttggacgggtgaatttgtttattacacagaggcagcagcccctccagacaactcagtctctttgaagccctttctccccctccaagttaccccactctcccaccttcccctatggccacatctcttgatctcgtctacctgaccttaaatgttagcctgtctcaggtttctgccctatgtggctcttctttctctagcctgtactctttttccatgtgatcccaccccatcctggtgtcaggaatcacattcttccctcatccaatccatcaccaagtcatgtccatgtctcccggtctctcggattgagctgcttctctccaccagctccaccaccgacttaggccaccgcactatttctccaactgctcttggttcctctactcttgctccctgaagatcccttcaaaggcaggttaccattgggtactgtggtgccatagtaccaaaggaactcagtggcttcccattgttcccaaagtaaagaggattccaggctcagcacggttgggtctttgccggcccctccagctccccagcaacaggacctccacctccctctctttgctccagccacactggacatctctccgttctctgagcaaaccctgttccctcccaccctaggcattctcagaaacattctgagaaacattcccagaaacattctcccttccccttttcccatctcagctgtcctcactgatctcccagatgaggccaaatcctccctcattacatgttttcatgcgactctgtaccaggatatgtgcttatgcactttatgtgattatgtgcgtactctttgccagtgcctccccatcccgcctccactgtgccccactagttccgtggacaaccaccaggtctgctttgctcaccattttattcctatcatgaaacacagtatctggaacataggaagctgtcactaaataatcgtcgaatgaatctggccctgtttctagcttgctgtatgactgtgggaaagttactttgtctttcaatgcctgaaaacctcacctgggaacctgtctcaaagggctatagagatggtggtgctagacagtgtgagatgctgcgggtctaaagctctacagggggaagggggagtcctgagcaggctcacagtgggcactgagacctatcataagaaagccacaggacagtggaaagaagccaggctgggtacaggaagacctagcatctggcccactgcccctgactccctgtatgaactcaggccagtccttgccttctctgagcctcagtcttcccatggccaggatgtaagctttggcctgcatgctgctgcaggcctgcctggctggcttgtgttctggcctgggaaacactctcagttctttagagaaaacaagaaccccagctctgccacccgagacagattctgtgcccaggtctactgggccagtctccaggcccagggtgtcccatgactggtctaggcctggctcagtgccctggggcttgaacagtacccagcacctgtcacccagcctgacacagagagacctgccagtcagagcacagcagggaccaggaagacagtggcactgacaggcacggggtgccccagtggacaggatgagatatggaaaaggggctagccaggagatggcctgtggggttctgacccttggccaaaggctgcatgtcagggctgccagcattggcagctgcttcttcggctgcctgctgcccagagctaatgagtggggacagagccaggactcgaaggggaaggcgctgcttcctctgtgcatgtggggcaggcttgggatggcacaggggaggtggcacagatcagggccagctagagtcatactcagaggatccttggttttcttagataagcctgagagccctgaccctggccctacactgagcttgaccttgattgtagactgagctcagccctgaccctggtcacagactgaggctggccttggtcacaggatgagctctgactctggtgactaattgaagaagatgttaaaagtaggacaattgtttgaaatcctggcaagaggggggataaagaaggttacagttatcaaatactcaccatacccctgagaaataagctaggagtgtattgtgtgtttcatacagtttaatcgccacccagtcctataattgaggtataatattatcattaaacctcattttacagatgaggttcctgaggctcaaagcatttccatgacttgcccaaggtcacagaactagttagtacccaaaggaggatgcaggatccaggatttcaaaatctaaaagctccctccacctcattctttgccttgatatttcatgccgtggttaccccttttggaaggggggttgttgagacaggatgctaacccagacttccagagaagatgcagtgactagtgtggagacccatcctgggatctggagttctccttcctccctgtctggctgggggccttcagtcaaggacccctgaaggcagggatctgggcagagtgggtggaggctcacaatgactcacaggtgacccatgggcttgtctcagcagccagagggttgggctcagcaaaaataacaataacacagtgacagtgatcatgggatagtcccaggaataaggcagccctcacttgctgatgatgttccactcgaagctcactgcgagctcggctatttacaccctctggttctaacggtgcagtcctggaagcaggctgcgttattcccatgtgatagtggaggaggccaaggcccaggggagaatgtggatgtgtctgaggtcacatggctggccagtgggagtggagcagatgaagatgactattcccatctggccgctggctcctacagaagccaaggctccttctcttccagcaggatccccatgggaaaaaagacaagggtggggagcaggcctggggtgaggcctgggaaccagggtcttcatctaccctgcagggcccccacaccatggtttgattttccacccacacctgccccccatgacatcagttcctggagactcagaacctcagaatttttgttcagtgagaacttccctttgtcccagggttataaacacagctggtgtcagtggttgaaggatggttggcctgagaaccatccccagccagaccgaagccataaggattctttccagatgttctcccatctctgccacctggggcccctaaggtgttctcatgcctgaaacccccattcagactcaagaagcatgagttctcccccacaggcttcttctggaatcctgcataacagcctcagagggcattcatgggggagatttggggccatgaggcaggccagagggggccttcctggtgtcctcattgcatcctgcatgggctgtctcctctgcttactcctgagcatgggcagagcggctgacagcctcctcctccctccctggtcatcatgagcagccaggaggcttggtgatccctccagactttatgtagcttccctctccctagcctggcccccgtgggtcccagggtcacatgccacagggtctagcttgtagtggagtgagggaggccattgagcaggggctggggctctgggcaccgattaggctcctcctacccctgtgtattccctgattctgtcatccttccatgcacacacttaagtttccagcagaaggagctgccctggaatcccgttgatctcctcgttccccccctccttctctgaggctccccctatccatccagaaacctgtgagatactgaacaccattatcagggagaagctgagctcagagatgcttaggggatgtgccacacagtcagcagcagtggagccgggagccagaattcaaagtcaatgtcttcagggccaatctacttatgcaaatcctgtagttcctggcatgtgatgcaatagagagaggaagcaactgtggcaaaccagagagcacctggctcattcagaggagtagcccctgcccgtcctactgatctctacatggaagaatgagggcatgggttgtcaaccctcttcatttttgtttatgtttaattattaggtttttttaatgtgtagagatggggtttcactgtgttgcccaggctggttcaaactcccggcctcaagtgatcctcccaccttggcctcacaaagtgctgacattacaggtgtgagccaccctggccagcctctctcaattttatttattttatttttttattttttgagatggagtctcactctgttgcctgggctggagtgcagtggtgtgatctcagctcactgcaacctctgcctcccaggttcaagagactctcctgcctcaacctcttgagtagctgggattacaggcgcgcgccaccactcccagctaatttttgtatttttagtagagatggggtttcaccatgtttgtcaggctggtctcgaactcctgacttcatgatctgcccgcctcagcctcccaaagtgctgggattacaggcgtgagccactgcgcccggacgcctctctcaatttttaaagagaaaccagaaatccaaatgtttgtgtaaaatcagccaagttttactttcaggccaaacacctctggtcagtgaggatctctgggcccctcattgttcctctcctgaaccctcaacccaactcggacaccaccggtgcctccagctttgctgactggtccccctctgccaggggagtgacctcccaatggctgtgcatcctccacacatgtataagtaggcattctcctttcttgaagccccttctttcctcgcctccaggacaactccctctcctgattttctaccctgtctctggccactccactgtgggatactctttgtcccagtaccctgcgaatgtcaatgctcctggctcagtccttggcctctcctctgcatctctaccctccttcttttttttttttttttttttgagacggagtttcactcttgtcacccaggctggtgtgcaatgatgtgatctcggctcactgcaacctccacctctggggttcaagcaattctcctgcctcagcctcctgagtagctgggattacaggcgtgtgccaacacacccggctaattattgtatttttagtagagacggtgttttgccatgttggccaagctggtctcgaactcctgattgcaggtgatccacctgcctcggcctcccaaaatgctggaattacaggtgtgagccaccacgcctggcctctatactttttaagagatcccccctcacctaggcatccccctttccccccatcctgaaagccccagaatccctggatccagccctctcctgagctccagttccatagacccacctgccaatatacgtctccactcagactcagccttcctcattgatctcctcatcctccctccttctcgaaacctgtgagatactgagcgctgttatcagggaggagctgagctcagagatgcttaggggatgtgccacacagtcagcagcggtgagccaggagccaggactcaagcccacgactggtgagcctgaacacaaagctgtctctctggtcttcagcaagcctggcctgggaatgctcaggaggccctggggttttatccctgggagggcaggctgtggcctaccccttccctgttcccatacaaaggtggggacagaggagcaactggccctgagtgaggagaggagctagtgggcatggccccctccctctcctgtcgacttcccagcggtgtgctcctgcggtgccctgtggcgttggaggagtggggcctagggactagccggggactgtggcagggactctcaggatggtcagtgtggctaacaaaaccagacctcgatccctccacagcaccctggaatgggacagagagaccaggggccaggctggaccgaggcgctcagtgccccctgggcctggagggagcccagttcccccactttccccccacagctgggttctgcttccccactttggggacacgctcttgggacaggacttgggatctgaaccctcctcccagccaagagctatttccaggacagttctgaggagctgccactggctcagcagcctgggccagtgagttggcctggcagagcttgaaaggaggggctgccactgtcccacctgattttccagtggtctgtcccttcttctttctttcagcaaacacctgctgggccccactttgcccaggcagtgggaactgagctccagcagcgacaagacaggtccctgcccttgaggggtgaacagtctagtagtggtggtgagggtggggaggcgccaggaatcataatgctgtccccactcactcatcctttgcccacagtctcccaggaaggcggccatccaggctccagtcgccagcactagggtatcggagcccctcaggaggctgggctctgtgtctgagccagggagtggccccagacctcaaaacgtggactgaacaccacacgagttaagcagggaatgagaatcagaatgacaggaatcagaagagtccggtgatttctgtgaggtcaggaagttcgactttatgtctggcccacgttcctcctgccctaaggctgcgtacgggagaaagggggtactcgaaagagtggctgttcagagtgaccgaaccattgagaggattccacgtcctggcaagtcctgctgggttgctcatccaggcccacaccttccaaggggactgtcattgcctccccataggactgtgatggtgactgacaggtccacccattgcggcccaagaaggtggctcccagggcccctcaccagctatgccacaggacaggacacggcatgacactccaaaggctgacagatggtgcagacagcggcccttcctgaccctgcatcgcctccagcctcaaaaagagcaaaaaagtatctctggaaaacaaggaaatccccttcccagaagagggtagaaggtgcaacaatgcccagaacaccggcacttaagcctgactttgggccatcacaaagctctgtgggctgtggctttctccttgtccgccatgggtggaaaggaggggtacccacacttttggatgaagtgtgagtagtggtggggtggaggagcagcatccttgtttgacaggaagatctttgcctttgctagagtgcttctcagagtttctcggaaggtgccctttctttttcccagagcagcccccatgccctgcaggcaagggcaggggaagagctgggccctcagggactgggagctgctggcctccagttggtgccctccttactccagagtcagttattctgtaaactgaggcccacctgcagtgttgtagcaccatcaggaattagtgatgcttcattagagtccaattaataaatgaaacccaggatgagagtccctcgcgttgctgagaataacagccctgctcatgccttaagtggcagcctcctggggctcaaaacccacaaggaccagctgccctgccgtcagcatggggctgggggaggcggcagcacagactgggggccttgtcaaggctgttgtctggtgaagcgggggcgagaagagaagggagcttcagcactgactccctgcctcagatctcagctcctcctttgaggagtccctgggcacaaccccctgcccagcaatcccaggggagcttggctaaggccagaggtgtgagggctggggctcttccctcctgcctgcctggcttcagaagacactgattgtggccacggcaaaaaggggccttgagagggactcgggggagaaccacagcctccctctcctgactcccccaacccatgctccgaagtcagcacctgcatcagccaaacagcccccctcaagcctcaccttctctcctctaagtggaaagatcctccaatctatctgttcaagccctgccttctccaggtttagggtcagaaacacaggaacccagactttggccaccccattcagatgactgtctctgcagaagccaactccacacctcctgttgcataagactgggctcctggattgggaagaggtcactgggtttttcagagcttccaggagtggaggcaggcctagcctatggcctgggagtctggcagcctcttggacttctggaggatgggggaggcaggcctccctggctcagaagttggcatggaggaagcaggttgaggagaattgccctaccttctcaggaaagattgagacccaaccattacaccttgacagctggcctgcaggactgccagttccctcacctccctctcagtttcccaggtgagccagcaatgggttgtgatgggccaggtcaaaggtgcccaatacctcctattccaccatccatccacttaaaggtctgctccttatccactattcccagtgcctgcctgacttccccagtgccaggggcttctgggaacatcactctagtctctcaggatttacaagcctgcccagccaagaccccagcagccacagcagatctgagtcagggccctcccctttcctttgctctcttggtggctgtcctgggattggcactcaaaacaaaccaggccgcctgtgccccagcttctaaagctctgcccaggaggcggccaggtcttgactattgttcatgatttgaggctttgagggagccagaggccaacaggacaggcagggcaggtgggggaggtgggctcaggtgtgaatagaagaccccagaggcagcctgaggactgggtaacaagagtgggtacagtatggtactcacacctctctgggcagcctttgtgcacgtgcatgtgtgcatgtatgtgtgtgtgcatgcatttgtgcgcatgtgtgtgcatgtgtgtgtatgtatgtgtggatgtgtgtgtgtgtctcctggagtgagggggaaagcggctcatgagcactcttgctttctgtccatcaaatcccatgcttttccgatgctcatttcttccactcacagctgcagcccccgggaaccagatgacatattttcccttagtcatgaccttgcagaaggaaagcaaagtccttgttccctcccactcacagctgtgcttgagcctggcccccttacaccctgctggggtgggggccccaggaatgcctagctggggactggagtttgtcaaagacacacacacccttccagcagcctggagggtaggccaggttgagggaggtttatgttttcctgcagcttggtctcagggctgctgcactctaaacccaactccagtcctatcctggcatggctgcccatgctgtggctggattaaatctggccccgagacagcaggcaccacccactagctcctcctggccctggatgcctggagccaacgggtccaagtcaacagggcaggtctttggggggacagggaggggggtctctccttgcagacagcctgtggagaggcctagggaagcaggtcttggtgaggtcccctgggttctaagactgcattgggagccccgagagagcctggggacctggaactcagccacgtgcccatctgcggggtgcagaatggggctgggagcagggagtgagctcatcccctgctcctattctgtgaagaatcagaggcccttcttgctctccagattctagaatagcatcaagacccggaggagtcagctgtgccaggaaaagccattaccccgagagcctccctccacctgctaaaagcctcccccttcccctggggcctccccctcccacccagttgctttatctgcactcacctagccctgatgaccttcatattagatggggcagggaggtggggaaaatagttgcttaactctttctctgctggaggaaagtcagcacctgctcccttgccttgccccgtcacctttacccacctctttgcacctgggaattcctcctgccaccctcccaggagggttgggaggatacgaggacagtagaagacaggctggcatggggttcaatctgaatcctgtcactatgttgcctgtgacttcacaccttcatttgtgtcttctctgtgcacacagagccacatgaagatccctgggaatcccccaggaatgtgtccatgcaggtgcagttttgtgtccagctctggggttgacatctgggtgcagaaggactgacttcttcctgacacacccttggcgcttctgcttttctgctgtttctgtgcaggtccctgaggagggaggctgtgaggccttattgtgcactaactatatatctataagtagcagatcgggtggctgggtagcacagggaggctgctgagagcctgaggtctctgactttgctggggcagctgtcaggagcgggagcctaggcacagagcgtcatgggaggtacttagattgcaccccttggtcaagcatggtcacagagccggagggaaaaagggacccgagggtggagggagcaagctgagcgccacgttcctgccaggcttctgccttccctctctagcctggcagcctcccacacaccactttgcgggtgtgaggagtccattctgcagagcctgcaggggtgtgtctggatggacgctcatctgagaaggactccggctctctgggagatgccccttctcaccccagcttgtactcagtgctccttccccttcatgctgccctcaggcaggtcctcttgcaaaaacacccaagctgttttgtatcacaaatgagggaataacatgaactggggctttctggatgccaggagctgaacatgctttctttccagtccttataacactctctcagggcggtactattgaaaaaggaggaacttagtaggtgcagaggggagatgatctcgccaggataaacgcgggctccaaacccagctctgaatcattcccaagcctgtgctctttccaggattccacaccttggcccgagcagccagacattcccaattgtagacccagaactgggggcatgatggggaaaaatcacgccacggcaaaggggctggtcacaggagggtcaataaggctaagctctctggtgctatggggtaataacaggaatcatatttatattttaataatttaaggtactaagaattattaacactttcttggtacttagcaatgtgccaggcactacacatattcattcgtttccttcccacaaccgccctgcaggctgggcaccgttagcatctctgttttatagatgaagaaaataaggcaccacaggttctgtaccttgcctaacatcacacagctggcacggggtagagctgggatttggaacccaaaatgcccagctgcagggtccttcttacaatcactgtgtcatactgcctcagtcaaagcacagcaggagtcctcagttgacccctggaacttggagatggaactcctgcaagcatggtcacccacagaagaagggctcctgcaagcatggttacccacaggagcagggctgtgatgagtgggagcaaggagccaggtcacagcgtcacttaagtctaaagggcagagggaacagtgagggccgggggactccagagggcttcttggaggagaggaacaagctgggctgggaagaaccatgttggtattgctaatgcacagagaaggtggggtctgagccaactggcctgccccacactccctttggggtccttgagggtgaaacaagggctggtggggatgacgtctttgttcccatcctggggtaccattagtgcgtcttgcctccctccgcaaggtgtgtggtgtggctccccctgctacaggatctctgggatgattcctcagcccatgactgctgcagttaatggagcagcgctggggatggccctggcctagtaacctcttctacagaagaagtattcactctctccctgagccgtttgacggctctggatctccgatatctgtggggtgcactgggatgcagagggcccaagcttacctctcaccttatacagcctggtcctgaacaatctgagtgcttgagggctggaaagccctttccaccaccccctgcccccaggcctggacccagctccaggtttccagctccaggggcccagcccaaggccctgcacacagcaggcatctcagaaggcagcaggatgtgcgtgcttcattgcaagcatttagaactgggattgccgggtggagcctggaaatctgggccagaagtttagggaaataaggtgaagaagagaggacagccaggcggggcatcgcacagccactctgcccagaggattcctcccaccgaaacagaacctagagaagagggaggccatgcacacgggctcctgctggagagccctccctggcaagggctaggaagtcaggcgggcaaagcatctaccctctacccccatccctacccctgccctgagcctctctaagtgagaggcttgtgactaagtgaaggcctcagtagtggccagcgagacagtgtggtcacctgggctggcaggagagctgggggagaggcctgggatgacacaagtgtctatgcatgggacagagctctccatattctgtccacctttcactcagatttatggacagtggagcctgggatggggacaagcagcagacagaacccctccctttgactcaccctgcccctgctctccccaggaaaagcacatctgaggaaaagaacaatcagagctccaaggcagtcacatctgtgacctcagagcccaccagagcccctatctggggggacacggtgaatgtggagatccaagctgaggatgcagggcaagaaggtaagcaggggctgggcagggccggcatgtgcaggcagggtgtgaacacagccaaggacttagagcaagaagcaggctccctctcactgcagctggtagccacctgaacacctccttgggctcagttaaaagcacttagaaaaaatcataatactgtcacgcctcatctccccatcctgctcgaaaaatgagttgttccacataaatgaattttccagacaatgcaagcttatcttttttatgactgttgttattattttcatggctgttattagcgctgtctcctactgaaacaggacattacagcttcctggcacgtccccacacatcactcattggagtcaccacctcccaggaggagcaatgctgctcccattgcttaagagaacatcgaggttcagggaatttaactggcttaagcttaagaccaaggaccaaggactcagcattgcatgttcttactgcagctccagggttcccgctgcttccatttgattttttaaaaaatatttgaaatgtccctagaatggatccctattcctgcctagtcctccccaggtgtcagcctgagccacgaggtgcccatgtacacacatgcatgtgcacacttatatttactttcacactgtgggtctgttggatttccattctcctgggggagctcaggctggacacaagggaatactgattggctgatgcccgggtaggggggcatcgcatctggcactgccagcacagactggaggtgcctggcgatgtctctgatcttatctagtcaggacctcagacttgcttcttgcaggtggtctctccctgagaggacaggctttgcctctcccccttgaaatcttgccaggacctagacagatctccttgttctcctcacacagagcagaaagccagctgaagactatgggagaggagaaaggaaacaggaaggggagcctccgtaaaaggggaaggagctagttctaggtcaagccagataatttttcttttctgcctgtaaagggataggtggagctgttgggatgctttaagaagatgcaaaagaggaggaaaaattgacctaggatttcatgcagaggcacatgcgtgcctgtgtgtgcatgtctttgtgaatgcctgcatgctggttcatgcgcatgtgtgaatgtggtgtgtgctgtgtctgtacttgtaggcatgcatgtctgtgtgtcttatgtgtgtgtgcgcgtgggtgtgtctagctgcaacagtgtggttatatgtgtgtctggatgaatctggatggtggtgtatgccttgcagtgcacaagtatgtatagatcgtgtgtgtggctctgtgtgtatgcatgcatgtatttatgtggctggtgggaagttagaggttatgatgagtggacctgagctgggatcctgccctgggctctacatacttggggtaacagaggaaaaaatgtaataaggtcagtgaccccagggcccatctgtgcagcagagagaggggcaggactaactgcaggagggacaagagagtggggaggcctcatgggcaggcagggaatattggcaggcatctcattgcagattgaagtagctggatgcttgttggaaccggttgctgtggtgatgtctgcggtgggggtgggggagatggaggccaggccaagaggcgggggaagggtgggaggtagctcaaggatgtgttaatgaaaagcaaaggggagtttcagaccctgtgtcagggccaaagcaggcgggtggcagaaatagcttgttggccacacaaagggaacggtgggaggccggaagggcacaatgcccagagaggaagctgatgaagtgtgtttgtagcatggagacaggagcagggaggagtggctgtccattacccccaattccagctcatctgctggctgcccacacagagctccaggaatagcgggtggggaaaatgtacggcactcacctctcgttcaaccttggcaaatcccaactggatctggggactcttggtccatggcgagttggcataaggggcttcagcctgcacagctcctcgtggtgctttggctgggagcactggaatctcccagttgaatttcctcaggtctgcctacatcagggtttgtgtttggagagctgcagatgcttaaagagaaggaaaatagtgacaaccacgaggagcatttgcacagaatgttacagcttgaaaacacactcttctccctacaacaacccaaggggagagacaaggctttttattaaagtgttgacattttgaagagcagaaacatgaagttcagagaggttaaattacttgctaacagtcacagagcaagttagtattctggtactagaacccaggtctgctgacttcatatcccttacctcaatctcccttcttcaagccaacctcaacaccttcagtgccctctcccccttctttcctttgagcatggatcccatatgacaagctcttgagataccttggcaagtgttcagggtcgctgtggggaagacagagaaagaagaatacttaataaagccctcagcttccttctccaccccaacatccaaatgacccatccagttccaaatgacccatccagttccaaatgacccagcggctgagcccgctgaacctgctgagccctcaagggccagctgctgtccctggtgctgaaaccccttgtctcaagagaagcagagggcaagggtctccccaagtgtttccctcaggcacacccctccgccccatcctccctttcctgttctctgttttgtatcctttcttacctcatctctctcattctttctccatccctcctctatccttctcctccttttctccctccccatctcttcttcctcctgaaatcatagacttccagaatataaagatgcctcaagtgtcaccaaattcaacccttcctatcatctactttctagatgtgttatgttgatcaagttatataaccctctgagctccattgttcatattttaagaacagagatgatgatacctacccggggggttgtggtgagaatttgttggaatcatggctgagacatgcctggcacatagtagatactcactaaataatcatgacagtcccgctcactaaacaggactgtcatgattatttataggacattggtgttcttcttaaagtttttaccggccgggtgcggtggcccatgcctgtaatcccagcactttgggagtctgaggcgggtggatcacttgaagtcagaagtttgaggccagcctggccaacatggcaaaaccttgtctctactaaaaatacaaaacttggctgggtgtggtggcgggcacctgtaatcccagctacttgggaggctgaggcaggagactctcttgaacctggaaggcagaggttgtagtgagctgagatcatgccaccacactccagcctgggtgacaaagtgagacgctgtctcaaaagaaaaagtttataccaatattcatgccattttatgagaaaatatagtctctttggagggtgtttactaagtggtgcattattcttagtatttagactagttttcccttacttgtagtagacttttattgatagctgtattaaaggatttccttgagcagatcactttttcttactgaaattcagtttccccacctgcaacatgtgtgagataatctctccccatcctgcctcaagagctggcataagtgtttgtgaccaagggaaagagtcttattcctggaaagaggtgctatgcctgcttgcctgtgtatctcagtgtgtgcacatgtgtgtctgttgccacaggggactggactcagttctgtgtgtgtctatctctgacctgggagtttctagaccatgggagaaaattgcatgttggggtcctaacagctgccggcatggagctttgccctgtgcaggggctcagactgtgcttgtgggtttgtgtgcacaggggtgatccacacatgtgtgtgcatgttgattcctcagtgtggcccctgctccctactctcaacaatgtctctcacctctcactgtctctccttactgggagagaaagggatccatttaaaaataaacctgggctcattttttctctttccagatgtgatcctcaaggtggtggacaacagaaagaaacaggagttgttgtcctacaaaatccccatcaagtacctgcgtgtcttccacccctaccactttgagctggtgaaggtgagtcagaggcctggggaagtgccgggagagcaggtgggaaccaccttgaatgtccccagctattccctcggagcagccctgagcatcccacacccacccacagcatgacaagtctaggaccatgtggggctcaggaaacatggctcctggtacatacacaggaatggtgtctacaagaatttggaattctccaaattcatctctgtaaaaacagctgattattataggacaactgccacattaaatgaatataccaattaaagatagattttgattacaaaaatgttaaaagagcggatctaaaaatcaaagaaacacaatatttaccgagtacccgctgcttgcacgccctgtgctagacatttcacaccccctctctaatcctcaaggtaaattacattttgcagacatgggactgggacctggggagaaaaatctcctcctcctgggtcacagagcaagtgagcggcagagttgagggtgagcccaagtcatgctgtctcccaagccagttccttctgagctgcctccacatgctgccttggccagaaggcccaggagagttggggggtacatggaataaagcattccctggaatgcacccctggagtgagcaactgggtccaagccatggactgaggggcctgaggctcctcactccaaggttgggcctcccaggccagacccctgcctgtcctccctcctagtgctgaagggtaaggggtagaattcactctctcattgctcaaggacttatgaagcacctactatgtgccaggtagtgagccagagatgaacagaagcatcacattcccctccccactgtgcattccagaccctgaaagtggttgagagtaaagaacaatgtgaagccagactgtcgggggtcctagaccaagtttgttgcctcctagctggatacccatggaagccacttggtccccaggcctccatcctcactggcaaagctggcacagtcgttttgaggatctcaagcaatgataggcaaggttcctggcatacagtaggtgctcagtttggtcagttaccctcccccatccctcctccgggccagcactgaactttcttctaagcatttcttcaatcatggcaccagggggctttaccttctcttaggccccatgaggaaccccaatcccagggcttcaggatgggccatgcagggaagtaaaagagagatgtgctactcaccctgggagactcagcacttgagctgtaattctgggggcatcacccaggccccctggctgtctgttcacttacaacccaggccttgttatcacatctttactggaaagcagacaggcagtggtccttgtgagggtgatgaaatattcaaatggaaaagggaagatttattatattgatctccttggaagggctcacagggaccatgagctttaattatcagctcggagccccagcggagcaatgccaagtgattgtctgcagagggctggatttatggccaggatctgccccttagacactctccttcctctgtgtcttctgccccaaccctgtctccagcccactgagtctgggaaagccgatgaagccactgccaagacccagttgtacgcaacagtcgttcggaagagcagcttcataccccgctacatcggctgcaaccacatggctctggaggtaccagggctggggccctctggggtggtggtgggggtgggaaagggccaagctttgagcaggccccacgccttgcccttagccccctctggctgacctgagggtgtggagcagagatgtcaagaatggaaaaagcaaccaggcctttccaaaatagcaaaaggagttgtgaagacaagccctttggcagggatgacaaggatgaagatgctcaagcctcttctccttccctctctgtcttggaggtggcggggaggggctcagccacactgctgctcctggtgtaccgtctctgtgctgcagtggggaccagagcctgtctccccgaatcttatgctaggggcaggggagaagccccgtgctccccctgagcccacagcccagcagtttcctgctctattcttcccctcctgggatagtgccttggcccccaagcaaaagtttagggcctccttgagctttccttcagcactgtgtctaaagaggtttgactggtctggcgattaggtatttagtttattcattcatttattcatccagcaactgtttacagagcctcttccattagccaggacagggctgagcccaccttgggcctggccactgccccttgacccatcaccatccaccccctaggccaattagcagctttgggaggaactcttgatgctcaaagcagacatgatgcagggacctggcccctctcccattccccccaactttcaaactgcccatgggtgacagattcaaattcagctatggcctgagtatgatcagggtgggagccacaggacccaagctctgagcttccacctacccaaacatggctgatctgttcctatccttcccacccccctacttcccaccagcaccgtgggcctggcagggaaggaagcattcttttgccttctttcacagccagggacactgagacccaaggggagtatggtatgggagccaaaactcctaacccacatttctactcccctacagccacccctctgatgccagcatatcagacctacaggcgccctctgctccccgccaccttctatcacgccctttcctgaggacagccagcaattcacacacacacagaacaaggaagaggggcaacagcctggccttgctgtccccaggccgcaccccacagggaggaggccacatccccaagacacaggcagaactttagggctgctgtggagctgccccaccccacccagccctctgacttgcctggtagagcggtagagtaggggccttctctggctcacagcaccctgcccactctcctgccccagcacagatgccctctccatccgtgcgacaggtatggccacagagcagctgcctgctcctgatggtgagcgcatggcaggagcaggaacttctgctacttcccaggctgtcatgagcaggtgtacttgggcagctgtctcattcacacctgatcagagtccacacagaacaggtgcaaattagctgccaccaccccctttttagtcttacacctgctggggagcctgtgagcaatagggcctgccagcctccagtgaaatccctcagccccagaccccagacccatccaaagtgtgaaatgtaccatcagagattcaatcctttgaatgtgatgaagggattcagtctccagagccctcagtgagagctgcgaggccctaaggactattgtacgtgcccatcagctcacacctgtgtggggttagaggtgggaaaaccagctgagatgggtattgaaagaggagcctgaaaggagggtgcggagggagaaaagggagaatgatccagaacaagcctcactcctgggccctcgccagccacaatgggttggtgggagctgcagggagtctgagtagagggatcagcatgtgcaaagaccctgtggcagaaataagaggggtaagtggcaggagtaaaagagtctggagcaagaagacaggggctgggggcctgtcgggagacacggcagaggggcttgtggggtgtcgggcagggaataacgtgacccagttcatttttaacaagagcacttttgccatcatgtgtcaaattgcctgggaaagaggatggattagggaaaggaacagaagtggagaggctagtgaggaggcagaggaatcgaaggagcaagaggaatgagagccgagtgggaggtgggtgagggctgagggagagtgggagccattggtggatacagggtgagggtcagggtccgggagatcagggcctcttaggctggcagcagaggcgcatggggacagactccctgtctcccctgtctgccttccagtgtcccccaggcccagactgagcagggggtcagtgagggttggagcaaggtgacgctgtccactcctgctttgtaacctcctgctgggaccccgctcggctctctgaaagctgcgccaatagaagcctggagtagaggagagggcagtcaggactgggaggcagggaagcctttagggggtgacagaggactgaggagggaacaaccaagggcggtcaggggagtgacaaccgggatctgatgaagaaagaggagcccagagatgcggatgctatgatcctgttccaaaccagtacttcctggggaaaccagcaaggcaggagagcaggcaccagggtgagcagtggagcaggcaccagggtgatgggcacgagggaggcaaggggagcctggctgtggccgctgatctcaggaagttcagcatggtcggagaaaccagacctgggcttcctgtcttcagtttataaagtgctctctcacaaacgatctaatcagagacccctcacagccctgggaggagcctcatttgactgacagaaaccaaggagctggaacacctagccctacccctagcccaacccctccccaggagccagtggaggggccgaggttagaacacaacctcccttcccaggacccaactctcatcgtaccctttctccccaaagaaactagtgtaagagatccattggtaaatcccaggacagaaagcgggagcagttgcctcagctcggcagagaaggcttcctgagggagggcagcctggtgcaaagcaagaaccgagtaaggcagggaacagggagaagcaggtgtcaagtgtggaggcagccatgagctcacggatggggaaaaagagggtaggcagtctggctggctgtctctggaaggtcccaaggccacatggtgttcacctgcctcctctcctctcctctccagatctttctccggggagtcaacgagcccctggccaacaaccccaaccccatagtggtgattgcccgggtcgttcccaactacaaggaatttaagtgagtggggcccaggtggacctgggtgaggagggcagagcagagggcagaggagggggtgaggctgtcattgctgccatgggctgattccaggacctccggcaacccctctacccctaaggcccttcaagcctctccattgggtctgaggtcccagtaagcttcctgcagcagaccatgcctttctttccccagggagagcccaggcccctggaaaggggcagctcagtcctctcctgagagcaagctggagggcaggtggtggggatgagtgccgataccaggcctaacagctagagagtgtggggaggacaacaagaggggtcctcattccctgctcagggaacctcagcccctccaacctgcctccctgcctcacacccaccacctccccactccccctcccactctagctcagggccacaggctccagccagtggttggccccaaaggccatcttggaacttcacagcctttagccctgccgggcggagtctcctccctcctcatcctggaggtctccctggtcccagccacaactcatcccctcctcccctagacctccttttgagtctgttggagtcacagtcctcaagaggagattcatactttgccacacagtgggaaattcccctatgaacgtgtgctctctgccacagcaccgactcctgggagtcagggtctgtcttggtcacttccaactggccctgatggcccaagatgactcccctacttctctgtatctcctgttgagtttttatgacttatgaagcccccttgcttgttggaggaaggaagatgattgatgcacgcccagcccagtggtccccacttgtcgtgaggtccaggcccgaactcggcgggatccctgcaactcccttctcttgcatcaacccagagtctaagcggggggccctgggctgccaggctcaggtgcagagcccagagcactgaccctgtctccctgcctccccagggtcagccaggctaacagggacctggcctctgtggggctgcccatcaccccactgtccttccctatcccgtccatgatgaactttgacgtgcctcgcgtcagccagaacggatgccctcaggtatgtctcctccccagtggttccagcttcctgtaactaccccacacattcactgttcactcactcagtgagtcagtcagcagttcccttgactatcgagtaagagttgactgaatcccacggcatacccagtgctgtgctcgcctgtgcggcagagaaactgccctccaggaactcttggtctggtgaagatgggagtcacgtgggtgaaaaagttgaacatcaacacaagataatgtataatctaataacaaactgggagggcctgtcagggctatcacatcagaggagaagatacaaaaggacaaatatatgattccacttatatgggatacctagaataggaaaattcagagtcagaatgtagaacagtggctacaggggctggggaaagggaagaatggggagttacaggtcataagtacctagtttccgtttcaagtgatgaaaagtcctggaaatagatagtggtgatggttacacaacaatacgaacaaatgaatgcatttaacattaccgaactgtacattaaaaatggctacaatggtgaatgttgtgttacgtatattttaacccagtaaaaaaattttttttgagacagagcctcgctcttgtctcccaggctggagtgcagtggcgcagtcttggctcactgcaacctctgcctcccgggttcaagcaattctcctgcctcagcctctcgagtagctgggcttataggcacatgccaccatgcctggctaatttttatccttttagtagagacagggtttcaccatgtcggccaggctggtctcgaactcctgacctcaggtgatccacccgctttggcctcccaaaaggctgggattacaggcatgagtcactgcgcccagcgaaaaattttttttaatcagaggagagggatgtaaagcctggattagggaaggcagtcttgaatttttttttttttttttgagacagagtcttgctcttgttgcccaggctggagtgcagtggcaccatcttggctcactagcaacctccgcctcccaggttcaagcaattctcctgcctcagcctcccaggtagctgggattactggcacccgccaccatgcccggctaatttttgtattttcagtagagatggagtttcaccatgttggccaggctggtctcaaactcctgaccttgtgacctgtccacctcggcctcccaaagtgctggaattacaggcatgagccactgcactcagccggcagtcttgaatttttaacagaggaagggttggtacaggttggacacagcaatagcacaagtgtgaggtggagacaggcaggctatgacccatgtcagggcagacaggagggctgtgtgtttgagtatgaggttgggggcgggtgcacgcacagaacatggctgggttcaggggaatagccagattggtctcttctcatgatctgcgcttcactgccagcttgccctacacgatggtcccaacattcctaggggccttgggggacagagggatttttggaggtccctcctattgtctgcccaccagtgcttatgtctggcatagcaaaaatagaacaagacacccctttggagcccaggcttcatttaaaggcaaagacatttgaagaaggctcagacatggggtagagtgatggtggtggggaggagtgggacaaagggggaccctggggacagaggcttcaaacccaaaccaatcctttgcctgatttccctagagttacctcacacatggccctgcatttgcccagaaaattaagaaccaatcagcaggctgtcccaaggggcaagaggcactgcctgctttaatgagtgtgccccctcccacccccaggctttctctggctgcctttgctgcctaactagtctgggtaggagaggtgccactcactacagagacttgttcccagtgccttttgcatgtgtgggacccggtccagcaatggcaggacacctgttgaacatcacccaaccccatggcagctgggccaggttgggaatttgctggcagctggcacagaggtgcccaggtgcagcagtgagagaacaggagcaggctgctgtggtaaggaggggtggggattgcccgggcagagccatacctggaggggcaccagtcagcagcgtgagctcagtcttcacacagacccctgccctgttccctttgagcgtcagtcccctcatctctacacttgagggggtgggattggacttggtaattttagggcctgccctctctgacatcttggggggctgtgatttctcaccaactgtcactgtgcaaaagcactgtttgacctgggtttgaccccagctctgtaacttactggctgcatgacctttggtaagctgctcctttctccagactcattgattccaatctgttaggagaactcaaaggataatctttgcaaagtgtccaggcccagggtccaaggtaaatgggttccactcttaacagagctgtacctcccctagtgccagtgtcccctctgaggccagcctcaccactgcccttttcacatctggctccaagtaacagaaaccccaacttggatcggcttaaatactaaggatatttattgtcacacaccacatcaactcacgacatagaatgctgccagaattggtggatgctcaggctcagaagcatcctcgaggtctcaggatctttccaacaccccgaattaccatcttcagctggctaacggctcatgggggcacttcatccaaatagaatgaaagaccagcagataagaggcagcctctctttttttttttgcgaccaagtctctgtcccccaggctggagtgcagtggcgcaatcctggctcacactgcaacctctgcctcctgggttcaagcaattctcctgcctcagcctcccgagtatctgggattacaggcgagcgccaccatgcccagctaattttgtatatttagtagagatagggttcaaccatgttaaccaggctgatcttgaactcccgacctctggcgatacgcccaccttggcctcccaaagtgctggaattacaggcctgaggcaccgcacccagcagcaccctctcttcttgtaggtggttttaaagagcaactggaaaccaaccttacccagccatccctcagcagacctccttcctgtctgattagccaggattgggttacatgcacttccctgagccaatcactaaggaggggtgtggctctgccttgctggtataaatgtggaaggttatggaggcggagccacccgaacccaagggccatctgctggtgatgaggcaaggaggggcatggtggtgggctaggtggccctcagtggagcctggtgatgatggcaaaggctgaactggtgagttaaggggtagatggcctgtcggacttcacctggtccagcctgctggaaccaacatagggtgggccgtgtaagttactcctaccccggcaccttggaaggggcccattgcccaacaggctgctcctgttgttctggtctcctacagagctggagtggagctccgggaagccatgtgtgcccaccaccatcccctcctctctcagccccacagctggcctgtccccaagctctcctggggccccttccatccccacagaccctgccctagtgctagcctcccctcaggcccctgccatccattctctgaggagcagccagggcatcccctgcctagcccttcccctgggccccctgttactatcacgacaaggcaaatcccactctcagccaggtccacaggccctgtgccctccagcctcctggcttatggctccagctcatacaggcattctgcagccccactggacagcttgctgttctccacacccacactgccccttcccacctccagcctccacctctgctgcactcgcagtctggaatggccttcctcttccttacctactgcccttgtccttcaggtcctccctgaggaatggggtcagaagtcatggctttctcctcgcacaccccagctcccacaaccacagcttgcttaggactctacatgtttgtgtgtgtgtgtctgtctgtctgtctgtctgtctgtcccctatcctcctggatgatggtgggctacagggtcgggggcagagtctggctctacagcaccccacaggcatctggaatggagaagccccccagagtcaacatttgctgagttcagtgaagttgaacttacatcttaatagcaaaacatccattgtctcctttaaccttacaacaggctttcaaagtgaggagtttgaggcatatccccatgggatgatgggaaaagtaggtcccaaagaggagaagggacttgaaggccacacagcaaggttgaggcagacccagacccagagccaaggggtcctagatccctagagaccccagcccagcatctgctcccagcagctactcctccagatggcggccactatgcctgggcagagcaggcagaggtggatgtgggtgggcccaggggaaataaggcggtgggcgtggaggggccatggaatgaaggctctgtccccaggggaagcaggtctgcctccatggctgggggttaatggcttttctgaagatcacagctgagggttaatgacattccataattccactaccgctgtggcccttccattagcatctgcaggcgatgcctgcctctccccgcccccatcctgcacacacatcagccacagtaccctcaccagggctctggcgtcagactgcaggtcttctaactttgagttcccaccactcctgcctgcacatgcacaagacaggctgaccctccctccccagtcctaggtctgaagtgatctttcctaagtgacttgccctgggaaactactcagggaaagggctgttccttattgggccggcagccactcaccacctctggcttcataggctccatttagacacatgaataggtcccagaaagggcagctagcgtctactaaataaccctcttccagggtaggagcaaggtatggacggcaggggactgagtcacaggtgccccaatgcctggcagacagtcccagccatgtggaccctcctgcacccaggagaatggggtgactctgggagggacatggtttggggatcaatcttgaaagatcactcccaagccccacagaagtcagaaccaacttctctcaccggacctgttggccaagctcccataagaagtgggatgttcccatcattgcagtctctgttcaggtgtccagggcaccctagccctgcagtgactgcaacccatctccccaggggcaggggcagacacagctgagccttgggctgggcctggacaaaccaggcccattagtgtgaccgtcatcagcaccctgccactgtggggaagtggacctacactgatatttcatgatcctgcatcaataactcctggagccgcagtgcatttgtgctgaccttttcgagcaatgactgattcctgtgggggagcaggaggtgggagcggctgctactgttgctgacagcccctggctggggaacagaggcaaggcagccacttggtgggtctgtagcaacgacccgcagccccgccctgtgctgggaccctgcagggctgcctgctgggagttatgggccgatggccatctcccatctcccaccttctggccttggcagatgctgggcctccccctggagtctctcctcatttcaggcgtcctctgcacagggtgtgctcagtgccactccacatttttgattgtgctgttttcccatcctgaagacctttatccctctcttcacccagccagaccttccttcagagcctttctctggttctgcttcctttaaggaggcttttctgaccacccatgggaatatttcatatagctctcttattgggcagtgctacagttaatactgtcttgtttcattgtttaaatcatacccatgtgtgtgccctaactgctgacctagggtgccatcaagtcccccgagtgcccactggcccacactgcgggcacacggagcctctgtagtctgcagagatgtcttggcctctgcaaggggctggggaaactgtgtgggaaagagaggggctggtgacacagacagaggtcatgtctaacttggcatctgtgacaccaccagccatgggtgtgaacacagatacaacactttaggaaaacagtttaccaataatgaatgaggtgtcctaaaatacacatgtcctataacccagcaattccattttaggtagttgtactaaggaagtaatttgcgacatgaagatatgtagcagagaacgttcaatgcagtgttattacagggaaaaatgggaaggaagaaatcagggcacttggacatgaacttcatatcctgaagttactcaagtcatgggtaatgagctttctgtgactttggatctgcttaggttttactggcaaatgaaaaatgcaggatgctagaatggtgattatacacaaaatatacacagaaaaaaactaggaagaagcacagttttatgaattattgtgtttatcataggaacacaggagctgtttttcttcttcctatttttctgcattttcctaaatgtatttattaggtgtgtgctgcatttatttgtttatttatttatttatttattttatttatttagagacggagtttcgctctgtcacccaggctggagtacagtggcgcaatctcatctcagggcaacctctgcccccccgggttcaagcagttctcctgcctcagcctcctgggtagctgggattacaggagtcccccaccacacctagctaatttttgtatttttagtagagacagggttttgccatgttggccaggctggtcttgaactcctgacctcaagtgatccacttgccttggcctcccgaagtgctggaattacaggcgtgagccactgtgcccagccagcttgcttttatagttgggagaaacatttgtgacaaatctagatacacaaaaccaaatatctgtgtatgccttgatttgggagaagctgtggcccccaccacctgctcctaccctctccctccagctgtccaagcctgggggacccccagagcagcccctgtggaatcagtccttcctcttccaaggccgagatggagctaccagcttctcagaagacacagccctggtgctggagtactactcctcaacttcaagtacgtgacccctggtgcctcgccagggcagccatgcctcaggagatctgtattatgaaagggtgttcagaccatcccacctctgcctcccacagggatggatggttcccaggtgtccaggcggcttcctaatgcaggcagaggagagctggctgcgttccttgtccacaggccaggacacgtgggcctgtcccatactaggtcttggccccaagctttgttttattgcacccatcagtgatgggggagggctggagccctcggaactcacagagaggggtgagggagatgggcttcagagaccagctgatccacagttttctgcactgtgggattgaagcccccaaagggtagagatgaggctgatgtatataaattcccagacacacagagtatgtttagagttggctttgagttcacaaagccctgaagatgagaagaggatgtatgtgcagggaaaggccaggaggcaggaaagcaggcagcgggagacaggaggactggatgtcaggtattaaaggatggggccgaggtgggggctttggcaggagccctagttgatccttcccccacagtgaaaggcagccagccgtggaccctcaaccagcccctgggcatctctgtgttgccgctaaagagccgtttgtaccagaagatgctgacagggaaaggcttggacgggcttcacgtggagcggctccccatcatggtgagccccctgccctgaactgggcccctagcgtgcccacctggccccaccctgcctcaccctgccccacctcaccacacctccataggagaatttggcttctccagaagcttctgtcaaggcacccaccagggaagtcacccagtctagaagtgaggagctccctggaaccccagaagccagtcttgcctctgggactatgacgaaccaagccagagaaattgcccctgagcaacttgggagacaagtacagggtgaccctgtgagacagtgcaagagttcaggctttcagccagccagaccctgatttgaaccacagttcaaatcctcactgtggaaattcaggcacattactgaaccacaagagtcctcgtctgtaacacaggagaagcatgccaagtacacaatctctgtgtataacaagagagttcagagctcaggctctagagccagactgtctgggtccaaattctggttccaccacataccagctaacatgaccatgggaaaactactgaaagtgtcaatgcctcagtttccttgcctataaaatgggtacatggcaatagcacttttttcatagggttgctgtgagatttcatgagaaaacccatggaaagcacttagagtaagttctcaacaagaatgaataatatcgttaccatcattctctattcctatgccaccatttcccctaaaatacttctggccatcctgacataatagacctcaatgaatgagaatctctctgtcagatgagcctggtagtgccagacaggtctctagaggggtttagaaggggtggtgtggaggcagtttgcgagggcaaaagcaggaggccagctcccacctccctcccaccctcctgggtgcagcccgcaggtgacaccttccagagaaatctagaacagtaggtggggcagaggcggaagctgccctggccagcatggtctgagtgctcccttttcctccccaggacaccagcctgaaaactatcaatgatgaggcccccacagtggctctctccttccagctgctttcctctgaggtaaggctgtgggccaggggagggtcagggccagcaggcacatgtcagtgagatccaacttccttcacaattgctggctttgttcagggacttctgggaggatgggactactactttggatagaaacgtctaagggtgatttgagactccagacaaacgtagagagagctgggattaggaagaggagagttgtgagcagagggccacccagaccttggagtcagcctctgaccaagcccaagccaagtctggctcactgggatcgaggttctgcaagggtgagctaggatatcagttttctattgctttataaccaaattagcagcttaaaacaatgcccatttattagctgacacttctatatgtaggtcccatgacacagggtggctggaatcaagatgttggcagggtcacattcctttctggggattatggggaggaatctgcttccaaattcattcaggtggctgccacaatccagttccctgcagtgccggactcacatcccggtctccttgcaggctgtcagccggggcagctctcagctcctgaaggacgcccacatgccccctcacaatggccccgttcatcttaagccagcaggcatgtccagtccctgtcacacctcaaaactctgacttcctcttctgtcagcagccacagaaaacttttagaggtgcttttagagggattttagaggggctggtgtgataaggtcaggccattctaatcatcttcctatcttaaagtcaacggtgccatgtaacaaacataatcccaggagtgatcagtcatcatattcacgggttccaagaatgagggtgtaaaatcttggaggcccgtttttggaattctgtctaccacagctgggttggtccaaatgtgaagacacccagggctaagccctgcctgctggatgagcctcgatccctctcgctagctacacctggtctcagcccagcttagaccctgctcatttggctgcagtgcacatgccaggcacccgctggactttccctctttcctctcagtggtgctgggatgtgagtagtttaggaccatgaacccagaaagtgtttgcagggactaatgtccgcgccaacccactcctgccttcttcccacgcaggaaaaatatccaccagctctggggtagcacttggctctgtgacctcactcatgaagaacacagggaatcctatggtgtggggtatgaggagtatatctgggttggtaccagcctgaaagtgcctttacaaggcctctggagagggcctgagaccccattagcactccctgctataggtgttcaggattgccctctcaagggtagaagcaacaaaccccaagaaagaggcaccagaatcttggagaaaaaggtcacaaacttcccagtttggagcccaaccctccggggcctcttcccaaggtatagagtctgcctgtggccactggccactgccagcccctccccacctccctctgtctcctgccccttccactgggcatgtgtatcctgggactaaaaggagcgtcaggtgcccctggtcaggggactgactagtgggcccaggcaggcaacaggcaggtgggcagaacagtttccccattgcccaggggctgggcacaaaggtctccagtaatgaattattcaccggagctgtgctaagtgcagaattaatccctttccttccagctggcggcctcactaaattatccctccaagtcatgcgggaaaatgctgccgaattcatttagctgctgagtgttttgatctgggccttgtgattttagcgtctccttcccccaaccccctccccctggaggcgggtaaaaaaccttttagtaatggatttctgagaagaaaggaaaagaaaggggatcaggattgggtgtgtaccaagaaaatagtactagcagaaattcagattctgcagccaagaattcacacacacacacacacacacacaccccctctacatatacactctcaatcacgtgtgaatatctacacacagtcacagacacacagatgtgtgcgcacataccttggcaagaaggatgcacactcttaacacatatgtacacgctctcacatacatgcaaactgacacacagatgttttcacacctgcagtggcacacacggaagctaaatctctttgtagtggaactatttcttggtaaactatctgagaattggccaataactgactccctttgattctagaatcttgaagaccaatttaggagcctaagtataaagtgctaatgtggttaaattcaccatgaagtccttgcagctgcagcacccattcatttattcttttattccatgtatatttgatgaggagtcactgcatgtcaggtagcatgcaaggcaagaagtagaattttggctgccattgtggattgaaatggggagaaggaggggttggcagccatggacctcattttgatttgagctcacaccttcattgggcttggacatggctctctagtgtctgagaccttttggcatccttctccctaagggatggcaggaaagtgttgagaattcatgaacaggtcagatggcattgcagctaaatctaaaggggcccatccccttctccatccctcatcaccaccttcactgcaataccatcattgttctctatgcaactgcaaacatttctgaagcacccacatgagcaattgctgttctggattttaggaatattacactgaagaagaagaagaaaaaaaaacaatcaggccctgtctttctaaagcttgcattcttagcagggagtatggaacagacaataaaaaaataattcatgtcagctaatgataaagggtctgaggaaactcaaacaaggtgacatgatacggagtccttgaaggggctatttggactcctcatggtagctgagtacggtgatgagctaagctgctataacaaagagatcaggttcctgcccccttattgttgcgcctaaggtgttgcctgcaacttcatcatggaaggtacctggtattcatctctgcatcctagactttgggaaggcagcagcagggctggggccatcaactcttccaccctttaaatcaaatattgcataatgggtccagaagccaccacctgacacctggaggtcttagagtcctgtggacactccagctgccgaggcttgtgatattgggcctctcaggcccctcgttcacatggtcaacaactccatcctaggggtagctctttgcatgtggtcagacatggtcagtgctgtcacagagcggaaatgcttcaggagaaatgaatgcgcgtgccgtatttgggcccagccccagtctgaggacataggctctttccatgagcctccatgtccaggagttttgggcacaggctgtcctggataattggacattttggtgaacacagcttccccacacccgccactaccacgtcacccattctcagagctttcagaagcagcatggtgaaatttgcaaataggcagagacagcagtggcctctctcaacagcccacactggacagcaatctccctggcagcacgtggtcatcccagtctctcctcctgtgctgccatgacagacagctcactacctccagaagcaggccttcctatggctgagtgatagaaatggccaccccacatgatctcaacctgcctcctggggacctccctctgccccaagctcctggctttgcccccgaggctgcagggcgacctcagcaagcctcctacatagatcacatagtcagccaacacttttgagggcagactagataacaaagcctgcagactcagtgaatggcaagaggtggtggtctctggtttggaatattgcacttgaaggtggttggttggtgatgggttcgtttttcaccctctggtaggacttctctagtcatttgctgcttaaagtgatctgcattaagatggcttgtgtgtgtaggtgagtacgtatatgaacacacacagatcacacaaaaactagaaaaacatgtacactcatatacaaaaacacatacacagaaaacttccctttattgcacattcagtggggactggcctttgaggtccattaggctctaaaaatccatgagtctggctgggtgcggtggctcacgcctgtaatcccaagactttaggagtctgaggcgggcggatcatgaggtcaggaattcaagaccagcctggccaacatggtgaaaccctgtctctactaaaaatgcaaaaattagttgggtgtggtggtgggtgcctgtaatcccagctacttgggaggctgaggcaggagaataacttgaacctgggaggtagaggttgcagtgagccaagatcatgccactgcactccagcctggacaacagagcaagactgtgtctcaaaaacaaaaacaaacaaacaaaaaaactccatgagcctatggctactccacatacacacacacacagaaacctttggtctcctccattcctcctctgatctcagcctcttctctttgaagagtgtgatgtggtctctggggagtctacacttccccaggcaaagcagcttggctctcttaatgaactggtttcgagatcccacagcatcctgggtgccctccagcttgcagccagcctctttgaagtgaggcccacactgcccaggtttcctgggctgaccttgtggattggagcctggcatgcacacagtaggtgctcactgcatcagttcctgcctctctgcctggaaatgcacctccccatgaggtgggacaagttcatgccgtcatctgggtatacagcaacatttctcctcttgcatttaagatttgggatccatcaccttgcccagatagggcaccaggcagaagtagggcctctcagatgggtggccacaccctcctcagcccacagcccacagacatgctgggatgacgtgaaaccccctggcttcctgggagtatagagagggtgcatttgaggagaggtggcagtggcacctgctgccaccactgaggggaggggcaggtgccatggtcccatctgaccttccccctccctcttcccctcatagggagagaggggggcaagtctttgatgctactctggtggcttcttttcagactagttacaaagatctctctggagaccagcccagagtgaggacaagtggccacttagcaaatatagaggaaagggcaggggacaggcagcatcatgctggcttttgaagaatttttatggattttttgtaagccacacctgacacccctgagatggtccttagagaaactgcaacacaaacctccctccatttcttccccaagcacagcggcctgaatgggccagtgcccagggcagcacagcagtctcctccactggttctgccctctgaaggctctgttcccacccccaagactccatctgtgaaaacactaccataaggatggatccagagagagagaccctttccctgccactatctcacaccatccctcactgccctcctttccacacccaaagcctctgccctcctatcctctcattgcctcaggtcatttggcaggaggcagaggagacagatccaccccttacccacaggtgccctttccctcacctgctcaggttctaggtccagtgtagagctcttcccatcccatccaaagaaaacttagagctgggcgtggtggctctggagagattaaatctgtatacctgtaatcccagcactttgggaggccgaggtgggcagatcacctgaggtcaggagtttgagaccagcctggccaacatggagaaaccccgtctttactaaaaatacaaaaattagctgggcttggtggcaggagcctgtaatcccagctactgggaggcggaggttgcagtgagccgagatcacaccactgcactccagcctgggcgacagagcaagactgtctctaaaaacagaaaacaaacaaatcaaaggaagcttaggatggggcaggagagacatgagagtctgtgctttcacaaggccaacctggcccccaggtcacagactctgtgtcggagcagggctggccatcccacctctcctcctgcgctgccatgacggaggctcctacctgctttccacaatgcctgaatccccctatagtgttccctgccttggggacaatattggcctcccttggtgatcatgcaactcccatgctgcccacttcagagagaaggaactgaacagtccctccagaacacacacagagtttgacagactctacttggtcatttcccgacagagagttcattaccacccaggatgccctctccatcctctactagctcccttctaaacttccttctgtctctcttcaatttcctccccctggccctgccttttcctcccagaggccaactccagagaagtcagggcctgtcagccctactgacatttgcaaactatttatggcatctccagcctgaacccactctcattcctcttcctctttgtagcacttggtttctgattcttgtcctgctgattgtctcctcttgacaacattcctgttaaagtatcccccaaaactgtggggcccaatcagcattagaggtagagtaggaacatcactccctctctctgaatacattctcccctttggtgcagctgaagcctagctttggttctattttagtatttatcaaagcagtgagggtctgtttagagccagagtccaactctggcacatcagtaagcagcatgtctgcatcttgcctccctgctgttctatactgaacttagacagggtttctctcccctgtggtatttcaccttttttatctcagcccatcttctaagcttgagatcattctggaccctgattttatcatgcaacacactcacagccccatctgtacccccaaccccaagctccaggtcatctgtggaggtggccaagacacttgaagtgctgcaatgtccaccttgtaagcctgtagacctgggcttgaatctggatcttccatttgatcttagccatcctgagtttcactgttctcatccataaaaggggattgtaatccctaccagccaggaacatagtgaagattgaatgaggaagcatgtgcaggtaacctagcacagtgtcctgcagatgctcggtaaagggatctcttagtgtctttcacccaggtttctgacaaacatgctgaactcatcagggatgaggacagggctcctgggggaggggagttggtggagccctgcgaacccatcactcggtgcccgcccctcatgacagctgctccaccagcttcgcatccataaggacatcaggaggccttgtcaggtgctgaagataaacatcgccagcaccacatttggtctcgctgcaattttctgagaatgaaatgggggaagagacagacaaccatctctccagaagccagacttgctgaagtcctcaatgtaccctgccctgagttgggggctgtggagcctaggagctcccaggccagaatgggaagggctggatggagaggcatactgcttccaattgctagtcattcagaagacctgctttagctcatctcaaatgtctcaccaggctgggcctagtggctcatgcccataatcccaacactttgggaggccaaggtggacagatcacttgagctcaggagttcgagaccagcccgggcaacatggcaaaaccccatctccactaaaaatgcaaaaattagccaggcatcgtgttgtgcacctgtagtcctagctacttgggggcgttgaggcaggaggattgcttgaacctgggaggttgaggctgcaatgagctgagatggtgccacttgggggtgctggggcaggaggattgcttgaacttgggagattgagtctacagtgagctgagatggtgccactacaccccagcctgggcaacagagtgagaacctttgtctatttatttttttaaatgcctcaccaaccacagaacctagtgttgccttgagaatgtgagcctacaactcccagctgcagatggtgtgtattaagtcagaatgcagagatgactgagaaaactggacattgaacactcccttcccttgctctgctctccctgtgagcccagtgcataattggtagattgaagaagggggagggaaggaatagagagagacatggcagaagcttctagacaaaacttctcagaaaatgggagttggtcttgggatttccccccttctgaaaacccaaccaccttagtatagacctcccttcagtgctttcagccaagatgtatctctggcccagccaaggtcattcattcattaaccatttgttaggtttcttttcctttttttttttttgagatggagtcctgacctgttgcccaggctggagcacaatagcatgatctcggctcacttcaacctccgcctcctgggttcaaacgattctcctgccttagtctccccagtagctgggattacaggtgcccgccaccatgcccagctaactgttgtatttttagtagagatggggtttcaccatgttggccaggctggtctcaaactcctgacctcacgatccacctgccttggcttcccaaagccatttattagatttctaacctgtgccaagcagtaaagcaccccaacagatcactatcacccatcttactaagggtcctggttgagattggtgcattgaatatacagaggtcagggcaagcatcacagaaaggcatggtttgagctctgttccaaatagtgggttggaaattggcaaagcaagggtgcttcaggcaaagggacccccatgtgcaaaggcatggaggcatgacagtgtctggagcacatgacatatgagaactgtaatgggcagtgagactagaaagctagaagaagtctagattgtagaggacctgggtgctagggtgcagggtgagggctttatcataaagtggtaggaaactaagaaaggtcttggagcagcagtaggatgtgatttcatctgtgttggaaaggtctgtctgcatgagaataggggaaacccaagggaaaaaaataaattcagaaagccaggtttcagggtaacaagagtgagcccacagtcaaaccactgagccacaggcaggactttcatactaaaatccccaacagaatttttaaaaattcttatcagtggcacccctcctctggcctcaaaatgtgctttgggattaaccctctaacaccacttctggcaaatgaatcatggccccaccaaggattaacactggggcccttcttggctgggagacagacccggagcttcaaaccccactgcagctgcaagagcacgcaggatgccataaatgaggctcgctgtatgcaggggaggcagcaagccctcttggaggggcctgttgtctgagcttcgcctacagctgaagagataagaacctacaactgcagccacaggaaatgacaaagcagtgactgatcggggaactgctgcacagggctcattatggcgcttgccagtgggcgagacacccttatcagggagaaaattgcatcaggcctcctgaattactagcgattggaagcagatttcttgggactcactttgttagatacctaatgagcgggatacaggcgggcagagcccaaagccagcggggcgagggacaaatgtctttgttaaacagaatttgtcagtttccgcttcaggccccctggggagggttcagggccagctaattgaattaagagcatgtgcgctccagcaagaaggctcagggcggggcgagaggcaggcaggccggaaggcgggcactttcagcaccaaggacagcagctgcagcctggctagtcagtaattgtggggcaggctggaactgctgcattttgcatgattggggatctaggggatggaatgggtaggaggaaggcagaggatgttgtggggaggagggagacaggtgacctaagaagcctcaagcctgtgatgccattggcctggtctgtctcaacagacccaactctgctaacaacagtgagtgctgggaggagtgaggaagggatgtcttctccccaaccatggcactcacatgtggtgtgggcagctgcaacaacacagggagcagtgagctgaatgctgggtctgagctagtgcgtggccatgcatctctttgagctttcaaagtcaatctccaattatagtcttaatgaaccaggatgtgctgcagccacgaagccatggggacaggggccacttgtcagccccaagctgccccagcaggcagagcaaggcttgtcaaatacagaagcaaataagtaggcttgtggggtgggccagcagcccccaccttacctggaggaaaggagagcgaggcaaggctgggcttgattaggaggagttagtcttgggaggagttagtctccaaggctcttcccatcctccaccctgactcaccatctcctatgggttggctctttctatggtctcgagcagcctggccctctctatggtctcaggcaagctcccttccttgagaagcaaggggctgagggcataatttccttccccaaatgtgagctgattgaagctgtggagtctggagaggcaatgctgaccctaaagaaggagaactattagggagaatttagacatgatggatctcttggtgcccgtcacctcacatgacaaaagcaactccctctgatgtgccctgcgggatctgtgctgtttggaggtctaaagatttcactataaaattcacctctccaccttgcctccaaatcccaggccaggatggatcctggcaaagttgaatgggacaggggaatgggaatgtgggcagagacctgcaggctggggaggtacaggcatggagcagccatgggagcagatcctggccagggccagccccagggtagggcaggacagaatcattgagtctggcaggcactacaggaagggtggctggagcaggaatgggcaggatagacttaaagtccataggtactctgccttgcctgccctccttccccgagcccacccccacctcaccccataagagactgatggggtaaaggcactggtctggactgaggggttgttcccacctttattttagctttgtgatgaaattaaatggattatacatggtaaatttcagaatccacatacaagtacctggtgagtgcccagctctgaccaggggctcagtaaatgtcagctctgggttattgcattgacccatctggtgctggggccacactgagtggatgtcagggagacaggctatgggggagggaactcctttgcaattgtccctgctttcagtactgatgggggcacctctggagacctctcccttgatttcattacttctacttcctctcctaactggattagatggcagtctatgaaatccagggcatagagattggctttctgcctggaaatgagcagaaatgtcattataggtcctgaatcagcatctcaccacagccccaggggccacctggtcaatgggaaggtggtctttgccctgtatttatgctttccttcattctctcctgcattcatccatccattcatccacccactcattcatccatccatccaatatgcattttgtagctcttcctctgcagtcaatctagtgttcagctgttccgagaaagagacagatgtggtactttttcctatctaaaacacatggccagaaaaccctaaaccatctgactcagatgctaccctgggtgtcttcacgtcagtggggagcctccaagtgaagcctgccctctgtgagccatagctactgagaggaccaggtgggagagagagccaggcctgatgcccacagacaaaacaggcccaggagtcttggtcatgaagtgcagtaggtggcctgccaaagtcagcctcggggtcccccagtgtcccactcttcccattccaagagtcttattatagctgctttctctttggcgttgtctattttgcacccatttgatggggagttgggggacatagagcccagacttagccaaatgcctctgtgtacttatgtgactgtcccttactctatagacatggccagaaacatcttcacattaatgaatttctgcacagcaaattttatttgaaaggggcataaaagaataattacttaaagaatttcagtggtaaagtgaagggtccttgtctcaattcattgaattagtatgcatggactttcctatagaagaaccactttaaaagaggcccacctgcattcattccctctctggttgttcagggtcaaacacctgggcacctctaactctgagcgcatctgtactggttggcagtgtgcccattgctctatttatttctagcacaagactccagacagtggaataatttgtctgctatgcagccaagagaggattccaacagctggtgcagggtggaactggctcacttttgaggtccctgaaaaccctaggactgcatgattctttgaacaatgagtatgttttagagataaccatgaatttccaacagggctttaaagtaacccttccccaaagggagcacagacatgtccctaagcccaaggaacttaaaattttatttaaaaaaaaaaaacaaaaaaaaagcagccaggcacagtggctcacgcctgtaatcccagcactttgggaggccaaggtgggcagatcacaaggtcaagagttcgagaccagcctggccaatatggtgaaaccccatctctactaaaaatacacaaaattagccaggtgtggtggcggatgcctgtagtcccagctactcaggaggctaaggcaggagaattacttgaactcaggaggtggaggttgcagtgagccgatatcatggcactgcactccagcccgggcaagagagcaagactctgtctcaaaaaaaaaaaaaagaaaaaaaaatagcaggcaagtctggaattagcaacatgaaagcacagacagccaactgctagaccagaagaacccagaaaacctacaagtcagtgtgagctgagacatcaagtcatccttgggcggtgggggtgctggtatttgagtggcatcagactttagacatatgacagtgataatcctgccaagggagaaggaggagaacgggaaaagaacatggagggagacgaaggctcatcagaatatacagagaggagagactgtctgcttaatgggtggtaagattgaaggatgatagaggagatgaaatggaaaataggtctacatagcaaagggtgtcaaaagagtgtaggattttagaagctgttgttactgcaccaagtgtgggtgccagagatggcataattcatttattcttccaccaaaaatgtattgagtgcctacaatgagccagagactagggatagacaaggttccttgctgacatgggactcacatcctagcatgggcatttgcagaaggaaggcagttaagaagtaaatgcatttttaaattttctggtagagtaggtgctatgaacacagtaaaatgggataaatgaatagagagtatattggaagtgggattactttagatagagtgggcctctatctcaaagtgtagggaccctctgagcagatcacatctgggctgagacttgaatgataagaaggagacagctgcgtaaggatccctgaggacctccaggaagagaacagcaaatgcaaaggccctgaggcaggagcgagcttggcttgttggaggaacagcaagggccatgtatttgggacccggtgagcaaggggcagatggtaggaggtgtgcacgggccagccatgcagggcctcctgagccatgaggaggagaggcttggggtgtagatggtgtgcttatggtagatgggcacagagaaggggcctgtcctgaagtttctctgcaccttctcttctcagagaccagaaaacttcttgacaccaaacaacagcaaggctcttcctaccttggaccccaagatcctggataagaagctgagaaccatccaagagtcctggtccaaggacacagtgagctccacaatggacttgagcacgtccactccacgagaagcagaggaggaacctctggtgcctgagatgtcccatgacacagtgagtgtctctccccaggtgggaagggccggggcagtgatgaggccatgggaaggggacttgactgccatctgcaggactgcttcatgcctcaggtggccagtagacctccctccccttaggcacactctgcatgtgagttaccccaaagtcaaactgctgggcgctgtggcttcttcgtttgcagggtctcttcaccttttgagtggaactcccgtgtaatttctttcaaaacaaacccatgcaacacttgtaagccagggttccatttatgtgtgtaggcatcaactcagaacttcctgaggtgcatggccactgggtagtgggaaacacctttaagagattcattttagcttataacaggagaaactggggctcaaaaaaagaggacaccagctgggcacggtggctcacacctgtaatctcagcactttgggaggccaaggcgggcgggtcacccgaggtcgggagttcgagaccagcctgacctacatggaaaaaccccgtctctactaaaaaaatacaaaattagccagacgtggtggtgcatggctgtaattccagctactcgggaggctgaggcgggagaatcacttgaacctgggaggtggaggttgcggtgagccaagattgtgccattgcactccagcctgggcaacaagagtgaaactccatctcaaaaaataataataataataataaaagaggacaccaattctggtgacatagtctgtgtccttgatcatgggagctgctgtgttttcctgttgctggttgagcagatgctcaggaagggctggtggaggtggccaaagtgacatcctaatttgctgaggagtcagtgctgggtttcagccctcgatgcagagagctaaagaatgggctaccaaagagacagtccagggaggtgctacccagtaaccatggctgaattattgggtagcttcctcccttcttccacagcgggtcccatggggaacgctgctctggaagatcttgagaaaaggccccagacaaggccaccagtccacagggaagtccaagccatcctcctcccaggacctgacctcctccaccaacagcctcctcatcttcccctggcacttctgcacctttctggaacatgtcccatcagacgaataggaaggctggctgtctgctgggcatgcccagggttcttccacatgagcacccctgcccaccctggagcagggccatcctgctcaggcaccacagcacttatgggccatctttacaattttctcccgtcacctctggcccttggggaaagagcccttgggattaacatccagctcagtcataaactgcattgaaaataaagaaaccctgtctttggagatttggggcagcatgaataaaccacttgctcctgccctctccacatcctggcctcgtggttcccccttcttgtgcctctaagcagaggtagtaaaggaaagagaggccaggtgcatggcctgcatctgtaatctcactacttgggcaggccgaggtgggaggatcgcttgagcccagaagtttgagaccagccctggcaacataatgagatcctatctctacaaaaaattcaaaaaattagctggacttgttggtgcacgtctgtagtctcagctactcaggaacctgaggcaggaggatcacttgagcctgggaggtcaaggttgcagtgagctatgatcgtgctactgtactccagcttgggtgacagagcaacaccctgtctcaagagaaaaacaaaataaaagaaaaaacaggccaggaaagaaagaagagggaaggtgccatcatggggaaaggcacatgggaagggaagagaaagaaggcatccctccctggtctcagccctgtggagggctcagagcaacctctcctgctcagctgccccggaggggccaaccagccaaccctctgccctccccaagctaagcctccaccttcccccaaggatgcagacctcagcccctgactcacaccacctctagaagcaggaaccacaagcacctcctggctggacaagcctctcacatcagccatctgggcactgacatagcacaaccaaggagggggaagtacccagccctgctcctagtactgggcatggcaggcagtccttcgtttggagtctgctgggtaaagcatccaaggtctgaactgaggtcattaggtctgagagtctttgagagaaaccagatacagatgtcttaataccatggatttgtctgtgggaagtgagacacaaattgctggggtgggttgggttggagtctgcactgtacttataaaacttgatgatgatgatgatggtggtggtgatgatggtgatgatgatggtggaggaggagcagagaggaaaaaatagagtggaggaagaaatggcctttaaatatagaatggatctgagaggtaggcaatataaacaatgttttcaacatctgaaagaatattagaataacatgggtagagggccagtcttgattttctcttaagaattaaaccaaaagagatgggaccagattgcagcttgagaagtcaaggttagccattaggaggaagtgttttttggttttttgtttgtttgtttgttttcgagatggagtttcgctcttgttatccaggctggagtgcaatggtgcgatctcagctcaccacaacatccgcctcccgggttcaagagattctcctgcctcagtctctcaagtagctgggattacaggcattcgacaccctggctaattctgccttttttttttttttttttttttgagactgagtctcactctgtcaccagcctggagtgcagtggtaccatctcagctcattgcaacctccgcctcccgggttcaagcgattctccttcctcagcctcttgagtagctgggattacaggcgggcgccaccacgcccggctaatttttgtatttttagtagagacgggctttcactatgttggccaggatagtcccaagctcttaaccttgtgatctgcccgccttggcctcccaaagtgctgagattacagacctgagccaccacacccagccaggaggaggtgtttttgagcaacagtaaccattgtgagcgacagaggagtaggcagagaaagaagcagcctgagcatgctaggccgggattctgggaggctctgagtgataccccatacccacagactgcagaggtgttgtgagctgggtctgatggagaactcactcaagcatgcccaccctgggcatcaccctcagcactcccatcagtggctcattcacccggagagagtgttcctggtccctctaccctccctcttgctggacacctggtgaggccttaaggactggctgctagccctggtttgctatcgggttagggccactcagccaccaccatccagtccttgaactaaagaacacactgacttactcgcctctgggctccagagccctgcccaggcctggtccaagacagatgttggtaaatgctttttgggcaatggaatagagaacccctggctggacagcaagagaatcagaaagaaccttagaaagtatctagactgatcctctcattttacaaagggtggcaatgaggtggcccagggatgggcaggaatgggcctgcccaaagcttcctgacatggcaatctcatgccaccttgcatccagccaaggaaatactggacactacagaggcctgtatgctcagtcaacctggcaccatcgggtcccccagagactcatagagtatccagggcagtgggtatgcccctctcccttacccatcccactctgttccaggcacgccatccctccttgttcctgactcttgactacgtccttgtttatcctctcacctctggttcggtctcccaactcatcatttctctctctcactccctctctcactcaccttctcgctctcactctctcgctctcctcagatttaccaggctggctatttctacttctgacactttgccctagttggggcctagagacccagcccccagccccagctcctacccactggccagtgcccagaaggatcatggcaggacccagacacacatgttcacgtggccagtagatcccagttacaggcagtagaacgtgggtgagtagcaacagtgtacggctccatgacaagcacaggtagcctagctgtgtagcaatgggtcactcttccatagcaaccaaacaaaattacatagcaatggatgaactcaagcgaccatgaggcacagtgacaagcaatcgaacgtggccgcggagcagtggagtgtcgttgcataacaatagacccagccgtagaagcatgtcacacagccctgcaccgcaggagggtgcaatcacgggaatgagtacggagcacagtgtggaagacgtgggcagacatacagagtagtagcactgggacacaactgagtagcaatggcacggtcacagtgtgtgtggctcctggacatgcggccagggagcggtggccggcagcaggtcccagggctggagcagcaggcgccagcgacatggcagtggttgagttgtagtcaaatgaagaaccgcctccctcacgctgggccgttgtctccggctgagcctcttggcctcccctgatttcaggagtgtgtttgtctatatccagtctcatcatgcattccccggagcccaaaaaacaattttatctctgattcccttcagatccgacttcagcttaataggaaattgaacattttctggagagaaaagcgctctgggaatagatgagagtggagaagaggaggtctatgcctctctgtgcaatgctgcctgctgcccctggccctgcctgtcccatccccatggctcactaagcccactgtggctccctgtccctggatgtgcccttgatctacctcattcccagactgcaacccaaccatttcttctcaccttggaacacttcgttttgatgcaggcctttcaagttccatttggtcaacatggtacaaaactctggtcctgggtgggcccatcaaggtcaaggtcccatgggtatggtcttgggtcaagtgtagggcctcaggcagaggtagaggaagccttatctcccgtctgagtagctcaggaagccattgggaagaggtgagcctttaagtgagtgtgaagagtgaggtgttaaggttcatcctgaacatggcaactccccaaatagtcaacagcctgcaagcatctgccctccactctctgggcaccctgagcccatctcacacggagccaggccatgcctcctgacgccaggaggggagcaggtaaggcgagggggctctatgccacctctagatggaccgacttcctccacaaagggcttctgaaacacctgccatgtgcctggactccccattcctccagcctgtcagaaaaccagaactctccaccctgccatgtgcccagccctgtgtccagctggggcagggacatggggacaaagaggccaaggacctcagctctgagaattccccagtggacaggagcaagccatacccggggagacgattagtggcacagagtaggcacacagtaaatatttggtgggggatgaacaggcaaaggaggggcatggttgggacaatgtagctttttaactgccacacttacccagcactcctggacacacctagtgagcccttagtgaatgagagagagctggggaggtggtggatagggggagaggcaggcaaggaagtcttcctggaggaggcagactatgctttggataaagaaaggcagatgtgctcatttactatggaagaattgtgtattcagtgttgtttccagcacagaaattcaagcacagggttgcttccctcctcttcctgtctctctccctgtctctcctgctctctctcgctctctctctttttctccctcccccctctctctctccacctctctctccttctctctctctctgcctcctctgtttccctccctccttctgccttgctcagaggagatttgtggcagaccagagggccctcataccaggagatgaataattgacaagggttgttaaaagattcagtggagtttttccaacctccttacactggaataactcatttctttcattctgtttttgaaagcctttccccctccctccacctgtctcctccacatccccgccccctctgagcataccgcttttgtttctcttcctttcttgagtctgctggaccctagaatgattcggccttaatccctcggtttctctaaatccccttccccagctgtccccaccccacttgccgtgctccggaggtgtaggttgacttcagcagagacagccccagatcatgagtgcagagaggaaggaggaccagggaagctgtggcctctcccaagtcccagtgtgccagaggtgggctcggtcctcagaaaggcaagcctcccagcacagggacccctttcctcgcaggcaggcggaggggtgctctggggacgctgggtgaccatgtgccttggtttctccatcttagcatgctgcttaccctaccctacctgcctctcaggatcagatgggagaggtgaggccccccagaaagggcggctggccgtgtagcagagacaccctgagcctagtcctttctgtccggctggcatggccctggggtgaccacccatccctgtctgtccaggactgacgggtttccagactatgaggtgttcagtgcttaaaccaagacagtcctaggcaaacctggatgggggccaccctacatggcacagaaacctcccctgtcccaggtctgccccactggaggttgccacactctctaccctgtcagcctccctcatccacagggcatactccccctgcccagtctggcccagctccgtgctgtccatgcactcatagtgctcccactgctcctgcaagtgaccttgaccttccttcccttctctgggccccagttcctgcctctgacagcacaggcggttggagcagatgttcctgagtgccctgaggctcctgcactgtggctgcagccttggtcctgcccccagacccacacccaggatggggtctgcagcctggtgaggccgacagcagagcagtcagacccggcctccactcctcagcaccacctggtggcaggtgattaactctgagcaggagtcttttgaggctgccagcagcagtcaccagggaagggacttggagcacccctgcacactacccactttggtggcaacaagcagcaggaacgtcagcctagggtggtgacattgcaaagccccgggagcctgggattggcccccaggagcaggaataagcagcccccccagggccactagttcaggcaccaagcccagcctgggagcagggtcacccagggtctgggagtacgagagggcccaggccccaggtcctttggaaccaagagaggctgaggaactacaagagaaacagggagtgagacagagacagagagcagagccaaccagggcccacccaacggcctccaaacagatgcccttgactcagtgtccccttcaggccatcccacaccagccacaagacacgttcccaaaacactggccaccccagccttcctgctgtgtcccctcagtctccgtagcccctgactctactgcccagcgtgattgccccatttgctgggtttgtgctctctcccagtcacctctccaagcatccctgttctgtgcagcacacactcacgagctcccgcccaggcccagctccccgaaggcaggaaggcttctcagggccccagccctcctcagctcctcccctgcactcctgcaggccccgagctgggagcaccgcctgctgacaggggctggagggggtcctacaattaaatacttaagacaaggcaaccgacctaagccatggctgagaacactcgccagctcttttccctttcctgtccctcccccaactctgacctttttctctccaattcctaaacacaatcacacacagtgcttaccaagcattttagcgaggaagggagggagggagaggagaagggtagaaaggaagaaataaggatcacatcccacatgtgtctgttacttccctctgcagacccctcctctcacctgcatagctcttgcaggtttgtgttccatctccaccactccgaagctgtgtgaccttggataaatcactccacctctctgctcctgtctcctcattgttaagtagagggaacactgtcaccctgtccacctcttgagactatggggaggattaacaagagaatgaggggcaatgtgttggaaactgtaaagggctgtccactttgcaggagacttaatagtcactgtgttcctggggccctgcgatcaaggcggagaataaaaaggaagcaaaaatcccccaggcctctccctctgaccctttctccggcagggctgttcccagacccctgacccacttctcctccctccttcccccatccctccgagtctcagcgggccattctcctcctccatccatcacctgagactaaagagattaataaacgagactcataactcagctgctgggatgcagcagatatttacggctccgtttcaatttgcagagagattaagtgtttgtcgatttattgtctcttggtgtgtgcaagcggctgagcaaggccccctgcaggccagtcccctcccccactccacacgccctgcacatgtgtgtgggtgcctcgcctcccacccccagcccccagccctggagctggcggggagcctggtgctgctctgccaggcaaagctatgagccagtccggtgggcctgtcttcctgaccgacttggccaggtacctaagctgatttagagggcccactcacactcctccagccttgtccctccccacctggctaggtaaatgtgccccagatcccaagctccacgcttctagaacactctgtcggtacccaagacccccgaatgggcctgaacctgcttctgcttcttcttcttctttttttttttttagacagagtcttgctctgtcacccaggagggagtagtgcaatggcgtgatctcaactcactgcaacctccgcctcccaggttcaagtgattcttctgtttcagcctcccaagtagctgggattacagacacctgccaccatgcccagctaacttttgtatttttagtagagacaaggtttcaccatgttggtgaggctggtctcaaactcctgacctcaagtgatccacccgcctcgccctcccaaagtgctgggattacaggcgtgagccaccacgcctggcctaaacctgcttctgaggactatgcaagcttaaatctacacttctaagggttgaatacttttgcaagggtgcaccctgagacccaagaagcaacggctgtttgcagagggcacatgctggaagcctccatttctgttcttgtactgggcactacagatattaggggtgggcctggagaggggaggcttccatagagaaagccccccagcctaactggggagaagtctgcaaaggccaagggaagtgagacagcatgaaaaggagcatcacccaggggctaagggggaagtactcaaaccccaaggatgagcagtgcttcaggagccaagaaggggccacatgagcacagggagcaaaagtgtctggtgcccccaacctcctcagacccccagctgtctctcctttccctgttgactttgtattctggcacaggcacctactcattcattcatttctggtacatgcacctactcattcattcatgcattcattcatttgttcgaccagggttttgagcatctactctgtgccaagtctggttatctcgccccacagattcctccactcatttgtgcagccccagcaggtatgagttccatttccacctcccaagagctgtgtggccttgaaaaaatcactcaacctctctgatcctgtctcttcattgttaagtagaggaaatactctccccgcctcttgaggcttttcagaggactaacaggagagtggatggcaatgcactggaaactgtaaagggccgtccactttggcactttgcaggaggcttattaatagtcgttgtgttcatgggatccctcgagactgagggggatgacggaaggcagcacaactcacccaggcctctccctctgaccccctctccagaagttcacctccaagatatgtgacagtcacataaagataattccgtacaagggtccctgtgctcaagaagtcccaattgagcagggagacacatcaagaatggctggaggaggatgtggtcaggactggggctcagggtcctcaggagattgtgggagcacagagggggtctacctaatcctaacccccatcaactcccaccccaggcagtgcacactttctacagaatgccagggtagtctgcagatgtcactgtgataagcaagagagaaaagccaaccaagcatcagtggcggttagcatgaaaccataacagatctttgatttgttggtggaagggaaatgaaattcctcttgttcctgcaagaggaatctgttgatctgttgagtgggaattactagttagtgtgtgtgtgcctgtctctctccaggcctggcctggggtctcaccaaaaggcactgtggggccccagggctagtcccttccctgtctggacctcagtttctctatctgtattaatggagcgaatgcctccctccagtgagggatgagaaagtcttagcggtgtggaggaaagaatggatgggataggtggactagaggactggtcaagtcagggcctgccctaagtacccagaagatcaggctcagaggagatgagaacgaggtcactccgggcagaggccacccagagagagagaaaatttactgccgagagagggttgggcaggaggagcatcaggagacatggagtcagttctgacttgaggagtcagcctgactgacccctcccctcctgggcctccgtctcccctcctgtggagtgaggagcctggtcttgacaatttcctctttcatcccagcaaacaaggcaggcagaggtgggacagcctcctggcgctgctccttagtgagatggccggtgctgccaggtcttgctgtccatccttaattaaatggtgggtgggcgaggcaggagtggagcactctcggtaactaaagccaagatgatgaggccataaattgctgagggcttgaatcatcgattggtgagggtgaggtggactatagaaccaggagcgactgggagaaagagttgctaacctgggaaatggggcttgtcccttctgtgctctgcaagcaccagcccaaccttagtactcattttaataacactaagtgttcccatcaagattcactgagctcgtactctgtacccagaacttcggtcacaatctcatgtaatcctcactccagactgaaaaggaacatacaattatcatccccactttgtgggagaggaacctgctgatagcacaataaccctcccagggccaccagacaagaccgagggggagtcttggtccaacacaggttgggggtctccagcctagcacttgagccttggccgagcctggtgacttggaagtcaggagcctggtgagcttaactcaccatcttcccagcctatctgggaggaagagctgcctcagtttcctagtaaacaccaagacaagctctgtggcctcaggccaccccctgccgagttccacctggaacatttgagagtataagcaaggcctacataccatatgtccaaaccccagtaatcaaaatataaatcaagcagaagctagcaaactcctaaatatgttccattcctctacctcaataaatacaccttatgaacaacctcaaagaattctcagcttccacactggcccctggcagtatggcgagagccactcccaggcccccacccctcaaccccacccatccccttttcttctcacacagctcaatttcagtcccacacctatgagactctgtgggctctctcgagtgcataagggtatactgccaccttcaggaggacaggccctggaagcaggggagtgccaggatcccagttacccagggtgaggtctaaagcgggcacgggctctaggtgggcacgtcccccttgggaccactgactcctcaccccatgggaagggttgtaccccgaagagggccaaagcaggacctttcaacccacggggcccagggctggagcccctcttgtccagggctaaaggcagaactgtccctcccccaaccctcaccactagcttggtgactctatcagggtgcactcctgagttcagattaaatgtttttcagtacaatccaatttcttcctgacacacggactagaaaagcccagtccatgtgtgcagacagacagacacacacacacacacacacacacacacatttggtgctaaatatccaatcaagtccgcagataatagagaccagccagttcactcccagtttaatcagataaaatgctcattcatcggctcctgccagagctgccgtcccctccttagggcggagtcgagggggcggggagggcctgtgggggaaggggctgagacccgagtggcttgagcatgtgggctgcgcctttaaatcttcaaggaggggggacagcgttgcccacgggggactaattatccttcagcctttagccagctcttactcaaacagacaaaagggggctcagcatctctggtggcactaagcctctgcagcagaatttttttcactctcagatatgcaaatccacctccacagggtggaccctggggttgggctgcagaggggctcggggatttggaagggccaggaagagcaatgacagctggaccctctcagaggactagtttgggactggaggcatctcactcttcctcctcaggctgggtagggagccattcagtagggagctgccacgctggtagggagggtcctgtggaggccaagatgaagacctcaccctcctgccttctcctgtatgtgggtgggggggctcctgtggagggccagtgggctcactcagagagctggctcaggatctgggagctgaccgtccagatggggccctcctgcctacctcagccttcctcctcctaagacacagccaccaggtgacctgtcccaagcccaaatctagacatgctaccccccgccctgaacccatgcattgttcccttgcctgcaacaggagcccctcagcctgatgggccctggggcttctgaagcccctgcctcaagcctttacctgaacccagaatattctacccatgctcaatggcagtggtgcctcctcccagctccaggcctgtgttcccggctcactccaccttgtacccctcgcccacctccacaccaggtgcctggcgtgcagtgggtgctcagtaagtgtgtgctcactgaatgcacagaatgcccttcctgagcagcttggtggaccaggggtggtctggatcacagaggtgtttacctcctactcggctcccagccagcacctacaggaacctcagtctctttagctgggaaagggggacagtgctagcccttatccccaggctggctgtgaaaacctcacagtgcctggagcggcttctgtgagccatgaagagcttctggcgcctttttttcctacagtggggagtgaagagtacagtgtaggagagtgcagagggtctgggaacaagcttccatctctctcggtccctccaagacccacatcttacaccactattggccactccttcagggaatctatttatccactacaaatggatctgtgccccacccgttccagaccccccaagtcctccaccagccatctcaacagaacagcctggactttaagtatgaggggaacttaaaaactctgggagaagctagcgcagtggctcacacctgtaatcccagcactttgggaggctgaggcaggaggatcacttgagaccaggagcttgagaccagcctaggtaacatagcgagatgccgtctccacaaaatttttttaaaaaattaaccaagcatggtgacacgtgcctgtaatactagctacttgggagactgaggtgggagaattgcttgagcctaagaggttgaggctgcgggcagtgagccatgtgcccgccactgcactccagcccggatgacagagtgagaacctgactcaaacaaaataaaaacaaaaacaactctgggaagatggttaggaggcaggactggagatgtgcttggtgcagaaggtctggctaatcagaatttgaattctgaggccgggcacaatggctcatgcctgtaatcccagcactttggaaggccgaggcgggcagatcacgaggtcaagagattgagaccatcctgaacaacatggtgaaaccccgtttctactaaaaatacaaaaatcagctgagcgtgatggtgcatgcctgtaatcccagctacttgagaggctgaagcaggaaaatagcttgaacccaggagacagaggttgcagtgagccgagatcaagccactgcactctagcctgggcgacagaggagactccatctcaaaaaaaaaaaaaaaaaagaaatttgaattttgagaccgactctgaggggcctgaggtggtcagggggcatcctgagagagccagcagggagggtacccgccagcagcgagagtgctgcccccaggaagccccctcccttcattgccacctgcatctgtgaggtctgggccctggatttccattacctgagcagtgggcaaggctgagcaggctgtagagaaggttcccatgggggactctcagggatggggagagtgaggtgtgagaggaactgaggccaaaagaggctgggtgacaggcaggggaggtggggggctctgaaaggaccaactgccttgaggctcaagcctcaagaggcaaagctgaacacagggattactggggttttgatggctgaagcactttgtgaagctctggggtggcctggagcctggcagcagtgaggtggttttccgcaacacagggctggggaggaggcttgtggcctaggctggaggcaggaccgtgatctgcctggacagggcgcacggggcctgtagcacaggcctggaggcaggacgggtggtctcaccccacctctgctctcctgtgacactgagctcccatcaccctggtcccttcccctacccatggtccctcccaaggctaaagatggtctaggcctccttggatcccccaagagccccaaatgtccagacagggctccttcccccagggagagatgtggcaggtgcccccagcatctctcccctccacaccccctaccccagtgtgttctctcctggcctgggtgaggacaacaaatgggacacagtgggcacatgcttcgcaaaaataatgagagggaagaatgtgaaaatgagagcctaggattcaggcctggagagcacagtcatctaaacagacgaggctctaatagcaggatctcaacccctccagctgaaaacgaccaggaacacacatgcagtttaacaaagttggagttattctgggtttattgactcgttgtagtaagggggatgcaaccatgggagttgcggggcatcccagaaagagtgtgtgggaaaggacttcacagattcaagctggtgttaggggatttgggaaagggtttgaggaaacaggctttgctctgggttagatgacagcgggaggctggcttagaatcagcattctaagagtcggtatcataggagttctcatcgagaaggcaggaatgatggtcactaataaagaagcagcagtcactcatattagccaggaaagggagtttggtcatttttgtggtttggacaatgactatgttttatctgtgttcacacactttacagagtggtcagagagtggtgttgtgaatgacaccagggtccagctgtggccgccagctcctggccaccaggggccgcttttctttcttggtagcttcagacagtgaccgagaagagatgaaagggacagatgttactcacacagcacatgccaggcactgtgctcaacactagacagaccttgctcacgtaatcttcaccacagccctctcctcattgtacagatgaggaaactgaggttcagagagggaaggtgcccatcagagtccagaaggactggcaaaactagaatgtaaacccagcttatgttccccttgttccaaagtccctttcacccccttgcccttgcctagaggctgagcctctgctcgttcctcggagccacgtggtcctgaatagtgtcccttggacacccccgctaggcacatcttcctgaaggggttcagcctgtccatggcaggccagccgcagtgtcagcagccgccccagcccaggagggtcccccgtgcctagaggtgtgaagggtaatgaggccccgtaattaaggtttctgaagacatggctgggagatttatagacaggctttgtcaataattgtgctaccggctgcagatccagcgagacatcggtaagtgctcgttacagcttctccctgctccctgccctgcccccgcaccacccctcctgagccatcagcctgcctgttcacagcgcctatgtacacaggcttcgctcaattaatttgcacttgttggcgccatctgttcttttcatgtgtccttatcaggagtgtgtgcgtcctgcctcctgctcagatgtgacagtgcaaccctcctcatacatataggggcttcctgggcaggctcacatctcccctctcagactgggctcctcagggtgggacactgtctcccccctcagtctaggacccctgaaggcaaggccaagtcttcatcttccttcacctccccctcaacacccacagcctctctctgctgagccaagcttggcctggaccctagcaaaaccttctgagtctgaccccaccaggcagggcctcagccctccagaggaagcccccagaccccaaaccaaacaatgccctggaaggctggctgcctctgggtgctgggaggtagggtgtttgttctgatccccactctggctcccatagcctgagctttggcaggttcttgttacgagaacagtgacatctttgagtcacaggggtgggaaggggctaagaagccacttggaagtctctgtttcccttgagcagcattggttaagggtggtacaggggccaaggcttggacagctcctagagtggggtgggtcatggcctggtggctccaggatgccagggcaggtggcccacccagataactgagaaaaggcagcacctcaaggatgctttcccttggctctctccccatcccgaggttttgggcagccaacatcccagcctactcttctctgggtcattctgtcttccagaaggcctctcagtcccttccaaccccagcacagatttctttctttctttctttctttttttttttttttttttttgagacagagtctcactctgtcatccaggctggagtacagtggcgcgatctcagctcactgcaacctccgcctccccgggttcaagcgattctcctgcctcagcctcccaagtgtctgggattactggtgctggccgcgatgctccgctaatttttatgtttttggtagagacggggtttcgccatattggccaggatggtctcgaacacctgacctcaggtgattagcccagcacagatttctaaccccggagggctatgaatgctgagctggccctgccacagaagtgctaggcaacttcttaccctgtctgggctctgggtcctgcatagcacattggatttgtttagaatgcaaccagaccttattctgggagggtcacaagcatgcttggtgccagcatccaggcccagcccagtccactttgcctgcctataacaggcttgacagctgggccttggacttacatccaaggtcccatgactgaaccctgcagccgctccagtctcatctcctaccagcccctccttgccgcgtgtcctgtctgcactcccacggtgttccaggctgctgctcacctccacacctgtgctcctgctgttccctgtgctaggactgtgtctcctccttatgcctgtatcacctgacaaactcctactcatccttcaaaacccatctcccgctctgacataccctccaatacacccttgcctgcaccccagggtgaggagggggctggctggggggctcccccgctactgcatttgccatactgatttactatgccacactgcctgctctcacatcgactagaatacaagctacttggggacagagaccccaagccttggccacatctgtgtctccagtgcccaccacagggcctggccaagtgggcctgccaaagagtatatcctgaactgggaggacctcagtccttggcctgggtgggggaaaggcagtgctcacccctcccctagagatggaaggagacacactcttgccaccctggctgcccacttatagggtcatggcgacctcaaggcagacagtggattcagttagggcaaaatgcaaacacacatttcaggggtggggggcacagagcagggggctttaaccaagctctctgcccaccctccccctgccagccccctagtctggacccatcccagggcccctctgtgaacatcactggcatcatgacgagccctttcctgcagacagctccaagctgtggtggagcacctggggtggggatttgggggttaggaggggtacagttccatttgtatttcaggcccagcagcattcctgccaggagagagttttagaaatggaaatggagggctgtgttccctcagcacatgtcccgcctccgggagctggcatctctgctctcacatggcccatgtgcaggggcacagaaccccaggtgccaacgagccccctcctaggctgcagcagaagcccacagccaggcagggcccagagaagtctgacagcctgccaaaagcaacagcaaaaaccacctcagcccaggagcctcccatcccccacccccgtgtgtctgatgcggtggttttattgcgggcagtgagggcattcatgacagcctcagaatgtatgagccagacctggagccagcaggggtaaggggagcagagcaactgtgcgactccaggagatgggatgtgggctcagtggaggccgttgcaggggaccagggaggcatctggaccttctggctaggccagcttcaagctcgagttgcggggaggcctctcctaccagcagctaagcatggctatcaacatcctgcgtgccccaccctgagttcagctgagcctctggccctgcaatagggagatcccagccctgatgagtgatgaagcatgagccctgcccttgcggactccaaggccaaggccagttgaggacaggagagccagccccagggtccggagtggtggtgaagactctggaaccagctcacccactccaagaacttccctagcctcctcatacctcactctcctcctctgtggaatggacatggagaaggctacttcatcaggtgactggtggtgaagttaggccgatctatttaaggtagttagaacagtgcccagcctatggtgagctcttgttacctgcctggtgcaggctctagaaattcagaaaggaagccaagaagagtaggaaagtcttttgttaggaggtgggctttgcagaatggatctgcagagatgggggaaggcgactctgtcctgtaggtgggggaactgcgtgagcaaaggcacagaggccggatgcactgaacctgtttgttcccccagaggttctgaggccacaggaagtggctggcgtgggagtggctggtccaaggggagctgcactattaagtgtggagggggagggggacaggagcaggaccacagggaccttgaccgccaagctgggggaaggaagtgtgaataaagccccaatgccaccaggcatctctgtactgccctcctctccctccccactccagccaggcacctgccctgtttcctgggaccccctgaaggaggacatcccttagctccacaaagagccctgccctagtcttcacatagtaattgtcttgtgtgtctcacccagtgataaggggtgggcaaggggcaggggtgggggctcttgagcacccgttttatagatgaaatgcctgagaccaggcgggagcccctggggcctccctggcttcatggggcaggctcaagtccctcaagggcgcggcttccctccctctcagcagcccacacttgttctatgtccggtgatgggtccctgagggtccgctggggcgcccctccagcctcccgccagagcagggctggaagactgccatgtctggggccaggctgagctcagtgcatgcctctgcgtagtgcattattgatggggcttctaattgtgcgtttcccaaagtctacaggcttttgatgaaaaattcatggcacgcccgaggatgggagcagactcaatcgattggcgcacagcaggcaggggaggacagggccccttgcagggaggggtggtgaagcctggtctgggaggcttcttgccccaggatcttggggatagcagggggcacacacccatttccctggtggggaggctgaggggcaggagcaggaagatttaaggcccacatctcagtgccagccagtgactggtgccatccagggaggatggccgactccaccacgggcctccctttcatttccctggaggggtgctagaccctccagagcccctcatgagagttgcacagaggagggagtaatatttctggagccactcttatatgccagacgctgctcggacgtgtacactcgcagcctcatttaatccccaacagcgttatgagatgggcacagtgatgcactccattttacagaggagaaaacaggcttagagaggttaagtgacctgtccaaagtcacacagctgcttagtaacagagcccactatctttccacttcaccaggcccactcaaataagaactaataggagtatggggattgtcttgtgccactcccctacttgtccctattgttcagaggaagtgtccccattaagaaaaagtggagtgggccaggtgcagtggctcatgcctgtaatcccagcattttgggaggctgaggcaggtggatcacgaggtcaggagatcgagagcatcctggctaacacggtgaaacccagtctctactaaaaaaatacaagaaattagccaggcatggtggcaggcacctgtagtcccagctactcgggaggctgaggcaggagaatggcatgaacccgggaggcggagcttgcagtgagcccagatcgcgccactgtactccagcctgggagacagagcaagagacagagccagactccatttcaaaaaaaggaaaaaagaaaaagagtaagtgaaacatgaggcctgcaaatgagaaaaggaagcgccctccacaacaccggcagaagccagaggccccccaaccctgtgcagagtgctgagctgggcacccagcagcaggggtggagattttgaaacgggtagaggtgactgtcttggcttgtccagtcagggattattattgtgccaccattgaggccccaaagaacactgtaagtcatctattcattcattaaacaagtaaacaaatatttatgaagtcccagtgctggtcagcatcttgctaggtccaggtggagggccctatcatgaaagcctttgggaccaagcttgtctgggacagacaggctgaacccagttcagctggggaaaggcaggcaggcccctccatgccccaggagggggtctccgcaacccaggctgaagccagttatatcagacattctgccttcatgaccagggccgtttctaggtggcgggctggcttgtttgggtttgtttttttttttttttttttttttgcttcccagtgagtttctttcaaaaacatccacccatgtctccgctgaactaaagagaaaggaatttgtccagagcatcaggaaagcagccagaggaagtccccagggaccaggcgtggggccctaagccacactgcagctgcagggaggagagtgagcccagcttgtgctgctgcggggtggggaggactcctgaggggacaagggggaatcagggagcagagagactaagggggagggggaggaggagactcagggacagagggtgaggctcagtgggagagaaaggggagacagggtatgggggtaaccaggaggcagagaaagtggagaagagcggagggagttgagggggaggcaggaaccaaggtgtagccaagggcaggtgagggaggagggactctgagcctgggccaggggagtcagaaggccggagccctgaagggccccacagccctccccggccctgctgtctccatacaattctgtggccaaggagtgaaccttgcatgatttcagccaccccacccagacaccccccaccctggaacaaaggggaagtggccccatgggcctgcctgcttccagctcagggctgggcttggtcaccaggcaggcacttgttgtagcaacagtccctggggacccatcctggggaacaggactgctagcagtaaagatgggggagccagggcccccatcccctccagcccccaaggctgccccaggcctcattgacagcttctctgtaagtcgccccctcgcccactggttctgggaagatgggttggctcgcctagcagcaggtgtgttggggtgtgttgcccagcaaccagtagaggtgttcccagagcctcttaagtgggaggcagggtggagaggaccagggctttggcccttagatgcccgtggtcacaggaatcttttgcaaggcccctggctccagcctaggccacctgagcccacacagtaatccagagagggaggacagaagggcttctgggaaaatcccttgaagtgatcattgcctcctgctagtctgggccctacctctggtgtcttggaggtccagccttggatcctagaaagtggctgagcctgggctagcctgggaaggcttgctggtagtgcatgtgtggtgccgagctgtgaggaggagtgggtgtggcagatggggcatccagtggaagcagcagctcagactgggggctggggccgccccagtaagtgctaacccttctggtttgggccccagttgccaaagcatttcttcttcccctttggcaagaatcccagaggacaaccccaacaagggtcattccccacagggtgcagatgagcaggcacggagtgggcaagggcctcgcttcgggtcgttcgacagctgtgggcagaggctggatcagaacccaaggttctgggttccagccagggctcttcccccacccaatgtggggcattcctgaggcagcaaagctctaaccagggaggattctggcaggaggtgaccagtggggaagggttctttgaggaagagtgaacagggcctgtgagaccaggactggggcctgcccctcaccacctgctgaatgcccagccctgtactcacctgggctgagagcaagggctggccccaatctgctgtcagcagaggctggactctggcccaatacccaaggagtcatgactgatggcctgtcttgggatagcccgggggtcttcctggaggaggagggcccagaatggagccttgagggtcaggcagcgttcagaaaagcctaggaggggaagtaggaatgggaagccagcatcttccaggaagccccgcccccaccccagcccagccggtctccattgtcccagccaggcccaattagcacctggctcctgcaggggccaattagacaggggctgaggtcagctgccggccaaggccctgccacccctccaagcttcaccaagccaagcacaaaagctttctaggcatcatctctgctgcagcaggaagggaaagaaagaacagaagaaagggaaaattcactccttttgtttctttgccataaccttgggctgaacaaagaagcaactgcctcccctccctgggagggcagcttctgtggagcaggaagtctgttttaaacagcaatttgcacagatttgttgtggttgggaggcccagatgacattcgaggggaaccaggagcagagacctggggtgagcagggccctggttctagaaactcctgtgactccccactgcgctctgttcagaagcagagcttccgggcctggctggtgcaaacaggtgggcctgctccagctctctagccagacagacctgtgtactttgctgcctccaaagagcccagcccacatgggcctccacaccttccctcagtgttccccacctctgaagtcccacccaatccagtcaaatctcacctgcacctcaaaggcccagctccacccctcccctgcaggatcccctccccaaccctacccctggccttgacttgcactcctagggtgtgagccatgtcccacacaaggcctgcctcccaccgggaactctctgagtgcagggtctccccacccccaacagagctgagcttaggggtacaaacagcagctgccaggccctgctggggagcaggtggaagggagatatatgccagagtccaaaatggggtttgggaagctggggccaccctggggtggtgacaggtggagaaggggacccaccagtgccattgcctcctccaggctcccacccccagggcaatgccacatcgcacagaccaccctgccctcacctccctaaccctgccctctgtgtctcaggagcgcagcctctcccactgggctatgcccttgccgcttcgatatcccacccagccaatgaggctctcagtcctccctcgcctgccctctggtggtgatgaggttccagagtgaatggagggaaagaaagaagcttgtcctcatggccagtgggttctattgtccttcagtggctgggaagggagcttggctgggtgggcagtggcaaagaactgagaggccagggtcccagtggcattggcccgtgtgtttctgggagtaaggggacttcttagccatggtgagccccaacccctgggaaaacactagtccctttcagcaaattttcaggcacaacctccatcctccccgacttgtccctgagacggcccctcagaactgggcttttgctccctggtctctggaactggaggaggccagcatcaatttgccagctgaattttccattgtattttaaagaaatgtggttaattcgctttattttattttatcttattttatttatttatttatttttgagatggagtcttgctctgttgcccaggctggagttcagaggcacgatctcagctcagtgcaacctccgccccacccccgcctgccccccagttcaagcgattctcccacctcatcctcccaagtagctgggattacaggcatccaccaccatgcctggctaatttttgtatttttagtagagatggggtttcaccatgttggccaggctggtctcaaactgctgacctcaggtgatccacctcccttagcctcccaaagtgctgagattacaggcatgagccactgtgcccggtgtactttttgtatttttagtagagagggggtttcactgtgttggctaggctggtcttgaactcctgaccgtgagtgatccgcccccctcggctcccaaagtgctgggattacaggcgtgaaccaccgcaccgggccaagaaatgtggttaattccctttaaaagtattgggaaatttagattagccaagagagacctctctgacattcaaaggacacctacaggagttctgtttggcaaatctggcaggagcagggtctgggtcaaaggatttgcctgagtaagtcagggaggcagggaggcccttccctgccatcaaggtctttaggagctgaagggggagcatgtgcgtggcccttggcagatgaggagtgccaggctggtgtaggcgagaaacagcttctgggcagaggtagggaaggctttgaagataggggcccagaaggctgggcccatgggtggagtggccagggctaaattctgaaagggggtctagctgtgctgaaagaggtggaaattcaaagttggaaatttaccatgagggccagtgggagtcattggaggggtctggaggccagagaggatgttccagttacctattgcaataacaaactaccccaaaatgttatcatttaaaacgataattttttcttttattatcacatctcatagctttgtgggtcaggaactcagccacggcacagcaggtctaagtcctcagctgggacgacctacgggcaggggcgggagcagccagggctgggtgggcctcgctctctcccatacacttagtttgggcttcctcacagtctcagggcagcaaggaattagcagctagcagggaagaattggggttactgcaagatgggtctcatcccaagcccctgtcctcaccactcagccccaacatcttccctggagctaacccaggatagaggccccaggttcaagattcactgagtgacttcaggcaaatctctgcacctctctggtcccaatatcagaacttgtgagatgggggttccagggctagaggtcttggaaggctggctggaccacctggaggaaggacatgtgctcctggaactggggagagagacagctccgcacacaccttccccacaatatgagctgtgggccactcaggttggcctcatcccaccacaggctgaagctgagtgtctgtgggaggcggctgccctctgctgactgcaaaggcaaaccacatgcagatggcctgggcctgccagcgatggatcctggggatccggggaaccctgagattgggtggccgcccaaggaaggggacagaggagagggtgtgtgcctggtccagcaaacccaccctctgcacccacttcaacactagccagactgccacccacactacctcagacccagcaacctgtctcaggcctccttctctgggagagtgaagcccctccccgctcctacccctgctccagcccatacctcccctatgcatccctccctcttaccttctaagtctccaggaaatcctctctctccaccactatgcctctccttgaccctgttttcctagctacctttgacccttctcaacctcactgtcccctcagaccttacccacagcacccagcattcagagcactggccaaggtcacttcctccaggccacaccaagaggctccctctgcagatccggaaactgctaagccttctctcctttttccaaaattcttttaaattgtgaaatgtaacccatttcacaatttaagaaaaattgcattgaacatatagaacataattattataaattattatatagcaaatgtccatgaaaccaccacccaggtcaggaaacagcatcaccagcatcctcacgcccctcatgcccctcccagccacacccctcctctcctggatgtaatcactctgccagctttctgtccttgctttgcttctttatttttttattttttaattattttttttatttttgggacacagtcttgctctatcacccaggctgaagtgcagtggcataatctcagctcactgcaacctccgcctcccgggttcaagtgattctcaggcctcggcctgccaagtagctgggattacaggcacccgccaccacgcccggctattttttgggcttttgtgtagaaatggggtttcaccatgttagtcaggctggtctcaagcttctgacctggagtgacctgcctgcctcagcctcccaaagtgctgggattaaagggttaagctgccggttggttcacgcctgtaatcccagcactttgggaggccaaggtgggcggatcatgaggtcaggagttcgagactagcctgaccaacatggtgaaaccccgtctctactaaaaatacaaaaaaaattagcccggcatagtggcaggcgcctgtaatcccagctactcaggaggctgaggcaggagaattgcctgaacccgggaggcggttacagtgagccaagatcacaccactgcactccagcctaggcaatagaaagagactccatctcaaaaaaaaaaaaaaaaaaaaaaagtgtgagccactgtgcctgacctgctttgcttctttatactgtcgctacctgagcatgcctctcgaatcactctggcctaaattttctatttttaccttcatggagagggcaccgtgacatacacattgctttgcacacggctcttttgctcaccttgatgtatgtgaggttcacccacatcatggtttcttattgctctgaagtatcccgctgtatgggtctccacctgcccctatctctgccccataattcctcactcacttgccagttctttaatgtttttatgaaggtgagttttgctttgtgtcccattcagaccatctctagcggcgggttcatctccatcatccaagccgcaagactcaagcggaaggtggttgtcctccttttgaagccctcttgccagcctgctctcgccgcttttcctcctacctctctggcaattgcgctagtcctgagagctcctctcctaccaccccttgtccttgaaccccctcctcactccacagttgccagacgctgaaaatctgctcccttcccaaggctccaatggaaccagggctgtcctgccacctgtcccccaccaggattcactccaggcttgatcaccatcagccactgctggcctcctgcacctgaggccctgcaggtacctcacccctaacacgctcctcccccaacccagctccccctccttcccactccagacctgcgcctcctccacccaaagaccccagctcctcctctcctcatcccccacctcctccttctcccctcttcctccttcccactccaggcatgcacctctaccaaaaggccccagacttctcccactcctccccctcctcccccacctcctcctcctccacactacaggcatgcacctcctccacccaaagaccctagccccctgccaacctcctgctctgccatccccaaccctcctcttcgttgttcacttcactctgtcatgctgagtcctccttggtctgcctccacccagcaagggtccctggctccctgctctgggcctccattcatttctctgtccatcttggtggcctgaggcatcttgccacaaaccccctccagcttaggcccttcactggcctgcaggatggaatccaagctcctgagattggccacacccctacttactccccaaccagcactctgccctccaggaagtcaccgactttgttcctgatcatacactctctctcctccctgcctttgccacagtgtctcctctgcccaagagccctctcccctaccccgggtaacacctgctcaccctcctagagtgagctcaggctatcaccacctccaggaaggcttcctagacctggggctaggaaaagagactcctgtaagctctcctctgtcacagatgtcactgccatctccttggtgtagatgggagaccatcacaagcagggacggtctgggctggtctgggctccatggccccagtgtggacatggccttcagcaactgctgatgactgtgctgcttccaatgtagcctttacactgagtctctgtgaccttgggaacactacttccaatctcagcttccccattttacaatgagtttataaggaccctaagtagccacaggtgtcattggatgcagtgcctcagattctgccagaagcacttcttatttttttgcggggggtgggtaagggttaagcattaccctctttaggcctcctgcacccaaggccctgcaggtaccttacccccaacacaccctccctaacccagctcctccttctccccactcccagcataaaaacaaagacaatcgccattcctcctccttcgtgggaactggtcctcagtttctatacaatgaaagtagtcacatcatcatatcttctgtgcccactgcccagggttataataagaaccattaaaagtgcgacggcaggcagaatggctcatgcctataatcccagcactttgggaggtcaaggtaggaggatctcttgaggctaggagttcaagaccagcctgggcaacatagcaaggccccatctttacaaaaaatttaaaaattagccaggcatggtggcacacacctgtagtcccagctacttgggaggctgagtcaggaggaccacttgagcccagaagttcgaggttgcagtgagctatgatcatgccactgcactctagcctgggtgacagagtaagtctccatcttggaaaacaagaaagcactcagaaggtggtggaggaaaaagagatgctgttgccaggcaccctgtgtgccagagcctgggctggcactgttcatgccccctctctctccacagcaaccccccttggggtggggtgattttcccattccacggatgaggacgctaaggctcagagaacagcctcccttccagagccaaagcgaaggtgtcggtgcagcaaaggccaccagcgctcagtggcagtggggcaattcaaacccaaggacacctgacatttctcacctgggcaggatctgatagctgggtcttggatggggaaagcgcagtgtcaatgggtgaggagaatgcagtgggcactagccttaggcacaatggctttggagtcagtccttctagaggaggctaagcctagggacaagacagggaagtggctggtgcctgaccctcccccagcagactggaaagtggggagggggctggaggggagggattggagcaggggagtcagcaggaccacaacaggaatctgggccatggtgtccttcctgttctcaaggctgggctgtgacgcagagcatggccctgggggttggggaggcccagctccaggctgtagggagtggtcagggctgctcatctgcaggcagtgtcctcccagaccagctgtgctgctcaaggtcactgctgtgcgggtgggggaagccgaggagggaaagcaggtccttcagtttcccacagatgtagagggaagagagcatacagactgaggggtaagccagggccgagatccctctccatgccctgggggagccctctctctcagagagcagccaggcttggtgggggagggggataggcacctgtggaggcctataggactagtctccgaggagtggagtccagcagggaccgtctgactgagacagggacgcggcctcaccagaagccatgctctccctccatctccttcctcgctctgggccccagctttctttgtctgtcaaagcgaggtgttaataacagagctctgggccaggtgcggtggctcattcctctaatctcagcactttgggaggctgaggcgggcagattacctgaggtcaggagttcgagactagcctgaccaacatggtgaaactccatctctactaaaaagacaaaaattagctgggcgtggtggtgcacgcctgtagtcccagctacttgggaggctgaggccagagaatggcttgaacctgggaggcagagtttgcagagagccaagattgtgccactgcactccagcctgggtgatggagtgagactccgtcacaaaacaaaaataaaaataacagagctctgctcatgccccaaaacagctgagttggagaacaggagggtcttagaaaaaatgaccctctgaatgagaagagggggtgatcagacccatggggtgggctgaggaactggcagccccctcccccaggactcactccatgagcatgctcacaacccggttatggacaggatcgtattaatttgccacatgcactttcctttcacaatagagcgtggccatctctgtgtgtcagtataataaaatctgggtcatcctttgtgaccacagcctgtggtgcagagactgagcatgccctcatataagaccacaagctgtgctgcagtgagcatccctgcatgcattttcctggatgtgtgtgtgcgtgtttcgctggaagccaagaaaacccatttggatgctgctgtaattgtccagggcagatatgctaagagcttgaaccaggctgggcaaagaaagaaggggccaaatttcctttgccaaaatatcgtgtgcttcctttggtcagtcccccatcagtaatgggctgccataaactgaagatttagagcacagcaaaggaagggcctgggagctctgggggcagcaaggaggaagaggaaggggtctgacctgttgattaaagcagtgattagaatagaaatgggtgtggaggagagcagcagcctccaaattatacctgcctgggcaggggcttcacgcaccaactcttgagcctcacagcaacaccaggcatctccgtgtgaggactctgaggctcagaaaggtgaaggggcctggctgaactcacactgcatgtgagtggccaagctggcctgctgatctgggcctgactgcaaagccctgtgtgtgtgtggtctctagacagagtctctccattaacaatgctgtccgaggacaccagatgggcagatctggaggagccaagacctggaactcaacaggggcaagtgctggagagatgaacctggcactggtgcaattagagggagcccaaccagaaggctagacagtggcaggtgacaagtggtgtctggtgggcccctgctgccaggagacccctgctctcgaagccatggcctgccatgcagcaggtgggaggcagtggctgagaaggcaggccatatccgcagtcagcatgaggcccaggtggttgctgggggccgagctctgcttcctggaggtgtgagtccccacccgtatgtacacagcctcccacagcttcaggaagcccacagccacaggggctcagcaaacgcaggagcaaactcacttccccatgcccatttcctcccccatcccagctcccacctgctgttcctccatccagacctctctggcttcacatcgaggttgcagtgagctatgatggtgccactgcacgatccttttctattttgtgctgttcagatttaagaaactccctttgtgaaactttataaataacagtagggaatttctgcttataaaacaaatgcatataaatatagcctattaattttcatatatatatatatatacatgcacatgggcaggcatgattttttctctcgattggggattgcactgatcattcctttttgtagcctgcttttatcacttctcagcgtattgtgaagtgtccacatatggaggcctcatggcagaattgcacggctcttcagaacagaggctcaagtccctgcaggcctggatttcagaccctggctctatcactaatcagtcttgtaactgagcaagttactcacctctctgggccttggtttccgcattggtataacggagataatagtacctatccacgcaggtctgatgagaggactgagggagggcacataaaaagcttagaagaagacctggaacacagtgaatgctcaatgagcatcagacattaggattgctgttgttcctgacctcatggctgactccagcccccagccccacctcataccccacatcctgtagctggatcccagcctccactaagctctaacctgggtctcccagggtgaccttgggtcctctgactactgagctgtttggagggctgatgcccagtcaccttccaagtggcatccagtgggatttctgagaggttcttccctgggttctcagtgacgtgaggaatgagaggagttagaagatggggaaggaggagggaaaaggtgaagaaatagctatgatcgagccagaccctgcaaacctggccctggatcttctcaagtctccattgcccataggcctcctcccctgtgtccacacctggggtttccccctgagttggtatcacaggacgtgatgtggccccggggagagaacattagtgtggctgccctcacatggccaggatgggtgaggatcaagtcataaccacccttccagggagctgctaagacttagggccatggcttggggctcctggtgctcactggccttgtgggggacccactgactttcaagtgtagatgtggatgtgggaccagggttgctatggggcagtgggctcagctctgggctctgggatccacaggagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccagtgaggcccagaacacgggtgaggatgtgcaggccaccaagggcacccgggcttctgcctgggcccaggctccaggttgtgcaatagggtggctgggagcttctcccagatgtgcatgctgctggactctggcaaataggagcccctcgcccacagacactcacacagtccctgcccagctgggtcctctcagggatgggaaacagagaatccagtcccgtcccaagccctcgggccaagggatatctgccttcctgctactgaccatgctgatttgagctgggagaggcttcctccctgagccagctccccaacccacctaacagtgtccatgaagcagaaactgctgctgagtgagctggatatgaagaaactgagggacagggtgcagcatttgcagaatgagctgattcgagtgagctggggcttgtgggggcagaggggagggagctatggtgggggagcatcggggtgagaagagtctgggaggagaagggagaacaggcacagagggaatggaagcacggaagaaagggggaccagcctggtggaggattcagcagaggggccgaggtggaccctcagggccaaggtggactcccaggcacccattctctccccttctctcctcccccatctcacagaagaatgatcgagagaaggagctgctccttctgtatcaggcccagcagccacaggccgctctgctgaagcagtaccagggcaagctgcagaagatgaaggcgctggaggagactgtgcggcaccaagagaaggcaggtggcagaggggctgcccccgaggccaactgatgatggcagagtagggagcccctgggccagcccagcctctgctctgctctccaggtgatcgagaagatggagcgggtgctggaggacaggctgcaggacaggagcaagccccctcctctgaacaggcagcagggaaagccctacacgggtgggtccacaccctgatgtgatcagctccccagcttctgctccacccctggaggccctgccttcctggagcctctcagcttcaggagaacctgcgaagaggtcccctgcactcagttatgtctgtgggcctgggagacccaggattgccctgctcccctcctcattcaggcgccccatccagagatcccctgagctccctccttccctggaagcccctcagaacacaattgggatgcagtgtgagccaggctagaaagagggtggacctccagaggagggccctgcagactagcacagcagagagggccttcccctgaagaagggccacctggggcaacacttcccagctcctagccccaggatccgtcgaattatttccccataccgccaaagattctgcctctgcaaagcaaacaaacaaaaatactttgattaaatcaatgatctggggccaggcgcaatggttcatgcctgtaatcccagcactttgggaggccgaggagggcagatcacttgaggtcaggagttcaagaccagcctggccaacatggtgaaaccccatctctactaaaaatacaaaaattagctgggcatggtggcgggcacctataatcccagctacttgggaggctgaggcaggagaatcacttgagcccaggaggcagaggttgctgtgagccaagattgtgccactgtactccggcctgggtgacagagggagactccgcctcaaaataaataaataaataaatgatttggaggttttcttccccatcgatattaaccaaaagccacctaaaactgccaatcagcctctgataagcagaaaggaccaggtaacaccatatcaggccagcccaaagcaagggatttccctgagcctgcctgtgcaacctcacccagggcccctgtgtgcccagccctgtgcttagccttcaccgctgagggtctcaggggcaggagggtgtttctaggagcctttagaatgcaatgaaagctgggctggcctttcaggaagcctgaggtcatccaggagtctggatgagactgagaaggcaacctagggaggggaaacagccagatcaaaggcccagggagtgagaagaattccaggatcagagaagggaggaagagagagaggtgaggagctgaaatacactgaagacaaatgaggagttagagagaacgttgaggtcaggttctaaagagcctagaaggacagcctgtgtgcacctgatcccactggtggtagggagccattgaaggcttgggagtagaggggaggggtggcagattgaagcaaaatgctggagcagatcaggacagggacatgggaagcaggagagcccatctcaccaacatctgtggccgtgtctctaggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggtaagaggcccttgacctgggcctgcctatgccggtcactgggtgcccagaaatcacccatggtacaacccaagttgaagatcaagaccaggagctaagcttcccagggtctccagtctgcctgggggctcctggaatcagctctcaggccttggtctttttctcctgcggaatgtgtgtccccgaacacttcacctttaacctcatctagcatcccaggagaaagcaagccccttgttgacccttggtccctgaaccctgacccctttttcacctggctggcctccacctggaccctacacaggcctctcaaaactcccttctggagcattccctggtcttggtgcagccttggagagcccttttccatcccaggtggaccccggggagttgggagcaggaggagacttgacagagaggctacaagagacgcatggcccaggccactcagagtgcacagagaccctgcccgcacaggtgggtggcccagggcccagaaatgcccaggccctgctccacctctgaagatgcttcaggggccccttgctttacataaaccccaaagcagaacatttggaatcacagaatattgggcagggcaggggcacaggagagttttctctccatcccaggactcgccggaggtgagttctgttgaaagcacacctgactcatggacatccaggtaaagtgtgagggatgaggtcaactgcctcacaggttcttcacttcactcaaagactcccagtgcgttaattatagggggctccctaatgcattttacattaaaaaaaatgttgtgtcaaaacttcgtattctcaaaatctgtgtgggaaacagctgtgaaaaaagcacatgccagaccctgttctgaacttccagaagagggttcggcccaggtctgacgctctgcctcgggagctcagtctgaactcaggcctgactggtttcttcctcaataccttatggtttcccaagctcacactgccacagcctccagctggggccaaatgtgagtttgtgctttgcccacaggatctcctctctggtacttcagacaagttcaacctcctggccaagctggaacacgctcagagccggatcctgtccctggaaagccaggtgggtgagatgcaggagttgatgaggctggatcaggctcaccacacagcctataaccagggctcagtgtgtgagcagagtctaggctcaatctatgaccaggatcaaggcttagtgtgtggccagggtcggggttcagtgtgcaaccagggtcagggctcagtgtacaaccagggttagggttcagtgtgtaaccagggtcagggttcagtgtacaaccagggttagagttcagtgtgttaccagggttagggttcaatgtgcaaccagggtcagggttcagtgtacaaccagggttagggttcagtgtgtgaccagggtcagggttcagtgtacaatcagggtcagggctcagtgtacaaccagggttagggttcagtgtgtgaccagggtcagggttcagtgtacatccagggtcagggttcagtgtgtgaccagggttagggttcagtgtgtgaccagggtcagggttcagtgtacaaccagggtcagggttcagtgtgcgaccagggttagggttcagtatacaaccagggtcagggttcagtgtgcagccagggttaggattcagtgtgtgaccagagtcagcgttcagtgtgcaaccagggtcagggttccgtgtacaacgaggttagggttctgtgtatgaccagggttagggttctgtgtatgaccagggttagggttcagtgtatatccagggtcagggttcattgtgtgaccagggtcaggctctgtctatgaccagaatcagggatcagtgtggactcaggatcagagctcagtatgttgttgaaatgtccatctgtgtcttggtcaggctgcctgactgtttggccccctcaccctcaccccgccacccctgaggtctcgggaaggtgtcaagcccacatggcccagagctttgctttctgcctggacagcaggctcaggccctggttgtcctggccatcagggattagccctgctgcccatggtcctccaattgtccctctctgtgtctgcagttagaggactcagctcgacgctggggacgagagaagcaggatctggccacacggctgcaggagcaagaaaaaggtttcaggcacccctcgaactccatcatcatagaacagcctgtgagtgacccccctggagtagctcccaggggttcaggtggtggagcaggaagccaccgcacccccaaagtcactgggccctgagaaaagccattgtggagccaactccagggctgggggtcaggagtcctaggctcccattcctgctccattaccaaccgaaggctcggtcttaattcccccacctgtctaaggggaacagaaaacccctgccaaaactaccctttcccccatggggtgctgtgaaactcaaggagatgactgtggatgaggggtccatgcaggcatctccaggatgccctgacactgtgctttaggactggctgcgctcatgggcagagtagcttgtggccctacccccctgaatccatagagcctaagattctcaaattagcacacccttctcagatggccacgatgtaggctccactttgccaacttcccgagaacaaacaggcctgctcacaactgcccctcaagttcaaccccgggaccgcccagccccgcaaagcaaagaccctgacttctcctgctcttgagccagctgtgctttgcccgtggccagaagctcagcagcggctcctgggaaaggcctggaaaggatgagggaacaggcaaggaacaaaggcaacctttgcacactcacctgagccctggggacccttggagaaattaggtgtcacctgctgtggcaaaatgggtttagaaatctttgccaggtcatggcccactggattctggatactctgaggcctggtttgtcaggcaatatgcccttgagcaggtcaccccctgggaatggggggtactcacgcaccccgctttgcacaccacagagtgccctcacccactccatggacctcaagcagccctcagagctggagcccctgctgcccagctcagactctaagctcaacaagcccttgagcccccagaaggagaccgctaactctcagcagacctgagccccagagcaggcctccttccctgtgtgctggggagtctcatcaccgccccctaaaaatgacgttattaaatgttgtagctctgtga

SEQ ID NO: 943 - DNA, 37991 bp, Homo sapiens
atacactagaaaaatcaagttttttattttaaaatattttcaaaggctaaggccatagcaaaacaacccaagggtggttgaatcaaactcagggaattagaggagcatcagccaatgcaagcaggtctatataaaatacacatcatttataaatgcacacagcagaaagcacagtggccccagaggaccaggcagggggacaacagagagaaacagagcactatctggagggacaggcacacccgcaacactcaaagccctgggccccaagtgcacctccaaagtcacctacgctgcagcatggctcttgccctttctgagcctgggtatagctgaagaccaagttcaccagcatcttggcacatccacctataactggcacctctcatggcctctgacaaccaagcaaggctcagagaatggatttttatctctgtctttcagcaaggaccagggagaagtgctgaagcaagaagggttattttcctaaaaaaaaaagacggatgaaagggtgaaaggggctggttccaaaaaaaaaaaaaaaaaaaggatgaccattcatggaacagtgagtttcacctgagacatacagatttggtgcaagcaacacaaaaggccaggctctaaatttcatcctaaaaactgggatggggagagcatgaagagaccacttactggtagtccctccaattctcatttgggtttgtcataaacaggacagacagtcgtctgcttcacaataaataatttccacctggatttcattccctgattaatctctcagtgtctgaagaggggaaaacagtggctgcttctgacaccgcccaccccatcaccagcaactttccctgatacttctggcctcctcactaagcccttccagaacctccaaagccactatcttagcagatgggagtcccagggcgatgaggccagagttgtgggacacagagaagaagagaaggccttgatagaggaagaggaatatccaaggcaaagccaccaccacgtccaacctcctcatcctctacctttcctgtccccagaggtatgagatagaccccctggcctggttcctgcactgtgctaggcccacagtggacacttccaccttaatggagaataggccccatggagtggaggtccctcctccatggcctgcaacccaatgactatgggggtgacacaagtgacctctgccctgtgatggctcaacaccatcacacgcaactgtccagacaagcccccctcaacgggctgctgttggccatgcctgagatgcgggcaggcaggcagggagtggacagcaagacctcagatccaagcctccacccttcccttccctatttccagggcttgggacaccttagaaatgtttgagcacacaagggcaaaacccagtaccaggtctgtgaccacagtgatcaaaggccctgctccacttgtctcaccggaaagtgacagctgaggacacagaattcaggtacctctgttcttcacagccactgccaccatctccgccgtgggcagcatctccccataatgcagccagccacctcatgaggggccggcacagagccctggcccagagcatggaaattcatctctggctggaatcctggccatgagccctcccctctgcattcacagattctcagcaggcccctgcccaagcctgacaggtgcctggctgcccgcagagaagccctgtgggaacacagagtgttgggagggagcagagcccacatgggtggtttgtgttctgacctctgaccccaccataggagtgagctgtgtggcagagccacattccaaatgcgaaagcatggcctctgtcctttgaggtggcctccagtgttctgcctgtgtgccagaactgtttccaaggacccagtttgtttgtttgtttgttttctctaagtgtttgctgaagctttgtgtacagaattcctcagttggttccaaaaaatctggctttttgcttgagtccaaaaattgtagaagccagttactttgtaaacacgtacttcagatctctcatagagggaagagaagagctgcggggaggaggagggatctggaatattttccttcataggcagtcttagcacagcagcagcataaaccacagggatcattggtggagacttagcacccagaacattcttcttggagaaggaatggggacaaaggccaagtggctgttacctgcacacaggaaagatgtccacatcagggaaagggcccagaatgcagacggacgtgggcagaagggccagtgataactttacttcccccaagagtgggccagggtgggactggtgtaccctgcacgctgcccaaccttgcttagggtcagaagccagctcaaaacaggaccaagtccagccaggcagcctggcctgaggttcttggctcctgtcctcaaccctcaatatcaaaggcattagaaagagaaaaggcctcacctgtgcccagggactgggtcatcccaactcaaggagcataactgctgctctagccgagaaatacggaacgccaggtaggatgaggacatgaccaggaagcagatcctgaagaaagcggcaatacggagttaaatatttcttccacagaaagagcatttctggaagttcaccggaaatagtggggaccaagctacccctgcagttggaagaattaaagagccctttgtcctgcagccagttcaggcctcagcatctttcttcccagacaccatgtaggggtcttcagacttgtccccatggaagtgtccttacagcccagctagagctctgggcccttcagctgagctctggggggagctctggccagacagccagatcagtcatcctaccctctctctcaccagccatggtggtccttcctgtgcctcctctgggaggtcatgatgatgaccccctaggcggtgggcccattcccccagcaggtgctgatgttgatggtcaaaacccggccagccgagccagaggaggctgatgagctaaggtgagggaaagcaggggctggctgttcatgtcacttcccacgatgctccctgctctactggtccttagacagaggtagagacaagtcaggggttccagaagctgccctagtggtgggcagtggcgaggccaagcttttcctctctctctccaattttcctggccctccttctcccaaatccttttcctcttctcaacatctccatatcctgcccctctccaccaaatagtcttaaccctaaattacagggtttcaagaataaaaactggagatcctttctcttgctacagaagggcgtgccacatggccttcagataccacccaagagcttgaatttgactcagaaacttccccctggttctgaatagtgaattccccacactccaaggcccttgttccaagcacctagacatgcaggtgggtctgtccccctccccagtatagtcacttacagcacaaagaagaccttgaggagccggtaatcccagagcctcagctccccagtgctcctgggctcctcctccagctcatcctcctcatagacagcattctttgcagtgggagagcagttcggcatcttcttagggcaggcaggaccccagcctggcatgggccatgcccacctcccaccattttctgaagctacttgggctcttgacttttctttatggattgggagaaaaaaaaaatcagctctcagaagccctgctggctgtggtgagccctttttatggaactgggaagacagaaagtctggcctttgcaagtagttgccatggacaagccctcccgaacttaccagacattggaggcttcctggaggggaagaaactgtctgtggagtccacggatgatggagggatacaagggatgttgtctgggagagacagggacctggaggaagggcatacctttctccacttcatctcagggatgaggacttcctgcagtaagacaggagaagctatcttaccatggcccttgcgatctcacttgccctaaggagcccacaccaggtttatcagagttttctccagatattaccaaatatagatgcctagccagggatggaagcaggtacaagcgaggagggcagttgctatagcaaccatatgcctctcctctctgctcccttgctgtgactagctattctgccagcaaacgatgtctttgaacactgctagtgtagaaccacagtgggatcttagatgtgagccaacccagatacatgctcagatctgaggccaagaaagctcggcacaacatgtcttaggtaggataagttcctgctcctatcccaagccctaaccttggcagggaggacttagcgtccccatctacaaaaatgggaacttcaccttctatccggcacatggtattatgcatatcacatgcttggctaaacactaatagttactaaaggagccttcaaacaccccagggtcatttctacgccatccctgccctagaaactcagttctgcctacccagggccccagctgccaaaggaaacttctggaactttggcaaatctaaaataagtctgtctgggttcttcagggatagtctttggagttcttccctagggacatcttttattttttttttttttgacagggtctccctctgttgcccaggctggaatacagtgttgtgatcttggctcactgcagccttaacctcccaggctcaagtgatcctcccatctcagcctcctgcgtagctgggactacaggtacgtgccaacatgccctgctaatttttgtatttttattgagacagggtctcactatgttgcccaggccaatctcgaactcccgggctcaagccatcctcctgctttggcctcccaaagtgctgggattacaggcgtgagccaccacactcggctcccagggtcatctttatccccttgaaggccctcttgactcagctgaagaaaagaggatgggccactggtcctgcatctgtacaggtgtgcagcccaacctggccagtgttttggtgcttggacttctgttctactcagaaagtcagcctatcggctgggcacggtggctcacgcctataatcccagcactttgggaggcggaggccagtggatcacttgaggccatgaattcgagatcagcttggccaacgtggtgaaaccccatctctactaaaaatacaaaaattagctgagtgtgatggcaagtgcctgtaatcccagctacttgggagggtgaggcaggagaatcacttgaacccagcaggtggaagttgcagtgagatgagatggtgccactgcactgcagcatgggcaacatagcaagactctgtcgtccaaaaaagaaagaaaagaaagcctatctgctgaggccctggtggctctgcattatggtgtggcaggtttaagagatgccctggcatagcatggccactgactcttgagcctggtgccccagttctgcattgtgggcccccctaggaggcccagaagcctcagagctccaggcactgtcagtccagcagtctttgctcccagcttcagctctcaccagagactcaggttcccctgaaaattctcttacactcagactcttcttgctggaaggctgaggaggaaagggaacagcagtcacttgtccatctggaacaggcaaggtcaggcagggggaagcatcagccctctccaagagagctttacctccaaataagccactttgtgtcaggtgaagcccagctcccagggtctatagggggccccctatttaatgctggagcagagaggcaaaccccaggaaacttactctcccacctgctgccccatccctcccctcttcctcaccataggcagagagagtcatagggcatgttgggaagcagctacgcgctcctatctgtgcattaaggaagcacaagtgagggcctggacatagagacggtccctgacctacgatggttccacttaagatttttcaactttatgatggtgcaaaagtgataggcttcctgtagaaactgtacttcaagtacctatacagccattccggttttcgttttttgttttttgtttttttttgtttttttgagatggagtcttgctcttgtcacccaggctggagggcaatggtgcaatctcggctcactacaacctcctcctcccgggttcaagtgattctcctgcctcatcctcccaagtagctgggattacaggtgcctgccaccacacccggctaatttttgtatttttagtaaagacagggtttcactacgttggccaggctggtctcgaactcttgacctcaggtgatccacctgcctcggcctcccaaagtgctgggaccatacagccattgtttttcacattcagtacaggattcaataagttatataagatgttccacactttattataaaacaggctttgcctgagatgcttttgcccagctctaggctaatgaaagcattctgagatgtttaagggaggtgaggctaagctacgatgttctgtaggtgatgtgtacctctattaaacacatttttgacttacgatattttcaacttttgatgggttcatgggacataagcccatgaacaaggagcatctgtatatggggacacacaggggctcactggcctcaaagacatgcttgcaagcatagacacacaatccaagtactgtctcttgtacattgagcctgagcctttaactcccctctccctgccccattccctgtgctggagagatgggcgacctcccccaacacccttgtgcaagacctgcatccaggcctgagcgacttccctggccttcctgctcccaagctccatacctgtaggtgggtgcagactctcctcagcaggtcatatacactgtcccgggagagcagtgacacaaagatatactgggacatggaaagaaaacagacaggggtagggtgagatgagactccttgctgtgccagccagcccccttgtggattgggcacaggcccacaggggtatcaggccatgagagccaacagaagctctgcctaggaacttctcttccagcttgttgtacggcctgaaatacctactggagagctgcagggtggggtgaaataaagacctgggaatgtgcccgagtcagactgtgggctgtcagggctgggagcgggagactgacaagggagcatgggcccagtgcactgaccttctggctggtgttggtggtgatggccagtccattgggaaggagccgtgccatcttgtgttttttgatcatttgcacagacaccacaggaatgaccacctgagagggagagggatgcttctctcaggactaacccccaaggacgtggtccctttgctccctgcctagggacccagctgtgagcccagcatggccaccatggggaagcctggccccatgtggggaagtctctgaaccttctaccttttcatccaggctccccttccagttgtccctgccaccctgccccagccttggcaggatgtgtcactcttggctgtcacataggtatgatccctgttatccaggaggccaaggatggtggctctggtaaatctcatactctagtaatggagctccccaggctacttcttggccacagctagggctccgcctaaatgtgatatcccactctgattctcaaagcatttctgaaatacccagaggcagaatgatttggctgtgaactgttcaggccagctcaggccagatgtggggtccagattgggcccctgtttttgaaggggcaggactactttcctggacactggatgggatgcctcgaagctgcgcatccaaccagcaaggggcttcacccggggcccagcacgcagagagataggcatgactttgaggcatgcccgtggggcaggaggctggctcccctcacagggtcatggcagccctcaccactcattactaccttgatatccttgccaaagaggctggcatggaagcagagccagttgggggagatgtagagccggccctggaggaggaagtccctctggagggcacaggaacacactaggatgtcacaggagagaaaatggccataagcaaggtcagcccaggaagccccaggacctgggtcctcacgttctggagtccacagtccagcctcaggacctgtcttcctcagactcccccttccccaccgcaggccccaaaccccaaacagtccattccccagcgtcgaagggtccttctcctgactgctcctccactccaccagcctgctggatgtttcttccttctccacccttgctccagagggtccaggcaagttcctgccctgatctccaagcctgcattctcaccacctcaggcagaatccctgacctttccctgctctgctctgccccaagggccttgattgtgcaaatgcccccacctgctcagtgagaggccagagcaggtaagaagtcaccagtaagagcaggacacaagattccaaagccctgacgtttccccaagaaaaccttcaaaaatgcaatgctatgtccaaaccagcccagtcttctcaccagcccagtcttctcacattctaggggagtggtccacatctaaaggacagccagttcccatttctaagtcgtgctttggaggctccagagcagaggcccctggccccaggcactctgggtgcctaaccagctataccgggagacagctcacctttgagaaccacttcctccaagggaacatccttaaacagcttgtggtattgctggttgtatttattcagtgttatctgcaaacacacaggctgcgtctgagaagcgctgggagatgagaccgccaaaggggccctgctccagccaacaggaaatgccacagccccccggcccatgctggggacttagcatgaggcagctagtaagcagccagtgagtatggagggctgtgtgccaagcacagcttgtctcctggtgctgctaggtcctgacaggcagcttgtactagcagagggggacacactactcccacccaggaagggatacacactcaggtctcctgatttcctgatgacaggcccggtggccaaggagccaaaagtcactgaattctggcagcccaggaccccttcctgggtgaatagtgagaagtcagcctccagacttaccccttctcggccacacttctttatctcttcacccttcaagccttctggccagtgcagactgcaaaggagacattccatttcgggaacaaggaaccccagtcctgcccatgcatcctcagtgccaattctgccctggccttgagccagaagcttgaggcagagatcagagactaggacccttctctaggggacacagcaaaatgacaagtacagcgagcacacagctaaactatacagctcatccctgggggagggcactgcgggaggtagagaggggtcgccaagggcccaccttccccagtgcgggtgagcagcatctcctggaggtgcgcctggtctcccagagatgctgaggagcttcccacctgggtgtcaaagaccctgtcccatttctctggccaaggggtaagcaggggagcaggcagtgctggaatagggacagtttggggtgtgggtgaggtgaaggtgtcagactcacagcgccggggcctggccacaggccatgatgccagcaggactgccctccctgccgcctccttcctgtggcctgagctctgctgcggggagcttggcacagactcacctgacctggctgaggctaccacactgggagagggggatggcactgagaaaaaaaggtaaacctttgccttggccaggttggcccagagcacaggtgagcagggaggaggctggaaacccgagaagcatggactctgctaggtcccagtgcactgggacagtcttgaggggcgggaggaagaagcctggggcagcctgtgcctgacctcacagacctgcaaaggggccccggctctgccttgaggtcctcttacaaacaggtcacttcctgagggcttcccaccctctagtctgtgtgtatctatgactgggaaaggggtcctcacctgtagtccgggggctcctcaactctgtctggtttctctttgcaggacacaggactgttcagagaagctgtctttctgtgcatttgttggttgctagggaaaaacaggcccatatcaggaagggggcttcatgaggacacctttccctaacagccccaccatgcccatggccgctgcctctggcccccacccaagactggccctgatattgagggtgacactgaaaatgtcacagttcagaggcagcagcgcaggcagaggttctgggatggctgacggagtaggcgggtctcacacagcgtctttcccgaaagccagaagttctgcttatgcctaggctgggaggaaaatcaacctgtctacctcatctccagtgccaggcagctcgtaggccaggctgagtgaggcctctagccccacccttgaggaggcacactgagagggaggaccctgagactcgcttatgccgagaacaaaagtgtccaaagtacccgcgcagcatgactgtaaaccatcaggttccgggaaagtaggctgagcacaggaggccttatcaaagctcaggagctgatgcgctgaaggtgtgggaggtggacgcccatcagcctacaggtgagtgtggccaggaggggaggagccgtcttataccaggaagtggcctcagccaccttggacagtcaggacagcttgatgatgagagccaaaccatctcaaaaatgtccctgagggagagcgtaggagggaacagatcctctctccctgggcaggtcgggctctccaatggcctttgagttcctgcctccactaatcgctccaaagaatcattaccctgttcctgctcctccaggctacacatcaataaagcctgagccgtcaagccagccccaaccaagtgggcccaggggctgaccaagaaagagagggtggccaagaagcagggccgtgctggggcagtgtggtggtcaggaacaggtaacaaggtcacgtgcagtggtcctgctgcagattaggagctggagcctggaacctacaaatctcaatgctcagtcaccctccgctctgtgactgaggccagccaaagttctcttcttcaagaacagagttttcgcctcagcccaagatctgccaggaccctcagagattgattcagcctcacccgctcccaccataccattgtacagattatgaaactgagacctgccaagggacaggctgtgtccggtcctacagtgaacagccagtgacctcacccacaaaatcagcccagccatggccatgtggcctggttacctctgtcctcaaccttagagaggattttgccacacatatcaacatatacctacaacagtcttgtgaagtgacagattttgctagagatttgactctcaaagttgatttctggatttatttggttccatcatgtcacatttcacagaggtttttttttttcccttgatttttaaagattatagaaaatatgaaaaatatatataagatcaaaatcacctaaagattccccaaaaatcacccaaataaaaaatgtatgataaacatataacctatgtaaatggttatataatctataatttgtataccctacttctgtggcttaacctgatttcatgagaaatttcccatgtcactcactgtccattcctaagatagattctcagaagtgaaattagtggattgagaatgaacagatgctgttccagttaacccagccatcagcacgacatgaaggtgcctgtttccccatattcatgcccttctctggatattgtctctcgctcacctttgcaaatctgataggtgaaaatacgttgtcttcatttgtatttctgcttactggtaggttgaacagttttttccaaataattattaaccactggaagttcattgtcttatagagaattcacaggtgaaattctttcttcatttgtattgaagttctttcttcatttgtataaattttttctggcttttttattttttttttttgagatggagtctctctctgtcgcccaggctggagtccagtggcgtgatcttggctcactgaaacctccacctcctgggttccagcaattctcctgcctcagcctcccaagtagctgggactacaggcgtgtgtcactgtgcctaatttttgtattttttagtagagacgggggtttcaccatattggccaagctagtctcgaactcctgaccttataatccccctgccttggcctcccagagtgctgggattacaggcatgagccaccacgcccggcctttttttttttgagacagggtttcactctgtcgcccaggctacagtacagtggcgcaatcttggttcactgcagcctcagcctcccgagctcatgtgatcctcccacctcagcttcccaagtagctgggactacaggaatgctccaccatgccgggctaaggttttcattttttttgtagacagcgggggtctcactgtgttgtccaggctggtcctaaactcctgagctcaatcgtcccacctcagcttcccaaagtgctgggattacaggtgtgagccaccatgcctagcctttttttttttttttggagacagagtcttgctctgtcacccaagctggagtgcagtggtgtgatctcagctcactgcaacctccgcctcccaggttcaagtgattctcatgcctcagcctcccgagtagctgggattacaggtacctgccatcacatctggctaatttatttatatatatataaattttttagcagagatggggtttcatcatgttgaccagtctggtcttgaactcctgatctcaggtgattcacctgccttggcctctccaaagtgctgggattacaggtgtgagccaccatacctggcctgtaaattctttattgagaacgttaatccttagtttatcatttttgtgatgttttccccagtttgtcgtttctcttttgtctgtggtatttctgctgtgcctgtgtgtaattactgcatgggagattccatctatttcttccatgtatgtttctcgcttggtctcagtcctctcacaggacaggcctggggggagtagatatgcaagtcagaccactgagccattacagcgtgggcctggcagtgaatccatggggccgccagggaaaaattctgtgggctcagctctgaagaacctgcatcccagactgaaggatggatgagggatagaacgggatgacaatgggaaggagcttggacagtgctttcagaggcagggagcctgttgcttgagaatgtgagtcaaattctcaggactgcaggagctcagaggatgcacagatccctgggaactgaaatacagtggggttcctagagaaaaggaagctgagccttagaaactgggtataattataatcttgcatggattatctaatcttgcatagataaccatgtctttgcatggattctaaaccaaacacatccttaggttcaaatgtgactgtctcagggagagaagccttccctcagccctcccccagcctaggtgagtagtccctgcttcagatactcactcacagcaccctgatcggaagtctctgctcagcatctgtcacactgtgtctgtgtgccatgactgtgcatctccaggggctcacagactctgcctggtccttcattgaatcccctgagtccagtgctgagcatgcagcaggcgctcacgacaactccagggaggagctttcctgccttcagaccaggctcagccaccaaacccggccaactttcaagtctctttaaattaaaagccaactcctggccaggtgtagtggcttatgcctgtaagcccagcactttgggaggctgaggcaggtggatcacctgaggtcaggagttcaagaccagcctggccaacatggtgaaacccgatctctactaaaaatatataaattagctgggcatggtggcgggcatctgtaatcccagctactcaaggggctgaggcagcaaagtcgcttgaacccgggaggtggaggtttcagtgagccgagatcacaccattgcactccagtccagcctgggcgacgagagtgaaattctgtctaaaaaaaaaaaaaaaaaaaaaaaagccaactcctttacacatgatcaagaggatggttgcaagccattcctttctgtttgcccactgaagccagttcctcctgtctctctgctgataatgctcttggctcagagaccctgcctatggccaaaatgagtaaacctgccgcgctctcaaaacgatcttcagttcactttccactcaatagtggtgtcttctcccctgtagtgtttattttgacgaatgaaaataaagaaatgggagtagtgccacctgaagaagtacagggcagactggtcactgagcactcaccagcagaaccactcaggcaggggacacccagtgaccagctgggccctgacccagagggccaagaaggaggcttcaagagcacagggctcagcctggtcccccaccctgcaggcagccgctgtagactctactcacagactttttgtcgcgctaggtgttcatgccctgtgggttgtgaaccacatctcctcccgctctgtcccatccagtcccgtcccatccccatgccccagctgtggaattcatgtcaggagtcctggaagccataaaaaactacctaatttctgtcaggagaggtatggagcaggggagtggcagtgttttgacattaaaggaggtacaaaagattggaaatcctccgatgaggcccttcccctggctgagcatggtctgaaggcaggaaggcccctccctagagggcacaggaggtgtctgcctgctctccagccccatgcagcaaaaaatactccctgagcttttcacatcatgaggcaggtagggagctccccagcctgagaagctgccagagggcagggatggcaccagcacagggagatgtcaagaatggggagacagggcaggagaggagggggcaatgagtgggagcccagatacacaggagtctaggggcctcgtggtgcacctgacacaggcattctgctctgcacacctcccccaggctccaaatacccacaccaggcagtcactcccaagtctacctctgtaaccttgacacccacaccctcccgagcttcaccccctgccatctagacgtgtccatgcatgtaatctcagtagcggccccccaaacccacttcctccttggcatccaatgtctgtgaaaggctctgtctccccacagttacccaggccagaatactccactcattcttctcctcacctccacagccaatcaagccctcaggtcccccccaagataacccataaaaccatctcttttctcattcccactacaccacgcaagcccaggccacaatccttttcccagatgctggcaacagctccctgaccaaaactgcctccggctgtgcgggtacacactgcctctctcccacatgcacactgcccagagggccagctggggcccgggtctgatcctgccactctcctgctgatgctccttcttcacttcccgtcacttcttcagctggcctcccagaccttcctgctttccagcctcatcgcccgtcattccctcccctgcagtacagcccagcaccttcacttctatgccacagcagcccttcacacctgcgtgctttgcctgcatacctgcttacccttctcatgcttatctacctggggagttccggtcatctttcaagccccaggtgaaacgtcaccacctctgtgaagccttcctcagtttcccccagcagaggggctcatccctcttctgtggtccactgtcgcttcttgcaggctgctgccccagcacttaccacaccagagtgtgcttgtctgtttacacatctgtgtcccccagttgactctgagctccagcaagggcgtgtcccgtacatctctgtatccccagcatacagccagcacccagtgtttgctgaatgaatgaaggagagacagggaaaaagagataacaccccaaaagggagaagcagaggaaaaagcaaggcagtaagagtgagggggcgcagagaatgacacacccagcaggaaaggaggggacaggctggacaggagctgatggggtcccccacagcagggccctttcctccaggagctctggttcggtacctcaaggcactcagcccagggtggctgactgatcaaagaggaactcaggtgggaggtaggaggcccaagcaaagaataaagggtctgggcaggatggggtatttgggtgaaagcacaggctgggcccctcctgtctccagtgggctgcacacacctgggcgggccatgccctggcaacactcccccagccttcccagcccttcctaaccacagggcaaacctccctccagtactcatccaagcctctggcagtggccaagcctgtggctgatgctgaagcacaaatctcagccgggcctgcgtggtcacaggcagggccttccccacagctggggtggggtggtccccttgggcatctcctcctccaaggaggtgaccgcactctcccaagctgacttcttgtggaccctgtgggtcctgccaactcttctcaaggccaggccaaagacagctccacccttttgtgcagccagccaggacgctcagccccagcgagctccaagcagagacctgaaaacaccactgttctcttccaaacaaaaacacatcatggcaacaggccccgacagtacaaacccagaaaccagggaaatagccatccaaggacaggaagcttcgtggacatctgtcctggataaaacttcgcaaactggggctcaataggctggacctgggactcttccccccagtggctgctccagatcccccgacaaggtctcttcactccacctgcacttctcactcagctcacctcctacttcagggggaaaggacactctccttttaactctaaagtgtagccgctgggtgcacattagaatcacctgcagtgctttttttttttttttttttttttttaagagatggagtcttgctctgttgcccaggctggaacacagtggtgcaatcatagctcaccacagcctcaacttcctggggctcaagtgatcctcctgcctaagcctcccaaagtaggtgaaactacaggtgtatgccaccatgcccagctattttttaaaaaatttttttatagagataaggtcttgctctgttgcccaggctggtcctggcctcaagcaattctcccacctcggctttctaaagtgctcggattacaggcatgagccactgtgctcagcctgcagtcctttaaaaaaaaaaaaaaatgatgcctgagctctgtctcaaaccagttaaatcagaatatctgggaatagcatttaaataactatagatttcttaaattgttgttgaagtattatttacatatagaaaagcacatgttaagtaaatgtacaattcaatgcatttcacaaacgagtacacacctgggaaccaggcccccagaactacccgctgcttcctctggtttcactggccacaccctcctggccatggatagccatcatcctgacttccagcaccacagagtgcttttgctgcttttgggactttaaatgaacagaatcataccatacatactcgtgtatgtgtctgcttttactcagcaatgcatttgaaatatggatagaccacaatttatttattcgttttactactgatggacatttaggcagtttccagtttttgcctcttatgaaagtgctatgaaaattgtagtaccagtcttgtgcatgcaagtattcacttccgtgggtaaacacttaggattagaagctctaggtcataaggcaggtgtatgttcagcttctttttttctttttgagacagagtctcactctttcaccgaggttggagggcagtggcataatctcagctcactgcagcctcgacctcccaggttcaagagattctcatgtatcagccccctgagtagctgggattacaggcgtgtgccaacacgcccagctaattgttgtatttttagcagagacggggtttcaccatgttggccaggctggtcttgaacccctcacttcaagtgatccacccgcctcggcctcccaaagtgctgggattataggcgtgagccaccgcacctggccggctttagcttttaaaggctcccaggtgattgtaaacccccagccaactaagaaaccatgggaagaatcctgcccccacccctcctttctttgtggcttctctccaaggccaatccacctgcctgggctctgaaactggggtcctgaccctcctgagccttcttcaccctggccctcttgagtttcaggaacttccttgacaaggcagggaaccccactgtcaataagctttccttcatctgtttaaggcctgggggcccatttcctaggttgtaccacagaagtcacaagaccagcttttccaggtggcagaggccggctctgaaccacactgtgtccttcccgagagactccctatgtgctctcagggccacagtcctcacacacagtcagaaactgggtgacaagacctttcctgatggcaaactaggattctgtggagagaggcaggcttattatcatcaatgtgctgaaacttgaagataaaaggtaatttccttcttttgcaaaaataatgtcattattgctgtcttgcactttctttttttttttttttttttttttttgagatggagtcttgctctatcgcccaggctggagtgcagtggcgcaatctcggctcactgccagctctgcctctgggttcgtgccgttctcctgcctcagcctccggagtagctgggactacaggcgcccgccaccacgcccggctaattttttgtatttttagtagagaaggggtttcaccgtgttagccaggatggtcttgatctcctgaccttgtgatccgcccgcctcggcctcccaaagtgctgggattacagttgtgagccacccggcccggctgtcttgcactttcatagaagctgtacctccctttttattttctcagatgacattccatatctaggacaactgctttgtcctttccactgactggaggaggggagaaaaatccaataatcgagtctcatactgagtgtaagggggtgaggcttagtgagttggggtcccactcagctcccctggcagcgggctccagaggggcgggaactcaacctcatcacaatcccttcttccaggaagggttctgagaacacccaggccgggaacgggcttgctctcccatcactgcctgtagcagctttgagatgaaggggggatgtggagggccagaggcctatcttcccaagacctaccaagtgaccctggccacagccagcggaaccatggtgtgctccaggcccaggaaaagccatcacaagctgaccagcagcctctttagagtgaaaagatgagccggcctgtcagattcccttcctaaggaatcctaactgggaaatccgagatgtggaggtatgcagccaggagggaacaggcgagagagagccaggtaggtgcgagctgcagctacactagagctgaacctctgggtgcccccggagactggctctagagcgagggaagagggggcaggaggcagagagaagcagggggccatgggccaggcctccagtctaggagagcacgaactggctcccctaagatgcccattaactcctgcatttgtgtctccacaaaatggcaaacagagaaaaaaattatcccctctgtgacctgcagatcgtcagggctactgtgaggatctgcaagaggtcttgactcagtctggggtggggctggggacacccataaccctgcccattgagcaggacgtccccgactagcactggtgagcgctgtgttagcctctgtcccatcacatccttgaaggatacctagaggggcatctacccacggcaagtgaagacaggggtaccactgggcctcaaaggcacccagaaagctccatacatgtcctccatgcctgaatctttccactgggactacagtccaaggaaccagccgcggcaaggccctctctacacctgggccacacccagtgactgcctcccaccaccatgggctcggaggcacgacccaacttcagctcaggcccagcctccctttcttctcctccctccaccagaggttagaggccagcaattgctgccccctcctgcccagagctcaaaggcctgtgcagtgagaacagtcgccacggagacagacagggacaaacagctaaaaccgggaagctttcctcctggggatatccaggatttcctacaaagcataggccaaatcacagagccggctctgcagagagtgccctgccggctgctggcttcgtcccatcatgcccgctgctggagcggcatctatttgagctggcacccccgggtctgctcatagaccactttttcttggcaggccacttggggcttggccatttccagacaaaaagctggtcattcaggtctaaaaacagacttgcattcattaaggaacagagcgcccctgtgctcttgggggccgccctccggccaggcctgctaagtgagggggcctgcagacaggctgagccgctcagacgcccccactcagggctgccaggggctgtggctactctggagacaagtcagttctgtccatccatggatactgtccagacagcccaccccaaccaccctgggatacccacctcagaattactctggctttgtggatccatcaggctcttctcaggaccacaggcaagtgtgaagggtcttggggtcctgaaagagcctggagttggggacaggaagacaggaatgcaggcctggaactgcttctcactgctgaggggctttgagtaagccactcttcctttctgggcctcagtgactcctctgcaaaggggcgagaaagtcacagcccaggagggacaacaaatgttgtctgagggaaaaaagcagaggccacgaactgtataaactgcagatggccactggccctctgaggtcagatgaaccctcatcccaggagggacctctattagggcatcctgactcaaccatggagggcaaggaagacttttctgaagacgtacaacattggagctcatctccaagggatgctagccaaatggagaagggggattctgggcggacagggtcactgtagaggggttgccatatacaaaggccccaaggccagaagtgtgcagcatgtgtgagaaagctaaatagagcctttgagtctggagggcagaggtgagcagcgaagtggtaaacaacaaggctggaggggttggcagggccagatcatgcagggcccatgggcctctataatggttttggtcattatcttaaaagcaatggggaaccaatgtagagatttaaacaggaaagtatactatcaactttgtgtgttaataatttgtttccaagtaatcccatggaagtggggcaggggagtggagggtgaatattggtgaaacaggaatgactcgtgttgttggttattgtagctgggtgatacatacgtggggatccactggacaactctctcatcctttgttatgttcacaattttccatggagagagatcaggtgaaaggctgtagctcagcagagagatgatgtcttggactgggtggcagtggtgatggagggccagggatggatttggaatatgtatttccaaatataatcaatctgacatggtgatgaattggatgagaggtaaaaacaagaaggtgtcaagtatgactccagatttctggcttaagcgagtaggatagtgggctcttttgctgagactaaatgaggtaaaaatggactagaagaaaagcctagttggaagcaacagtcacgagttcagccttgaacatgtgtgagagacatttaagtggagatgtcaaactatatatgactaagaagctcagaagaaaggtttaggcaggagggataaatttctgagttactggcccataagtgagaagaggagctagtaagactgtgccagggaaagtgggtacacaaggaacagaagctatcaacaagaatgccaagacttagggggaaataaaagtcttttcaacaaatcatgctgggacaaactgaatatccacatggaaaagaataacatgacctttagctcacactgtatacaaaaattagccaaaattcggccaggcgcagtggctcatgcctgtaatcccaacactttgggaggccgaggagggtggatcacttgaggtcaggagtttgagactagcctggccaacatggtgaaaccctgtctctactaaaaatacaaaaatcagctgggcgtggtggcgcatgtctataatcccagctactcaggaggctgaggcaagagaattgtttgagcccgggaggtggaggttgcagtgagccaagatcttgccactgtactccagcctgggcgacagagtgagactgtctcaaaaaaaaaaaaaaaaaaaaaaacccaaaatttgctaaaactatgaaactcttaaagaaaacataagtgtaaatctttatgacctatcaggcaatgatctcttagatatgacaccgaaagcataagaaacagaagaaaaaaacagataaattggatctcatcaaaattagaaatgtttatgctgttaatatcatcaagaaagtgaaaagacaatccacagaatgggagagaatatttgcaaatcatctgtctgataaggatttagtatcccaaatatatagagaacccttataatcttgaggacattatgttaagtgaaataagacagtcacaaaaacacaaacacatatgaatccacttaaattgggtatctagagtagttgaattcatagaaacaaagtagaatggtggttgccagggcctgggggcagaggggataatgagttgttgttctttgggtatagagtttcagttttgcaagaagaaaagttctgaagattgcacaacaacgtgaatatacttaacactactgaactgtgcactctgttgcccaggttagagtacagtggcgcaatcatggctcgctgcagcctcaacctccctgggcttaggtgatcctcccacctcagcctcctgagtagctggcactacaagcacatgccaccatgcccagctaattttggtattttatgtagagacagggtctctctatgttatccaggctggtctcaaacttctggcctcaagggatccttctgcctcagcctcccaaagtgttgggattacaggtgtgagccactgtgcccagatggtagggttttgttgtttttttttttcttaactacaatttaaaactgttctaaaagaactcttggccgggcgcggtggctcacgcctgtaatcccagcactttgggagccgaggtgggcagatcacatggtcaggagatggagaccagcctggccaatagggtgaaatcccatctctactaaaaatacaaaaattagccagacatggcgatatgtgcctgtcgtcccagctactcaggaagctgaggcaggagaatggcgtgaacacgggaggtggagcttgcagtgagctgagatcgcgccactgcactccagcctgggcgacagagcgagaccatgtctccattaaaaacaacaacaacaacaacaacaacaaacccgggcatggtggctcacgcctgtaatcccagcagtttgggaggccgaggcaggtgaatcacctgagatcggcagtttgagaccagcctggccaacatggtgaaatcctgtctctactaaaaaaaataaataaatacaaaacaacaaaaagtagaaaaccaggtgtaaggctgtcatggaagccaaaggagggtttcaaaagatggaggagaacgcaatgctgaagtctgctgaaaggccaagtaagagcaggacgcaaaggcagtccctgaatttaacactgcagatgagttactttggtcaggacaactttggtgcagtagtggggtctgctcctcctccttttctcctgggccggtgactgcatcccagggatggatggtgaggacaggtctctgtccaccagcaaggatgctgctgagcacagctggaaactcagtcccagtccagctcagcgccacatcccctctgaacctgccctccgccctccctcgcgggaaaagaccacggagatactgggaacggatagataggattgcatctttctctcctggttccccgagggggttgtttgcagtcggggagggagagggactgccctcgccccacggcctcactgccctgttccccagttccccaagccaccttcacctgcagcacctccacccctcggctagcacaggcaagagccacaagcctattttctgcgcctgccttggaaagggctgggaagctggtgaggcagccgcacccagcattccacagccacactcagtggctccaaagcggcgcccgcggcggcactgatcccgcccggctggccccagctgaccctttgcaggaggctggtggtcacagccagagcttgcgcaggccggggagctgccaggagtgccgcagccgtgcccccacctgctgggctcccgggaaaaggagcgcgcgcccctctgagccccttcctggtgcagtgcgtgtaccaagcgtggtaactggcctggctgaggacgcccgcgtggggacgggctgcgcgccctgcccaggctcctgccaactcggctcccccaggctgggctcggccgagggctcagattcctgaccaatgacctcgtcttgaggagcttgctaggtcctgggacctcctcctccagggagaaccccagattgtctaactgcgggaacgctccttaggaatgcctgctctcgccactgttattcaaccttgtcctggaggttccagccaccgcacacaggagagaaaaacaaataaaaggttcacttacatgttaaagagggacaattattgtttgaagatggtcagataaactacctaaacaacacataatcaaccgacaaatcataaaaacgtggcgcagatattttcatatttgggcaccaaagtaggcagaactgtgatggggtagacacataattaactcatggaattaattactactttaacggttacaagatcaatagatcttgtccaataaatggtattggggcaattggctacctcccaaacgactgattttttaacttgtaaaaatcaatcgttttcctgtagacctacaatacagttataaagtatatgtgggaaaatacctatattcatatgacaacaaaaatatattttgttccagttttttttttttttttttttttgagacggagtcttgctctgttgcccaggctagagtgcaatggcaccatctcggctcactgcaacctctacctcccaggttcaagcaattctcctgcctcagcctcctgagtagctaggactacaggcacgtgccaccatacctggctaatttttgtatttttaatagagacaggatttcaccatgttggccaggcaggtcttcaactcccaacctcaggtgatccacctgcctcagcctcccaaagtgctgggattacaggcataagccaccattcctggcctgagtcaaagttttaaaggagcaaatttaccccaaattaatttgtaaatgttccaacagggtgcacgtgcatgtgcacacatgtgaaagagagcaagaaaattttgaaaaagaaaatgatgtaaaggctttgccttaccagatgtcagaacaaattacaaaggtaggataattaagtagcgaagtattaactggcctaggaaagattactagatcaatggagcataagacagtccagaaaatgacctatgagtatatgagaatttagtatagcatgaagaatgtgtttcacacaagtaaggaaagaatgagttgtccaataaatgatattggggcaatttggctacctcccaccattcacaaaaagataacccagggagataaaacacctaaatattttctaaatctataaatagctagaataaaagagaatatttttaaatatcaggaaaagtttttctaagcaagatataaaacccagaacacataaaagatttaattgcataaagatttaaaacttctgtatatcaaaatttaagtggacaaaggattggtattcttcatatgtagggagctcatccaagtcaataaaaataggtaaataacctaatagaaaagtgagcaaagaatatgaacaagcaatttagaaaacaatctatcttacctattttatcagtaaacactaaaattatagtgctcagtattaccaaggatgtgaaaaatagtcattcattattccccattataagactaaagactgagttaacctttctaatatacatcaaatgccttaagaaatacaaattcttttctttttcttttatttatttatttaattttttttttttttgagacagagtctcgctctatcacccaggctggagtacagtggcgccatctcggctcactgcaacctccacctcctgggttcaagcgattctcccgcctcagcctcccgagtagctgggactacagaagcatgccaccacgcccggataatttttgtatttttagtagagacagggtttcactgtgttagccaggttggtctcaatctcctgacctcgtgatctgtctgccttggcctcccaaagtgctgggattacgggcgtgagccactgtgcccagccaagaaatacaaattctttaacccaacaattccctttaagacacttgatgtaaggaaataaatggacaaaaatgtatattcgtatgattaacaattatggggaaaaatgtagaaataccataatggtattttatcagtataatggattcctatgcaattgataaaaaagagtaagttagagctcctatatgtgctaatatggaaaaaaagtccaacatgtattgtaactgataagtaggtacagactgaatgcagtggctcatgtctgtaataccagcactttgagaagccgagacaggtggatcacctgagctcaggagttcgagaccagcctggccaacatagtgaaaccccatctctactaataaaaatacaaaaaaaaaaaaaaaattagctgggtgtggtggtaggctcctgtgatcccagctacttgggagactgaggcaggaaaatcacttgaaccccagaggtagaggtagagtgagctgagatagcgccactgcattccagcctgggcaacaagagcaaaactctgtctcaaaagaaaaaaaaaagaaaagaaaagtagatacagatcagtatgatataatctataacataaaaaaactatacttaagggtatatatcaatcatgactacatccaggagaataaagggatgatgttcactctttatacactgttttgtttgaacttatactaacaggtataagttcccatctgctacttgggaggctgaggtgggaggatcacttgagcctgggatgttgaggctgcagtgaactatgatcatgtcactgcactccagcctgggcaacagagcaagaccctgtctcaaaaaagaaaaaacaaaaaagaaaactaaaaaaaaaacaacagtaaattaaagatataagttatatatatattttgagacagggtatcactctgttacccaggctggagtgcagtggtgtgatataaactcactacaacctctgcctgctgggctcaagcaattctcccactcagcctccaaagtagctgggactgcaggcatgtgccatcaagcctggctactttttgcattttttatagaaacagggttcttgccatgttggccaggctagtctcaaattcctgggctcaagtgatctgccagcctcagccagcctctgaaagtgctgggattacaggtgtgagtgagtcactgtacctggccataatatctttttttcctaactttttagattttaaaggcttaaagttaatactatctaatgttgatcaacatattgtgaatgaacagtctcacatacttgtatgttacgacagtatgaaaaaggtacataaattttatgtgtagacacctgtcacacctgtaaattccatttctaacaatttattgctaggaaataattgagcacaaattacaatgtataataagaatgctcactggctgggcgtggtggctcatggctgtaatcctagcactttgggaggccaaagcaggcagatcacgaggttaggagttctagaccagcctgaccaatgtggtgaaaccccatctctactaaaaatacaaaaattagctgggtatggtagcatgcagctgtaatcccagctactcaggaggctaaggcaggagaatcacttgaacccaggaggcggaaattacagtgagctgagatcctcctactgcactccagcctgggcaacagagctagacttcgtctcaaagaaaaaaaaaaaaaaagaatgctcattaaagtgtagttagaggagaaaaaaaggaagtactataaatgtccatcaataaggcacaaattatgttttatttgtagactggaaggctatgtaaccattaaaaatatttatcaatatttattaaaacttattaaaaagtctatattaacatgaaagatagcattatataacattggaaaagcgttctgtagaacagtgtgcctaataatatatgtagaaagatgctcactaaaattctaacattttcctccacgaattgggatttttacatgtttttttgttttctttatacttttctgtatttttggtatactttgcctcaatttttttttttgagacagagtcttgctctgtcgcccaaggtggagtgcagtggcatgatcttggctcactgcaacctccgacccccaggttcaagtgattctcctgcctcagcctcccaagtagctgggattacaggtgcccgccacctcagccagctaaatttttgtatatttagtagagatggagttttgccatgttggccaggctggtctcgaactgttgacctcaggtgatctgcccacctcagctcctgaagtgctgggattacaggtgtgggccaccatgcccagcctttaagagctttattggttttgatcttaaaagtattatacacctgttagaataagttcaaacaaaacaaagtattcaggccactttgcctgaattttataattagaataaacatactattttcatttagtaaaagaatttttaaaaaggaggagaaggagaaggcaggaaaaagaattgttccaaaggcactgcgatattattaatgaatagacacctctgaaattcaaaattcctaaaatctcattcttcactacatggaaactttcagaaccaacagaaaaataaagctttgttttaaaaatgaactttgccaaatctacatgtgataaaaatcacacaagactaaatataggtccacacacatgcagagacacaaatgagtgcatgtaaaactagtgaaatctgactaaggtagatggattatatcaatgtcaattttctggttgtgatactgttctattgctattcaggatgttaccattgggggaaactgggtgaagaatacatgagatctctctgtggtattttataaaattgaatgtgaatttacaattctctcaaaacaaaaagtgtattttaaaaagtgaactttgtgcctggaaaagtaaaacagaggtagcttttcttagagctgtagctgaattatcactaagaagtcccattttaggttctcaaagttagaggcactgaaaggaaagtacgttttagtgagcacctactgtgtactaggccattacacagccagagtacctatgaagcaggttagatgtgagtctgttttatagaatgataacgggaggctcagagccagtagaaactcagcagtaacttgtggagcaagaatttgaacccaggtctgtctgaaagcttaggctgtcctattgactacatggctggaatggcttaaaagacaaaaccaaaccaaacccttactcagtgttatccatatcaagaaactccatataaagaaataaatattcgagtgggtggggaaaaaaaggtgcattgtaactaggcaacaggaatttcaaaatgtatgcctatacatgaatatcatctattagatctgtcactgcagtcctgactattagaaagttctaatagtcaattagctgggcgtggtggctcacgcctgtaatcccagcactttgggaggccaaggcgggaggatcacaaggtcaggagatcgagaccatcctggctaacatggtgaaaccccgtgtctactaaaaaaaatacaaaaaaatagccgggcgtggtggcaggcgcctgtagtcgcagctactcaggaggctgaggcaggagaatggtgtgaacctgggaggcggagcttgcagtgagccgagattgcaccactgcactccagcctgggcgacagagtgagattctgtctaaaaaaaaaaaggttcttcccaatacctaaatggaccaccttctagctaataatccttcaccaaggaacaaacctttgtcctcatgttccttccttaataaaactggatctccactgctggtgtgaccagggcaaagtctgctccacaactctctgttctcttgtgtcttcttatattgcaagattcattaacttttccagtttctgttttcacatggggacacttggttatttcccattctcccaagtcttccatcattatggacgcagattgacaatctaatgtaaattacatgcctctgaggtccaggcaagagttggagggtggatctgtgaactcctggaactttgggcaaaattgttgggtctgaacaaaggagtatgtttctgggaagagagcatttcacttttattagactctcaacgtagcctatgacccccaaatgatagaaaatactcctctaattaagcagctccttggggaaatggctgattccggatctgaggaaatgcaaaaaggagcctaaaacatctaatcataccagaaactaaagaagtcattgaagcctggagtcatggctcaagaactcaggaaccaacttaaagatgggaccatttgagcatcaataagaatggattaaaacacatcaaatatgtttaaatccatgagattataatacaccgaaatgactcattggccacctttggtggctactagagcccataccacgattttgaaaactaagaaataagagtcaagtatttattctgcctttctagtactggctacacctcaggataagcaaatggttgaagagggaacacatcttttttttttttaaatggagtttcactcttgttgcccaggctggagtgcaatggtgtgatctcagctcaatgcaacctccgcctcccgagttcaagcgattctcctgcctcaacctcctgagtagctgggattacaggtgcccgccaccatgcccagctaatttttgtattttttttagtagagacagggtttcaccatgttggccaggctggtctcaaactcctgacctcaggtgatccgcctgccttggcctcccaaagtgctgggattacaggcaggacccaccgtgcccagctgggaacacatctttttatagaaagagtctcctaataaatgatgaaaaactggtaggattagactaataccatatttcagtccctaattaaataatgggtctgcatgaaataatcatcaatggctgctaacattcttcaaagagaaataactgatattatatacttcttgaagcacacaataccatcagaatctgaccgagactgtaggtccaactcccaatgtataggaaatacataaatcaaaggaatggtttaaacaacatcaacacatcagaaaaagttatagaaaacatagcctgtttttttcaacaaataatttgcaaggaaaaaagaaaaggaagaaaagaggaaaccatagactaaagagataaagatatagagattcaaaatggcaactctttgactttagtcaaagtataaacttcatttgaatccttattaaatggtacaaagacatttatgagacaatggagggaatgtaaatgctgactagctatctgattaagaagttactgccattttttagatgtaataatgatattgtagaaatattttttaaaggctcttttatagatatacattgaaatatttttggataaaataatataatagctacaatttgcttcagaataatccaggagacagggagaagggaggtatatatgaaacaaactttacccatgacttgattattgctaaaaccaggagatgggtacatgccacttattatactattctctctccttttgtatatgtttgaaattttccacaataaaaagttagcaattcagaatataaacatgtttcaacttgtctggtaatgaaggaagcccaataggaataccaattctgaagtactgtcactgggttattttaaaataaaatttctaagtaatccttcaaaaattcaaaatgtattttaaaatagcattttgtgtggcctgagtgattactggcaggttttgagtaatctgattaattctaacacatattagaaatatctaaacttttttcctacagaagagagaaaaaaaatcctaataatcagtcacagttgtttggtcaggcatactgcccacgctgctgtgcggtgggtaaggcaatgaaatgaaataccagcaggatctcgacaattaactactataccattgatgtgccatgtacagatgttaggaggaaaagcaattcatgtttgatttaaactaattcttcaagtgatctttactttaggttaaaaagaaatagagccagccaaaaactgcttaaaaattaacaatgtaattacaaacatcactgaggaaacactaatttatgacaaggctttaaagattggttcagtcggccaggtgcagtggctaatgcctgtaatcccagcactttgggaggccaaggtgggcggatcacctgaggtcaggagttcaagaccagtctgaccaacatgcagaaaccccatctctactaaaaatacaaaaaattagtcgggcgtggtggcacatgactgtaatcccagctactcggaaggctgaggcaggagaatcgcttgaacctgggaggcggagtttgcagtgagctgatatcgtgccattgcactctagcctgggcaacaagagtgacagttcgtctcaaaaataaataaataaatagataaataaataaataaataaagattggttcagtcgccacaggttattaaaacacgcctccagtcctaaatgatgaccaatcatttcttttttttttttcattcttgttgcccaggctggagtgcaaatggtgtgatcttggctcactgcaacctctgcctcccgggttcaagcgattttcctgcctcagcctccctagtagctgaaattacaggtgcccgccaccacgcccagcaaattttttgtatttttagtagagacagggtttcactatgttggccaggctggcctcaaactcctgacctcaggcgatccacccgcctcagccccccaaagtgctgggattacaggcgtgagccaccacacccggcttgtgcatttcttttttttttttcgagacgcagtcttgctctgtcgcccaggctggagtacagtggcgtgatctctgctcactgcaagctccgcctcccaggttcacgccagtctcctgccacagcctcccgagtagctgggactacaggcgcccaccaccatgcctggctaattttttttctgtatttttagtagagatggggtttcgccctgttagccaggatggtctcgatctcctgacctcgtgatccgcccgcctcagcctcccaaagtgctgggattacaggtgtgagccaacgcgccaggccgtgcatttctaaactaataaaaatgtatagtagtgggaaggaggggcgaggaatcactttctcctacagtggcttatatccctgagaacaatgcctgtcttttggaatctgtgccggagcacgcaggtgcacctcagggaggctgttacttcttaattacacaggaagctccattcccaggggcttctgccctccccctcctccttcctttcccacattagcaaataactggggaattaaagcttcaaaggttggtgatgacaggtggtgacagactgatgccctgaagtccaggtgaatagcgcacagtggccaaggccgacctcaagtgaaactcacacttgcatcagagatggctgcagaattgagggaaatcattttcactttcctggaagggagaaaaattattttctggtgttcaggctcacaccagatgtcagagtggaatgctacaccgttcttgacttcaagggctttccatgggtagccacagcaaaggagaaattctgaaaataaatgaaacatcttccgaaactgggaaggaaattggagggattttggggggacggggaataagttttattttattctttctcctaagcttatgattttagtattccaagaccttatgcttgaattacttagcaagagggcatgcttatgcagaagacagggaaatgaagagaaaacagcaggcatatacaaaagtgaaggttccttaacagagttcatggtggagatagtaggcaccagtggagtttttatccagaacttaaaacttaggaaatacctatgatgacgctttagctggaagtaatggagatatctgattccaaactcatattttttctttattatttattattattattattattttgagacagagtctcactctgtcgcccgggctggaatgcagttgcgtgatctcagctcactacagcctctgcctcccaggttccagagattctccagcctcaacctcccaggtagctgggattacaggcacacaccaccacacctaactcatttttgtatttttagtagagatggggttttaccatgttggccaggctggtcttgaactcctgacctcaggggatccacctgtctcagcctcccaaagtgctgggattagaggtgtgagccgccgcgcccggctcaaattcatactttaaatgcctatttgcaatcagcaaagagccaggtatgctgcatgctgcttgctgtaaggatttggcttcactggcccaaattttttcactccaccaaaagataaggcacaggcccacttgtccaatcacatttgctgaaaatactgtagcatgagtgtagacaaacttcccctgaagctgctagaagtgtctagttaggagaatcactggatgactgcatgcagaaggcctttagggaacctacagtccaatctccttaccttatggtgtaaagcaggcccagaaagcggaagtgacttgtcccaagtcgcagcaaaacaggaacagcctgaggcttagaactcacttctgattccagagtgaggctcttccctccagctgataaacatggtccgtggcaggcaaggaccagagcgaacctaagcaggttaggggcggggtggagccacccaggaggcactaacagcgcagcagctcatgggagagcttccaagaggccagctggcagcaacccaccttgggtactgccgacctcaacctcagggggtcacgggagcaccctaggtggatgaattagcatacaagtctctctggtctgtgccaaagctttggggccttgctaaatttagaaatttgaggccaggtgcagtggctcacacctgtaatcccagcactttgagaggctgaggtgagcagctcacctgaggtcgagagttggagaccagcctgaccaacatggagaaaccccgtctctactaaaaaatacaaaattagccgggtgtggtggcgcatgcctgtaatcccacctactcgggaggctgaggcaggagaatcacttgaacccaggaggcggagactgcagtgagccgagatcacgccattgcactccagcctgggtaacaagagcaaaactccgtctcaaaaaaaaagaaagaaatttgaaagcagccagcaacatcaaggcacagatggagcttgagctaccctcttcaggctattcagaaaattctcccaaggggaagttgggaaggagaacttctatttggccccagcctaaactctcctggaagctcgatggggcctctgtcagctttcccctctggacctgcccatttgtcccagaggtgcccactgaggctacctcaatgcctgtcaaactaaaacttaaacctaagagtgtctgcagcatggtctccagccagcctgatcagaagactatggagggggccaggcacgtggctcacacctgtagtccctgtaatgctagcactttgggaggctgaggtgggtggatcacctgaggtcaggagttcaagaccagcctggccaacatggtgaaaccccatctctactaaaaatacaaaaattagctgggcgtggtggtgggcacctgtaatcccagctactcgggaggctgaggcaggaggatcacttgaacctgggaggcagaggttgcagtgagccaagatcccaccacggcactccagcctgggtgacagagtgaaactgtctcagaaaaaaaaaaaagaaaaaagaaggaggggcatactgactcctcactgaagaatgggatagacaccctctattctacctctcccagcaaggccataagtctttgctctgaaaggagccagactttagagccggctacaggtggacatggggtgaagacatcaggttgcgagggtaccctctctcgttccctaggagcctggcccctgcaaggaggggcacctttaaacaatcaagcatagtgagtggggcggcaagcagagcagagacacagacgacagcggggtggagccccaccagtccctctgagtataaggcagagggagtcccgctggggtccacatccctgtgtgtctcgggctgatttggacacaaggctcacacattcatcctacctgccccagtgctagctggccgaggatgccaggctgtacccgaccttaggctgtgcggcttggaacctggaccggggcaggaattgacaggttcccccaaacaatgtcactcccaggaccctaagacctcaagcagcagaaaccacaattctggatgttacgtgcagcgccagctcctgtctgccctgcctccttatccctttctcccagggcgactttggaccaggtctcgaggccgggagaccggccccagcccgcccgaccgggatgggcctggcgcccgggggaggccgcgtcgtgctgagacagctccgagctgcctccccgcagccgcgggccgctacaatacggattcggcggcgagaggaaacagtctggccctccaggggacgcagggaaatccaacctttgggtcgggggcaattaggactgggagtcgataccgcgggcaacgaatgatgaatgaataaatgaaaggatgaacagagtggcgaggcggagatgggccatgcggggcgtcccgaggagggtgcccttccttgccccgatgctgccgggaccgtccctcatcccccaggtcgcagcagactcagccaagacacccggtcctagtgcgaacacctcgcgggccccgggagacgcctgggcgcgcggtgcagctctggcccggagcccgcattccggcggccgggaagtgcctgccccgtgggcagaacgcgccgagttgccgcggccccaggagccgtcctgccccgcgcggcagcagcccctcgcggcggcctccggaacccccgagaccggcccccgggccgcaaccccttacccgccctcctcggtggcctcgctccggcttaaagcggtcatcccggcgcctgcacccagcgcccc

SEQ ID NO: 944 - DNA, 292081 bp, Homo sapiens
tttgtttttgctttccccagaatataacatggagtgttttttcagaaatcttaaaatagagggattaggctttttgtttgtaagtaagtttttggaaaaaaattatattctaccctagctcctaactatcccaaaataaacccaaaggcttttgctttcacggttaagaaagatttatacgttttcttcaaatgtcagaaatgagagggtccctcaggacagcaatatcccccctagttcaacacccacctttgggaagggaaaagagggtgggggagaggcaactacaactgacccaaatccccaggccctaggtggctttgtatagtaaaaatctcaattcaaatacaacagccaaggcacagctggcaccatccccagcaggctttctgcttctgcaggaggcccaggaattcagcacatacagtcttagccatatgcttagaaaagaggcaggaccacaattaggattgactattgtggacgaggtgatgaaacgcagccccaaaggtgagatttgtttaccactctgtagccacggagggacacacatctgccggttcagaccataaattcattatttccaaagagtgctagctgttggttggaggtgcagtctgggtccacagtttttctgcggccagacatgactgtcccctctggggtctctttggttttctgaggtgagtttttcacattctttaatttttgtttgcccttttccgggttgaaggttcctctgctgatgaactgaggcttgtcttccaggaatttggtctggcccaatggtccttccattcccagggcctcattacctgaggcagctcggtagaatggagatttggaataaatctgaaatagttttctggtcccatgagatgatgccgtgttagacagacataaagaggagaccgaagagtccacgacatctaaagagtcttgctgctttttaagttgctttcgcaacttgctggaaggttcagacttgccagctgtcttcagggagctaagggctaagcttctttctaatgcaaaaaagagaccaaagatgtaaatgacagtgccctctaaagcaaatcatcatataatgaatagatgccactgttcacacatgaaattgggtgggataagattcagagggtccaggatgacttactatgggcacagtcacagtaagagctcaccatccatttctctatgtagcatttccgaatcatctccaaggaaatctggtgtttgactatgccatcagcggaggcctagaacagtcactatcatttcaaaaactgccaggatatgcaggtaagtcctacatctccctgagacatgccacccagttaaacacctcctttgtatatgtatatagtcccacctcacagtgggggcacaatgcctgccaccctcagaaaatgggttatgggtcagtaagacaacatatattgtgattattggcttttctctgtggtaagtacaggataaaacattaaattaccaaaaaacaaaacaaaacaaaacaaaaaacaaaaaactcaatcacgttgaagagttggtttgataaacaatgtatatggaagctttacaaagacaacaggaaaaaaaagaccttccgtggaagtcaggaatctaagtagcaaagacaattatatttcttatccccttatatttcttatccccatccaggtcactacctgtatgccaaacgatgaaggctaaaattatatggataaaaggacaaaattcctcaagactttgttattgctgatgtacagtcagtaaattcttaaaagactttgtcttagttttggaatctttattcctcctttgcaaaacaaatctggagtctttggtctaccatgttcacttacctgatttctcagagatagcatattcagactccatattcaaattctctgagctatcagcagtcccaatggaggcctcagactcaagggtttcatcatcagaggcacggggttccagtacaagcatctcaaatgttagctcctccctgtaagacacaatcaagaaaccattagcatttgataggaagtggaaggaagataacagaaaaaaagatcctccatggaagtcaggaatctaagaagcaaagagagtccatttttactgtccccatccaggtggtgatgaggacctgtatgccaaatatggtgaaggctaaaactatatggactaaaggacaaaatgacagatagccaatctaggaccaataataggggtaagggtagggtgaagaaagatgtagtggtgagatctttcagtaaaatgaactctggactgataagcaggagatcagggctctaaccttgttcataatatccataatgcatcaggaaagtacctttctcttctggacctcagcttcctaccacaaaacaaagagattaaactagataacctctaagattccttccagctcttaaactattttccatgaagcttactaactggctatagacgataccctctatcttcaccacagagacctctagacgaagaaaaacactgattgatcttttctgtcctttgaagcttatgccatcttcagttgtcgtattctctagtctcccttcttcatcacggtcacccagctacctctcagtaatgccccacattctgtgaggtctttggtactcagatcctaatcttgctttttcactaatgcctgacatcacctgatctattcaattaatatctttgtaaaaactcatctgaatattctaacactgaagttcctttatgtctgcaacttctaacaatattctcctctactttatctaagctactttctccaatgcacagatcctggagcttgtcattactctgaatccaacactccaccctgttcacaacctccttatccttccaattcttactcaccttctaatcaagtctcttccctaacagagccccttacctttacttcccctttacctggcttgagatccatgaacaatcatttcaagaacagtatcaccagcattacaattgtctgaggccatgtgcattctgagactctgctcgttcttctttctttttctagagactctccccttccttgaaaattcctattaatccttcaagactgccaatatcatctgcatcaaagccaaactgggtcttcttttcagatcactcttctagcaaatagcccctggtcaatgtacatcatctttgccttatcatgttttttacagctgagccccagctgcttttttagctggcctatattccagaatcaatcatgagagaccaagaaagtattttaacagtcttatatccccttataaaccaaactcaagacctgggatcctggaactcaggaataaagatcccattaagacttcctaagagtcatcaatgtcgaccagaactattacacagcacctgtagggagaaccatggcacgttcatattatccccaaggcatactgtcacccaatccctgcaacagtgatgaatggaggtaaaagagcttctcatttgtctctctcctaaattgcaaccaatttccctatctagtatcctagcaccctctagggctatagccttactatgaccatctagttgctgttcccatggtcatatggatctttggctaataaccttccttcatggatttgtgaataatgcccattcttgaaagggactttggcttagcctaagaattccttctcttctttgcaaaataaatctgttcatggaggctggtctccgacctgttaggactccagtacctcatcttggctccccactgttactgctagatgaatcgtgactaagactgacatgccctgtggatactgtgtcctcctcccagtcagcctctacagaccatcactgtagcagcctcaggtttcccagctcatggaactggcttcccagagggaacaactctcacactgttacctgagtatagacaacacgtctttgtcatctcaacatctcctgtatcatctgacacagtgtttaacacacaggagataataaataagaaaaaataaagaaacgatagaaggaaggaaacaaaaacagactataactgtctctccccttcctcctggatactcacttctccttctgtaggttctcaatctgctcagtcagtactctctcctcctgctgcatagctgcttgctgctgttctgtgatgtcagtctccatggctgcctcactagtcaaggtctcctctgagacatcagacacagaaggcaaccgaactacaacaggagacgatggacctggatagtttcctcgacgaatacgcccctttccctgcagagaaaaattcatgttagaaagtaaattgagtgactgcatcagttttacattgctcttttaggataacaagtgtatttccatcacaccaggtgaatgataagaataaatggaaacactctgcgaggcctaggatatttagtgagacatattcatacaacacatttaagttaaaatatttcttgcaggagtactggaaaacggatactttggtaggtgggagtgtaagaacccattgtgtactgagatgagtttcttcttttaatataagctgcatccattccaaacaaaatagccacatctgggtatttatttttaaattaattaaaattgaactaacatttcagttctgcagtcacactagccacatttcaagtgctcaatagccacaagtagcttgtgacccccacactgactggtacagatctacatttcctaccatcatagtaagttctgatggataacagtgctctataactgtagccttggaatgcataatctctctaggaagaccatagaagtatgttctaaaactcagttttgaaaaacaaaaacaaaatgtagtcatttatagaacacagggtgctagtgagatatattttcttaggaaacttctatccttgagatcagagtgtgaaaatctcattgctgcttcttcctttttttttttttttttttttttttaaacattggttactttatatatgactttcttctggtagtggcaaactaaactttttaggttaatctcctgctaagaaacataaaaactcaacatatgctagaaggcactgaagagctaacaagatagattaaggagacactagtccagcatttagtgctgatctaaatgtcagaagtggctgtgactctaaacagagcttttgacatgctacagcagaggacggcaaactatagcccgtgtggcaaatctagccttgcacatattttgtaaatacaggttcactggaatacatttatctcattaatttattgtttattgctgcttttgcagaacaatggcagagttgattgttgagacagagattggcctacaaagactaaaatatttattctctagtcctttacagaaaaagtctgccatcaccttgggatagagaataaaagttggagccagacccactcaatggtgtgggttgctgcctggcaaaacctccgtgcctgacactgggatccccaaggtttgtttcttagacataagagtaaactgaaattataaaagtccttgcagatactgtagtctagcttcaagtcatctgaatggtccagaaaattctaatccctaaaaatgaattaatctcagattgctaatactttaggaccaggcagaaaaaaatgaaaacattcttggaagaaagtaacattatctaggcctcaaaatattttaaaaatagtttttcaaatactctgacaaataatcaaaggtaacaggcacaaaaggagacaggacaatgtaaatgaaaactagtaaaaatgacagaaaacagaaaccctaaaagactccagatattgtggctatcagatttaaaataaccatgctgaaggagacaggaagacatagctgaagtagtggactggaaattaggtcaaaagaaaaatcctgaaccaagcaggaagaaacaaaagaatggaaaaattcacaaaagaaagtaaaagaatggctgggcaccgtggctcatgcctgtaatcccagcacttcgggaggctgaggcaggcagatcacctgaggtcaggagttcaagaccagcctggccaatatgaagaaaccccatttccactgaaaatacaaaaattagctcggtgtggtggcatgcgcctgtagtcccagtactcaggatgctgaggtaagagcattgcttgaactcgagaggcagaggttgcagtgagccaagattacgccactgcactccagcctgggcaaatatcaggacaagagagagatcctatagaataaatattgaagagatcatggcagagaattttttaaaagcagttaaagatattaacctaggaatttaagaaagcctacaacccctaagaaagaaataaaaagaagtctatacctagacaaactactgttaaaaactaaaggcctaaggcaaaaaaaagacttaaaagcgttacaaaaagcaaattccttgcaaaaaaggaataactattagattcaaagtttatttctcaacagaaataatggaatgcagaaaacaatggaatattttcatggtgatgaaaaagtaactgccaagcttgattgttatatacagaaaataattttcaggaatgaaggtgaaataaagacatttcagacagactaagaggagaatctcacaccagcagacctgcactaaaggaaatattgaaggaaagattgaaaatgtctcgaagaaaagttagaggtgtgagaaataatgaaaggcaatgaaacgtgagtatgtttaaatagtgactgcataaaacataatagcgatgtgttgaatttaaaacatacagataattaagatacacaacaacaagaggaacaaaatcatatcacagtaaggcatattaaaacacctgtattatctgggaaaaagataaaactactagttagcaaatactgatagatcacagatctgttttcaccatttggttaatgactaaaataatagtaaaagagtaaaacttccaaacaaaagaaaaaatggaataaaaaagtagtaaaaaaatgcaagaaagagcaaaaaaggcaaggaagaaaagaaaaaggaacatatatcaggcaggacaaataaaaagcacataaaaaacagtagattttaagcccaaatatattggtgagtatattaaatataaatagatgaaatgctcctattaaaatttgaagattgttgggccatataaaaaaaaagaaaacctatctatatgatgtttataagagacatgtgaattcagaaaggctgagagtaaagaaatgggaaaaaaaagacataccatgcaaataccaaaataaagctagtacagctatattaactgtaaacaaagtaaactttaagaagtattacctgtgataaagagggatacctcacaatgacaaaggttcatattatgaagaataacatttccaaatatgtatgtacctaagaaattgcttcaaaaaatttaaagtaaaatattgacaaaactatttttaaaaaatagactataatcagtactgagagaacaagtatgcacacgcaatcagaaatgatgtaaaactgaacttgatataagcaatctaacagacatatacagacttcagtatctaactagagaatactcattttaaagcgcacacagcaagacaacaaaattccaagggttgaaataatttatctgaccgttaaagtaatttaaaacaagttttctaataatgtagttacaaagagaaaattaaaaattcttgtatactcagaaattaagaaatagactttaaaacaaaccatggtcaaagaggaaatcacaatggaaattagaaaatattttgaatgaaacaatataaaaacccatgtaagctctgtctactttaaagttacagccttaaatacatacattagaaaagaattaattaattaaagaattaattaattaaggatgtaagactctatttcaggaaactaaagaacaacataataaattccccctgcaacaaaagcaataaagaaaagagcaaacaaacattagaataaagacaatcaaagccaaatgtagctctttgaagaggctaataaaatttttaaaaccctagcaagactaaaagaagtcacaaataaccaaaggttgtaatgaaaaaggggatatcactacaaatcctgtagacccaaagaggataagagactactaaaaacaacttcatgtcaataaatataaaattttagacaaagtggagaaatttctatgaaaatctaattaataccatcaatgaagaaattaggaatgtgaataatattaaagaaattgaatccagagtcaaaatctttccaaaaacaaaactctaggcctagatttcagtggcaaagaagaagaaataacaaattcttccacagaattaaaaaagaaactattccctaacttgtctttagaggcaggcgttaagtttgataacaaaacacaacaaatacattaaaaagaaggattattgccaggtgcagtagtgcatgcccacaatcccagaactttgggaggctgaggcaggtggatcgcttgagctcaggagtttgagaccagccttggcaacatggcaaaaccccttctctaaaaaaaaaaaaatacaaaaattagccaggtgtggtggcacgtgcctgtagttccacctacatgaagcactgaggcgggagcccaggaggttgaggctgcagtgagccaagatcatgccactgcactgcagcctgggtgataacagtgagagcctgtctcaaaacaaacaaacaaacaaaaacaaaaaaggattattatgggttaactttactcataaacacatgcaaaaatcctaaacaatatcctaactacaacggaatcaagtaatatagaaaatgtaatataaaaattttaaatatatgaaaagttggatttattgtagtagtatgatactactacatacacataatataatgatactactacattataatgtagtagtctaatgtagtccattagaaatggactcagtgtaatgtgtcatatcaatgcaataaaaaagtctgataaaacctcaatacatgcagtaaaggcatttcataaaattcaacattctgtcacaataacaactcttagaaaacctggaatggaaggacacatgcttaatctcataaagtacctacaaaaattctatagcaaacatcacacttggtggtaaaaggttgaaagcttttcctttggggctgggaacatgccagtaatgatcactatcaccacttccattcaacactatactggaggttctaacttacataagaaaaagaaagaaaaggtataaggattacaaaagagcaaatgaaactatcattattcatgaatgatatgactgtacaggtagaaaatccaaaggagtccacagaaaacttattagaataagtgaattcagcaaagtcactgaatacaagatgaaaaataccaaaatcaattgtatttttatacaataagcaacagaaaataaaaattttaaaataatacctatgattgcatttaaatattaaatacctagtagtaattcaaactaaagatgtgtaaaatctcaacgtacaaaactataaaacacttttgagagtagctaatgatctacatgaatgaagagatatatcatgttcacagatgggaaaaatcagtatcgtaaaaatgtcagttctccagaaggcaatctatagatccaatgcaatcccaataaaaatcccaagagaattttttgaggctgatttcataatttatatggcatataaagagccaagaatagtcaaaacaccactgaagaaggtaggatgacttattctaccagttatttttagaaagctagggtaaataaaatagtggtggtgttggtacaaagatagtcaaaacagagcacctagaaacagacccacacataagaaggctcccaatttataataaaaggggaactgcagggcattgtggaaaggaaaaattttcttaaacatgactttaaaaggtattcatcctaaagggaaagactgattaacaacattaaaatccagaacctgtgttcatcaaaaaagaaaggaaaaaagcaaaccatagaatggaagaaaatttgcaacaaaagtaacaataaaggatttgtatctggaattcataaagaatccctacagaacatcagaaaaagacagacaatccaattagaaaaacaggcaagagctttgaacaggctcctcacaaaagaggatacagaaatggccaacatgtatatatacacacacattatacatgttagagtcacaacaaaaaatacaatttttaaaaataacacacccatcagaatagctaaaattaaggaatctggcaaaagaagtgctggaaggaggtggagcaattgggaattcctacacattgctaacatattaacaaccattttggaagaaagtttggcattatctactaaagctgaagacacatatatcctgtgaccctgcaaatccactcctgtatatttctccaacaaaaatacatgtatgagtccattaaaatcataattccccaaaacacaacccaaatgtccatcaacagtagactaaattgtggtataatgcatacactgataaactatacagttatgaaaatgagctacaacaaaatatgaataagtcttacacacataaggttgactgaaatgaatcagagacaaaataatacatcttagatgataccatttatataaagctcaaagttaggtaaagcaaaactacagtgctcagggatacatattttggtagcaaacaaaaaataaagtaagtcattaatgtaaaaatcaggttactgcttacctttggaggagaaagaggattgtgactagaaagggaaagaggagagcttctggggatgctggcaatgtcctatttcttgagctggggtggtatgtggatgttcatttataataattccttaaactgaatatgtttctgtgttttgtatgtgttttgttgttatgtatgtgttgtattttgcaataaaaaagatatttaagagttccttttcaaagttagctatttatggaaatatacgaatagcctttgaaaattatgtgactttaaactgacaaatttctgagttgagtttggcaagaaagaaaggaaaagtgctgtctcaaaaatagaaatccatgatctagggcaggtgatagggtaaaggctggagggtagttctaagggcattcaggctaactcctccaaaactaaaacacttaatgggataaaatcaggaggattacaatattgctattccacttttagttctaaaatcaacaaggaaaaaacatgttaagaaaaacaagctaaaaacagaagatcactctgcaaatttaacaaaaaatgacaaagtattctttatgttataaattccaggacatcatccagttccatttgacattgactatttctagccaaatgaataaataatatgatttaaaagcctcaaggagcttgaaaatctgagtttattcctagtgtccacattccagtattcaataaaagagctgccttttttcagtgttcataccatcagctggccaccggagtatttcaccatgagttagctgcaaatcttttaatatggctaaagaaaatcaaacaagctcaacagatctgatctcttttaagaagcattaaacaaaacaaagaaaaatggaaactcctacagcctagaattatcttaaaaagattaaagtaatttttaaaaagttgattacatggagcttttagaaacatgagaaaatactaatattgtgttaaaaacagtacataaggttgtataccattggttttaaaaatgagtaatacaaaatttgcaaatacactaaattattaacagtagtttcctgactggaataatatccttcactttcccactttcctaaaataagcatgaatttacttttttcaaactggaattttttcttttggatccatgttcactgtatattctcttgtagtgtttttttccataattgtttttctaccaccagtgtgtcacagagtgaaaaaggcaaatattttcttgacagtatcataaaaataaatttgaccttgtagacctccctgaaaaggatctgtagataacactgagaagtggtttatagtatcctttgttcatttttcactgggtagctaatctttctatttacttataggagcttctctttattaaggaaaattagactttgaaataggaattgaaaatattttcttatggtacgtcacttcccttttactttccttatggtcatttttgtcacacaataatacctggtttttgttgctgaacctttcaacttttttctttaatggtcttatataatagcaaagccctgtccaagattatatttttccatcataatagggattgtattggttttgactgatcacagactacatgaataatttgtacccaactcttaatgcaagtactggaaaaaatataaagccatattgtcatcctttttctcagtaactattccagtgacttcctggcttaaactttgcaggcaaactgttcctaaaatgagaatatcaaatacaattatcttgaactgttgataagtagtaggtctcaagtcctactaaatcacaatttaatattatatacaatacccagatttccaatcctttatagcacattaacaggattatcagaaaaatctggactggactaccactaccaaagacatcacagataatatgcttttgacagagagccaagatcaggaagcagtttaagacattattaggcttatagagagctaactattctcagtttgtacagaaaaataaactagcactgaattcattcctttcaagtgggaggaagtggagttctcttcttaaaagctgtgttttcagagctctaaaaaggtacacttataaaataatttaaaaattcttctgaattgtacaatgagatactgggacccctgacttaataagagatctttaatcacacttaagcttctttctggcttgttttcagtttctgttttatgaagataaatgttttttggttaatctctttccatttgctccccttttccctttttatttgcacttttttcaccctaaagatgtatcctcttcagccaccttttatggcttggtttcaacttttgcatgaaaaggtttagctgataactttgctgatttccccttgtgctccttcccgattgccctttgagctgagttaaactacttggatattttggcagtattaaggtagagaggtagggtacttgagttctacaggatgcagggcagtgagaacctctgccaggatggagtgccagagctgtacttccagtacttttatgttttagtctttgatgtgaatcaggttttttttttctttctttctttctttaaagatacagggtcttactcttgctcagcctagagtgcagtggcacaatcatagctcactgcagccttgaactcctgggctcaagggatccttctacctcagtgtccccaattcgtcggactataggcatgtaccaccatgcccagctaactttttaaattttttgtagagatgatatctcgcattgttgccacggctggtctgaaactcctggcttcaagcaatcctcctgccttggccttccaaagtgctgggattataggcatgaactactgtgcctggcctgaatcggctttttttttgtttcttttcttccctacatggatattcattttccccacatcatttagtgaatcccagacctttgaaatgccactcacattataatcctttatttttctcttttagaattttcctattctgcttctttattttcttatgaattttagtatcaacttgtaaagatccccaaagtattcttttgctgtttttgttgagacctcatttgtaagtagttatgaaactctttccttgtctgtgtaagaactgatctttggtcaaatgttctagctcaggacccctggaaacctgataaaggcaggatgcaaatgatgttattaggcaacatcacctctggcaaaaattaatctgattgataaatcgcatctggagaagtaatttataaatatcccataggaagtcatatatttccaattccctgaaagtggagtctgttgtaactggacataccccttgaggggaccctggaaacaatatctatggaatttcacaagaggttaattcctgtacaggcataaaacttctaaggcagaatagttctgcatccattggatgtggagtcctttttccttgcacctgagttgtgacttagaagccaaagataactcattgatggttgtgtggactgctgcaagggctcccacacgaggatgatcttaggctctctgcaggcatgctatactcccagtcccatatcctcagtgattctgatgccaagtggagcccatggtagtcatatgagtctgaaagttgagcctaagaaaatatcctctttccctcctagtgggtattgaaacaatatatgaatagattaatttagaagaactgacaccattacaaaatttagcctttctttccaaatgtatttaagtcttcttttgtaatatttgaggttttaaggctttctttttttgttttttttgagacggagtcttgctctgtcgcccaggctggagtgcagtggcgcgatctaggctcactgcaagctctgcctctggggttcacgccattcttctgcctcagcctcctgagtagctgggactacaggcgcctgccaccatgcccggctaatttttttgtattttttagtagagacagggtttcaccacgttagccaggatggtctcgacgtcctgacctcgtgatccgcccacctcggcctcccaaagtgctgcgattacaggcgtgagccgccgtgcccagccttaaggctttctttgtacaaatcttttacatttcttgttaagtgtgttctttggtatttgatgttgatgtttaaagtgtgtgtgtgtacaatatacaaatgggcatttttcttccatcatatcatccaagtgattgtttgcataagtaaaatttattaattgtactcagacaccttattgaattctcttatcatctttaagttccttcattgattttcttgagttttgcatgtatataatcataatggaaatggtgataattttatttctttattttatatctccaattctttttcttaattgctttatctagtaccttcaaatcaatgtcaaataatagtggggataatggatagcattgccttttctgattttaatcagaatgcttccagtgttcttccattaagcaagatgttggattttgggttcagatatattttttatcatgctaagaatgtaagatatccctgttttaataagaatgtttttaaaaagaatgctaatatatcaaatgcttttaaaatatctatgaggataatacgatttttctccacagatcaacaaacatggtgaattacattaacagctatcctaacatagagtcatccttgcattcctaggttaaaccctccttggtcaagatttatatttttatatttataggctattgaattctgcttgctgattcatttttattttattttaaatttttctttattttttatttttttgagatagggtctccccctgtcacccaggctggagtgcagtcatggctcactgcagccttgacttcctaggctcaggtgattttctcatctcagcctccctagtggctgggactataggtgctcgccaccaggggtagtttttttttttgttttttttgttttttttgtagagacggggtttcaccatgttgcccaggctggtctcaaactcctgggctcaaggatccacatgccttggtctcccaaagtgccggtgatattttaacctaggatttttgaattaatattcatagatgaggcagtcctacatttatatatcaagtgctatctgtgtatgggggtgtgtgtataagaactctctttctctctatggagagaggtccataacaagcataattcttaatggttttacaaatattaactcatttagactgggcatggtggctcacacctgtaatcccaccactttgggaggccaaggagggcagatcacctgaggtcaggagttcaataccaacctggccaacaaggcaaaaccccatctctactaaaaataaatacaaaaattaaccaggcgtggtagtgcacacctgtagtcccagctactcgggaggctgaggcatgagaatcgcttgaacccaggaggcagaggttgcagtgagccaagattgtgccactgcactccagcgtgggtgacagagcgagactctgtctcaattaaaaagcaaacaaaaaattaactcatttaatcctaagtttggtactattaaccaatttatagatgagaacactgaggcatggagattaaataacttgcccatatcacaactactagtaaactagagctaggatttacacccaaaagtctagtccagagtccatgctgtgctctgctgcttttaatatttctatatgtggctgggcacggtggctcacacttgtaatcccagcattttgggaggctgagacgggcagattatgaggtcaggagatcgagactatcctggctaacacggtgaaaccccgtctttaccaaaaatacaaaaaaatcagccgggcgtggtggcgggcacctgtagtcccagctacttgggaggctcagacaggagaatggcgtgaacccaggaggcggagcttgcagtgagctgagatagcaccactgcactccagcctgggtgacagagcgagactccacctcaaaaaaaaaaaaaaatttctatatgcaatttttattagcttttctttgtgtatgcatgtgtgtgtgtgtgtatggggcggggggtggtgaggatcaatgttagactcttttagttaaaaaaaagaccttttcccctctctgctctgagacagcttaaattatattgtaattatgtatttaaagagttggtacgttttctctgtgaaactatttatgtctgatgtttttatgagaggaagttcttagacaactctcctatctcttcttctttttaaattagtctgtttggccaggcatggtggctcatgcctgtaatcccagcactttgggaggccgaggtgggtggatcacttgaggtcaggagttcgagaccagcctggccaacatggtgaaaccccgtctctactaaaaatacaaaaattagccgggcacggtggcaggcacctataatctcagctacttggaaagctgaggcagaagaactgctggaaccggggaggcggaggttgcagtgagctgagatcatgccattgcactccagcccaggctgacaacagcaagactctgtctcaaaaataaagtaaataaataaataaatagattagtcttaggattcttttcagctactcttttgtttgtttttgtttaagacagggtctcactctgtcactcaggctggcgtgcagtggtgctatgttggctcactgcaacctctgcttctcaggctcaagcgatcctcccacctcagccttccaagtatctgggactataggcaaacaccactacatctgactaatttttttgtatttttggtagagatggggtttcaccgcattgcctaggctggtcttgaactcaagtgatccgcccgcctcggcctcccgaagttctgggagctaccactcccagcccctttttggctattcttattgagaaccttgaagacgacccaggaggaaattgtttttatggctaaaaaatagtagctaacatcagttcccattccctatcataaatataagatataaagcaccaaaatttacattaagtactaaactctgagactttgtgagtcctggctcactcttcaagaccccatagtactaatgtcttagagtttgcttcaaaacaaagcctattttggttttaacttaaggtttcccttctgcacaattatatatacaagtttatatgtaagctatatagctttttacagaattaaaccttgttgacttttaccaactggtagttctttctccatctgcttaatttaaactcatcccttaagagctagctcacatgtcacttctacagcctttccctgtgccaccaggcagaattaagtacttcttccttagtattctcaccatatttggcacacagtactgtctaatccatctctccctccttccttttgggacaggctttctaatacccacattcaatcacctaatcatatagatttgccatgctctgtctaaggaagtctatatatgattctatggtctattttttctaagaatgatattctgaaacagacagtcttaattatttaatttgggtgagaattctgtgagaccagtccattacaggcttctcagactgtaacaaaaatattgagagtcaaatgctctaatgtgggggatctgagtgatacctatttgagggaaacaggataccctatttgagggaatcagttgaaactcactttttcattttctcctaagactttaagaagataacagtggaaacaaatagaagatactccagtgttagaatgaataaggcctatgaggagagctttgatttcttctgaaaattctgtaaggctcacgatagcgaaagaatgcaagaaggaatggcaaggcatgattgatgggcacaaagaaattaaatactataaatcgaagtaagcctaaacagtaaaagagactcatggtgataatgaaggaatgaattgcattgcctttagtaaacctgatgactatttagaaaaagacatatattaccctcatgcagaaagtcatgatactttatgaagacccaaagaaagtacacgttactagggtttgtctatgggttaaatgtgtgaggaggaggaactatgcattatctagacagaataataatataactagctaaaacacaaatctcagaatcctaatgaaattttactcaaaaatagcacttcagggcaagacggaagatcactgttgagtgccttttgttaagtcacaaaaataggaaggaactgaattatcagaccacttcctgaggagtttgctttcctgataaggagagatcctttatccaaggcttttttttgaaaagactggttgttttgtgtggtattataactaggtatccaagcttgttcaaaaatcatatcccaatgcctgcagttatggttcaccagataatcagggttagtaagcactttaaatacagctagtatctgtttgtaggtatttatatcttgcatatgaaaaggaattattctcatcaaatatttctgtgaagtgcagtgagccggtagtattatatgtattatagtgcagtggttctcagagtgtagcccacagatccccagcaaagatgctggggtgtgatgatgtcctcaaaaccatttcacagggtctacaatgtcaaaattattttcataattatactaagatgctatttgccattttcacttgttgacatctgtactaattacatacaagcaattgtgggttcaactgctgtcaccgttacgtgaatcaaggtaatgataccaaatggttctagcagtcttcatattcttttgctaccacacatttagtttttaaaaagtcagtttcacttcatgtcattgaacaagaggtgtaaattaattttatttacttcttaactgttaaattaactattttcaactttctgtatgattaactggaaattacacatacagcaactctgtcacatactaatggttatctcaagaaagagtattagtgcaattctttgaattgcaagccaaattagctgctttattaatgaaacagtatttacaataattgacaaagtttgattattcttcttgagtacgtggtttgaaattatatgaagggaatctgttactgcaagtgaaacaaatggcgatatttgttgtcagtgagtaaatttcaagctttcaaacaaatatgagaattttggaaaacttgtatctgccctgtgagtttgacagcttcccatatggtgtgaatgccaacacccaggatttagccagaagatgtaaccatatcttgcaagggactatcagtgcctacagaaatgagatagaactgagttcactgtcaacagggtaaactggagctactacttatctttacttagcctactgacaatgagccggaatagcagtgttgaacaaccaagaaagtggactgccatctcaacaccaagatatcatacagaattctgcctcccctatcactcctcccagtctcaacatcaggggagaaagggtcaagaaagacgaaaggcagaagtgtctgacaaacagaaattacccacctaccctccaaagttttaagttccagataaaggtctagtctgccctgggaggaagtgagaagagcactggattaaaactgactgaagttttaatatgaagagaactgactcttaaatactagaatgaaatgaatttttgaaaattatagaattggtttcaagatgctgttaaggtaactgatatctaatgggaaagggaagtttgacaggctggagttaagaggcagttatagacaaaaagaaaaactgacttgtattagcatcccaacaagttaagcctcctcaataaaatggttacaacacaggtggacagttttccacaaatattggtgttctcagccttccatcccccccattcctttttttgtacaatcaatggaactgaagagggataccagcaatgagatcctggtatgagttctagcataccataatatttaagtctagaactagtccaccaatttggattagttcactcctatttgtagctctgtctgataaatgctaagtggataagaaccatatttctacatctgggaggacaccatcggagtcacagatatgaatggacaaataagcattactaatgataggagatgctgaaagtaatagtaagtatttcaaataataaagtggaggagattgctgggaacacagctcatagagcagaaattaatttgatatctcaatgcttttaactttcaccttttaatgattcaaccaaagaagaaacccaaaaggaggctcatctaacaaagaggaaaaaccagtgtattttaaatggatgctgttcaactacacaatacagaggaaggaaaatgaaggatctaaagaaagagattaagagaaaagcaagtgaaaggtaatcaaaaagtagaacctgacttggggccgaacatggagggtggacaggcatgaatgatagacagggcggaacaattcctggatgaacgagagacaataatgtagagtggctgtgacacattgcattattaatacataccgagactgaattgcgggtaatgttcatgaatctaactgcaattagtacaggtttctggattaggaaggacatgaaaaggaaagcagaaggttagaatgtacatgtcattgcctcattaaaagagaaggtttaatcttgcaatggactgaatatccatcttctgcagcactggaaaaaagcgcagcttatctatctgctttgaaaagtaggtttatagcaaaaggctcttcccttcctgcctggatagccaccactaaattgggcctctcagaactgagctcctgaaaattcatactacagaaatgtttcacttttaagtgggatttctgtttttaatttctggggaaaagatttagatagtatcccctatgatgagttttatttaatatctttactgcctgcaaaaagcccatgcttatgtttgtttttacagaagacccttcactaccttaatcaacagacctttgttaagcacttattctgtgccaggcagattaaataataaaggaagaaaaagaattattttagtgctaatttgcaaactgtgaagatatgggaggaagtactgctggacccctgaaagagtaagggcatgatgaagcctgcttctctttagagatttattgggaatctgaaatgcgtgctcattgtcacaattttattttacaactgagaggaagggtggcaaatgggcaataaataaaccttaatgcagcagttttccagttatcctgaaaactgacttcagggtaacatatatggataactccagttctcaatgaccactaatcaataaggctgaagctattgattagtggtcattgagaactggagttatatgttactggttgcaaaggaagatattaaaaagtgggcaaaccaaggaaataaattatcggttttacaaggactgtctcaaaacctaaccctaaactcaaagaaatactttttgattacagtagactcatagatggaattccatttccttaagaatcaaatgattccatttaaattcagttacaaatgattaagttctctacatcccaggggtcttggcaggaccaccaaaagtgacacgattaaaggcgggaacagacagtggaaggaagtggagaaaaaagttagaagaggattacgttttcatagaaaggacatgaaaagaaagcaaggcagattattaagacaccaacattttatctaaatacttgatttgaaaaattctgcacacttaatcacatagattctataatgtaactaaagagagccagcagattaaacatgaggaatccatagcaccttgagatttggtgacgttttacttgttttttataaaaaagattctgataataatccttgtatacaccacaaaagcacatttaaattcccaagacaactcccatttttccactattccatgtgttgcatcttaccattgatctacgaatcagtgacaacctggtctttgccttattctcagcaaattccaagctactgatatctttgagacgagccttgtatttattcatttgttccacaacaatcagttccacacaactgaaacagaaggaaagagaaaaaaactgttaagaggtgaagtaaataaagtatagcactcacagactgtttttgtggtagacagttgaaagatgaaggaaaaaattaacatcccttacttgataaactcagagacaaggtttagaatggtggttcacaactttggctgcactttagaagccatctaaagagcagttatggctgagcacagtggttcatgcctgtaatcccagcgctttgggaggccgaggcgggtggatcacctgaggtcaggagttcgagaccaacctggccaacatggtgaaaccctgtctctactaaaaatactaaatcagccaggcatggtggtgcacgcctataatctcagctacttgggaggctgaggcacgagaatcgcttaaacctgggaggtggaggttgcagtgagccaagatcatgccactgcactccagcctaggcgacaagagtaaaactccatctcaaaaaattaattaattaattaattaaaaataatacaaaataaagagcagttacaaatcccaatgcccaggctacacgctacaccaattaaatcagactctctggggatgggatccaaatattgatatattttttaaagttccttttgcagtcaagattgaggagagcaaaagaaaaccatgttagaaggaaagcagagcctcaagaaaaaagaccaaggtgaaatacaggaatactgaagtattaagaccaaaggattcagagccattaagaccacagttagactagattacaggaagatactaagtgtccataatttggtaaaatggaaatttaaaatctatttagaaactacaagcagtcctaaagaaaagccagattttaaaaataagatgctttaagacaaatgatgctcagttgaatccaggagtttgcatcctcagcataagaaaacccagcagtgtccaacaatcttcttaaaaacacctgaatttatgaacccattcactatgtttgatatctggatacagtgactacatagtcagaagtccctgaggtcttgcaaaggttatggtaactggccttacgtggtagtcttactgatgtcctgtacactttgtagtgggtcagtggtgtcagggcagcggagaatgcagggcgcaaacacaatggccaaagcattagcagacattcgattagtgtcttcctgcagagcaatcctaagaattaaaacaaaacaaaaaacaaatgagtaagggataaaaagggagcaccatagggaaataggcagaagagatgagcaaaagaagacagtatgacatgaactgcatagtactagaaggatatccattaagtttaagggtctgcagacttttcccaagttgttcctttgttcctttgtctctggaaaatgtattttcacttgttctttccttgaagcagtctaggtcagccgatagcttcccaagggaaatttgtgacctacctgctctaggccaagatcactagatgaacatgtccaaagaatgcagaatcggccaggcacggtggcccacacttgtaatccagcactttgggaggccaatgtgggcagattacttgtggtcaggagtttgagacaatcttggccaacatggcaaaaccttgtctctactaacaatacaaaaattagccagggtgtggtggcgcacacctgtaatcccagctatgtagggggctgaggcaggagaatcacttgaaccggggaggcggaggttgcagtgagctgagattgcgtcactgcactccggcctgggtgacagactgaaactgtgtctcaaaaaaaaaaaaaaaaaaaaaaaaaaaaaaaaaaaagaatgcagagtagaggctttaaccaaaaataaagatggctttcttctcaactactgctgatatttacacacaggggaagagacactactcctgacgcctctttggtcaattcctgagaatgatctgaacccctcatatgaattaggtcatttcaatagattatatatcctttctagttcagctgttagaaaacaggctaaactacacactgccaccatgaggctgaagctgttacatggttcaaacaagggcagaaaagcaactgccatgcattccagctcagctgaatatttctgctccaaggtatcctaaccacctgtttgagacactgactttataaatagaagaaaaaataaatacctgtcagtcttccaaatggagaaattccttatctatttaaaataatccaagagaaactattaaaaatcgttcccttgcttcttaaagttacctgactagatgaaagatgaggcgttccagtgtattgagatgagttcgggagagttgatcaatcacagagtatacaccacggattgtctccttcctctcctgaaggcctaaaaacagtaagagcagaaactaagactaaatatccccccttatacagtgtatcttcctcccagacactatgaagcaaagaaggctggctacagagttttaggagtagttgtacctgtagggcaggagaagagcaactcacagtaactatttaactccttttgcttgagttctatattcataaacagtctccttagtttgaacctatatcacagtaatccttaataacagcaaggggatagagatgttctagtttttcagtcattgtgtagcagattgatttaccattaaagtcaacataatttatgaatcctcagggcctaaatacctctaggaaggcctttatcaatatcctacgcacttacagcactgagaaactaaactctgaaacctgttaagcttggcataaaacagccagctttacacatagttcttgcctagatttccaatttaaatgaacataagcctaatcttaaaacttatttttaatattttaatctgttttataaccccagtctttccatttctttgtaagaagcaaccaagtgtctcactcagaaaatttttaggacactaacgttttgatgagtctctaaaaagtcaacatttgaataggtgacagtatactagccgttttgtattcactgtcaaaagcttacctttgaatctataagaattaaaccactagaggatggcttgataatctatactcaagatggcatttctttcccaactataggccttctctctaacccaggaagcctatgcttacccatagctcgaagaaattcctcatagagttcaaaggtcatgagaggattgggcaaatctcgaagccattgtttgaatacacttgcaatgacgtgtatgttatagtcatctagatttacactctcagcatctatttagagacaagagttagattaacagagccaaaacatgcaaagagattcaaataattcactttagaaactatcatcattaaaggaaggcttcatgtttcttttttttttttttttttgagatggagtttcactcttgttggccaggctggagtgcaatggtgtgatctcagctcaccacaacctctgcctcccgagttcaagtgattctcctgcctcagcctccggagtagctgggattacgggcatgcgccgccacgcttagctaattttgtatttttagtagagacggggtttctccatgttggtcaggctggtctcgaactcccaacctcaggtgatccacctgccttggcctcccaaagtggagggattacaggcgtgagccaccatgcccggccggcttcatgtttcttagtcaaactgactaacctattttccacaatgtaattccatgctttggaactgtgcttctaactgtggtgaaagaatacgtcttgtgtatttgttttccaaacctgttgtggactgaaatgtgtaaaataaaagatcatggccaggagcagcggctcatgactgtaatcccagcactttgggagactgagacaggccgattacttgaggccaggagacagaaagcagcctggccaacgtggtgagacctgtctctactaaaaatataaaaattagctgggtgtggtggcacacgcctataatcccagctacttgggaggctgaggcagaattgcttgaacccaggagacggaggttgcagtgagccaaggtcacaccattgtactacagcctgggcaacagagcaagactgtctctgaatgaatgaatgaatgaatgaatgaatgttttcgtgctgaagcactgttatactgctataaacgtctctacatgcttgctctcaatttctgtacttacctggttttggatttgtccacagaccacactttgagtaacaatggtttacatgacaaatgaaaaaacgcatacaggacactttctgaaagtaaggctaattttaagtcattcttagagataaaaggacagtgataactgagcttagaaaatgtaaaggaaacaccttcacccgtttcacttataaactccctaaggatatacagattagatgactggggaagattcaggatgattgattttcacttgtgctatttcaaggtatcagagacaaagtcagtaactgcctgtaaaccaaagtagaccaagtctcttgtagacggaacctcctgcctgagtcttaccagtcattgttattattttcatactcaattcatttctcattgatttgttcataagaaacagcactgaacacaggttcttgcccacacaaggacatgctttactctgtttagttcaaaaagatctattccttcccaacagtggtaaaatgtagaagttgagaatgaaaccagagtcagtcccctgcatgaattccagtactaaaactacagctctacaaagatacatgctcaactcactaattatcagtttgagtaactgtcatcagtgtaggcaggcaagaagatgatacacaggaaagagtaccccttggagtcagaataataaagagaaaggggaaatagattatgaattcagaagatctggggttaactccaatttggtcacttattggcgatcagtctttgggcaagatcttctgtaagcctcagttcctttttctgtaaatggggataataatatccctaattcataggattgttgtgaatattataaaaacattagtacagcaccttgcatcatcatcagcagctcattatttaatttccctataccttagtttttctctttgtcaatcagaggtatcacaatcttactaaattattacaaaaattaaatgagatctgtcccaagtgcaaattatatgctcaatatatgtctgctgagttgaccaaatgaaaccaaagactctttagaaagccaaaaaatgataacaaagcatcacagaaaagaatgcattcttctggctgctaagtaaaggattgacatgtaatgaaaactttaagagcatgaaaggaactatttaaataaaagtatttcattatgatttagagggcactatcttacctgtatctagaccctgccgaagctccttgattttattagtcgaaccagactttcgataaataccttctgtatacagtccatgcatttcaatgtagtttatgagcttttccactactaaaggaacagttcggtcttcactggtcaaacgggacagttcaaccccaaattgtcgagatgacagctctggatcatactaaatgaaagataatttttagtttccaaatgcattcaaacatcttgaaacatgtttaaccatttctttaccaggagctacttttttatttctctgaagttttatgagcatagttagaagagttgggagaaagggaattatgtttaagtaagtataaatgagatattagtttcaatccttttccaccagaatctccaaaagaaaataatggagtgaagaatgaaggcagtggcaaagggctacagcttctcctatcaaaaaattgcttcaaaagcaaaggtgggatttgggtgtggggaaaagggttggattttatatgcaaacagcttgaccacctaccagataccactagaaaatctactaatttgataagaattagagttgtcagcaagttcttaagcataagaatgctttgatgtttatataaactttacggaagtttaactgaaaaatgatttcataattaaaggcagaggtacacacagatcagcccatgactactgttacagctcttttgtatggacttgaatagcgtatctgatatcacactttatttattcatgcattcattcattcattcatttgagacagagtctcgctctgtcacccaggctggagtgcagtgatgcgatctcagctcactgcaacctccacctcccaggttcaagcgattctcgtgcctcagcctcccaagtagctgggactacaggcacatgacaccacgcccagctaatgtttgtagttttagtagagacggagtttcatcatgttggccaggctggtctcgagctcctgacctcaagtgatctgcccgccttggccttccaaagtgctgggattacaggcatgaaccactgtgtccagccaatattatactttattaacctataggttactttatatcctatgtgactgcaacataacagcttacccttaagattatttgaagtaattcactgaaaagaaaaatggcaggtattatctctgagactgaaaattgttttgcaaatctgtctttccttctcctgtaccattgtccttccctaactatatattccattttctcctttaacctgcatccaaccagttgccaagtcaatcagttcatcctctttattgtttcttttctgttctaagtgtcatcaccccagctcaaaactatatcactaaccaattagactatttcaacactttcttggcgagttttccccatattcatatgtctccttttaatatattctgtagtatatataatctgttttattatcctcaaaaacctttagcggctaattagtatatagcaaactaaagtgcaaacattcttgagtctcatactcaagaacttacttgaactgattctaatttctactttccagccttacattcatacatttgtcatttatgtgttaggtaccaaggaaacaaaatcaaggccttctgcttaagactagtagtgttaggcccggcacagtggctcacacctgtaatcccagcattttgtgaggctgaggtgggtggatcacctaaggtcaggagttcaagaccagcctggccaacatggtgaaaccccatttctactaaaaatacaaaaattagccaggcatagtggtgggcacctgtaatcccagctactcaggaggctgaggcaggagaatcacctgaacacaggaggcagaggttgcagtgagccaagatcacgccactgtactccagcttgggcaacaagggcaaaactctgtctcaaaagaaaaaaaaagaaaaagactagtagtgttagtgtgtggagataagtaaaattataaatagattaactattatggaaacacagaagagagacaactagatcaggaaagactgggctggataacaaacaactaatgatcttgaaaagacctgatgttcaaccttagtgttggaaagcaagtaatagataagtaaagaaagcaagatcttttaggcacaggaaatataaaactacaaaggtaggcagagcaaagtggctacggaaatgaagctaccagataattttaaataaaggaataatcagtttattagttttagcagtattatcagtattattttgcatcattcatgcatgtatctacatgctctgcattccagctcttaatccttagagtattaatttcatgtctattttgacatacattaaattatcttaatatcacacaacatctctgaaaagcatttccaagtctaaggcagaataggacacaatcttggaatatttagaggatgcatattaaaagttttgccttgtcactatgtgaacttggctaggttatttcacatttgcaacagaaatacctcctttctacttcagagggttgttgtagagattaagttgaacatacacagcatgacaacctggtatacgtcaaatactgaaaaaattattatagaaatagaatagaataaggcttgctgtaatgattaaattttagtcaaatgttttcctaatgctgggacacagatgtgcaaatacatattctgtttatttaaatccctatggcattagaaatgttatgacttgtggaagcaaaataacaaaatacttttaggtattaaacaaaaactttaaaaataacttgatttgaaactaagtaatctaaagcaaacatgctagaacattctatttcttgaaatgaagagacaaattaatcttactattttcaatggaaaaaaaaattctgagtatttttctaaaaatatatttttatagtttttgtttcatagttatttttcatttaaactaacttcaatgtgtattttaaataaaatctttattgagctgtgacatacacacattgcaagttacagcttaatggattttcacaaagacccagattaagaaacagaatattaccaagcagtttaaaattcccccaggtcccttccagccactatgccctttacccttcacaaataaccagtatctgtacttctgtcactaaaaattaattttacctgcttttggatattatataaatggaaaaacagagtatgtgcaccttgagttagtttaatctatttttgaactttgtttaaatgtactcttttgtctctagctttcagtcaacattatgtttgtatcgacagtttttttttttgcactttttacatttagtgaatattgataggtaaaagtatataaaggtacatggaaaaataatctaattaaactaaagagcttctacacagcaaaagaaactaccatcagagtgaacaggcaacctacagaatgagagaaaatttttgcaatctactcatctgacaaagggctaatatccagaatctacaaagaactcaaacaaatttacaaggaaaaaacaaacaaccccaccaaaaagtgggcaaaggatatgaacagacacttctcaaaagaagacatttatgcagccaacagacacatgaaaaaatgctcatcatcactggccatcagagaaatgcaaatcaaaaccacaatgagataccatctcataccagctggaatggcgatcattaaaaagtcaggaaacaacaggtgctggagaggatgtggagaaataggaacacttttacactgttggtgggactataaactggttcaaccattgtggaagacagtgtggtgattcctcaaggatctacaactagaaataccatttgacccagccataccattactgggtatatacccaaaggattatgaatcatgctgctataaagacacatgcacacatatgtttattgcggcactattcacaatagcaaagacttggaaccaacccaaatgtccatcaatgatagactggattaagaaaatgtggcacatatacagcatggaatactatgcagccataaaaaaggatgagttcatgtcctttgtagggacatggatgaagctggaaaccatcattctcagcaaactattgccaggacagaaaaccaaacaccgcatgttctcactcatagatgggaattgaacaatgagaacacttgggtctatggccatactaccctgaatgcgcccgatctcttctgatctcagaagctaagcagggtcaggcctggttagtacttggatgggagaacacttggacacaggaaggggaacatcacacactggggcctgtcgtggggtggggggaggggggagggatagcattaggagatatacctaatgtaaatgatgagttaatgggtgcagcacaccaacatggcacatgtatacatatgtaacaaacctgcacgttgtgcacatgtactctagaacttaaagtataataaaaaaaaaaaaaaggaaaattcccactagaagaaaaacatctcacagatgtagattcactactctgcattctcttctctctaaaatctagtctcctaaagtacaatttgcctgtgcagctccctgatgcttgccaacaaacttttttagtatttgtctgacataagctgctccatcttagctggaagcaaatgtctcactcatattctttgcattttaattcctgaatcaaatttctctctgtactttgccatgatttgtctactgcaaacaacatgcacacacatttatatttcagatttgcatgctattgtaacaactgtcagtatgtgattaatgaataagaaaatgttgtgatcatacatcgataaaagcctgaattttttaaaaagattacctccttgaaacataaggtatcaaacagtatgtgtacagtatattttagatctctgtgtatccaagagatatatgtaaaaacaccaaccatccatgctggtgaattttgctactcatgtttaaatttgttcatctttaattgtagcttactgcattaaggataattcctagaagatttatgagcatttaaggaagtatgaaacctcaatgcagtgttcttcaaattgtggtttacgaaattaatttagtaactcacatatagtaacggtaaaataattctatgaaaatcaattcatttttgtacatatatcaccaaacatatgaactggatcatggcataaaacatatttctactgtgatttgtggtcaaaaagtttaaaaaccactcatctgtaaaactatcaaaaaggccttaatttatttccataaggcacaaaagaccaacaggtctgttatctattactgataggtgataatttcttacctttttagagcacttggctgtggttttcagacagcacttcttatggcaagcatacttgcatactgaaaaataggtgaggaatgcaacatttttagaagtctgtacatcagtgataataacttatcaagtatactttattttagacctacgtttttttctttaaatctcagactgctgtaatatgacatacatactttgtacaatggtgtaattaaaaagaattttaacccattctattgggtataatgaagttgaaaacatgatcaaaatttctagccacagtcaatgaaaaagctttttgttctttcaaagctgctcatcctgcccctatgccatacagtaccactccccaacaaattccagcaggatacttatctttgtggtttgattcacaaattagtgttcatgttctaccacatatatgctctacaacatactaaaatctcagaaatgcctattaagaatcattcctatagataaggaaggcattactgtcaaagatccctcctgaaatgaaaactaattgggtagcacagtttaagatataagaaaggtcttatttatgatctctaaaggttcagaacagagctctgaagaaccagaacatgaagaatattgagttgtgattgggaagatgggataaagaaaatgttcagagctaaaataatttagaggagtggtgataacccagagtagctgggcagctggtgaacaggaagaggcacatttagaggaaggtattgagaacacagctggcttatgtcattttgttacactagctctggcttctgtgtaccaatacctgaatatcctttcttgagcttgtaaaatataacttgtaggcttttgaaggccaagatcaagtaagggaggccatgtcattgtactggtgaaataatcaggataacaacaaagaaagttagctaattctattaaaaaatcaaatcaggccaggcacagtggctcatgcctgtaatcctagcacactttgggaggtcgaggtgagtggatcacttgaggtcaggagttcaagaccagcctgatcaacatggtaaaaccctgtctctactaaatatacaaaaattagccaggcatggtggtgggcacctgtaatcccagctacttgggaggctgaggcaggacaagcacttaaacctggaaggcggaggctgcagtgagctgagattgtgccaatgcactccagtctgggcaacaaagttagactccatctcaccaaaaaaaaaaaaaaaaaaaaaaaaatcaaaccagcccaacatagtcataaaaaagaaaattatttaaatttttagctttaagttacagaagaaactaaacctacaagaatcatagttacactaaagggtcaaatacattacaaactacttcctattttcagactcattataattttttagactactgataataaaaccaaagcaaaactgctgttgaaccatggaataagtaaatatatagtaatagtggcaatttttctgtggcaaactgctgtcatattggttccagtcctttcctagtatttgcttcattcaattttagcccactagtaaaagcaaagcttcacagaactaataatagcaccagagcagatgtataaaataagatgagtggaggctaaaggttcactgtaagccagaaccaagttgatctacaaagaatctctactcacgttttaggatttatatatttagatatatatttatatgtaaaataatatatatattatatttatatatattttatatatttatattttctactgtaatctgctaaaaggattacagtagaaaaagtacctttttgactgtaatctaatttattcatttatccatccatccatccatccatccatctataggtttatctaaccaacaaatatttattaaaacttactatgtgccatcaccgttttaggcactgatgatataaaaaaaaaaaaaaaaaaaaaacaaataagtttcctgacctatagagcatatattttagaggtgtagactgaaaaacaagaacacaaatacttaatgtaattttgggtggtaataagttctataaagactattaagtctaagtgaaagaacagagaatttcggaggctggaggggcgggcgcagtggctcacgcctgtaatcccagcactttaggccaaggcgggaggatcatctgaggtcaggagttcaagaccagcctggccaacatggcaaaaccctgtctctactaaaaacacaaaaattagctgggcatggtggcacatgcctgtaatcccagctactcgggaggctgaggcagggagaatcacttgaacctgggaagcagaggttgcagtgagctgagatcacaccactgcactccagcctgggcgatggagcaagacaccatctcaaaaacaaaaaaaagaatagcgaatttggggacaaggtggcatttaaactgggggtagaaaagagagctctctgagaaggtgagatgtgagtgtaggcatgaagtaattgaaatattaagtcatactaaaatctgggacaagaccattttagacagagtgaattacatgtacaagactctcagtgaccaaataacatcaaaatatctggtttagagacaaagagtaggtgaagagagtatagcaagagatgaggttaaaaatttaggtagtgtaaataactcctttatgttaaaggagatataagacaactcaaggaaacagaaatgtcagtggttaaaaatattcctcaaagatctctcatacttacatttgcaaacagaggctcggtccattatccatatcaaagaagaacagtattcacagtatgtagggatgctatattgggtggctttaaagatgtgaccattgtgttcttccacctgaatgaaaaaatttagctacttatattaaagccaacacagtaaatgctgccctaacgtggtgggaaatccttcaatctcttgttaagtcttcactaggcactaattccagggggacaattaggatcttttgagaaataacataaaataaaatatatttttcctgctttccaaaagctaacaatctagataaacatgaccaaattatatgaaaaacagaaagcaatgcaacagacatataatagctgtcttacatgactctaatgttacattaaaagcagcagttctcaaagtatgttttctttttctttttttggcttttttttttttttttgagacttagtcttgctatgttgcccaggctggagtgcagtggtgctatcagctcactgcagcctccgcctcctgggttcaggcaattctcctgcttttgcctcccaaatagctgggattacaggcgcctaccactacgcctggataatttttgtatatatttttttttactagtgacagtgtttcaccatgttggccaggctggtcttgaactcctgatctcaagttatccgcctgcctcagactcccaaagtgctgggattatcagcgtgaaccactgcgcctggctaaaatatatatttttttgtaatctcaggaaacttttacagttgaaaattactgatgacctcagagagcttttgtttacatgagttatacctgttaatatttactatgctagcaattaaagctgaaaaaaatttaaagtatatattcattaatttatttaaaatgaacaataaatgtattatacatgaacataacattttaattaaaaacaactatatctttaaagcaaaaaaaaatagtggcaaaaggggtattgttttacatttttgtaaatttctttaatgtctggattaacaaaagacacctggattctcacatctactactgcactcaatctgttgcaatatgcagtttagtttgaaatatataaagaaaatctagcttaatacagatatgaaagtggaaaatgaaggaatataattttttaattaaaatttttttatttgtataaatgtatgtggtacaagtgtaattttgttacatgcataggtttcatagtggtgaagtcagggcttttagggtatcgaccactcaaataacgtgtattgtacccattaagtaatctctcatcatccatccccctcacaccccctcactcttccgagtcagtggagtaatattttaacagtcctttcagatagtaatacggcaccaaaactttacatatggtaacttaaaagttaagtaaaataccataaccaatgaacccttcctgtcctatgacagtaaaatctattgttttggacttaattaaaacttaaaactttaaccttcaaagacaccattaagaaaaaaagataaaccacagactcggagaaaacatttgcaaatcatatatctgataaatgacttctagtcattatattagaatgttatgtaattatgttagaaatgttagaacccaataataaggcaacccaactcaaaaatgggcaaaatactgaagagacagctcatcaaagaagccgttcaaatggtcaatgggcacatgaaaagatgttcaacatcattagttatcaaagaaatgcaaactaaaaccacaatgaaatactacttcatacctaccagaatggctataacaaaaaaggtaaacaatagcaaatgttggtaagaatgtggatagactagaaccctcaggtactgcaggtgggattgtaaagtggtgcagtcacttggaaaacagcatggcagtttctgaaaactggaagcatagagttgccacttgacccagaaattccactctcaggtttatacacaagataactgaaaatgtacgtccaagaaaaaacctgtacgtaactgttcatagtggcattattcatggtagccaaaaatacaaaacaactcaaatgtctgccaactgataaaaggataaataaaacgtgacatatccatgcaatggaattctatttagcattaaagaagactgaactatggataaacacaatgatatagatgaacttcaaaaacattatgctaaaaagccacatgcaaaaaccacagtgtattattctatttacatgaaatatccagaaaaggtaagactatagaaacagaaagtagagtaatagtgcctgaggctagtaaagagcagtgactgtaaactggcatgaaaaatccttttgggatttttctaaaattggattgagatgatgggaaaactatgtgaatttactgaaatcactgaattgtacacataaaaagggataaatttgtggtaagtaaatttacctccagaaagctggtttacaataccaattggtctattttgtatttggacatttaacctgtatatgattttacagtggtacatgttgatcatttggaatatactgattcactaaattaaacttccaaatgttgacacatttcattatacactagcagaaagtcatagtccttaactttataactgacctcattagaaaacttggcagatacaagttttccaaaatttgaatttttgcttgaatacacaagttttactggtaataaatattgtcagttgttttccttgaagtgacaggataactgcatatgccaaaatcttaatgaatagtttaagtaaaaataatgttctgtgaaaaaagtggctagaaacatgctgccacaaaaacttgttcatgaattttcatagcagcattattcaaacaaaaagtagaaacaactgaaatgtccttcaattaataaacagatatatgaaatgttatatatccatacaacagaatatttggctttacaaaggaatgatgtactgacacatgctacaacacgaatgaaccttgaaaacattatgctaagtgagagaaggcagacacaaaaggccatatatatgattatttaagtcaatatgaaaatttcagaataggcaaatccatacagacaaagtagactggtggttgtgaggggctcagaggaagagagaagagggattgagtgagtgctcagaaagtacagtttctttttgggataatgttctcaaattatatagtggtaatgattgcttaacatagtgaatatactaaaacccactaaattgcacactttacgtagttaaaatggctaaatagttaaattttgttatatgaattttatctcagttttaaaaaatgctagatcagcctgcaatctaattgtacaagtaatttcttgagacaaccatcatatcatggttttgcatctttcccatttcattacacagaatattaaagagatgtgaattcaagaatcaaaacttaatataattaacgtttttattatttcaccttcttcagtaaagcttctctatttttcttaaactatgagtgtgtgactgtaaaaattataatgcccattaacaaagtttgcaggcactgccttgattcacgttgatggcagttttacccatgtttgcttttgtgtcaactcaatgaaaaaggaaaatgatgttttattattacaaaaagagttgtaatatcataaaacccctaaaagtctaccagaaacccctgtagaccacactttgaaacgctggatcatatataaactagactcgagtttatacagactatgtatgtttataaatgatctagtacaaaaggatatatgttatactgttaactatagtgattatccgtgctgagataaaacactcaatagtaagtgtaacatgactgggcatggtggtgtgtgcctgtagtctgagctactagggagggtaaggtgggaggatcacttgagctcaggagtttgaggttggtctgggcaacagaccccatctcttaaataaataaatgtatgtatgtaacacgaagttttttttttttaaacctgtatatgaaacactttaaaaccctcttgaaggacacaaaaatagacttaatcagaagaaaagattcaaaataataaagatgtcagttctctctacattaatttataaatataaggtaatagaaatagaagtactaatagatcttttttctgctcaaactagacaatcaaatagttggaatggctcacgactatttagatcaactaatgaaacaagataaaaaagatcaaagcaggccaggcgcagtggctcacgcctgtaatcccagaactttgggacgccgaggcgggtggatcacaaagtcaggagtttgagatcagcctgaccaacatggtgaaaccccatctctactaaaaatacaaaaattagccaggcgtggtggcgcacacctgtggtcccagctactcaggaggctgaggcaggagaataacttgaactcgggaggtggaagctgtggtgagccgagattgcactactgcactccagccttggcaacagagtgagactctgtatcaaaaaaaacaaaaaacaaaacacacacacacacacacacacacacaaaacaagcataatgggaaatttagaatgtaaaaagggtgacatctcaaagttgatgagtaaagacggactttaaaataaatgatgttggtagccattgataagaggcaaaattagattcatatcccacactgcacaccaggacaattccataaagatcgcaatttaaatgtaaaaaatgtgaccactaaattattggaagaaaacactgagaattcctttataaccctgaagtgaggaaagtcttaactatgactcaaaattcagaagctatgaaaaaagaagattcacaagtttaatttcttaaaaatcttccacatgacaaaaaatataataagccaagtgaaaagacaactgacaaaccaggaaaacatactttcaacttatatcacagacaaagggtaatctctctaatgtacagagttgctacaaattgagaaggaaaagaccaaagccaaaagaaaaatgagtaacgaacaaaaacagactgcagttaaaaaaaaaaaaaagcaaatggtacttgagtataagaaaagatactcaatctcactgacagtatgagaaaagcaaataaaaactgtgtagagatacaaactacaaaatgagactacctttattacagagaaatgaagcaatatttatcaaaataacaaatgcattcaccctatgacccactaatttcaattctgggaatccatcacacacacacacacacacacacacacacacacacacacacacacacacacggttattcattgttcactctttgtaatagcagaagactagaagcagcctaatagtccggtaaggaatggtagccagttgtgaaatagatttctgtgtatagctactgtattagttttctattgctgctgccacaaattaccataaattcagtggcttaaaacaacacctatcatttgttatctcacagttcagtaagctagaagtctgacgcttctcagagtcagagacttttagtctcaccaggctaaaatcagatattgacaagggcgtgtgcccttctggatgctctgtggaacaatctgcttccaatctcattcaggttgttggcagaattcagttccatgtggttgttggactgaggtcctatttccttgctgactattagctggtagttgttctcagcctctagaggccggtcacattcccttgctcaacaccctcctttctccatcttcagagacatcaaaagaggattgagtccttctcatgcttgtatttctctgtcttctactacctatgtctcctgcatcatcttctacctcatctctcttactgactcttctgtcttcctcttcagcttttaagggcctatgtggttacactgggctcatctgcataatccaaaataaactgttatgttaaagtgagttgattagccatcttaattccatctgtgaagtcccttcacagcagtacccagattatgtgtgaatgaataaccaggtgacaagaaccttggagggaacatctttagaattctgcctaccatagacagagaagggtcttctgaatatattgttcaatgataaaagcaaagcacaaaagagtactagctgttattatataacatgctacattttatgtgagaaaggatagcaaataagtttatactggagaaagaaacactagaaagttataacaaaaatttaccactagaagacaaagggggttggagttagacttctcagtatatatattttaaaaaaaagtttgaatggtaaaaatatatctattagaaaaaacactgtaaaaataaattatatcagtgcaggctaaggaattcttcttttattcaatagttctactctcatttagtttgatgctctaattatcacaaatttgtccagtggcacttcctttgagctaaataaataaaaagggaatgcttgtctttagagcaaaaattcaactaataaatgtagaatgactgatggaatttttaaaaaatcactatttagcaaccatcacagcaattgattcagtcaagaatcatcaagtaataacaaaactagtaagagtttgaggaataagaggacacttatttacatggtctgaagtatatccccacaagataataattacaagggaaaatagtatctttgctgagttttttgaaacaaccttgcagatatcaaccacaataggacaaatagatatcatatatctcctgataccacacaatgaaaaatcacagcatttcttctgtgatgtttcatgccaaaaatgtgtaatctgaatctaatcatgaggaaatataagacaaactcaaatggaaaaacatgctctaaaaaaactgacctatgttcttcaacaatgccaatgtcacggaaactaagaaggctaaggaactgttcttgattaaaagagatttaaaaggcataacaattaagtgtaacaaatatcttgttaaaaaggaacaatagtgggatgaatggtggaatctaaataaatctgggttaagggatacggtttatttgtacttctcttgcaacttttctataacactgcaattatattatgtcaaacaaaaagaaggggagaggagggaatggaaggaaggcaaaaccaaaatgaaacaaaaagaactgatccaggacagtgagacaattacagctgctagaacaagttggtagagagtaatgaaaaataaggctggacagtagtgtagcagggaccatgaaagtctttcaagtcactcaacatttactcattcaattaaacatttatagatgcttactatgtgtcaggaactggcatgaacttgttgtggaaaagaatgctaactgcctactaatatccattctttgtttcttccttaaatacagatttcccaagccctatctgggcatgtgacaatctatctaaactttacttctcagcttctcttgcatctataaatggctgcataagtagctctgaataatgaaatgtgaacatatgtgatgagtgacacttccaagccatgcctaacattatgggctctcttgtccttttttctgtcctgcaagctaagatgggaatcaagaaattgagacctgaagcagtgattttgaaagtctgtattactttcatggtaaaagtggttaaaaaaaaaaaaagtggtaaaagttccaaagtatagtggaagcacaaagaaaggagtaattaaatggttccataggaaaaaaggtgtcacagagggaatgcttgagatgaatacaaagaactgagcaaagacaaaaaaaagaatgatatatttagggaatagtaattgtttctatttaagctggaaaatatgcaacaatagcctttaagactttttagagtcatgtgtatataggggtatacatgtacatatatatttgataaaataaaaagtaatttaagagatttggtactgatacaagaataaacacatcaatgaataaaaagagagactaaaaatttaaatccaaatacattaagatttgagtatactgttgtctctcagtagctgtggggaattagttccagcaaccccctgcagatacaaaaatgcagatgctgaagtcccttatataaaatggcacagtatttgcatattatttagacatatctgcatatccttccatatactttatatctagattacttacaatgcctaatacaatgcctatacatcacttcatttgtgtggattcactcaatggacagcaaattcaagtttgttttttggaactttgtggaatttctttttctaaatattttggattcatagttggttgaacccatggatgtgctgggccaactgtactataaaaatggtatttcaaaccagtgaaaaagaaatatatcattcaacagtgggcagacaactgatacactattaaagaaaaaaagcatcatcccttggtgccttggtccataactcgatcttgagactaaaataaattcaagaatgattaaatatttttgtaggaaaaaatgaaataataaacatactaggccaggtgtggtggctcatgcctgtaatcccagcactctgggaggctgaggcaggagaatcatgagcccaggagtttgagaccagactgggcaacatgctaagaccccatctctacaaaaaatgaaaaaatatttagctaggcatgataggtgtgcgtgtggtcccagccactcaggaggctaagatgagaggactgctcgagcccaagaggtcaaggccgcagtgagatgtcattacgccactgcacttcaggctgggcaacagagcgagacctagtctcaaaaaaagaaagaaagaaaatgtactggaaaaaaggtatgaatggacaggtatggtggctcacaccacccagtactttgggaggttgaggtaggtgaattgcttgagcccaggagtttgagaccagcctgggccccatggtgaaaccccatctctacaaaaaatacaaaaaagttggctaggcatggtggtgcactacttgggatgctgaggtgggagggcacttgagcctggcgaggttgtgaggctgcagtgagccgtgatcatgccactgcactccagcttaggtaacagagtgagaccctgtctcaaaaagaaaaaaaaaaaagaaagaaagaagaaagtaaaaaaaaatgataataattatgtaaataatttatctaagaaggacaaaaaactccagtagcataaagaatttaaaggaattaaaattagtagtaaataaatctactataaacaaagtaacaacataattccactcagaatatcctgaaaacagaggaggaatgtatgtgtaatacatatgtgtataaaatatatataatcatttatatataaatgattttatacggacactgtatttctggaataacaccaaaaaactggtaacagtatctctgggaagaagggctgggaaagaggtctactttataatgtatataatttcaaattatgtttatgtgactttctcaactgaaaaaacttagttcaaaatttatgatgataaaacagaactagaccaagaatgccattaatcctgattgacaccattgcctgtatcaaaccataatggcacaaaaagattggcagtcattttttttcttaagaaattaagtaaataatcaactaacttaaaaaaaatcaagggaggaaggaaaaaaaatacttcaactcatggttcatccatcctagtttcataatatggccttgctctatggtatctcaaatattcccagataataacatcttctctcacagatatccttctaattataaatcacacaaacgttattttcctctactaaactctaatattaaagttgttttcattaaaattttcattaaaaattactttattctgtaggtagaagagaggacttgctatgttcccaacacacagaaatgatactcaaggtgatacattccccaaataccctgacttgatcattacgcattttattcatgtaacgaatactcacatgtacccccaaaatatgtaaaatatatatcaatttaaaaattactttattctgaatggatataatataaacccctgatcaaaaggtacacaaagcaaaataagtctttttcctgtctctgtaccccagctgtctagttcctctttatagaaataatcactgctatcagtatactcccagatattttatatgtgtgtatatgtctgtgtgtgagtacagatattaaaatttttaaaaacatatgcaaatagtagctttctatacagtgtttatagcccttgtactttttttctttttttgcacaaatagtagctttctgtacagtgtttagcccttgtacttttttttttctttttttgagacagagtctcgctctgtcgcccaggctggagtgcagtggcgcgatctcggctcactgcaatctccacctcccaggttcaagcgattctcctgcctcagcctcccgagcagctgggattacaggcgcccatcaccacacctggctaatttttttttgtatttttagtagagatggggtttcgccatgttggccaggctggtctcgaactcccgacctcaggtgatccacacctgcctcagcctcccaaagtgctgggattacaagtgtgaaccaccgcgcctggccagcccttgtactttttacttaacaaaacatcttggtgaatgtccccttttcctttaatgttatgctacatcctattatatagatgtatctaatttatttaatcatttcccaatctatttaggttgttttcagtcttttgccattacaaactcttcttcaataaagaacctcgtgcatgtcagcatgttactgtgaaaaagtgtgattgatatgcctactaaacaaattcttaggtatgttattgctgggtcagttttttttttcctttaacgtttttaaggtttttaatacatcattgctaaagtacattctccaagaagattatgcaaattacactcctatttgtattattgaaaaatctgtcttatgtttccaaactctaggtaactaatttattttcagctttgttcaatgatggaaaaagtagaaaatcactgttacttcactttaatttgactgctaataaacatttatttgtgtatttctagacatttctatgaattgcacttattacagttcctgaattataataaaatagttgttgaataaatgtattcatatgcttgtacatttttattttgaagtgttgttctttcccttattgatatgaataactaatcttttaaggcttaaagtatataaagtgcctaaacatatctgttagtaagaggttctctgtcttccctatcctttcctttgtatacaatctcatttattttcacaaaaatctcagtggtgggtggcattattcctgctttacagatgaggacattgagactcagagcttaagttgtccagtgtttctcaatgagaaaatcctcttggaaaaccaaagcaaaccaggctaaggagttaggtatactactttcaaaattctgtacttgtgaaaaggcagaaacttcgcaataggcaaataatctataaaacagtcagatcgcacttctaacacagatagtggaaaagctgcaagtaaggatgtaaaaagatttgggaattttgtttacaagcaagaggggatgatttataatcctgaatattagtaaggtagatgataaatattctacaattagaatttgcaatttttggcagggttgaatccaggttttgtaggccctaaagtttaaagtttccagaagaaagtaaagacgataggaggaggaggggaagtgggaagtgatggcagcaaatgtagcttaaacagaaggaaccagggggagagtaggaggaaatgaagcttagagaggcagtcacgctcaagatcatgtcaagccttgtaggcatggtaagaactttgggtttcattctgacaaacactggaaatcactaaacagttctgagtagagaaaggatatgatttgatttttatgtttaaaaagtaactatggctattacatagagaactataacgggagaagagtataagaaggtagaccagtatgagactcatagttcatcggactgctgttgatagcagtggaggtgatgtgaaatggtaaggtattcaaaatattttgaaggtagagtcttgatcagactcctcccaaacgccttcatatgaacatgcaacacttaagccaatcaaagcaactggctcaacatagcagcttcttcattcacacacatttgtacatactgtttttcccaatggctagatattgactgtctaaaccactactcacttgtcaagaattagcaaaagtatttttctcttctgtaaactattccttcatttcccctttctgtatccaacagcactttgtattattcctactataatatttatcatacctgacagtaataatttgaaaactttttactgcctccacttgtagattatgcacaccttaagggcttaattcatccttgtaattgcacaaattatcataaaccacataatatatatgtgatatatattttgtatctatgtttctatctattgtattatatatatgatagatattataaatgatgttgtgtatatgatgtatatatgataacatcatatattggatatatatcatatagatgtgtctaatttatttaatcatttccctatatatttaggttgtttgcagtcttttgcttttacaaagtcctcttcaataaagaacctcatacatgtcagcatgtcagcgtgaaaaagtgtgattgtatatattgtgtgattgtatataaacatgaacaatgataaaatttgttcaaatgccttcagaaatgtcttttgaattgaaagtatttataattgtaaaatcctaaataacccctgttttctttagaagggagagaaaactcctgaagagctccttccccacccctagttctgaaaagaaataatattttttctttcatgagtaaacaatttcagttttctgccattttaggaagctatcattgataacaagtccagtcacatctaatcattctaaatttttgtaaagatataaatatgattattgcctaggtacctgataaacttatttcataaatatatccacatatatattgtatgatatacctcagacaactgatctgaaaattacttttttaatttaaaaaacagattataacttaccaaatcagtttcctttttccttcttttctttctttctgtttttggcacctgacagggggacaggagatatatggaaattgtgataacaaagactaacatactttcttacttcattgcaaatgttaagatacttgctcaacaggtaacacaatagtcatttctttattctccaagaggaactgtgcagtgctaataagcaaatgtgagaaaaaatttaaaatctgataaaacataattgccaatgacagcaacagaatggaaggatactttagagattattcttttttaaacctcagttctgcccagaagccaccgccatattaatttaaatgattgttttattttaatcattaattgatttttttttttttttgagacggagtcttgctctgtcgcccaggttggagtgcaattggtgcagtctaggctcactgcaacctctgcttcccaggttcaagtgaattctcctgcctcggcctcctgagtagctggtattataggcacacaccaccacatctggctatttttgtattttttgagaccggctggtctcaaacccctgacttcatgatccacccgcctcggcctcccaaagtgctgggattgcgggcttgagccaccacgcctggctggtattttttttttttttttttttttttttttgagacggagttttgctctgttgcccaggctggagggcagtggtgcaatcttggctcaccacaacctccacctcccaggttcaagcaattctcctgtctcagcctcccaagtagctgggactacaggcgtgtgccagcacacctggctaatttttgtatatttagtagagacggggtttcactatgttggccagtctggtctcgatctcccgaccttgtgatctgctcacctcagcctcccaaagtgctgggattacaggcatgagccactgtgccaagctgattgttttaaagattttacttcccgtattttagctgtagaaaactaccatggagctaaatataaaatatatacaaaaaggcaacatttgggacacggaaaaactcttttccatatgacatttcctgataaccatagtacagaacaatctaaacccaaccttttaaacttaaaaacaaacgtagtagaagcctactaagaatcttcttcagcataaagaccttaacctagatctagaactgaagaactgtccagaacttatttatatctgaaaacttcaaaaatgggattgaagaggttttggaaatttaaatacatataaggtagaataactaaaaataaaatggaacataatcaatacaaaatattgatggtattcttgatatgaataggtatctaattatttcatctggggtactgaaaagaaacacattgataactttgtctaagcctgatgtctcttctgtaatatggattttataaaaattatttaataaggctgaagcaagaattaaataaaatacacaacaccgagtacgattctcaggccgtaacaggcactcaaaataaaaaggttattattattatacagacttcccaaaacacgtattttcctaaaacctaattcaagaataaatataatttgtaggtttttataaagaggccactgggtaatacaatgaatcacatctttaactataatttttcaaaaggaaattcagatacttatctcttttttttttaagacggagtcgcactttgccacccagggtgaagtgcagtggcgtgaccttggctaactacaacctctgcctcctgggttcaagtgattctcctgcttcagcctcctgagtagctgaaattacaggcgcctgccatcatgcccagctaatttttgtatatttagtagagataggtttttgacatgttgaccaggctggtctcgaactcctgatttcaagttctctgccaatctaggcctcccaaagtgctgggattacaggcatgagccaccgccccaccccgatctctattaaagctaagagtataatcttgagggcagaacattatgttttaactcagtgaacaaagtattgattacagacggtttagaaaatatggtctgataaattataagacagaatgaagtttggaggatctaaagtggcgctaagttgacatgttccctgtaatgtttttctcaaaataaaatttttctcaaatttctcaaatacaagatgtcccaaacgctcttaaaaagaattcataattaaatcctttaagtaatcaaaatatatcacatttacctttgtggctgtgcaatctgaagtcttgaattcattcatatattcatctaaaaacactttaaaagtgttgacccaaactctcactggagattcacccagtgaatcacgctgctcaagcctcatcgtcttttccagaatctgttcaaatagtgcatagaggtctttataccgtatgcttttcccatcatccatctataagcaataagaaaagaaatgtatggttttataaagaaactccttaaatatagaggaaagattacacttgtaatggggtagtatttagaataaagattaggatcctgatataatttctaatgagcatgcccatgaggtcatgtggtatttgtaaactcccattctagtatgggatgaatgcagaatcaaacatgctaaattttagtaaaaaacctgacggtaataatttgaggaagtcttgagaatttctcttctaagtgtgactttttaattttatgtagctataaaggttatttgcatccctcttaattactttcctccccagaaatgaaccttgtttagatggttctactctaaaattgaaagaatgaatacttgaatcattgcctaagcatatattaagtaaccaatttatttttccaaagaagagtgacatgcccagaataacatcatattatttgcaaggaactgaaatagaatttcttttatttaaatgagatctggaatttttttttttttttttttttttttagacggagtcttgctctgtcacccaggctggagtgcagtggcatgatctcggctcactgcaacctccacctcaagctattgaatgggttcaagccattctcctgcctcagcctccccagtagctgggattacaagcatgcaccaccatacctagctaatttttgtatttttattagagacggggttttaccatattgcccaggctggtcttgaactcctgacctcatgacctacccgcctcagccacccaaagtgctgggattacaggcttgagccactgcgcccagccaagtagagtataaattaaaaagctttccagatttttctcttcacagtgaattaaagaatatattgaacaatgaaaagccaataaaatatgaattcttttacagaatatgataattcataaacactaatgcttctatagaccaaagcattaattgcacacaccaaaaataaattttctaaaacatgaccagtatcatgtgaaagtataaggtaaatctcaaagtgatataaactgatatgtagaaatcagtgtccataaactaactgccctaattccattaaaagaaaacatataatgcattcctcacaaaggaaaattagacattatagcctagcaatagagctaaaaggattatgaaaagtcacaggcaaaaacagaatcatacccaggacatctgaagtcagtatcttaaaagatgaaaaaaacagctgtaaggtgggaaaaagctactcaaggaaattcaagggagcttttaatctgaaaccattcagtttccttgtctatccctaaaacaaaaaccattcattttccttgtctatccctaaaacaaaaacaaggcactggagaaatctcttacgaaacatggcttttgtattatcttctacagcgctatcaaatttttcatatgttgaactactaaatatctcctaacatagtccaactcaccgccaatgcagatgaataaaagctgaagatattctgccgaaattccttcagggcttttttaaatacaacatccactagtgtatccttcttgctgtcttcattatctaggtcattcacctgggaaccacaaaacgagttttagtacacaatcaactaattgaaaagaagtaaatacaacagtaggcatgtattgttgcttccacaatgactgtcctcaaagtgcaagccacaggctattataggactcaggtgaaagttatgactagacagtcaaactataattactactctatgatttctaaggttccttctaacattgtatgattctatagttctgttacaagaaaactcccgtgtgcaacaagctgtaccttcccatatgaaatttgacaattttaggaaaattaaagtcactactaaagcctacaaccttaaatcctgtctacccagtctaactaatgcatatcctattattcacacctttctggtaaagaacagatcatctaaagcatggaagcatatgtaattttgatatctagagagtatatcctgatatacacaagtattccatacacagagctgctccagggcctgacgtggcaaataaagtgtacctttttcagaagaaattcatccatgctttttaaatcactgacacttgctatgatctggacagagtcattttgccaatgcatagaatccaaagccacgttgctaatcttcacacttcgcttgcgcttagcctttggagaaggttctttgttctctttgaattccttccggcaactgccgggcagttctgggctcaaaggaggtgttgggtgatatgcagctaattctacaattcaagatagaagacccaaaaggacacatttagtaaatatattgataatcttcacatccttctttttaaagttcctttaacaagtcactgaaggaaacatgcaaatatatgaatagcaaagtaacattaatgtttgaggttaggcagctaagcaataaatccagacagcacatttgtacagaaagcgtatttaaaaattaccacttttcaaagggagatgatatcatatctcccaagaagctgaagtctgatattaaaaacctggatagaaatgctttgcaggacgtcaagttagatcccaaagatctcagtcccaaagaaaagaagagaatataaaaccatactagcatattaaatgcttactgttaacaaagtcatagctttgctacatgtttgaaacaatatgtgtagctatatacaagtccaacaaaccagtggagtttgataattattattatttctttactacagtctaaagtcctgaatacttctgtgataacatttggtgattgctggcaacctgttagggagccaagtaactcaactggcttacttctgcttgggtctcttcagcatttaggattttcttaaacatcccccaaataactgtcaatttattttctctacaatttttctctacaaatgtttacaacggagaaattagattctatgtagcccattacaacttagaactagaccagatttgccaaaccctatctggagctcgatgaaaatgtttacctcctctcatttcacatgcttgtcttcccaatgtgtatgctcgttaccctctgtccaatggtatatcctgattctatccaaactaactttgataataaaggaaaaaagtagccccctacatgctaaataccacctcaggcaggaattgagagaaacccaatttcaactatgacacaagagtaaagaatataaagatacaggatacaattatattcaaacatatatcaactgattttaattctattatacagcttagatatattaagtatctattttatttagcaaagtcagtatctttcttattaataaaataaatgtttactaaagaaattatccataatcccatattagcattaaaaacaaggcctaccttaatacattttttccaaatataaataaaaagctataatcctaagttttatacatgtgtcattatgaagcaaacacacaacaaagtctgcttataatatgaattttcaattagagtttatacttctttctcaagaattagcagcaaagaatataattgtgggaaataaaaaacttagaaggatgactgtcaaccagacaagatataagaaactgataaccttagccattcaatagtagggaattcccagcttcctaaacctgtagtattcatttaacttgttattggttttattcacatccatttctcaactgatagaagcaaagccataagatacaaaaacaggggtctaactacctttccaccattctttcctctggcatagagagctcaagcccattcacccctctgggaagcttgatgatctttcctccttgtttctctattttatcctagatatgagaagatgctggtttcttactgtaactgggtctgttctatcctgccttaagctttcttccgaggacctctttctattttagtcaatgctggtatttcacccacattaccatatatccaccttggatgtatatctctgttgaagaagttggtatctttacgtagtagctaaaaactctcaggcatacctgagaaaagggcttgagaagtggtaatcttctaacattaggataacttggagagtaagtaattttcccatttagagaggtcagttttctgaacgatgaactaactgttgagtacttctcaaatgtgttatgctgcacgcccagaaagttaaaataagagctatgggactgggcatggtggctcatggctgtaatcccagcactttgggaggctgaggtgggaggataggttgagcccagaagttagaggttacagtgagctatgatcacaccactccggcctaagcaacatagtgaaaccttgtctctaaaattgaaaaataatagctattataaagtgccaggcatctgctaggtactgaaatatagcaagtacttaatatacaacacagtggttaagactatggactctggagcaggactgcctagattcaactcttagctcttccagttactatatgtgcataaataaataacttttcttttttatttatttatttgagacagggtctcactctttcccccaggctgaagtgcagtggtgtgatcacagctcactgcagcctcaacttcccagactcaagcgattctcctacctcagcctcccaagtagctgggactacaggcaaatgcctccatgcctggctaatttttatattttttgtagagatggggtttcactatgtgcccaggctggtgttgaactcctggactcatgtgatctgcccacctcagcctcccaaagcgctgggattacaggtgtgaaccatcgtgcctggcctaataaaaaaaattctctgtgcctgagttttctcatccataaattgggaataataatcatactaactctcaaaaaactgttgtgaggagcaactgacttaataaccataacatgcttaccacagtgccttgcatgtagtaagcattcaaatattagctgctattagttataaccagtaatacatatttgttaaatgaatgaataatggctacatttttttagtttagaaaattaaggctaacctatgatacacagtcatttttgaggtggttgctgcttcattgttttgtgatgcattttttggaaacttctattgtaggaaaaatgtaactttattttttagttaaggaaggatttaacaatgctggtcctatctcattagaacatccagccaacaggattgacattatgaatactacaggaatagcaaactttcagaaagagtgaacagaaattatgaacacaagttccaccctttggtcacttttaccatctggaaactgatgagctggaatcacatctgtgcctgcaaagagtggcgaaacctctgactgggtagtaggtttcactctggtagtcttcttctccccttgtttccctttggcccagaatctcatcttagctctctgaggtctgtttaaagaaataaaggtaaaaatggaaattaagagtatctcagtgataatatttgtatatatcactttaagctttacaaatcttctatgtatattagctcatttaagcttcacatttaaattaagtgtatttatctttacttttgcatttaaacttcacctgaaactgaaaggcgaaaaattatttaacttctctgggttttgttatttctatattcagatgaggaaacatcttgaatacagaaataacaaaacccagagaagttcaatattttttctaagatgaaacagccacaaagcagtggagctagaattctaactcaagttttctaactcccaaactggtttattttcattcttgtcccccatccagcttggatttagtatatacacaatttaacaacaaagaaaatactttttaaagaaatcacgaataatcctaccactctaaaaaacattagtttacctttgtttgtcatttccttccagtctttatccataagtatggcaagttttacatcactgttatcatgatgcacatagcattttaaatctttccactcaccattacataataaaagctttaatgtcactatttacattcatgagttattagtattattaacagccacttatttgaacttgtatctttctccaggcacagtgcttacaaaatttaattacaatatcaactttgcttttttcttttttcttaaagaacaggtgatagtaacaactttgcttttaacaaactactataaatatgttacaggtgaaaaactggagacttatatattaggtaactttcccaaagtttcacagtgagtgaaaaattcagaaccacatctattatattgtattgcctcttcttagtgcttgtacacgctttcatcatctacatcaaagaagtaccttgcgataacaatggcatgtagttactgaccatatattatgtattctaacctcatagttggaggtttatttgtaaattaatttatctgttcatttgtctgttcaatcattcaattaaaaaattttgagtatgtactaggtgacaggtactatgccttatatatgatattcctaatttcacaactactgtgataaacagtattatccttactttacacatgagcaaactaaggcttacaggcctgatggagatggaagttaaaatcaagtctatctggttttgaagcccatgagctctttctttcttcctttttttttttttttttaaaaaaaagcttattactaaactcatatatttatacattaaaaagagaaattgttctacaagactaattaaaaacaacagtatctctctgccatgctcaccccattttctgctccctagaggcaacacttttgaattgctttaactaattcttctgatatttagtgtgcttctgtaactatcatactcatggccacagataatgattaggcatgttccaccattccagtcctaaccataaacatgtgcccccaaaagaattatactgtaattttagttagatcaatattcagtatttacttttaatgatattcagtatttatttttattatgtaaataatattcacagttgagggatgtaattccctaaataatctactttattctagaggatttttaaaatttgctcatgaaaactgtttgatttttcatttcctcacttttctatatacaattcacctccacgtgtttccccatttctatcaactctcaatacattcaaatgtattaggtactttatcagtttcatcttgttgaaaaaaatctctcccagagccttctaacttgctccaatttggagtggtttccctcattgcctgctgtgcagttgtcatttgaaaagctactttcatcattgtaacagattccttttgtctcttttgtttcataacaacatgtcttttggtatgggtctattttcatccactatgttgggcactcagtggcgtcttcaaatctggaaaatcgtgtccttcggttctgtaaaatttggctgaattactttttcaataatttatcctccgttttctcggttctatctttccaaagttcctaccattgggtcattggatctcctgaatggagcctctaatattcccatctcttccatttcttcattttttgctcaacattctgagatatgtcctcaaatttccttttgattcttgagttgctcctttatcatatttttaatcttcaaaagctctttttattatgaatgtttctctttcatgcaccatttggtttcatgaatacaattgtatttgttatgcaaaaggcctgttgatagttacatttgtctatcttgaagtgttctattccctgtatagtttatttcttccaagttgtattttatctgttaattttggtttcttcaatataaggtatttcctcaaatatacggtgatcagtggtatgtgattattatttaaagtagggtaaaaaaaaaaaaaaaaaaaagaaagaggctgcttggaagctctagtgtgccttggtgggcctgctaaagtatggtcttccttacagggttatctggttggttgactttgcagggagagctcctgatagtaatatattcagggttttccctaagggctagacagaagtccccaaaactctttgaaccatttgcttagaaccatttgcttagagggtatgggaaatgaagaaggctggcaaatcttaacattctgtatataaacagtcattaaatccctatgttccaaatatgtgccccagccctcaattgtatctagtaaactccaggtccagagatactctgttttatactttccagataataaatttcttgttctgctataattggggaaggtcagccagctagatgtatctttctcagctttacttagctggattaggatttggctttctagtatgtattaacatatttaaaatttaaagtccatttactttttggattccacagttttattgcagttgttttcacttctaagtttttttgagggggagaaaagtccttcgtagattttgtcattttagcaattgtgggggaggacgtggaaactaaatatatataatctattatttccagatgtatgttcttctactgtgtcacatcttatttctcaatatttggtttctagtattatctgctctggatttggattaccttagattatacctctacagtcagcgaaaaagtggtctttaatatggttatgaaccagaaaaatttcaacataatcttgtaagttttctgcgaggcccaaatgcttatacaacataatgagggacaaagatatttatttgaaaaataaaaattccataagctctcttaaagagaacagaattatctcctgaaaggccttttcagttccatttctaaaatgcttacctcagaacagaatccaagtccaaagctggcacctattttcaatcttatttagtctcattctcttttacaacaaaataccataagtcatgtaacaatttggagactttccccaaatcatactgctaagtatagagggagataaagcccattatactgaagggaaccagtatgtgccaccccaaaatattcctctttgagataaatatttttaagctaaaggcaattaagaagtagatgcagaaaagctctctaccctcccctgttcgcctaaaagcaggatataaatttgaaaggtgttctttcttccctctctaccaacaaggacagaaaatcactggagacagtgtagacctttattagctagaaatgacatcagaggaatctaccaactttactccgttagtttccccataaatttaccttcccagttttgttacctttggaagcctgaaactgcttatctttgtcttgtcacttctctaaaattaattgttcattgttgaagacaatgtataagccagattcctaaaccactgttttgagttacctttcctctgcatgatgtgcatgcactgtatgcactaacttgcttatttttctcttgttaatctgtcttttgttacaggattctgtcccaactatgaacttatgagggttgagggaaatttttcttttcttctcttcaacacatatcttaactactatgtgcctataaacagtaggtacttaccatttcttgaaaaattggtaaataagtttaatttcaaaagtggcctatcaattatggtttttttaaaaaagctcagtacttaactatagtcagttatcaaataaaattatataacccctgttaactccgtgtatactttataccttatatctgaatctgaagccttctgtctcactgccaacttggtaatctctccttgagacatagtcttatgaagttttgcttgttcatcaactgacgaaaatcgctgtgatgtctgtaataattacatatgtgaaagatttaatgccaagtaaatatatgatagcactgtaatttaaattcaggttacagaattacttgagctatttaaaaacacacaaaacattgatattattcagagattcattgaaataatagagcctactgaaaactctatataaagtaatctgaaataaagatgacttggtcaatgaaaataaacaggatctaccagttcatattttctgacaatttaaaaaagaatctcaagtggaaaggcaagaaagtgaaaaccatttaaagatagagacaaaagatgcaggatctaataaatctagaacgctaagtattgtttttcaaatctccttttatttatcccaaaaggtggttattactttcatggcttaacttgctattataagttcttcatatatctaatcaataatttaaaagagatggaatatgcaatgatttttaaagagccaaaagatgacaggataaaggctcattaccattattaatggtctaaattataaacaacttataaggctatcaaactgtgacctgatttttaattggcagttcttgttccatttgtttaaaatgtgtccctctaaagacaatcctgttctgaggagagaatttcttgttatctattcaagtcatttcctaatatttcatttttctgtagttataatattctttctttagccttttggtctgcctcactatggccttattaacagaaagaggaaataccttaagttggcaaagatgaagtaatagggatctggtctacccacttacctgaaaccaacaaaaaacccagacaaaataatatgaaaccgcaatgtttaaaacaatggacagatacccctgagagatgggaaaaaagggaagtatgttctacacttgtttctaggctgtgatgcagagaggaggaacccaggtgaaacttgacagactctaagtggaacacatgaagctgaaagtccaaggtgagcacagtgactagagaccaaaagacagagtactggagaggagtgagaagcacaaagatagaactctagagatctacagaaggtccacattgaatgttcagcttgagtactaatcaacactttgtatgagaaaacaatccaagaccaagaaaaagatcacttgaaaggattaaaggtaattgagcccatcactcacaaaaggtcagtaatagtgtctatgcccaagagccagagcatataactttatgattcccagggcactgggcaaagtatagagaggatctcacctcaatagtcaagaataattagccctagactgagtactgtttgggtctaacaaacctttttttttttttttttttttttttttaagagacatggtcttgctctgttgctcaggctggagtgcagtggtacaatcacagctcactgcagccctgcactcctgggccccagttatcctcctgcctcagccttctgagtagctgggactacaggcacatggctctgtgcccagatcttactttccagacctctgtgcaaataaattgaaaagttagatgaaattgataattttataagaaaaaagggtttaccaaaattgaccctgttagataaaaggtttaaaaaagactgatttccctagaagaaaaaaagaaaaacttatccaggaactacaccacaaaaaagtaccaatcccaggtggtttcatagaaaaattctgccaaatcttcaaagaacagatagctgcaatgctataaactggtcctgactttttttagagaaataaaatacacatataaatactaagtgtatagtcaacagtgtggctgctgtcttaaggctgccaatccaaaactcttaagtaatgaactttgttcaataacaaccagttttctaccacgcaagaccaacctcaaaatcacctagcccaggtcctaaaactttatgaatatcctctcctgacttctcccttgtgagatattactaagacacagtcaaagtgggttttctcttactgtaataagctaataaacagctttgtttgatcaacaggtttttctggcagtctatggagtagacatcagagagaaagaaaattcaacacagacaaggatcagagagtatctcagagaatagcagaaataggaatataagaagtgacagcagtttggggggaataatgagaaatttagttttactatgctagaagtaatgaagattgaaattctggagagccattcagaagtcatatccatagagatgactgctttaaatctgggggatgataaaagaaaactgtacagagaaaagtataatgtttcctatactaatcctataaataaggaatagaaatgattttactaacccgcttaccattcagaagacagaaactaaaaaaaaactatcttaaaaacaactgcttagcagaaaacgccattcttcttgagtaaatgccaatgtggtgtgtataaaaatggagtgagagcagcacatagagactaaacagttattcaaacggcagcgtttgaagtaagaggttaaaaaacaccaaagtcactaaggagggaaactactacacttgtttcccctcccacagcaggtaacaactgattaataatttaaaaactcaaatctccttcaattcatttgtgaatgtctttatcccattagattgggttacttcacaattagaaaggtcatacagcaatttcttccaagatttaatgacacacttcagagtaataaaatcagtttgtccagaaaaaaaaaatccagcttttaaaactccatgtacctagaaaatcaaatacatttaaaatccagaaaatactgtgagattgtagtagattttatttagacacaatacatcttcatcttcacaatatcagataatgttagaacgtggaatattctcaagataaataaaaagagaaacacatttaaaaattgttcctacccaccccatccccaaccctggtaagtaactatccacatattctacaaagcaaagcttcttcatgcagtgtccaccagaaacaagcaccaccacctgttcctaaaatagctcgtggtgaaagagaagaaaatgagaaagctggcgacgtgactaacacactgtgcagggaagtgctctacaactactggcatgcagtgaccgtcaagcaggtgaacagaggctagaacactgaaaggagctgaatgctccaagcagaaagcccaacttcctggttcatctcagtaaaagttcccagtgtaaaagaagtctatcaccaaaaggactaagggttgttacaaaggaaactctcagaaacaaaacagcagtcataatgccaaagtttttctgcaaacaataaatctatgtatactagacaaagcaggacttttcatcaaaattagtttgttccattacataatttcgtatttaactgttaatcagataacacagtatatttccttatttataactcaaatacagggcacctccaaaatgctattattttattctacactgaagattttggctctaattatacatattatcagatacacagaatgtttccaatttctataatcctacagttcggctcaggttaatgactcatttatctaatcaggggacttgttttgcatttttctctttttgttgttgttgtttttgccttcataaaacatcacttttgtcacttaaaaactgggtctacctccaacaaaagataaaagacaacgagagtattctggacaataggagaaatttcaattaattagatctttgacaattcaaacagcttaaaacagttcaaagatagaatatttaatgagtcaaataaagaccattctaaaatttttctctgataattgacagacactaaagaatattagagagctcagttacagatatgtatggaaataaaatgttatttcactctacttcatcagtgatgttctggttcatattagacatacggtctttatcttatatatttctaggacaattccaaaataaaattctttgcattaatatacccatcaatatactataatacttgtcaaaccacatatacacctgatttgggctgagaagatgatatagttatattcttagcttaaaatggtgcagctttattcaaacacaacaccaatgttatattgtgtgattaatacaaattcacattacatatagccttctatttggctgggttggtccaggaagacactttttgctcactatatgttttaaaattcatgtttatttcttattagtggaaagtgaggtggaggaagaaagtttacaggcaaaaaatgtaaaagtgcattgtagctaaaagctactggattattttagaccaaggatcagtaaactaaaccacggatcagtaaactatggccaacaggtcaaatacaatccactgtctgtttttgcagttttattacaagacggtcatgcccatttgtttacttagtgtctatggctgctttcacactacagtgggtgagttaagtagttaagttaggtagttgcaatagagactatatgacccacaaagtctaaaatatttgttatctggccgtttacagaaaaaatgtaaggaccactgctctagaccttttaggatacaacatggaaaatttctacattagtgccaagtcaaataatcttaattttgcctaatttgtggctttttaaagtgccctttatttgagttctattaaattaaggtttagcttagttgctgtgttcactgaggtttcccatgcacaaaccattacatgggaagaagctgtgaaggttagctttagattagcaaagactatttccatcagatttgcttgctatttttcttatattgctgtaaaattaccatttcggagtcactgtgagaggcctgacccaggctgggtgcaggccctagctcacagtgagaagcttggtcaagggagagaaggggctcaataatgtcatcgtaatcatcttcctctgtatccccctccccatcggcaaaagtacctctagtcaagaaatcggagcgcgtccgcgccattcgagctttctttttatgggccggtctggcaacctgcttgaccaaatgataaaacaaataacacaacaatgtttggggtttttgttctttttgagatgatgccaatgaaagacatcagagggctcatgaatttcttgaaatatccctccacccaaccatgccctttccactagcagaagtgacagggatgaccaaaaggaatctgtatacattactctggatgaaggactagaatggaagctaaatctacactgttctacatagccaaagaagtcatctttcactgccatagtaagtcaacaaagtctcttgcacaaattgccttctttttcttagcaactgggtttttaggcaccattccctgcctggagtacaccttcataattataacaatctccgctcatggcttctttctctaaaaacacttgggagtaaatgggtagatgaggtgctctacctacaagaataataatttccaaaataatgtacatctcttttgtatagaagatagataaacaaaaactcaaaacttacctctctttggcctggcccagctaacttcacaggtttccatgctggttcatcttctttatggagttgaggatttttactgtttaaggcttctttgctgacactttaaataaaacaatgaaattacatttcagttcttagcagatatcccatggcagccaggttaaagacttccagcaaattccataaatattttcagatcttagtcaattcccaagacaattaagtcatattttttctgcttagctaattagtaataataatcctgaacctacgcataagactgaattactaaaggccttgtcctgatgatcagtgggtatattccactatgaatatgacatatgtttaagaatagtagctgcaaaataaactcaagaaataaaatagatctgatgatggggaaaggaaaataccaaacccctgaatctttagaatactagtcttacaaggggcctttccatctaatcattataaaatacctgaaaaatagccatccagggatgaggatctcattatattttatactgagatggttcttattggttagaaaactccttctgaaatctctctttgtagttttcatccactgtctttgagttttaaaacttgacgttgaggctgggtgcagtggctcatgcctgtaaacccagcagtttgggaggccgaggcaggcggatcacctgaggtcaggagtttgagaccagcgtggtcaacatggcaaaactccgtctctaccaaaaatataaaaattagctgggtgtggtggcaggtggctgtagtcccaggtacttggaaggctgaggtaggagaatcacttgaacccaggaggcagaggttgcagtgagccaagatcgtgccactgcacactctagcttgggtgacaagagtgaaactgtctcaaaaaaaccaaaaaacaaacaaacaaaaagcttgatgttgaatagcctaaaatcaacactggcagggtaagaaattgttatcaaactaaaagtatgctccagacaatacaggtgttacagtgttagcttatgaaaatttaattttgattgaaaaactgtatgatgagaatgctttatcattaaattctgggcagaaatagatgccagaatctgatgaaaaagtgtatataaccttcatggccccaattacctatattaactcagtaccatgagtctcatcaacaacatattgataatctctcctgagcagaactgtaagctccttgagaatcatatcttacttccaaggatagtgctagctaaaattagacactaacttatgatactagttggtagattaattgttcttccattcaaaatctttcatttaatttttataaaagtaagtctaggagccataagaaattatcttgccctttgcctctatgcaataagcccgaaacaaacacaaatagatgcaatctttgctagctataggcttcttagagatctccctttttgagcaatgtatgtacaatgtgtataagcctagcaatcctagcttgttctaaaggattctcttctggctatcaaaatctctcttgccacagttgagcctattggaccttcatttatcctccaaagagaaacaacaattaataggatcttgatagtacttgaccactgcaattaaccttttaactcacaacattttctttagacttcaccatgaattctttttgtcctttctcattaaacagttaaaaactactgtgtactcatcaccactacagtacaaaagggacactaacctagtattactttctaattataaaacccaatgccgatccttaatgatgaaatgcaagttctagtcccagccatttctctaaatacatgatcttgaataagtcatttcacctctatgggccccagtgaccttatctgtaacatgtgggaactggattacataattcagaagcaccagcatttatgattctacaaaatgttaatgtttctaatattacttatacaacaggatgagatttaaagtatgaattttatctgtagagtttaatataatctaatatataataattttaaagataagtagatcattaataaagcaataaaagaaatcaactcaaatacacctacaactatgtatcttggaaaaataagataaatatttcacaaggatgattaatattttttagaatccacaatttgttttttacaaaacaaattcatggatccaacagctactttataagtgtatacacctataatacatacacacacataaatgtcataattaatagacattaaagaatattaaagagctcacttacagatatgcatggaataccatgtatcactaaacttagaatgacagggaatatgtttttaacactctcttatggatgcatatgctacacagagtctttgaacttctgggaaatctgtaggttaatgggtgggaataatacttaaaactgtcattaagctcaactgcactttgtaatactatagagactcttggaaaaatatattattgatcatctcttgcccacatttacaaaggatttctctaaaatccatatgaaattttaaagggtggaacatttaaatgtttgggttatatataaaaggagagaaaaggttattttcattgttaatgtaaaatttatttttaacccaaagatacagccctcctttcatttcaatgatgacattctccataagaaccaaaagaatctaccaaatataaagataatacaagtatcttcaattttgttaaatttgtttttacgtaccacttaaaaatgcttttctcatgactacctctagtttaaaaaagtataaagaaattctacttacggctgggtgcggtggctcacacctgtaatcccagcaatttggggggcagaggcaggtggatcacctgaggtcaggagttcgagaccagcctgacaaatatggtgaaaccccatctctactaaaaatacaaaaattagccaggcatggtggcgtgcacctatagtcccagctactcgggaggctgagacaggagaactgcttgagcctaggaggcagaggttgcagttagctgagatcacaccactgcactccagcctgggtgacagagtgagactccatcttaaaaaaaaaaaaaaaatttcatttctatttatatgaagtataaaaagtaaactcttggaaacagaaagtagaatgatggttgccaggggctacaaggaaaagcagagttgttcaatgggtacagagttttattttacaagaagaaaaagttctagagatcttttgcaaaacaatgtatatacagttaacactactgtactatattatttaaaaatggttaagatgggaaattttatgttatgtgtttatcacatacaaagaagtataatgaacgtaatgatgaccataaataggccaacagctgtaacaaaacaaattaacttctttaaagcctgaaacaaacaaccttcaactactaaacttcacagctgtaaagcaaccagtattcggtgaatgcctactatgtttataggcactgtactgcccttcacaaatgcttctcacttaatggggaggaacccagtatttactctgctattcatgatcagtcaaggattcctaggatataactacatccaacttcaggtgatggtagagtcaacaattagggaatatttttacaaagagaaaatggccaagttgagcagccactttacacaaatagttggagcagaacaaggcaccttaataaaaatactccaagaagtttcccatttatacataaataaacatttcacttacaggggaatactcatattgtcctttggagtgaagaaaatgggcctagcatttccctctctggaaaggtcatcagaattgtggctgtaagactgagttggcctaaagtgttctctttttgaaatgcgattatttgagagtttacaggctacattcagctgggtgcccattctgtctgtcttggataattccttgacagtactagattggcatggacttccttttctttcaaagaacacggtgacaggtcggtcctttgggggtaagtgagcagaggaactgtctttttgggcaagagctgcatcttttaatgatagggaccccagtacattaagttctcccttatttgaggtatttaagctgaggagagaggatggcctctctactctttgctttgactgataggaagatggtgccaccaaacactctccaattcttggcttttcaattgtcttgaaggctttgcgctccttctctaaaatatctgtttgctggcgaatctgttccatcatctctttttcattctgttgctgcaactgtttttgcctttcttccttctcagtgtttagcttttctaacttcttaagcacaggattagaagactctgtattcaaagaaggaacaatctgatcttttcctgagcagtgataccttctagtttccctgttgatatccaaagtaagagcttcccccgctgtgtcttcattttccaatagtttgtttctttggatacttgtgtctagttgggaatttgttttcagtgggtcttgttgggggatataaaaaaaagtaggtagactatttgaaatgaaggagtctttcagctgtggtttacaggtaatagactcagaactgcagaccaccatttccttcatagttccatccttcaaatgctctgcactgctagtctcatttgaggcactgagggcattgtcccgtgaatcaaattttggactgctggatatcttaggtgatggaaactgcaagtctccttcatctgaaatgacagactctagtttgctcttttggctttcctcatagctcagaagttccaagcttccttgagagctctcactatcaggtgtaccccgtggagactgaaggccttcaggcaccaattctgtagaccatctgcgatcctctgaaggagaaataccaccaagagaacgaactttcagcaattctaagctaaatatagcttgctctagttctctcattctcctactttctctcttagcccggcctacttttttctgatggagatcctccaaggatctgggtctctctcttacaagcacatcttcctgcaagtccacaccactctggctttgggctctctcctgctgcttgtttggtgactccttcaagcagtccactgaactttcacggctaattcgattactctctattacagatttacattcctctatggcttttattctgttgtcaaaagaacaatcctcccatcctgaagggtctgaaccctgaatttccagagatccatatcccttaatattcaccaatccaacttctggctttgtttctcttagcctttgttcttttaaagctttaaatctatataaaaacagacaaaatgggttatagaaatatcttagttaccactgaaaataacatatttcctgagaatttaagaaaaaatgcagagttgtaaaatctttttataatacctaagttcttcttaaactaacttgaatgcacatttcataattttcctatttccatgagtcagatgatatttcattaagtgtattacttctacctaggcatttcagtcaaaatgtaaactaattcagaagtaaagctctcattttaataatgcctttattttaaagtaaacctcaaattaaagtgaaattttaagtgtgaaattaaagtgaaattttaatttaagtgtgaaattaaagtttctgaaagtaacaacagttgaatattgccaattttataagattcagcctaatgtagaagttaattcttagcagttatgatcacagaccatgtagattttcaatccaatttaattcaataaaaccttatttaacttccattatagacaatacaatgtgggttaaaatcggtatcacagtatagtggaaaagacaaattgtatacaaccaattctaatacaaattagacaagtgttaatgcagaggtataaacaaagtacttgggaagaagaaaaaaagcaattattatagtaatagagattacctttgtcttgctctgaatcctctacatgttgattgcaaaaggataatttttttcctttgttcttggtaccttttactttccctgtaggctttccatcttgcttgtatgcaaatagcagccatgtgcctgcgcctatagtaatctctccatttctgctggataacgatggctgcagcccgtaactccaagtaccgctgcctctctaagtgagcacgccaggaagcttggagaagagcagctgcactagccataacaaaagcatccttctgcacagctgcatctctgacttgcttctgatttaggtaattcctccagaatctctatggggaagacaaaataacagaaactggttgtcatatcttacactgcattttcacaggaaaaaaagagaataaatttcttatgtcataattacaggttaagtggctatgcagctaaattcttggtgattaaaaataagttttctggccaggtgcggtggctcatgcctgtaatcccagcacttttggaggctaaggcaggcagatcatgaggtcaggagatagagaccaacctggctaacatggtgaaaccccgtctctactaaaaatacaaaaaaaattagctgggcgtggtggtgggtgcctatagtcccagctactcaggaggctgaggcaggagaatggcgtgaacctgggagctggagcttgcagtgagcagaattcacgccactgcactccagcctgggtgacagagtgagactctgtctcaaaaaaataaaaataaaaaaactagttttctacaaaagcagaaagtgtacctgaaaaagataaatagaaaaaagttttctcttccagatatgtttggctaaaacagctattttaaataatataaccttgaagaagttaattacagaacctaatttaaaatttttggatgatttcatgtccttcaaattattagtaactttaacatattatattcttttgttacaattttcctaaataacactaatgggtttaaggtaatcctgacacacattccaaagatgaagatactaaagattttcttgcacaaatggaaaagatcttatggaaatgatataaatcaatgagggagttaataaaacaaataaaatgtaaaataaggtacctatcatccaaaatgagtgtctaaaaccaacggtatatatacaactctcaaacatcactccaaaaactattaaataaaaacaactatgtcaacaaatattaggtaactccttagcccctacacagatctcacaagacattataactacaaattcaatttaatttaaattcaatggaatcaatatttattaatagtctattatatgccagataatctgttgggtgttatgagcacttcaaaattgggtacgacatattctcatttctgaagttcacattattactgaaaatgttttacagtaaaaaggttctggttactaaacaaaggccaaataaactagtcaatctcatgcaaagaatcctttgcttctcacctggataataacagatgcttgtctcagatggaggaaatgctgcctacacagcaagaccctgaaccatcgctgcaacaatatgattctgcggagcacctcttggtgaagcagatcttgtaagtgctgtcgttcctgctcctttagaaagacctaccaaaaggaagaaagatgaggaatgcagcttaagaagaaatgagaaatttatttcatgaatcatcctttctgtgataagcttttagagaagaacaaacacagtggcaggcatgtaaatgaagtactgataaatattcctacagatttatccaaagtagtcattctcaaattgaaatggagatagtagaatacggaaggtgagctgggtgtggtgctacatgcctatactcctaactactgagaaggctgaaacaggaagtttgctgaagcccaggagttccagttctacggcaaaatagagagacctggtctccaaaaaaaaaaaagacaaaaaaaggaaggtaaggaagggaggaagggagggaaaaatgacaaggtgagcaagaatatcaaaattccagtgccagagattatgatacattagtccattggggaaaccactgctatgagtaaatgtattactggtaataagtcatatttttcaagcgtgttgggatggggaaaaaagttgaaaaccatagatcttgaagcttgaatcatataatgaataaaccaatgataacagtctttttgaaatccagcgtgcattaaaagcttctcactgtccaaagttattaataagtttattttatttactccttcattccactaatgtttagggtttgtgaggctgcaaaggtgaaggagacatatccctttagaaacaggaattatacctctcatttgagagcaggtagatattatatacccgaagaggaagatggtaaactaataagggccagagacaaaagatcccacctgagtaacacagagagttgaaaataataataaaggcatgcacaggagacaacgggacaattaatctccataaaaaagatattaagtaatgtgaagccacaatatgaaggttctcaaaaaagagaaagatgtttggatttaatgaggaggttatcaggaggttattatcaagcaggaggcagacataaagaactaagtatattaagataataattttaatattatgagtagaataaattaaatggaatgacaaatatactagaatcagataagtaagctgttcactgtataagcaatgtagatgagaagagataaggaataaaaataaaatggaagcagtagtaatggagaaacagaaagcgatgtaagaatctctttgtaaaaggaaaaaaaatccctaaaactttgtgaaaggattaaagtgaacggtatgccaaagacaattatggtttctagactgagaaactggaaaaagggtgacagagaaagaaagtatttgataaatttaagaacagatgaatctggatatggtcaccttgggcaagctggcttggagattacagtagagtatctatggagagatgatttttaggcagttaaaattatagtcagaactagagcactggccagagctctgtgattaatattgactacataattaaataaaaacctgggcctaaccaattgtcttctgatatctgattcactatctttttaataaacaatctcataggcaaaaattattattttttaaataaatgcactcaattttgaccagagctatacagattatatttaccatggtttttccaacttgataattatctggattaagatttattttcctgaagaaatcctgaatgttaaatttggatggaataatatttcggggaagaagtacatggaagtggctcacaaaatcctgaaaaataatttaaaaatattgtaaaatcagaaaacagtgtatgtaaacaagaccttaaactaattatcattctattaatcttttctctttcttttaaacagggtgaaaccaagacgtgcatgttaatttaagatatgataaaaggttaattcggaaaacataggaggtggagaaagatattgggttctacatatcatgacatcaaaagggaatgagagaaaaaaaaggcagaggctaattatcccttttgagaaagctttataaaagaccaaagaaaagggtatttaacaagaccctaaaatttctatcaggaaaaaaaaagcaaacgtggcaggatggggacagggtatcactgagaatgaggctttccgtcccagtaacagcaaagacttgctcagttgctgaacagcttcaatatagtttccatacccatagcagcaattgctgatacgagtagctgtgagccttgctggcagcttactatgaaagaaaatcctgctgagaaaactttagggaaaaccaaatagaatcttttcactagataattctcattgaactatttcagttactggagaggtcagtgcaaagaattgttatatcaggagtaaatttagtattagcaaacattccgagcaaatgagaatagccaagtactggattctattacaataagcttaatgagattgctgccattcaatcaaagtaaatactgtctatcccttttcaattccgtatacaaaacgtgaaatggaaaggaagaattaaggaaaataagtaagccccaaagaaataataagcaagatatgtgggaatcatttacttgatgtgtctaaatatgtaaatatcactataaaaacagaacctggaaagaatatttggagctgtatcctgattggcgaattcgaactgtttccagcatcccggtgtatcgaagctgtctaagtaccaagacatcactgaaccttaagggcagctaaagcaaatggaaaaaagattaacccagaacagtagatctccaaattaattatctgtttataagcatgactaactgttgagtatctagagattgactggaggttgtctggttaacatatacagtaactaagtatattaaggcaagctcacctctcagctggtagcttcagaaaagttctgactgcccaaccctagggaaaagagagaaaccaagcttccaggcttctctggttgtgaagagagaggaccttaaaggctcaaaaagaatgtagtcacccacagaggccacatagtccaatcactacaaaatctgtaacaagataacctacaactgggtgtagtggctcacgcctataatcctagcactttgggaggccaaggtgggctgatcacctgaggtcaggagttcaagaccagcctggccaacatggcaaatccttgtctctactaaaaatacaaaaattagccgggcgtggtggtgcacacctgtagtcccagctactcaggaggctgaggcaggagaactgcttgaaaccaggaggcggagattacagtgagctgagatcatgccactgcactccagcctaggtgacacagtgagactctgcctcaaaacaaaaacaaaaacaaaaaagaaaattcttttctgacaggacttcaagaggtatttgcttctcaaattctgggtgatgctaaatcaaatccaaataaacaccttacaggcagggaagtgtggaaaaatccatttaaagtgtttataacatactattttccttataaatattatagttagtgcttcccctccacttattctgcttaaaagtatttaaagctcagtttgaagtaagctgagatatgtgctctcatttataggacatttttaccttttcagcattagagcgaatgcattttacaaaatatggttctgcttgaccaagtgtttccattagcttgcttaatgatgcctgcaacagaaagcaatataattatcatactcttccattccaaactattaacaaataatttataactataatcaacatgctggcaaaacattcaaaaagtagaggtacacatagaaagaggtttttgaaaagcacattgtgtatattctcatactggttaaattatggataattaaggataaagatggtagtttaatattaaagcagatagcctggaaatagtaaatattgcagatgttttcagaacaatcaaatatagaatttttttcacttttcttcacatttcatcaaacaattttattcaaactcatgtatcctacaacttttaaaatgattcaggagggtatccagtaaggtagtaagcccttgctttactttaaatgtctacaaagtatgtaatgatatccctttttttattcctgataatggtaatttgcacattctctctttcttcctgattagtggctagaaatttatcaactttttgatttgctcagcccaggcatggtggctcacgcctataatcccagcattttggagggccaaggagggcaggatcacctgaggtcagaagtttgagaccagcctggccaacatggtgaaaccccatctctactaaaaaatacaaaaattagccaggcgtggtggtgcccggctgaggcatgagaattacttaaacctgggaggtggaggttgcagtaagccaagatggtgccactgcactccagcctgcgcaacaaagtgagactctgtctcaaaaaaaaaaaaaaaaaaaaaaaaaatttggatctgcttaaagaaccagcttttggtgtcagtgttttgtctatttttctgtttttcatttcattgaattctgctgttatctttattatttacttttctctgcttgtattgggtttcatatattctttttatagtttatcgaggtagaaatttagattattgaattgagacatatctccttttctaataaaagcatttagtgctataaattaaccttggagcactgctttagctgcattgcacaaattttgatatttcattctatttaaaatattataaaattttccttcctctaaaatatgtattatttagaagtcgcttttacatattctaaatatttggggattgatgtctttctttgatttctggtttaattctattataaatacaacattttgtatgattttaactcaaaattgttaaggttttatggcctagtttacgatctaccttggcaagtatttcatgggcacttaaaataaatgcatattctgcaattgttggctagggtgttctacaaatttcagttaggtcaagtaggttaattgttctatttaagtcttccatatccttcctaattgcctacttaccctgtcaattaccaagaggtatgctgaagtttccaagcataactgcagatttgtccatttttcttttaattctatcagtttttggttcagatatttgggagttctgttattagatgaatatacatgtaagacttggtaaattgcaccttttatcactatgaaattatctccctttatccttggtaattttctctgttctgaagtctactttgtctgactctactatagtcactatagctttcttttggtttttgttcgcatggtttattttttttcattttttaaccctttagtatcattgtatttaaagaggtttcttgtagataacatacagttaggtcttattttatccaatcagataatatccatttctttcttttttttttttttttttttcctgagacagtgtctcgctctgtcacccaggctggaatgcagtggcacgatctcggcctactgcaagctctgcctcccgggttcacgccattctcctgcctcagcctcccgattagctgggactacaggccccaccaccacacccggctaattttttttttcttttttttttttattattatactttaagtgttagggtacatgtgcacaatgtgcaggttagttacatatgtatacatgtgacatgctggtgcgctgcccccactaactcgtcatctagcattaggtatatctcccaatgctatccctcccccctccccctaccccacaacagtccccagactgtgatgttcccattcctgtgtccatgtgatctcattgttcaattcccacctatgagggagaatatgcggtgtttggttttttgtttttgcgatagtttactgagaatgatgatttccaatttcatccatgtccctacaaaggacatgaactcatcattttttatggctgcgtagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatgatatctcattgtggttttgatttgcatttctctgatggccagtgatggtgagcattttttcatgtgttttttggctgcataaatgtcttcttttgagaagtgtctgttcatgtccttcacccgctttttgatggggttgtttgtttttttcttgtaaatgtgtttgagttcattgtagattctggatattagccctttgtcagatgagtagattgcaaaaattttctcccattttgtgggttgcctgttcactctgatggtagtttcttctgttgtgcagaagctctttagtttaattagatcccatttgtcaattttggcttttgttgccattgcttttggtgttttagacatgaagtacttgcccatgcctatgtcctgaatggtaatgcctaggttttcttctagggtttttatggttttaggtctaacgtttaagtctttaatccatcttgaaatgatttttgtataaggtgtaaggaggggatccagtttcagctttctacatatggctagacagttttcccagcaccatttattaaatagggaatcctttccccattgcttatttttctcaggtttgtcaaagatcagatagttgtagatatacagcgttatttctgagggctctgttctgttccattgatctatatctctgttttggtacccggctaatttttttttgtatttttagtagagacgaggtttcaccgtgttagccaggatggtctcaatctcctgacctcgtgatctgcctgcctcggcctcccaaagtgctgggattacaggcgtgagcctgtgcccggccgataatatccatttcttaattggactgtttagagcatttacattgttaataattagtatgattggatttagggctaccaattttattactggccttctgtttgtcctctctcatttgttcctcccttcctcctcttactccctgtctgtttaaaatagacttttggagcagttttaggttcacagcaaaaatgagcagaacatagaattcccatatgcccctttaccctcacatgcacaatttcccctataattaacatcttgcattagtgtgttatatgtgatgaaccaatactgacatgattattaactacagtccataatatgcattagggttcactctttatgttgcacattctctgggtttaaacaaatatatagacatttattcaccattgcagtatcatacagattaatttgactaacctaaagtcctctatgctctgcctactcatcctcccccaactagatcctggcgactactgatcttttttactgtctccatagttttgttttttccagaatgtcatatatttggaatcttatggtatgtagccttttcatattggcttctttcactcagtaatatgtatttaaggttcctgcaagccttttcatggcttgaaagctcatttctttttagtgttgaataatattccattgtctgaatgtaccatagtttatccattcacctactgaaggacatcttgactgtttccaagttttagcaattatgaataaagctgctataaatatctgtgtacaggttattgtgtggacataagttttcaactaatttaggtaaataccaagaagttgttactgctggatcatatggtaaaaatatagtttataagaaactgtcaaactgttttccaaagtggctgtaccattttgcattcccaccaccaatgaatgagtgttcctgttgctccacattctcaccagcatttggtgttgtcattgttttggacttctgccattccaatagctgtgctgtggtatctcatttttgttttaatttgcaattccctaataacatataatgtggaacatcttttcatatgcttatttgacatctgtgtactttctttggtgaggtgcccctcccctctgttcaatatactttagtattccatattaatttatctacttttcaactatctttgtactgcattttagtagctgctctagggattacaatatacaaacctaacttgtcacagtctacttacttaagagtcgatatttcacaagttcaagtaaaacaaagaagtcttacaactatatatagacccctgttactgttgtgaaattacatcaacatacaaatttttaaacttttaactgttcgtttttcttgcaaatgctattgtagtataatatacatagggcttggcacagtgtcacatgcctgtagccacagctacttgggaggctgaggagggaggatagcttaagcccagaagctggagtccagccagggcaacattttatttatgagactccgtctcaaaataatgataataataatacacataaaatattaaaataataagtgtaaattatgactttttacaaaaggaagacattgttgtaactaaagccccaattttatatatatacacgtatatatatatacgtatatatatacgtgtatatatacacgtgtatatatatatacgtgtgtgtgtatatatatatacgtgtatatatatatataaaatcagaaactcagaagcccctttgtgccccatcccattgactttagcaagctcactgtacataagctatgtactcttatttccacaccccaaccaagggtaattattattcttacttttaagatgataagttaattttacctactattaaagttcatatgaatggaaaaatacaccatgtactattttgtatttgttgcatacaattatattttgtaaatttccagtgctgtatattagtgatccattatttggctatactggctatactaccattaaactatccattaagagatgagtatttcgttgtttccagtttattatgaaaaattttgctatgaacatacttatacttgcctcttttaactgttttccaatatgcttgtatcaatttacatttcaacagtaccatataaggttctgaatgctccccaatcttgccaacatgttgtataatcagtttatttcagccatgttggcaagtatgtaacagtattgctttgtggtattaattggcatttccctcatgaataataatgttgaacaggttttacataggtgtgttggccttctggatatcatcttttataaactgcctatttgagacttttgtccatttgtctattaggttttcttccttttaaaacactgatttttagttcttcatattatacaagtccttttttagtcttgctctttttcttcttttaatggtgacttttttggtttaaagttttattggaataaaatctacatactattaaaatatacacattgtagttcacaaatcaatgagttttagtaaatttacacagttatgccactatcactacagtccagttttagaactcctctatcacccccaaaaaactccctcctgcccatctgcagtcaataaccacttgagaagcagccccaggcaactaccaatctgcttcctgctgctataaactatcttttaaaaaaatacattcttttttagatggcttttcctgtgattataaaagtaatatgtagctattctagaacacttaatacatacatatatgttcagagaatatcagcttgggtttaatttgactaatgactaaattcttagagctataattaaaaccaggttaatttcttcaaaccaatcagccttttcaaagggaattcatacttctacaagtatgaattcaattcaaatatgaaaacaagcttaatgtatcctacatcttccttatacccacagttagaagactcctagggaagagaaaaatttaggtttcaccgcttgaagaaagagtatgttgactgttcacataacagcggatatttttcctagcaacctgtggatccctaggcagctgagtatggagaggagtagcagctttaccagtaagttttagtagctacaacaagcaacagcatgtgtatgactgattatattaggagaaagccacaaaacttcttttaaaaaactactaagtagagacatagtgctatgaagtgaccagactttgacatacaggtccatgcataaacattgcacagttctttatgatcaagttgtatcatcccagtcataacttaaggctttacctgctttgaaagtttggtggtcaaagggattgactcattaaaatctaacattagcctgcagaagacaaactctcaagagggaatgttttagagtatagtgaaggtggtaatttaccacaaaaggctgaaataatacagaaaatatacattatagtctaccatgttgttacttgtttctatttatcagtctgaattttctttttccttttttttattgagtatattttatggttccattttagttcagctattaccttactaactgttaactcttttttaaaggattattctaggatttgcaccttttatcacagtctaccttcaaataatactataccatgttctgtatagtgtaaaagcttaacaacactatatttccacttagccccactttaggtgttttgtgatacttttattatatattttatttctacctcacaatatactattatttttgttttctatagccaattattttaaaaagagaaaagttttttttttttttcttgagacagtctcgctcttttgtccaggctggagtgcagtggtgcaatctcagctcactgcaacctccacctcctgggttcaagcgattctcctgcctcagcctcccaagtagctgggattacaggcgcccatcgccatgcctggctaatttttgtattttcagtagagatggggattcaccatgttggccaggctggtctcgaactcctgaccttgggtgatctgcctgcctcggcctcccaaagtgctgggattgcaggtgtgagccaccaagcctgtccaagaaaacatatttttaaaatattagcctacatttctatcaatctgccactattcatgttttgtgtaaattcaaacttccatgtggttttcccatcatttttcttccatgtttaaaatttctgatattatagatctgctggtaataaattctctcagcttttttggtctgaaaatgtctctacttaaccttagtttttaaaagatacattcaccacacatagaattctagggtgactttttttctctttttggtcttttgaagctatcactcttgtcttatggctttgatagtttctgatcatcttcacttagttacacaaaatgtctcttttctccctctggctaagtttaagatgctctctttttaactggttttagcaatttgatataatgtgtcttggtgtgtttttgtttgctctgattgaggtttactgagattctttgatctccgtagttttttttttttccatcaaatcagaaaatattttgctcattatttcttcaaatatatttttctgtgccctcctccctttcatctcctgagattccaattacatctatgttagactgcatcatattgctccataagttattgctattttcgtttttttacatctttgttgctttctctgggctttaataaactatgacttcaaatgtactacttctgaactgtctaaccgatgttaatccaatttagcttgttttttattgtcaaatattacatatttaatctctaaaagttccatttgagtctttttcatatcttcagttttttcattttcataatacaaatggcccttattggttgcaacaggcagtgaaagacaggacagaacaactccatctcctgagaaagcgtccagagactctgtcatcaccttccaaaataaaaaatctattttgttcttatcatattcatgttttttgttatgtctttgggcatatttaaaagatacattatagctaatttgacattcttactatttacatcatctccatcattttaaagtctgtctctgattattgatttttttttcccccttgttatgggttatttttttcctgactctttgcctgccttgtaatttctcatcggatgttagacactgtgttttacattgttggattttgttgtattcctttaaagagtgacaaacatttttcttaacatgctgttaagttacttaggatcagtctgattcttttaagacttaatttttagttttgtgagagcagggccagagcagcctttacattaggactattttggtcccattgctaaaacattgtctttctgaggattctacctaatgcctcatgtaataaaaggtcgtttcactctggctgatgagaacagaactactcctctaatcctgtataagtaccagaaattgttaggtctacaggatttaggtgattagaataatcattctttccccaatctcatggaattttaactcacatatgcacagatcagtagtcagccacagagactcaaggagacccctcagcagatctctagctctttctcttcatacaatttccttctcctctttactctgcctcacaaattctagttgcctctacctttctatctccatctcttcaattagcaagaccactggcatttgtttgggtttcctcttcctgagccgtagcaaatcatctttaggtgttaatctggggctttcctcatttatttcccctattctcagagattggagtcccgtaatgcttactaatatctgaaaatatttgactcatatcttttgtccagtttctggttgtttatagcagaagggcaattcctataccaattaatcctttgtgagttctatggtatcattttcatgaaaataagcattcaaggaagggcacaaagacggctgggtgccatccattttgactacctgcaatttggtcatctgttacttggtttcctcacctttataataagtataatagtaattatcctagaataattggagaagaacttagacaacacctattagacaatgcatacgtgtaaatttttggcaaagggcctggaaaacataccatacattggtcattatctatggatggcagatgactttcacttgttcttactcatgtatattttctaaataatcaaaaattaactcattacttttgtaataacttaatggccgattagaaatatgaaagaggactctttttctaaaaattaaatataattcatgaatataaattgagaatatgtaaatttggaaggattttaaaagacacaataggattgtgattataactaagtttttattgtactagctatatggtattcttcagattaaagaatgattttggtatacatggcacctgtaaaagatccaaggtaacaaaacacttaacagcttaataattctacctttcataatcacgagattaatgttcccttttcagacactgagctcaccaaagtactttttgaccagaatttggcttcccatgtggatttgctaatcaggaaaaaaatatgctaataaactaaaaaattgtattaagtctgcttatgactcatatttatgttgtatattaataaacttatattactcaacatgatttttttttctataacccattaatctttgcatttctaatctacaaagtgaacatccagactctggattgtgaggacagaagcaaggtaaagacagacttccccaagcactatcttctcattcttcccaaccaaatgccattaacccatatgattattaggaaggatttttaaaattcatggcagtgatttcattatactcaattccctttcctttaagcttatttgcacataatgagttatttggctccttggtcttgctttttcatttctttttttttttttttaaagagaaaggatgtgaccaaatagcctgcacagattcaaatttttctttaggcccatggtgagaattacctaaaataaaatgacatttctagcccacaatttgaagaactgtgcttataaatcaaacaagatcatatacaatgatacattagtagatagcttatgttcaaacatcctagctgcaaaagaagcattttaaaaagtgttaacatatacagatacacctatcatgaataaggaaatttttatacaacagtgaacactgcttctgtgatataaacatgaaatagggtaaaattatgcaaagcatttgttacctaccagatattttgcttactttcataaatatctaccaaatgaaaagatcttaggagatagatgatttgagaagaatggaagaggcaatttaaaaaggaatttgaaaaaattattctggaagaaatttggttaactattatcatatttattcctaaaagccccaaaaaagaactggatttctatttatacaaaggtaaaataaatacacaggaaaaaaaccttcagcctcatttagttaactattgatggtagcagcatgaggtttaagcagggaaaaaaacatatatcattatgctaacagtgacattatctaagcagcagggtttaaaggcagatttgtttataacatcaattttctgctttctcctcacactgaaaataacaaatattgagatatccattatccagacatatgtggatgaaaaacaaaggcatctgactttttttttttcatctttggttcttttttccaaaatgatcagtaatatatggctttttagtcacataaattaaaatcccattcaagtaccctgcagatcactttaacctttcaatgacaatctgaaagatacagattcttatttgttttaagcgaaacaagaaataacctgaaactgggcactgatgctgggaggttttttcttcttgtgtaaatgaagaagagacttggtaatgcgatcttgtagtgtcagtcttgtcaggtgctttaaagaatttacttctagcaagtgctgaaagaagagaaaaaataaattgctcacataaattaatctaacaataagccaaaattctcagccagttttcatcatttcctatctatatgaccatttcccatcttaaatgactgtagtgaatatgaaagactgatatccaacattcattctattctcctgtcttcctctagaagctagaaagctaaaaagaaaagtacacttcacaaactctcttgcatctagagttctggatatggtttaagtttactaataaaaggcccacatgtgaaactgggaaggtataactgaggcagaggctctggctactagttctgcttctgctagcaaaaatgcatatactttatgtaccttttttctgtggttccagcatccaggcactagttttgtaaatgctcagaggcagagtgcagaacatttgtgttgtcatcacaactatactaaatgcagcttagccctggagcaaatagttgtagcagtttcttccagatggctagattacaccacaggcagtatgtaccgcaagtagcagctgcactgacagcttcctgatttcctagctttctaattacatttagggacatttctgcaaatgttattttaacatgtgacttctaatgattttataagtgcctgcttaattccctttctacttaaaaatatctactgtaattactgttatctcaatcctgactcacagagacaacaattaaataccagggcgacagtcggtgtgccagggacatacacaaaaaccaagtaggctgggcacagtggcacacgcctgtaatcccagcactttgggagactgaggtgggcgggtcacgaggtcaggagtttgacatcagcctggctaacacagtgaaaccccgtctccactaaaaatacaaaaattaggcaggcatggtggcacgtgcctgtagtcccagctactcgggaggctgaggcaggagaactgcttgaacccgggaggcagaggctgcagcgagccaagattgagccactgcacaccagcccgggcaacagtgagagactctgtcaaaaacaaaaaacaaaaaaaccaaagcatagtccctattaaccctcatcatgatgtactacactaaaaattaggaaaatgggagttagacatgaagcaactaaagtatacaaagtaaagacagtacaagtatttgggagctttttgagccaatcataattttttaaaccacacaatatttatggtagtgagtttgtaaatgaaaagaatatatctatacagatgtaaactatatgttatttaaaaagtaatcaaaaatcttaatgtatgagaaacaaaagattgtgttaaaaacatgacaaattttcaagtctaaaggtatctattttgacaatataaacattaataaaaccatgcaaattgaaagaagtacaacacacatgtaaacaatctgaattaaggaaatgttatttcctacaaatgaaaaggcttatcatctgtatgtaaaaaaaaaacttttaaaaattcttaaaaagacagatatcacaataaaagaaagggcaaagattatctgacaaggcaattctcaaagtaaaaatggcaagtaacaaaaccacaatccattcaatctcacttgtattgaaggaaaatgccatttcttttaaaagaggttttctgcatcagattggccaatacaataaagactgacaagagccagtattcatgaggtggtggggaaacagacatatactatatactcactgttcttaggaatgtaaattattataactttcctgacaagaaatttcacatctagatatttattctaaggagttatcaaacaaatctatgttgtttataacaatatacttcaaaaaataatgaaaaattatagatatgcaattatatagaattatttatataaagtatgcttcatttacacaactgagtactccacagctcataaagttactgtaaatctgtatttcctgacatgggaaaatatttgtaagcactattgatcaaaaaaaaagccatgtaaaacaacacacatgtaaaaagggcatttgtgctaattagaaagtttttgttttacttttattggcacttttgaattatcacagcttcacggtatgtatattcatgaaaagtaatttttcatactggtcaagaatcaattagaataatttataggttacccttatgtgaaaacaaattagcattgaagcctaaaataattcccccacttccacttttaagatactatggagaaaaagaccttggaaataaagtttgagtttaaattgtttttcactatgaaaaaaacaccagagggactatgcaaaataaaataactattagaaaatctttgctgtcatgtatattgcaaaagtttgaaaaaccaaacatgacattcatttctgcctcagagtcattccaatttttttcatttgcttggaatactctatagccgggccctcacaagacttggttttacttggcactgaatttgtagtttaaatgtaactttctcagaaaactcttgcttaaatactgaaaaaatagcccacttctatgtcaattacatgtcacttaattttcaacactgcacataatatcatctaaattattttttcatttatttgttaatttgtatattgtcttctttttctctaaaaaataacctcctgcagtgccacgcactgtggctcagggctataatccgagaacggctgaggcaggcagatcacctgagctcaggagttggagaccagcctgggcaacatggcaaggcttcatgcctactaaaagtacaaaaattagccaggcgtggtggcgagtgcctgcggtcctagctattcgggaggtggagataagggaggattgcttgagctcagggggcagaggctgcagtgaaccaggatcgcaccactgcactccagcctgggtgacagagcgagacactgactcaaaaaacaaaaaataaataagagataacctcccaaaggattctaactgtactgtgcatccctgtaccctcaatttctaaaatactgtctggtttagagtaggattcaataaatattagtttgaatgaattaaatacctagcaactggccaggcgtgaggaggccgaggagagtggatcaccagaggtcaggagttcgagaccagcctggccaacatggcgaaaccccatctctactaaaaatacaaaaaattagcaaggcatggtgacaggcgcctataatcccagctactcgggaggctgaggcagaagaatcgcttgaacccaggaggcagaggttgaagggagctgagatcgcaccactgcactccagccagggcgacagaataagactccatctcaaaaaaaaaaaaaaaaaaaaagctagcaactaatgaactttgagcaatgctttccctagcaagtggagaccagacttcttcccatatacctaacaataacctggtcaatcaacaaatgttcagagtcattactaaaggtcagactctgttgtaagtgctaaggatacattgcattcaagtccaggctattaggacattaaaaaataattcaatcatgcataaggtttatgaaaaaaagataaaataggaccgtaaatctagaggtaaagggatacagaattatttcctttcttagggcttcagttccttgtctacttcattcctttcttaattccatcattatggttgagtttattaagcttaattaaccagtttattatttttttcaacaattatctaccacttgctgtgcaaggtgctgtaggcaaaaagattaatgagatattgcttgaatatagtctaactgttttgagtctcccaaaattcatatattgaaacctaatcctggtgtgatagtattaagaggcgaaggggaggggcccttgggaagtagctgggtagtggtattagtaccttgataaaagaggcccaaaagagctgccatgttaaaacacatagaaggtatcattccatgaggaatgaaccatcactagacatcaactctgaaaacttgattttgaaattccctgcctcttacactgtaatatatttcttttgtttataaattacccaatctaaaacattttatcatagcagcccaaacaaactaaggcatttctcatgttattaaaaaggactaaaatggctaataaaattaacttcaaggttgggcacagtggctcacacctgtaatcccagcacttcggaaggctgaggtgagcagatcacttgaggccaggagttggaaaccagtgaggtcaatatggcaaaaccctgtctctagtggaaaaaaaaaaatagccgggcatggtgacgcatgcccgtcatctcagctacttgggtggctggggcacaagaactgcttgaacccaagaggcaagcggtcagcaaaaatcgtgccactgcactccagcctaggtgacagagtgagactttgtctcaaaaaaataataacttcaagatttgagcccaagtgactataaaaacgtactaggggagcaacacagtaaaattagtttgagcatgaattttgagacaaggaagatatcaaagtacaaatatataactggacaatgaagctgtcactaaaacaatgtaactaaaaaaaataggtcatgttagaaaagtagatctaatacaggtgacagtttcaagttaggagggaataaattctaacaagaaaaatgggaaagtattaccaaaacagagctatcatcttgtggaaggacgaacttgagttcatgaaagctgcctctgcatttcaagtggatgcttgtctgaagcaaactaggctaacttgttatccaaaagggaagagctgtgtgtcatctcagagtcatagttgtacaaactaagtgctgactgtggctcctgtcaagaggtttgatggaaaggctccctgtaataacaaggatctcagatcattttgacttatcctgcaaaacccaacctagatgtcatcccttccacccactccttctcccgcactccatccctacctaactcatccctacttcttaaatagagaacttagtctgagacgaaattagtgagttgaggatatttggcctcctactatatactcaaaaaattcctcaggatagggatatatcttatctagcatagcctgtgtaaacaggagatatttttaataaaaagttgaaatgaattaaaagtagtaagaagtttaaaagatatatattcaataagtaaaaaggtcaaaaagttagtatgagtctaaattcctttccctcaatgatcttttttccaatagctttactgaaacaaaataagctgcacgtatttaatgtatacactataagttatgacatatttacatagctatgaagccatcaccacaatcatgataatgaacatatccatagcccctaatgctttctttgttccttctctcactttgcaagtcctctcttttccctaaacactgcatgctgcttcctggcaatctttttctacttttttttttattttttgagcatggagtctcactctgtcgtccaagctggagtgcagtggcgcgatcctggctcaccgcaacctccgcctcccaggttcaagcaattctcctgcctcagcctcctgagtagttgagactacaggcacgtgccaccacgcccagctaattttttgtatttttagtagacacagggtttcaccatgttgcccaggctggtctcgaactcctgagctcaggcaatctgcccaccttggcctcccacagtgctgggattacaggcgtgagccaccgcacccagcctctggcaatctttaatctactttaggtcactgtatatttttggtttttcatcttttttaaaatgatgaataataattgtatatatttatggggcacaatgtgatattatgacacatgtatacattgagtagtgattaaatcaggctaaataaaatatctcacatacttatttctttgcggtgagatcacttgaaatttacttgtacagcaactttgaaatatataatacattattatgaaccatattcaacttgctacacaaaagatcactagaacctgtctaactgaaacattatcctttgaccagtgttgtccctttccctttcccacccttataccccaaacctttgggaatcaaaactctattatatactgctatgagtttggctttttgttgttgttatggttaaaagaaaccttttatttaaaaacaatatgacattttaattttaattagcattcattaagtagccagtttttaattcctggggagcaaatatgtacaaatatcaagcactaaataattgataattactaatgtacttaacattaggtaatttagtgtcttcctcctttccaatttctatgccttttttttctttctcttgcttacttgctctggctaggacttccagtactatgttgaatagagaaagtggtgaaagcgggcatccttgtcttattctagatcacagaagaaaagctttccatttttccttgtttagtatgctgtctgtgagtctgtcatgtggtctttattatgttgaggtacatctgttctgtctatatcatgagagtttttatcatgaatgagtgttgaattttgtcagatgctttatctgtgtctattgaaataactgtataattttttcccttaattctgttaatgtatcacatttaccgatttgcatatgttaaaccattcttgcatccctgggatgaatcccacttagtcatgatgttatctttttaatgtgctattgaatttagtttcctagtagtttgttgaggatttatgcatccatgttcaatcagagacactgtcctacaattttcttttttgttgtgttcttgtctggttttcttatcaaggccttgaaaataaatttggaagaattctctcctctccatttttctgaaatagttttaaaaggactgagactcattcttcttcaaatgtttggtagaattgagcagtgaagctgtcatgtaatggacttttcttcaatgggagactttttattactgatttgaactcagagttgttactggtttcttcagattttctattcatgattcaattttggtaggttgtatgtgactaggaatttacccatttcttctaggttttccaaatagttgccttatagttgttagtaataggctcttatgatcccttatatttctgtaatatcagccataatgtcaccttttcacatctctgaatttgaatcttttccttttaaaattttgtctagctagaaatttgtcgatttttatcttttcaaaacactaactcttaatttcattaacgttttgtatttttaagcctctatttcacttatttctgctatgatctttatcatttctcttcttctattaacttaaggtttattttgttctcatttttcctagttccttgaggaataatgttattggtggtttactggagatctttctcacttactaacgtagacaattattgctataaacttccccattagaactgcttttgctgtagaccataggttttagtacattgcatttgcattctcatttctttaaatttttttttaatttcccttttagtatctcctttgactcatttgtagttcagaagcatgttgtttaaaaactatttgcatatagtttctaaagaacctattattgatttctagtttaatcccttgtcacaaaagatactccccaacttgaaattttgtttattattattattattatcattattgttattatttttgagatggagtctcgctctgtcacccaggttggagcccagtggcgtgatctcggctcactgcaagctccacctcccaggttcaagccattctcctgcctcagcctcctgagtagctgggaatacaggcgcctgccaccatgcctggctaaattttttgtatttttaatagagacagggttttaccgtgttaggcaggagggtctcaatctcctgatctcgtgacctgcccaccttggcctcccaaagtgctgggattacaggtgtgagccaaggcccccggctcccaatttgaaatttttttaacttattgagacttgttttgtggcccaacacatgacatatcttaaagaaaggtccatgtgctaatgaaaaaaatgtgggccaggcgtggtggctcacgcctgtaatcccagcactttgagaggccaagatgggtggatcacctgaggtcaggaattcgtgaccagcctgaccaacatggtgaaaccccatctctactaactacaaaaaagtagccgggtgtggtgacacatgcctgtaaccccagctatttgggaggttgaggcaggagaatcgcttgaactcgggaggtggagattgcagcaagccgagatcgtgtcactgcactccagtctaggtgaagaatgaaacttagtctcaaaaaaaaaagaaaaaaagaaaaagaaaaaaatgtgtattctacaactgctgggcagaatgttttgtaaatgtctgttaggttcatatatcttgagtgcagtttaactctatcgttctttgctgattttctgtctggttgtcctatccattgctgaaagtggagtgttgatgtcccctataattacagtattgctatctctctctccctttagggctaataatatttccttcacatatatacatgtgtatatatacacatatatacatgtgtatatatacacatatatacatgtgtatatatacacatatatacacatatatatacatatacgtatacacatatatacatatatacatatacgtatacacgtgtatgtacatatatacgtatatacgtatatgtacatatatacgtatatgtacatatatacttacatgtatatatacatatatacgtatatacgtgtatatggatatatacgtatatacatatctatgtatatgtatatatagatacgtatatacatgtatatctatatataacctttcttcctctcttactatttatctgtctgttttggtggttttctggagagttaagctttaattcttttctctttcttatttatgtatctgctgtcgttttgttctttcaggttactatggggcttacattttaaaatcttgtatttataatggactattttaaacagataacaactttgcatacaaatacgctagacttttatccccatccccccacaatttataacttgctgccttaatttacatctttttaaaatcatgtgttacttaacatttaattgtagctatagacatcacttaccattttgagttataaccatcatactagagatttaaaagactatatgccaccattacattaataatatattctgagtttgaaagtgaaattacctctaacagttctaaattggattctgaattgacttctaccagtgagttttattcttttgcatatttttatcacggtagttatcttaccatatttcttgtgtccccgtattgacctgtgccattaggtgaaacagctgcctcttccaattttatggggtaactttcttaagaagacattttctgtagatggatcctaaggtggtaaatgggtagggtgctttagctttggttctaggtaggtgcagcagtgtagtctctgtgtaatttctttacctgtagtcaacatccgatgttactgcctcagtgacttaggctacgggtgtttacaaagttggtgtgcttttccagtactatgttggtgccaccaagcaagccagtcctctggtcctggggggcatgcgcaaggcatgagtgacagttccaagccatgcaccgtggtatatgcctataatcccagcaacttgggaggctgaggctggaggatcacttgaactgaggagttcaagtccagacagggcaacataatgagaccctgcatatttttgtttgtttgttttaaagtgcagtgggccagacacagtggttcacacctgtaaccccagcactttgggaggccgaggcagaaagactgcttgaggtcagaagttcaagacaagttcaggcaatagagtgagatcctgtctaccaaaaacagaaaaattagccgggcatggtggtacatgcctatatttccagctacttgggaggctaaggcacgagaactgattgagcttgggaggtagaggctgcagtgagccacgatcgtaccactgtactccagcctgggtgacagtgtggctgtggggaaagccgccacacaagctatcttgatgccaagggtgtatgtccaaagcatggttgttctagcaaatgaaaaggcagtgtcaccaggagcagagctaccagacagcctggccctcagaccctgcagggtacacatgcaaagcatagtggttctgtaggtttcagaggtggcatcattggatacacaccagtccactggctctggaaggcacacacaaaatgcaccagttcagccagttgtagggacagcgtcatcaggggtggggatgctgggtgggctggccctcaggacctgggtaagagtacaaatccactcatcatgggggtggcattggcaagagtggggccaccaagtgggcccatcctcaggccctcggggagggcacaaatccaatgatcacaggagctgcactgtcaggggtggggctgccaggtaggctgatcctcaggccctaagacatttctttggcaaaatgtcttttggctatttttaaattaaattatttgcttttttgctattaagttgtttggactgcttatatattctagacattaacccactgccatatgcatagtctgcaaatattttctcccatttacagtttgtctcatcattctgttgattagttcctttgctgtgcagaagcttttgagtttgatgcaatcccatttgtctattactgctttcgttatctgtgttttgggggtcatagtcaagaaatcaacagccagaccaatgtcatagagttttccccgtatgttttattctacaattgtccctcaatatccatggggattggttccagaaccacgctgagataacaaaatatgtacatactcaaatcccatggccggccctgcagaacccacaggtacaaaaagttggtcctccataagggtggattttgcatctcacaaataccatattttgatccacatttggtcacagatgtagatccccctgatatggatgactgtatttattttttttaaacccatgtataagcggacctgcacagctcaaacctgtgttcaagtttaacagtttcaggtcttatatttaagtctttaacctacttggttggattttttatgtggggtgagatatggtcccaatttcattcttctacatgtggatatccagttttcccaacatcatttattgaagagactatactttactcattgtgtgtccttggcacctttgtttaaagtcaactaaccataaatgtacgggtttacttctgagcttttaatacttttccattggttaatgtatattttcttctgccagctccatgctgttttgattacaatacctttctaatatatatatatatatatatatatatatattttttttttttttttttttttttttttttttgaggcggagtctcgctctgtcgcccaggccggactgcggactgcagtggcgcaatctcggctcactgcaagctccgcttcccgggttcacgccattctcctgcctcagcctcccgagtagctgggactacaggcgcccgccactacgcccggctaattttttgtatttttagtagagacggggtttcaccttgttagccaggatagtctcgatctcctgacctcatgatccacccgcctcggcctcccaaagtgctgtctaatatatttttaaatcaggtagtgtgagcctccatccagctttgttctttttgttcaagattgctttggctatttggggtttttttgtgtattcatatgaatttcaggattttttttatttctgtgaaaaatgaaaatggaatgttatagggattgcactgaatcagtgaatcactctgggcaatatggagattttaacaatattaatttttccaacccactaacacaggatatcatttttcatttgtgttgtcttcaatttctttcatcaatgttttatgatttttttgtatacagatttttaacctctttggttgaatttactataaaatagtttatattttttgatgctattgtaaatgggatggtttccttaatttctttttcagatagttcatttttagtttataaaatgctactgatttttaggctgggtgcagtggctcatgactgtaattctagtactttaggaggccaaagcaggaaaatcatttgaggctaagactttaagaccagcctgggcaacacagagaaagaagattccatctctacgagaaaaaaaaaaaaaatttaatagccagatgtggtagcatgcacctgcagtcctagctactgaggaggctgaggtggaaggattgcttgaacccatgagttcaaggtacagtgagctacaatcatgccactgcacttcagcctgagtggcagagtgatacactgtctctattaaaaaaaaaaaaaaagcaagaaacactgctgatttttgtatgttgactttgtatcctgaaacattactgaagtacattacggaatttatatatcagttctaacagctttttagtggggtcttgaggattttctatataacattatgttgttgacaaccacaatatcacttcttccttttgaatctggatgccttttatttctttttattacctaatttctgtggctaacaattccagtaatacactgaattgaagtgtaacagaagtggtgacagtgggcatccttttcttgttcctgatcctaagagtaaagctttcaacttttcaccaatgagtataatgtcagctgtgggcttgtcacatatcgcctaattatattgaggaacagtccttctatacctaattcgttgagcttttatcatgacaggttgaattttgtcaaattctttttctgcatgtgttgaaatgacagtatggtttttgctattcactgtgttaatatgataaatcacatttattgatttgcatatattgaaccattcttgtatcgcaagaataaaccccaactgatcatggtaaatgatcctttcaatgtcgtattgaatatggtgtagtagcattttgatgaagatatctgcactatttacaacagcaaagactactgtgaatagtgctgcaatgaatgtacaggtgcatgtgtttttggtagaacaatttattttcctttgagcatgcacccagtcatggcactgctgggttgaatgggagttcaactcttagttctttgtgaaatctccaaacttctccgtagtagctgaactaattttcttgtagtactttcgtatggctttgctatcagggtaatgctggccttataaaatgagtttgaggtattctctccagttcaattttttgaaagagtttgaataggactggtattcatttttatttaaatgtttggtagtgttgcatcatgaaactatctggtcctgggctaatcttttatgaaagaatttctattgctggccaggcatggtggctcaatgcctgtaatgtcctgaagaatgtcctatgtatgcttcagacgaatgtgtattctgctgctgttgactgaaatgttctgtatatgtctattaaatgcatttggtccactgttttcttcaaatccattgtttccttattgatttttggtgtggatggtctgttcattgttgaaagtggggtactgaaatcccctaggattactgtattgtagtttatctctctcttcagatgtctcaatatttgcttcatgcttttagatgctacaatgttgggtgcatatatatttaaaattgttacatccttttgatgaccatacccctttttattattatatgttgaccttctttatctcatctacagtttttgactttattttgtctgttataaggataactactgttgctctctttaggttttcatttgcgtgggatacttttttccatcccttaatgttcattctctgtacatcgttaaagctaaagtgagtctctcgcaggtagcatatagatgagtctctctttttttaatgcattcaggcactctgtggcttttaattggagaatttaatccatttacattcaaaccagttattgataggtaaagatttactagtgccactttgttcattattttatcattttgtagagcctttcttccaataattctgtcttccctttgtggtttgatggttttctatagcagtatgacttccatccttttatcttttgtgtatccactaaaggtggtcaccttgaggcttacataaaaagccagtcatatacttacaactggctattttatgcttacaaaaactaaactttcattgcatgcataaaccctacacttttactcacccttcatgttttatctttttgatgttacattttatatctttttataatttgtgtcccttcacaaactattgtagctgccattgtttcaacagttttgtatttcaacctttatactagagatatcattgatttacacactggcatcacataattaaaatgtttgaattagacagtgtacttacttttatcagtgagttttctgctttcatgttctcatggtactaattatcactgtcctttagcttgaagaactttctttagagaactctcaagaaagaagttcaagaaagtagaactctacttgtaagtcaggtctagcagtgctgaattcccttagccatcatttgtctgagaaagttgttatctccttttcatttttgaaagacaaaattgctgggcatagtactatggttggcaggtcttttttctcagaggattttgaatcccactaactctggcatgcaaggtttctcatgaaaaatctgatgatagtcttgtgggggacccttgtatttaacatgttgctttttcattgttgctttttaaaaaatactctgtctttaatttttgacaaattgattataacatgtcttaataaggatctctttggatggatagtattcggtgtcctttgaattttctagatctggagttctatttccccaggcttgagtagttttctgcctttacatctttgaaagtgttttctctcactttttctttcttctccttcaggtattttttgaatttatcttgtttctctatttggaacatacttccccatttcttcatttgcctttaccctctgtgttgttttctgcacattagataacctaatagcttctcccaatcttgtttagtgtagaagaacctaaccagtcagtctggccagaaattctagggtacctctcaaacctttgtgtttgtccaaactgctgcctttgttttttgttgtctccaggaaattaggatgtgccaagttccgttagtacctcaaaagtctggccagaaattctagggtacctctcaaacctttgtgtttgtccaaactgctgcctttgttttttgttgtctccaggaaattaggatgtgccaagttccgttagtacctcaaaacatttgagagagaagtcattccccctagacacagctagaaaggttgaagtgttaagtgtgttccagttccttctatcctcgtggtgaagctgacagtaggattctctctgcactacgctgaagagaggaattctagcaaacgtctatattttagatcagactgcattatctcatcttgggggaaaaaagtgggcccactgaatgcccatttatttgttttcagtggtctagagactcagaaattcagtgtcccatcaattcccagaactataaggttaaggcggctatcccttgggagggagcagtggcagctgtgatcaatccatgaataaactccttccaaggataatctacagagataatctgctctagctttattgctggagcaagccagatgaaaaaactcaggaaacgctggaactcacagtcagtatcccagggttctgctgtttctttgcccattggctactagatgcagcctagagaggagcccaatcctcaaacaatggctagagaagtatacagacaaaccccttccagaaattaactggggagtgtgctttttaactgcttatctgcattgatccagggggctgtagtccctggaaatgtctgtgtgtttaaaaccacctctttgttctctgtcactgcaattcatattttctaagatttatatacagtatctactactgcatgtaattattttgagattcattcacgttgttacacgcatcaatagtttattcatttttattggtgagttaagtattcaattatatggatataccacagtgtgtttatccatatttctgttgatgaaagtttgagttgcttcaagttttttgctattacaaataaagctgctatacacattaataaaacaaacaaagcaaaatgaaacaacaacccctgcaaaaaaataaaaaaataaaaaaaaaccagagctatattaacagaggggcaagtactgctcaccaaatcctgcccactatttatatattgtttatatgggttaaaataataatattttatggcatgtgaaaaattatataaaattcaattttcagtgtccattaacaaagttttattggaatgcaaattatagctgcatttctgctacaacagcagagccaactagttatatcagaaaccataagcctgaaaagacaatgtccctttatagaaaaacctggcaaacatttattatagataattggattaggtgagcactaatcagaaattattttaaaatcaggtaccattcagaatttgaccttaacttggctcaaggagaaatgaaaagaccttacataaagaggcaataactaaacaacatttatattcaggagctattaaaacgctagaaaatggtatatatcacaaataaatatttacctgaaccattaggctcagccatttcataacagtgttatttctaaaatggattcaactaagtgcacgatcactatcttggatacaaataaggttatttcttgttttttgatgtatgaagattgtatgagtaataaaaaataattgtgtagcagaataccaatacaaaaaaagttttcatagtactcacctttggaagggcaggcttggatttgaaatttttgtttctcctatagagataaatcattcattaaaaaaagctactgtataaaaacaaaaacaaaagctactgtagagaagaaagatttcaaggtctctcctaaaacaacagattatatacccattaccaagactgtaggttctttatatgaaaacactatctgattcagccaagcaggcaccttgggaaggaagaataaacaaggaaaagatacctgccttgttatataagtataaacagatttacacctgatgattagtaacactgtgttgtacattctaagccacaggttcattttcttcagttgttagtagtttcttgtacctacagaagacttatttctatcatatcaaaactaaatgagatgtctaagtttcataaattttaaaaaaacgtacttatcaccaaaacgtaatcttccatttttggtaattaaaaattctattccactcatttttttccttattcaaacctcaataccatacttaaatcaagtctttttaatttatttttagccttttttatggccacagaaaagaaggaataaagtccaacgcttatgaatatgggctgggaagttagaaagacctggacaacaatctatggtctaccatctattaaggtatgattttaacctctttaacttttcattatgtaataatgtaaaacagggaggacaatactacctataacttaaaagttgttgtgaggattaaatgagttaatgtatatctctgggctagagcaagacctacataaatagaacctactaatattattaagcagtgattcagacaaggattatggaatccaattcagtcacacctctagctagcggtcaaacgatatgcttgggaaatatctaaaacatgttaatgctaataactaataactttttttcctttttttttttttctcagagacaggatgttaatcggttgcccaggctgaagtgcaatggcaagatcatgactcattgcagcctcaacttccttggctcaactgatcctcctacctcagtctcctgagtagctggaactacatgcatgcactaccacacctggctaattttttttcttttcttttctttttttttttttttttttttttttggagagatggggtctctatgaagcatggtagagaatggttatagctatgtcttcaaaccaactctgtaatcagttaatgagaaatggaaagcttggataagtgttatatatcactcaaccattcaccatttatagattttcttgcctaatttgttaagattgctagaattaatggataattatagtaaaaattgggaatcctaaaaggagctaacagttttttctttctctgaaggtagggcctgtctaaacaataagacctttattatcatctccataacaaatatactcagtcatgattctcctggtaatatgggggagaaaaatcaacaaaaacacaagctttataacacatgagattcatggctgtaaacgctacctaaataactttgagtcttgtttcagtcaaaattcttcccatgaaaataacatttcaccatcttccttcttcatttttttctgccagaaattttaaaccagacaaaaaacaaaaaacaaaaaacaatttacattactgattagtactgacgtgagaattccatgggctctctccaggagtttgctgctagttgaattagcaaatattccatctttatcaagcaaggaggtgccacttgatagtctgctctggcgaatcccagttctgccattccaggcaatatcaaatgtatcactgtaaaaaatataatttgctttagttaatgaagacgtctctaacactatactgcttaaataagtaaaataaaactttaaatactaaagttaaaatttagaaaaaaatgctaaaccaaccaaaaactgatttcatccaaatgactgccaatcagttgggactaaccgttgtctcattcagaacaaattcctatgaattccatcatattcacatacaaacgtgcatgtagatgagcatatcatgtagctgatatctttaaatatattatcattcaacaactagtaactaataaaatggattatagtatcttccctctttgttagattttagaattttcaaatgctactataggaatttgtcatcctaatacactatcccatcctatggaatatctaatttcctcctgaaaggtcttatttacacacacacacacacacacacacacactcactactcacacacccattaaactaagtcctatgagactctaaacattgcagatatagcaatgaacaaaacataacactatcacagtgattgtaacatcataattaatggaggactcaccaggtaaagtagtagtatccaacaacaaatgaatggataaagaaaatgtggtatatacatacaatggaatgctattcagtcattaaaaaaagaataaaatcctatcatttggacaacatggacaaacatagagtacattatgttaactgaaataagccagacacagaaagacaaatactgcatgaccccactcgtatgtggaatctaaataagctgctctcacagaagtactgaatagagcagtgattaccagagactggaaaaggtaatgaggtggaggggtgcagtaagcagagaggttggtcaatgggtacgaagttacagtaagacaacaggaataaattgtggtcctctattgcacaatgaagtgattatagttaacaataaggtattgtatacctgaaaacagctagaagacagaattttgaaagagaaatgttcccaccacaaaaaaatgacacatatttgagacgacgaatatggtaattattttaatttgatcattacacaatgtatacaggtatcaaaacatcacactgtacctgataatatgtataattattatgagtgaactaaaaattttttaaaagaagtatcaggagatagctacttacaacaatttcacatttgtccatatttataaatctcagcttccatttgcttagagcatttattcaagatatataaatggcatgtaatcaataaaccatttagaaacgcttgtattttcattattttgtgctaaaccattaaaaaaaagtcagtgaatcatcatccctaagataatgtgtcttcccaaatgggagaatcatactgcacttaagatggtttgtgtgtgcacttatatttttctcatttacaaaaatgagtggtactctggctttagaaaaaaaaaaaagaaaacaaaaggagagagagaggagagagtgagaggaaggaaggaagcaagtgagggaagaaggaaagcaggaaggaaggaaaaacgaagggagggagggagggagagggaggaaaaaatgcagtaggaaaatacattcctggtgaagatactgtgaaaagtgttgaaatgacaacatattctgcagtagggactgtgaggaaaaaattcttttaaaaaaagaaaacagaggattcaaagcattatagaaattgagttgataaagcagtggcagggtttgagaggattgactccaattctggagttctactgtggataaaaggctatcaaacagcattggatgctacagggaaatctttcctgtaaggaagaggcaactgatgtgcaaatttcattgtcttattttaagaaattgccatagccactccaattttcagcatccaccaccttaaacagtcagcagccatcaacatcaaggaaagaccctctaccagcaaaaagattatgactcactgaaggctcagatgattgttattttttttagcaacaaagtattttttaattaaggtgtgtatgtattttttaaacataatactattgcacaattgacagactacagtatagtgtaaacataacttttatatgcactgggaaaccgaaaaatttgtgtgatttgttttactgagaattcgttttattgtggtggtctggaactgaaccagaaacccatatagatcacttcaggtatccaaaatggaaagtacaaagaaagaagcacaaactagaaattaggaaacttaaaaccactaaactgctttgtgaaatgaggcatattgcggtttcttttttatataatcaagaaaattgggttcccatctgatgaccagggtgagaatactgccaacagatgaaactgaaggtacacaggtcaaggttaactatctaatttgtgttcgggtaaaatttaacatgcaaatatggtggtagataccatagttagccaaatactactgttaagaaaacaaaggacatacaatataaagatagcaaatagcttaatttgtggcattcaaagtgaatatatttgtggctagatacttgggctgtgacagatcttgcatatgaagttagtgaacctagacttttaaataagcaataaagagtcatgaaaaagttactgagcagacaagtgacaattatgtattagaaagacacggtgactcaattggaaaaaatgatcaatgaagttataccttcattttaatgacagaccatccttattaccacagtattaggaagctcaattttttgatgatgtttaaaacatacagaatacattctagaaacaatgttctcctcatacaaattacaatctttattaaatagtatatataaaaaacaaaattttatgaactcataaaattatttatatttgttactgtcaaattgttctcaggaattcatcattgaaaatagtaaaaggtaagctttggtaatcgcactcacccaaaaaaggtattggatggtttgatgtaaatcaaactattcaattattacttcccaataagatttctccacagaaagcagcggaataacccttaaattttgtaaaagacataaaatgcaagaagggtctcagcaattaaaatatatgagctcattttaagttattctgaagaaactttttcaaaattgtaaagccattttaccagaagcaactgtagacaaatcttgttaactttaacctattaatgtgttattacatcacttataaaggattcaagaaataaaaaaacaaaacaagcctgaattacttcaaacttttaaagtcacaaaaatatcaataagaatgttagttatttcttctatacgtccttgaaaacataaaccaaacacacttactgttggtttttttcatttagagcattcatgccctggagatcagaaagaggtgttctgggatttttccgggttatacctagcaaaatttaaaaaacagaaaatttcaaatcagtgcaaagaaaaatgaaacgtgaaatagtttttctaaagacaaacgaaaatttaatcacgagtatttgctaaatatttcagaaatatctaaataattacatgacccaagtctcataactgtcatagatcttagttaacaatgaacccaattagaaaatttaataatgaaatattttcttctttcattgaatcattaacttcagaaaatacaagggtgactggactgaaggcctagaagtgtacaagttcatttttatttttaggttcagggggtacacatgaaggtttgttacaaaggtaaactcatgtaacgggggtttgttgtgcagattatttcacccaggtactaagcccagtactcaatagctattttttctgctcctctccctcctcccaacctccatcttcaactagacctcactgtctgttgtttccttcgtgttcataagtttttatcatttagctcccacttataagtgagaatatgcagtatttggttttctgttcctgcatttagtttgctaaggacaatagcctccagctccatccatgttcccacaaaagacatgatcttgttctttttatgactgcacaaattcatttcttattttgatgcatcattttttagccatacatttctgacatgttcagataaatacaatgagtatcaatgtattgagaattaatgttataaatacgatgaatataaaagaaattgcttccttaagaattactaatatttaaaaaatgtaatgttcttcaaatcatatgataaacatgtaagttccgtaagcataaggctatcaatttttataacacacaaacatgtaatatatgtaagatacactggaaaaaggaagtaaaagtatctctactcaagatgacaatcttgtaggcagaaaatcctatggaataatttaaaaaaactgattcgactaataaacgagttctgcaaaactacaagaaacaaataaatatacagtggtggccaggtgtagtcacagatgcctgtaatcccagcactttgggaggccaaggcaggcagatcacttgagctttgtagttcaagacaagctgggcaacttagacttcatctatactaaaaataaaaaatacatgtaagtgcttagaagagtgcttggcacatagtcaacactatatccacatgaagtgattgttatctttctgtatgaatgagggaaactgaaaacccacagaagactctttgtgctgtttaaatcatgcaaatgggccaggcacagtggcccatgctggtaatcccaacagtttgggaggccaagacaggcagattacttgagcccgagagttcaggacaagcctgggcaacatgctgaaaccccacctctataaaaaatacaaaaattagctgagtgtagtggctcacacctatagtcccagcttgagagtctgatgtgggagaactgcttgggccccagaggtcgaggctgcagtgagctgaggtcgtgccactgcattctagcctgggtgacagagtgagaccctgtcttggagcggggacggggttgggggaggaggggcggaaatagcaataaatattctgaaatgaaatttttaaaagtataaaatgtctacattgaaaactataaaacatcattaaaagaaaataaagactcaactaaatggaatactatctatgtgcctgaattggaaaatataatattgttaagatgtcaatgttccccaaactgacctacagatcaatgcattttctattaaaattccagataattatttttgtagaaatgaatgagccaatcctaaaattaacatggaaatacaagggatccacaagagctgaaaacaatcttgcaaacaatcttcaaggaggatggcttgagtccaagagttcaaggctacagtgagttatgactacgccatctcaccccagcctggatgacagaggaagactccatctcaaagaagaaggaagaagaaagaagagacagaagaaaggaggagggggaggaggagtaaatttctagacaatagattaggcaatggttaccatttttacatcaattattaagtattttaaacataaaagtggcctaaagaataatatactaaacacttatgatggatcactcagattaaaaaatgaagccctgtgtagctcactccctgatcccatttaaaaatcatcagatctggtcaggtgcagtggctcccacctgtaatcctagcactttaggaggccaaggtgggcacatcacctgaggtcaggagttcgaggccagcctggctaacacggtaaaaccccatctctacaaaaatacaaaaattagcccggcatggtggcacacacttgtaatcccaactactcaggaggctgagggaggagaatcgctcaaacccagaaggcagaggttgcagtgagccaagatcgcgccattgcactccagcctggatgacagggcaagactccatctcaaaaacaacaacaacaacaacaacaaacccatcagatcccaagattgcccatttgttcgaattagcaaaaaaagcattttaaaatagctatcttgagatggtatcaaatattctaacaacatttgtaactggagtttcagaaggaaaaaagaaattgtagcagaaaaaatttttgaaaaatattggccaaaaattttctaaatttgatgaaaaacaatgaaagtccaaaaggtacagcaaatcccaaagaaaattaatataaatcatatttagggacatgagaatcaaattgctgaatgccaaatatgaagagaaaattttaaagtcaaaggaaaaaaaggtacacgacatatgaaggaatgacaatgggatgacaatctgagtaatcatcacaaataaagccctaagaacatggaacatctttaaaatgccaaaaatttgatagtttgtaatgatgttaaacatatgcctacttcatgaagtaactccactcataagtatttactgaggaataaaaatatatgtctgcaaaatgactcaaaaaagaatgtttatagcactgttgttcacaatagctctaacaatatatataattcttaactacaccaacaaatcaataagcacaattatatacattatatataatcatataaattaaatacaatgtgtgtatatacatatacaatggaacacacctgagcaacaaatgatatatggaaaaatatgtatgaatacatgcataactatgttgcataacacaatcagaacacaaaatacatactatgtaatcccacttgcgtaaaatttttagaaaatgtaaaactgacttatagtaataaatctgtggttacctaaaggaggtgggaaaatgtacaagagaataaggataaattttgatataactctttcctaatattcttaatttctttgtgtttatatgctttaggtttgtctcttgtaagcattctacagctaaattttgctcatcttccttaatccataatgttttttaaactgttcagtttagtccattttaacttactgctataattgatacatctggaatttttttctgacatcttagtttatatttttttatttaccttaactattatatgctttcatccaggcttctattgttttctttgtactttgacttcttttgttccacaaattgtatactttctgctttatttatccttaaatgtttaacatactcatgaattctaaactaataatctgttctctttctctaaagagtacaagaaccttcaaatgttttaattaaagtcatccccttctcattagggatgttattgctacccaatacttacattcaccttgtttcttttccttcatcaagcaaattaggtataagttttataaaattgttgcttatttagctttatatatacatttaccaagttctttattaaatatcaaaactttctagtgggttcagcttctatcttgctcaactaaatttttaaaatctatataggtgagcatctgttcagattactatctagctttaataattgctatcattcatatttgcctggtacatcactgtccatccttttattttcacctctttaattaaaaatcatgtagctatcacttaaactactgaaaaattcattgagagtttaactggtgagtgtaaaccatttatattaattttaaataatacttgtttctggcatttcatttcatgtttttcatttatttcactctttcatttttttccttcttgattttcactttataaggtctcttatgctaccttaaaagataaaaattgttattactgtggttgtccttaaggtacacgttcaatttatttaattatactgatttcctaaacttgaaaagattatgttaattcaagagcagtagagctccccgctttcccttcagttttcaccaaaatgcatgccagtatcttctatatttgtctctgtataccatctgcaagcagtaattctgatcatatacaattttttattttggatattcttagtttcatgaaaaataatctcttctaggcatttacttgtaacttgtatcaggcttcataacatgtaattaaacatttttattggaataaaaatttcaaagttaaacatatatatgttaaatgtacagttaaataagttttgctaaatgcattcaccacactaataaccaccaaagaaagatacaaaacatttccatcatcaccaaagttgccttatgccccttcttggacaatctcccacacttacttatgggtaaagacaatcactaacttgctctccacacagattggcttgtattgactagaactttatacagatggaataaaacagtatgctttgaggataggccttcccttagcataccactttagagattcatacgtaaaagtcttttgtgaatatatactttcatttcttaggtaaataactgagatttgaattcatgaaacatatgggaaaaatacgcttatctttataaaactgacaaactgttttcggaaataactgtaccatttgacagtgccaagagacagtaggagagctccagttgctccacatccttatcagttcgtatttcaacttcttacattttagccactatagacgtattagtgaccttagtcagattacaatttgcctttccataatgaaaaagttgaacatctttcatgagaacacagataaatcttcttttgtggaagtgtatgttcaaatcttttgcccatttaaaaactggcctgtttatcttattattgtaggagtttttatattttgttttcaagtccattatcaggtatgaatattacaaattgtaataaatactgtttcccaggctgtggtatgttttttgttttcttaatagcagttaagaaaagtagttttcaaattggctaactttaccaatttgttaattttttccttttatattcatgctcttatgtctcatctaagaaacttttgcctgtcacaagattacaaaaatttgtttctcaggttttcttctattttaagacaaatttaatagttttggtccttacatagagctgtatgacacatttcaaaattaacttacatgtatgatataagggtcaaagttctcttataccttatggatatccagttgttctagtgctatttgtttaaaagactatcccttacccccactaaattatcttggtgccttaacagaaaatcaactgactgtgtatgtgtagatctacttctgtactttgtatttggttcattaatccattgatccttaacaccaatagaacaatgtcatgaatattttagtcttaaaatcatataatgtaaattatccagctttgttctgtttaaaaattgttttggacagtctgggtattctacatttctctataaagtttagattcagcttgttaatttctaccaaaaaatctgctattatacttattgggttgaattcaatctatagatcaatctgagagagagctgcatctcaaaaatacaaacataaatatgtatctctcttcattgtattcttcagtttctcctagtagtgcacaactcttaaacatatttgttaaatttatccccaagtatttcatgtttctgttaattatccactgcatattaaattactccaaaatccaacactttaaaacaagttatcatctcatatagtttttagaggaacaacaattcaggagtggcttagctgggtggttctgactcaacatgtctcaagaggttgtattcaagctatcagccaaggctgcagtcatctcaacattggaatgaaggatccacttctaaggtcactcacatagttggtgacaagcctcagttcatactgagttttggctactcacaaatagcatcttgtctctccaagagacagtgatttcagagaggcctagcaagtaaagcagtaccccagaaggaaattgcagtcttttacagaaatcgtaaaagtgacataccatcatttttgccatgtgctttctgttacacagaccaactcttgtaaaatataggagaggactataaaagcttgtgacatctaggaggctggctgccatagatgtacagtacatggaatttgtaaatcattttcttagtgctcatggctaggatattacaattttctataattacttggtatcccgtaaaaatgttaaactcactttttagttttaagagcacttttccttaaataggaagtgtgattccttcacacttcctatattaatgaatttgttgactacttcttttcaatctatgtacaatttctttttgttgcctttttgcaccacctgtgacctttagcaaatgtcaaatttaagtggcaaaagatgtctttgccttgttcttaatgttagggaaaaagtattcaatctttcactaataactatggagtttgctgtaggattttcatgcatattcttcataaagtagaggaagttggtctctattcctaggctactaaaagttttaaaatagaatgagcgtggtattaagacaaactttttctccatctactgagacaatcatatgtggctttctttttatatggttaacatggtcaagccaacctttctcatccctggaataaattccatgtggtcttcatgtattattcttcatgtattatctttaatatattgctgaattcagccagctattattatttctatatccaccattacaaagttatattggtctatagttttcttataatggttttggtaacagaataataacactggcctcatgaaatgatttggatagtgttcccttctcctgttttttgaaagagttgaagagaattggtataatagtcatttcttaaataaaattactaatgagcctatcttggcctaaacttcgtgtggggggaaaattttagttaagaattcaatattgtaaaaagataccgcactattcatattttctatattttcttgggttgattttaataaccgttgacgttcaaggaatttttccatttcacgtaagttgaactgattgccataaatgttcataatctctttgtcaaacttttgatttctgtagcatatataattgtgtccactctttcattctaggtaatagctttgtgtcttctctcacttttctagatcagaatagctataactgcactatccaatacagtagccactagctatatgtggctatacaaacacattaaacaaaattagaacttcagtttcagctgcaccagacacagttcaggtgcttaacagccacatgtggctagtggctacagtactgacagtgtagctggagaacatttccacatcgcagaaagttctactgcaccatgctggcctagagatttatcaacttcattgttcttttcaaaaaaccagctttaggccggatgtagtggctcacatctgtaatcctagtactttgggaggccaaagcaggaggattgcttgaagccaggagtttgagaccagcctggacaacatagtaagactccatctccacaaataaaattttaaaaattagcagggcatggtggcatgcacctgtagacctagctacttgagagactggggtgggaggatcacttgagccaaggaggtcaaggctgcaataagccatgattgtgccattgcactccagtctgggtgacagaacgagctcctatctctaaaatatgaaacaaaacaaagtaaaatggtggcatgcacctgtagtccgaggtgcttgggaggctaaggcatgagaatcacttgaacccgggaggtggaggttgcagtgagccaagatcatgccactgcactccagcctgtgtgacaagccagactccatctcaggaaaaaaaaaaaaaaaaagttttatttactttacttccttttacttatttggagtctaatatgctcttttcttcctagcttaaggtgaaagcctcaatcactgattattttaccttacttttctaatttaagaatttaaagctgtaagttttctcctaagtacttctttatttatattccctaagttgtaatatgttgtttccatcatctttcagatcaaaaaacttccaagttacccttatgaaattttttcaactcattagttacatatacattttatttttcaaatatgtgagggtttcccagatatatctgttaattgatttgcatttaattccattttgatcagacaatccactaaactttcaatcatctgaatgaccatcctgatacctgaggttagggacattaaagtaggcactgtcagcatggtgagggtaatttaggtggagtaagccctcagcccttccctggcaattgctgatccttcatcttgctgatgcacatcatattctcaatcatcccaaacaggactgaaggccaaaagaatgggttcaaattaaagttagattcttcttttctacccctgctctccttctgccatctgattccttctttctagggctcctgtcatttctggaagtgagctgtagctcatgctccccaaaacttcaatttttcctcactcctctaatttcctccctgagaaatttcagagaagagccactttggagagaaggcgagagcaccagaaagaaagagaaggaggaaaggccacaatacctttatgtcttaatattgaaggtcacacactgtaacttctgccacattccatttcttggaagcaagtcactaagtacaggacatgccttatgaagggggcagtatcaatttgtggacatattttaaaccaccaaaataatgtcagattttttactttaaacagtcatttttttaattaagagaagccaagaaaatatgtgtagtcatttatatttttatacatatttattagttctgccttctttattccttccagtaattcatgcatgtatcagcaaactagagtccatggcctaaaccaaacccactgcctgttttttgtatgacctatgacctatgaatggcttatatagtttttaactgaggagaaaaaggagaacatttttgtaccatgtgaaaattgtttgaaatttaagtatcagtgtccataataaagctttattggaacacagctaaactcatttatttatgtattgtctatggctcccttcacagaagagatgagtagctgcaacagaaaccatactggcctacaaagcctaaaatgtttgctgtctgctttttgcagaaaaaatttgccaacccctactatagacccaagttacgatcatggggtgatttccctcgagcctgaagaatttctattatcattttccatataatacatatgttgacaaattcccagactctgttagtctgaaaatgtatttcaccttcatttttgaaggatacttttgctacatgataacaggacattgtggataacacatcatagcaacagtggatactgttaggttcttctgaagattgttaatttttcttctgtcagttaatctgtctggactcaaactgcaaatacagaaattctggttcaaattttttttgtgagggggggggatgtgacatattaaacatgattttttgacaccttttggcctccattatttttactgagaagtcaagtgttaattatctcattattcccctgtatttaatatgtgtatcttttccaggctgctttcaagattttctctttatctttgacattttagcagtttatctataatgtgcctaggtgtagttttccttcgtatttaccctgctttgtggtcactgatcttcctggatctgtaagctagtgtttgtttgtttgttttgagacagtcttgctctgttgcctaggctggagtgcagtggtgtgatctcaactcactgcaacctctgcctcccaggttcaagcaattcttgtgcttcagccacacgaggaggctgggattacaggcgtgcaccaccacacctggctaaattttgtatttttagtagagacagggtttcactatgctgggtgtttttttgttttttttttttttaaccaaataagggatgttttctgccactgtcttcaaataattttcgacccctttatctctcatttcctatgggactccaattaaggcagaaagacttcagtttttcccacacaagctaagcacaggcagaaaatttcctcagtttttctaaaaagcagcaaacttgcatagctcagctattatagttatgtctttcaaggattatctcttatttgatttccacttttttttttttttttaatacggttcctggggtcttccctgcatactcacagcagtcgccagggatatgggcagagttcatactttaatttgggttttagccctttagcagctctctcagtcccaggattttcctcctaaaccccaagctgctctgaaagtcttctaacataataagccagtatggtggtggtggtggtggttttctatctctgaaactatgcaagttaggaaaccccttgtataaaaagctacaaattcacaattcttacccactgctttactacctttaaagaataaacttttccctactttctgcctacttttggtctttttccagtacttttaaatatttggttattttaaaaatttttttccaggttttatcactgttacttgtgggaggattcattcacctcaccaattcaccactacctaaagctggtagttccgttttttttaagaacaatttccaaaacttgaatctacagttttacgtataataaaatttataacgtgatacctttttataattagtatattgctaatactatcgtggaaaatggaataaattacataaaataatggaagagctccaacgtccacaaaagtagaaatttgcaagtgaacacacatagacacacaatttcttcatgcagcctatgctgaaactggtgccctcctattcaagatccatatgtagctggcatacaatcaggtctggggttgtcaggctgggtcatgaaaaaacaaagcaaataaaccatttgcaactatttaagagttaatagaaattaatttaagtgttccaaaatgttttatagactattttaaataatgtcccatggattaaaagacagaataggaagatgaataactggaatgaggatttgttacattcctcttagaaacaacagcaacaattaagaataattttaaggatgtctttttaaaacaaaacacttacctttgttcctcttaaaatgagaaaatactttaaatactgtttttcaaaacacattacacacttttgttttaaccaagacagcaatggcaattgaaaaagaatccacaacatttgttcttaggaattctacttatattctcctctcactgacaactggatagtaaaatttcatggaatttcaaccagaaaactgtgaaattagcaaactaaatcagtggtaatttattaaaagctcagaacagattatgtaggtccattatacgcaaattgctgagttgtctttgagtattttgaaggatccacttattctcacaatagcagtgcctcaataatagtaatcttacaactggcaaaagaatcaattttcatgcagaatgagtacaacaaataaagagcaagaaaggaaacggagaccaagggcatcttttcacaccaattttataaaaaagcaaacaaaaaagaacatgcaccatgattctgttattattcctcaagccaaaacattaatgcggtggttttgctctaaaccagacataggaaaggctggctgaagcactgcaatcaaactaagtggatttaccaatgatacacaaaaataacatttgctaatgttgaaatttcaagcataagcaaacagaaaaatcatccagatttagaaagggctatgacaaaactttttgggaatgctgaatatattcattatcttgactctggagataatttcatgggtgcctacatacgtcaaaacttaccaaattgttgtctttgcattcagttttttacttcaattagacctcaataaagttttttttgttgtttttttttttatgagcaggaaagaaaacattgttgattcctatccatcacttggctacttgaaagacaaatagaaaccaatccagtgactgtaaccaagtataattaacaatccaatgatcacaggcaaacagaaaagtcaccaaagttaaaaaagtatatcagtattttcaaaagaaagtactaaagactcaatagaaatattcaaagactgctcagaggtttatggaggccatgttgcccatacaatctatatcccaccctggtgtaggatgctcctggtttccatttccaaatggatatgtgataacagtttatcaggatttgtagccttactgtacttctcttccttgcatctctgcagaatctctaagctcctctggtggactgggtgttggagaaagctaaaactatccatacttttcaaaattgcacatggcgctgtatcatcatgtccttaggaagcaaaaaaaaacaaacaaaaaaaaaaggagaaaagaaaaagacattatataagcccaaaccaacagagaatcaaggacaatgctgccaactatttaagggtgtataaaaatgtatcaaataatagaggttatatgtgaatgtccaattattttgaggaaaatgcttaaaaataacaggaaaaaatacaggcatttttcagatattcaaagtgtccttttcagtactcaaagtattgttagttaacaccatactagaaatttctcaatacaagcaaaaattcaaaagcaatttgtatgatttattttttaaaaggacttatttttatcaggtctcaaatataattaacatatagttggcaacactgatggaaccccaaagagaaatatacccagaacaatttacttaaacaattctttcacaaatcctgcaattaaccacacttgtaggaattccaacaagtgtgtcaataatgaaaacatgaagaaaagcaccatagagcaggaaagcccagcagcacttctgtacttataaatttgaaaacaaagctgaagactctgtacctcattatcacttcttaggaaaataggatagaaatcagctaccagtgaaaaatagaagagagcacattcaagtaaagaccaaagccccagatcagtgttatttaaagtgagtacttaggaaataaagtgaatgggagatgagtgccataaatattagcaataaagagtttccaggctttagggtggtggttgtgtaacatttattcagagatcacctctagagttagggcataatgttcaaatttaaataagtttgcttttaaaaaacaaagtacataataatatagaggcaaattaagtaacacattaaaatgaactaaagttctattactgcattttactgtataattaggaatgagatacaacagaacaatctttggaaaaatctcatagcagaatcattttaaaagttaaacagtctcatactaattcaaagaggtttgtagggcatattttagtctcattctaattccctaaattggatttatatatccagagaataggcagccatatttggcaatggagagggaatctaataccataaatcatgtaatattatacacagaaaacaggcttttaaaaaataaagtgaatttgaaatatttttcataataaaagtaactaaactaataaaatactatattatttgtacaatacgaaaagtcaataggtacaaaggttgaatgtttcaaaaagagaagtataaccaagcttaacatcatttcttactcaaaagatacctcgataaacatactctgttctcattattaccagtaatccccccttgatggattgcttggagaaagaatgcttaggccttaaactccactgcacttggtttggcagtcagctgaaggggaccagttgaggaaaaaacacccagtgagttctagtcagactccattcaaattgtaaattgaagaagttatcactaaacaatcacgcctttcaacagctaatctgataatcagctagtcaaaaataattcaagaatattatgtgttaaagtattctgtataagagctcaggatattaaaatacactaatttattatgtagagttttaaaaaatcaatcaacattactacaaccaccaaactattttctatttcatctaataaactgtggcactgccatttaaaaatgggtatttttgtatctgtgactgctttgtctcaccaccatgcctagattagtttctttaacctctctcctgttctttcattctgctttctatacctttttacagttttgaacgttattttccagactgtgacataatttctaaatcttaaagtgatattccctgtttgttttatgtaccaaacccctgccaaggtagtttggtttcccaggatggtttatattttcagtggggattcttttctgaggagtctcatcaactgtttttttgttttgttttgttttgttttgttttgttttgttttttgagagggagtctcactctgtcgccaggctggagtgcactggtgcaatctcggctcactgcaccctctgcatcccgggttcaagcgattctcctgcctcagcctccggagtagctgggactacaggcacgcaccaccatgcccagctaatttttgtatttttagtggagatggggtttcaccatgttgagcaggatggtctcgacctcctgacctcgtgacctgcctgcctcaacttcccaaagtgctgggattacaggcatgagccactgtgcccggccatcatcaactcttttttctttttttaagatggagtcttgctctgtcgcccaggctggagtgcagtggtgcgatctccgctcactgtaacctccgcctcccaggttgatgccattctcccacctcagcctcctgagtagctggaactacaggcgccagccaccacgcctggctaattttgtttttgtatttttagtagagacagggtttcaccgtgttagccaggatggtctctatctcctgacctcgtgatccacctgactcggcctccaaagtgctgggattataggcgtaagccaccgcacccagcctactcatcatcaactcttaaaagagatttatttagtatttgcttatgctagttgctggactggttgtgatgataatttcttagtttgacattatgcaccaaacacatagtataaattcagaccccatactcatatatggtgcagatgtggggcattgatttttttaaaggtaacttctttttaaccttatctaaggcctaacacagattgctaaggctcctcattttttcttatgcaggaccagcaattttcaataatttttttagtgacagaaaagttccataactttgaaggacttggactatgtaacagaggctcagtcccagctccaaagtatcattcagaccttaggcaatatctttggccctataaaagtttctgtaatgtcaattcaaaggccttaaggccatttttaaaagccatatttcacaaacataaaataacgcttttcttaagtactcagtttgatgaatttaaacaaacgtttacatccacaaaatcctgaatcaagatagagaacatttctatcacccccccaagttattttatctcccttcctatcaatactacccttgcccctgatcccaccagaagtaatcaagttctgatttgtcacaatttattacctttttttttttttttgagatggagtttcgctcttgttgcccaggctggagtgcaatggttcaatctcagctcaccacaatctccacctcctggattcaagctattctcctgcctcagcttcccaagtagctgggattacaggcatgcgccaccaagcccggctaaatttttgtatttttagtagagacagggtttctccatgttggtcaggctggtcttgaactcctgacctcaggtgatccacccaccttggcctcccaaagtgctgggattacaggcgtgagccactgggcccagccatgttgtctgttcttaaactaaagaaataacacagcatatattctttcatatctagctttttgctgaggattttttgtgactcattcattctgagtatcagtggtttgtttcttttcattgctgagtaatgttacatggtaggagtatatcacaatttggtcatccattcttccactgatgaacattcaggaactattatgaataaaagcactttagaatattcttttttatatgtttgtaacagttttattgaaatacaattcacctactaaacaattccttgatttaaagtatacaattaaatgcttttagtataattcatgaagctacataaacattaccacaatcaattttagaacattttgatcatacaaaaagatactcacactctctatcatcctccccatctcttagctctatacctgaccctctagccctaggcaaacactaatctaagttctgtctctacagatttgcttattctggacaattcacataaatggaatgatacaatattccattttgtaatatagagtattgtatgattccatattacaaatatggaaactgtacttctttgatataatgagaaccaggcatggtggctcgcacctgtaatcccagacactcggggggaggctgagcagcgaggatcacttaaggccaggagttcaagaccagcctgggtaatacagcaagacccacctccaaaaacaaatttaaaaaaagaaaaggccaggcatggtggcatgtgcctgtagttccagtgtcttgagatgctgaagcaggaagataacatgagcccaggagtttgaggctacagtgaactgtgatagcaccactgcattccaacacatgcaacacagcgaaacccggctcttaaaaaaaaaaaaaaaaaaaaatatatatatatatatatataaaatacgcccagcgtggtggctcacgcctgtaatcccagaactttgggaggccgaggcaggtgggtcacctgaggtcaggagttgaagaccagtctggccaacatagtgaaacctcgcctctactaaaaatacaaaaatataaaaatagccaggcatggtgacgagtgcctgtagtcccagctactagcgaggctgaggcaagagaatcgcttgaacctgggaggtgaaggttgcagtgagccaagattgcaccactgcactccagcctgggcgacagagcgagactccgtctcaaaaaatatatatatctatatatatctatctatatatctctcttatatacacgtagcatatgtgtgtagcatatgcattagcatatatacacatatgtagcatatatagcatatattcatatatgtagcatgtatgctatatatgtatatatgtatgctatatatatatgctatatatgctatatatatatacacacacacacacacacacacaaatatatatatatatatatatatatcttaatgctttcaaggttcattcatattgtggcatgtaccagtatttcatttcttttatggccaaataacatgccatgtatggatataccaccttttgttcatccattcatcagttgatggaacatttgggttgtctctacttgttggctattagaaagatgttgtaaagaatatctgtctacacattttgttttgtttgttcttctaagtacatacctaggagcagaattggtgggtcaaatacaattctatatttaactttctgaggaactgccaaaacgtattacggagtggctacatcagtagtatacaagacttctaattttccatatcctcactaaaatatgtattaggcactgtctttactgatattcagccttttgtcttgtataaatacttctcaggttactgggagcctttgattaaattccagggttctgacaaagttgttttgacaatttttgccaattttctcattgctattatgaaaaaaaatttagaggtccttaccccaccatttcactgatgtctatccaaaacccttattcttaattgccctactatactgcccaatacagaagtaatttataaaaaaagtccttttttttttaacaaaagtttatttaaatctattaagtactaggaagaattgtgtacagagtacagcatagagattctagacttatggtgatacccaaatcaattttagtatctggtcatttttgaaaatagatggtcactagaacgcttctcccacttacataaacaaacagaagtacatcagagttacatagtctattgagtgggatgaagaagagaaacaggttctgtggaaaaccttgaagctctctcatctgcagacactatataaagggtttcagcttctctctttgtagatgaagaaactgaaaaatactttggaccctcttgttcacgtctcatcctgatggcacagctgaattacccatctttgcctagcctttttagactagtttaaattcctatttggctatacttttattaataactccaaaagaatcaaataaagcatcattgtactcagttctacatactgtataattcccagtcaggttatttctgtataattcccagtcagggtgtttcttgacaattaactaagagtccactgaagtttttaattaagatatcatcaaaggaaataaaaacatactgtaattctgcagatttcatcttctttcttctttagaaagtattatctttgccctcttattctcatatccaacatctagaattggtcacctcaccttttctgcctttcatattttctacttcgtcttaatctgtaattcctatttcatcttaatatgactgcataatatttacggtcattataaaaattctggatctaccatttaaaccatttttacaatctgttagtttttacagtgatacaatgttccaactttataatatgtttttatcctaaacctaccaaaagagagtaggtaggaagcggtgtggagaaaataaaacgttagggtgaatgctggcattgacactgatatattgtaatataaacaattactttcggaaacaaatctgctcaggcttcaaaatgcaaacaaactagagtttttcttttcctttataaaaagtaaaaattttaaagttttttccaaggagaaattttgggtggctggaatgttgtgtttcttaacctaggtggtagttccagggttgtgtttactttgtggtactccactgaactatacatttttgctttgtgtacttttgtatatgcatgttatgttgaatacaaattttcaaaaagagattattatatggaagctctgtactagccagaagggaaaacaagattagaaaataaggaatctagactttatcaaggtagagaaaatacaggttgtttatcattaataacattgcatgtcattgccgatattgataataacagatatgtaacaactagctttcacaaataatagattttaaatgccaaaggaatatacagataatgtgaataaagtaaataggctttgacagtaaatacaagaaaagtttcttctcttactcaattatgtcttagcaggatgctaatcaattttgagtggttttcttgattagaagtttgtcataataaacaagaaagcatcttaaagaaaaaaaattttccttaaagctttttacaaagataacctcttagaaatcactttgtaaaaggcaaagcaggtttgagatagtccttttatttctctaataaactataattctccctatacatctacaaagaccagttcaaatactttacaatctaaaaaatggaaactaggttcaattattttacatgtatttttagaaatacactctctcaaatatatctatttgtctcaaacatttaaaagctaaacttaaaagttttactactagtgcacatcccaaaaagccacgtaaatcactttgggagtcctgaaagcacaggtgagccctataacatttctactgaaaggcataaatctcaactgcatatgtatcacaaaatcttctctatgcagcaatggccctatctaagactagagctacagcaaacaatagtttggtttccagtaggccaaaagtgcttatgaagttgccctcccacagaaaatgagatgagagattttatgattgaagggggaggcatacagaaaaagtatcctgctttatctatttctaaatttcaaagtttttaaaaatccatgaactaagagtaaaggaaaagaaaatgaacacttcatgaacagatgctctgactttatcctcattattttaaaggcagtataactcttttacagaaaagaaaaactgttcatagtcacaaatcagttaagagatgacactagattgactacagaagcaggatttttgtccttgagaatctcatagcaagaattctactcctttttgtggagaagtagaaaggtaaaaaaaaaaaaaaagatgaagtatggtagaatactaataactactacttaccagtttttctgtgaatgtttcttttcccagcttccctgaaagcaaccatggctctgaaaaaagctcggagaattgcccatcggaaaacagctacaggatcaattccaatcatcccagagataaatgcattcttgctgcttctcagaagagctacaatgtctgggcgcatatgatctgtatttttttcccggaaatcctatatgaaaaaagtaccagtgttacttatgggaaaaaaaaattatgaaaaacaagatgacgggtgataacatactttggatgcttgtccctccaaacctcatattgaaatgtgattcccccatggtggagatggggcctggtaggaggtgtttgggtcatggaggcagatccctcatgaatggattggggctctcttcaaagtaatgaatgagtttttgttctgaattcaccaaaatctggttatttaaaagtgtggcactcctacttctccatctcgttccctctctcttgccatgtgacacatgtgcttccactttgccttccaccacaagtaaaagctctctgaggcttcaccagaagccaggtagatatcagtgctctgcttcctgtacagcctgaagaatcgtgagccaattaaatctcttttctttataagttgcccagccataggtgtttctttatagaaacataagaatggactaacccaagtgacatgtttgaacagtggttgaacaatgagatagaagaaatgtctgctccaggtagctaactggaccgggtatcttctataaggtctcatccaatcctaaaactattgatttctataatacatgtaagttagaataaatattctataattttatagcagcttgttaaactctggtcagggacagcctctccaaagaggtatcacatacagcaacaggagagctgaataacaaaaagaagccagagatgagaaaactgggaagagcaagcaagggtaacacctataacctatagatgatgataagctggacaagttaggagaaaaaggataaaaaccacaggctggagcactggggacaaggagaaagtgtggaagattagataaataaataggctatttagactctgaacttcagttgtttgttcagattttattcaagtataaaggaaagccctggaaaggtaacaacatgagctaactggtgtcttatacattggttgctgcataggaaatgaattattcaaagaaagaatggaaaaaaggaggcacaatattagagtaaaccaggtaagaactgctagtaacttggacttggtcagttgtaacagcagaaataaaaaatagctatatttgggacatgtaaaggcaaaaaacctgctgattaattagggtatgatgagaaaatgaggaaatcaggttaaaacttacattttggggttgggtatttagtggatggagatgccatatactgataaggagaagactagagaaaggaaagttatgaggataagaaatgaagaccaagagatcagttttttccaagtgaagtttgggccagtgaggataataatagtaggtaacacttgagaggttagtatgtgtctggcactcttctaagtattttacatgtattgtctcatgtaatctcatttaatactcctaataatcctttcagatagatattactactctcattttatagatgagaaaactgaatcagagagaggtgaaatatcttggctcctatcacacaataagtggaagagcaagggctcaaaaacattcactcataaccaaatggatgtgtgagtctggagtgctagggagatttcagaaattatatttggttattatcaccatatagatttttttttttaaacaaggtctcgctcttcaatacagtgcagttggcaccatcatagctcactgcagcttgttaactcctggactcaggcaatcccctgcctcagccttccgtgtacctgtgagtacagatgtgcatcaccacgtctggctaattttttttcattatttttgtagagacagagtcttgccatgttgcccaggctggtcttgaactcctggcctcaagtaattcccccacctcagcctcccaaaatgctggaattacaggtgtaagccattgtgcccagccagcacacagatttttaaaactgaataagaaggattgtaaataggcagggacaaccatctaccaaagaacagaggttggaggagctagaacataagaaaatgggttaaaatgcaccataaataaatggggagagtaagcttccactctgggaacaagggcccagcctgatattacagcataggcattgactataatcttaccaaatggaaggattaaaaatttggtaagtaaatcgctccaagttggtacagcttcatagaatatctctaactcagaattctatgagaaacatacctagtatcatgtcatctatcctcatgtacagaagtcagcttgcacttatcctattacttttagggttttcctttcctaattcttctttattctcctgagaacaaggaaaaacaggaaacaagccaggaattttggtccttggcttgtccttacatacccttagagcaaacgtatgtattataaaagaaaattagaaaaactgaataagagtactcaaatccaaataacctctgacaccataatcagcagctaataactactgatggcagacaagctgtgaggcatgaacttaatgtattttacgtaacttatttttacccagttctaacaactactcaataaagcagatttagtcataagccataatttactgataagtaaacagaaaggtaaagcagcttgccaaaggtcaaagagacaataagtaccagtgcagaaactgaaacaccagtctgccctactcctattaataactacactgtacaacctaaaaacctaggattcttttcaatgctgactgtcaagtgttgagagtgaccagtgaccttcattttcaaaatgaaataatctgtcttcatatttctagatttctaagtacattatcaactgaccatatcattcttcttcaaaatctctctctagtttccacaagaacatactttgtggtttaccatttacctcctatactgcccttctaagtcctcattgctagttcatattggaaattcaagggtgggtttaacagtgtgtactcatttctctttttttggtttgtttgttttttgagacagggtcttgttctgttgcccaggctggagtgcagtggcaccatctcaattcactgcaacctctgcctcccgggctcaagtgaattctacccctctgcctcccaagtagctgggactacaggcacacaccaccatgcccagctaaccattggtattctgtgtagacactaggccttcccatgttccccaggctgatctcgaactccaggacttaagtgatccacccacctcggcctcccaaagtgctgggattacaggagtgagccaccacacctggctgtgcactcatttcttcactcaaccctcttatatcaagtgatcagaaccagagttacgactttattttattttatgtatttagagacagagtttcgctcttgttgctcaggctggagtgcaatggcttgatcttggctcaccgcaacctccacctcctgggttcaagcaattgtcctgcctcagcctcctgagtagctgggattacaggcatacacgccaccacgcctggctaattttctatttttttagtagagacagggtttcttcatgttgatcaagctggtctcgaactcctgacctcaggtgatctgcctgccttggcctcccaaagtgctgggattacaggcgtgaagttatgactttaaattaacaccatcgcccaaatgcaaatttccagatcagatctttcttattatttcttgagatccattaacaaatcttaaaggatatgtctaatttgaaagaaaatgtgtaagaccagtagtacatttaaatgtttggaagcattcactagtaaaaccatgtgggcctgggatttcctctgtggaaaagttctgaactactgattcaaattatttagccaacagaattttcaggtttttctatttattctggtgttagttttggtaaagtgttttttaatggaatttatccattttttgttttcaaatttcctgacaaaatatatgcatatccttctaatatctgtaggttatgtagtaaagttcttttttcattcctggtatctgtaatctataattttttttatattatcagttattttcctattgcatttaatttatattattttgtgttatcttctcaaggaactaacttttggcttagttgatttctttgttcaatgtctgctttatattgcactgatttctggtcttatttttataccctttctctaattcctttgagtgtgatttctcttttcctagtttctcacatagaagcttagagaaccacttttcaatcaagcatggtggctcacacctgtaatcccagcactctgggagactgaggtgagcagatcacttggggccaggagtttgagaccagcctagccaacatggcgaaaccccatctctaccaaaaatacaaaaactggctgggcgcgatggctcacatctgtaatcccagcactttgggaggtcaaggctggcggatcacgaggtgaagaaattgagaccatcctggccaacatggtgacaccccatctctactaaaaaaaaaaaaaaaaaaaattagctgggcgtggtggcatgtgcctgtagtcccagctactcaggaggctgaggcaggagaatcacttgaacccgggaggcagaggttgcagtgagccgagatcgcgccactgcattccagccgggtgacagagtgagactccatctcaaaaaacaaaaacaaaaaaattagccaggcatggtggcacaagcctgtagtcctagctacttgggaggctgaggaacgagaattgcttgaacccaggtggtggtggttgcagtacgccaagatcgcaccactgcactccagcctgggtgataaaacaagactcttgtctcaaaaaaaaaaaaagtttagataaccacttttcaacttttcttcctttccaacatatgtatttaaagttataaactttcctacattccttgctttaactgtatcctacaagtttctgataggctggatttcattaatgttcagtataaaatattataattttaataatttattataagtaatttatattgtcatttcttttttgactcatgggttattcagaagagttttgcttagtttctaaatatccaatgattttctaagttatccttatgatgtgctaattaggtcacctatttaacagtgctatttgtattgattttgtgttgcttgttctgttagttactaacagaaatgtgttaaaatctataattttttcttttttaagtttttttctttttccttagaaaaatattgaagaaaaaaatctacaattatgatggtgcacttatctaggtctacttttgctttccttttgctttatatattttaaatcagtcattagctacatataatatcaagtggctcatgcctgtaatcctagcactttgggaggccgaggagggtggatcaactgaggtcagatgttcgagaccagcctggccaacatagtgaaaccccatctctagtaaaaatacaaaaattcgctgggcgtggtggagtacgcctctgatcccagctactcaggaggcagagaatcgcttaaacctggagggcggaggttgcagtgagtcgagatcacaccacttcacttcagcctggcaaaagagcgaagcgagactccgtctcaaaacaaacaaacaaacaaaaaccccaaaaacatttagtgattacgtcttcctgttgaactggccccttttatcattataaaatgtccctttgtatctctagtaatatttctggtcttaaagtctattttgtcctacaattttttttttttggagacagagtctcactctctttctcaggctggagtgaaatggcactatctcggctcaatgcaacctcctcctcccaggttcaagcacttgtcctatctcaccctcctcagtagctgggattacaggcgtgcaccaccatgcctggctaatttttgtatttttagtagagatgaggtttcaccacgttgaccaggctagtctcagacttatgacctcagatgatccacccatctcagcctcccaaagtgctgggattacaggcgtgagccaccatgcccagcctgtccagaaataatatacaccagcttttatcctttctccatctttttactttcaacctatctgataacgcagatgaatatcccaggcaagtgtgtgtgtgtgtgtgtgtgtgtgtgtgtgtgtgtgtgtgtatgattctatttatctgaaatttaattaaaagtaaaattaagaatgataaaaattagggcagtggtaatctctgaggggagctggctgggaaggggtataaaagaaatctaaacactttatttgtgcactttatgcacaatatcctcaagtttttctatagctcaagcttttgttttactttttaaactatagtcttaatttctattctaaaatccattccttccagtattttccatcttaggaaatggtacctccaaagcacccatcagctctagccagaggtcacttactcatttagagtccatcaataaagtctgtggatggtttaccgccagaaatacatctcataatcatctggatcccccccaacctctactgccactccagtgcttcagtttaccttaagatttcacttcaatttaaaaaaaagtgacttaactgatcttccagattccactcttaccctctgctatcccttctcctcaaggtaatcaatgcaatcttttaaaaacacaagtcgtatcctctgcttaaaatattatcacagtgccactaatttggataaaagccaaactcaacttggcttacaagccctaaataataaccccctgtctattctctaagttcatttcatgttactctccttagttcattataatctagtagcacttacctgttttcaattatttcaccatatcaaactcctatctcctggcctataatattcatcatccgaactcctcatcaaggtaacatttatttcaggtcatctctcaaaatttaagtttcttagagaagtgttcatgtattcacaaattcaaaatccactattttactactttctctcataggacccattaacttatttataacacatagcccatttatctatgttatacaaatagatacacacacatatatatatgcacacacaatatgtatatatgcacatatgtatagagaatcaggactacatctgtctagtttatcattagatcattccaaacaccaagcacaaagtctgacacatgttctgtgttcaacaaatacttcttaaataaatcaataaatggatgaataaatgatcttaagacactcgactcaagacccaggagaaaacatttaattccactattctccatatcatcagctgccttacctgggaaattaaatgcctgaaatagcaggcttaaacatcaagtagttaaagaataacagactcacaaattacacaagaaatggacaacattattaagattccactccacataagagtttcaatatattcatgaaaagtacgaactgacaaatccctaatggtgaacagagacatgaagaccttatgagtgcagagaagggaaaaattcaacaaattatgtgcataaacaagtgagtttgggatatacagatgcaatctattctttcagatctaaagtttatcaggatcaactgacaacatcaggtttatctccaggcagaaaccaacagaaacattaccttacctaagacagtaatgtgctgaaaagcagaatctaagttttagtagtatctttatacaatatctccagttattactgatcaaaagcctccacaaactacaaagagggcagtgtgctggggacagttaagaacacatctctgccctgtaagcatattcagtgagaaatttactgacctttaccccatattttacttttccagcataatgttttataatgaaagcaggctccatcacggctggaaattcgatgtaagaattatcttcatgttgatgcttaaacttgtctagcaatgtttgatttgtagcctgtggaaagctgaattaaaaaaaaaagaaaaaatatcattacagaaagatgagaaagatgcggtaattagtacagcccttttcaaagtacattacaattacattgccatcttacatagcagtttacaaaagttttcacctatattatctaacctgattctcataacaagctaaaaagtaataataaatattggtgttactattttatagatgagggatcaaaagttatgatttgcctgtactcatattttgcaagtagtagtaccaagaaattaactcattacatatttagcttagattgcagtgttctgaactactataaaacccaaaggaaaataaaatccaaatcatatactctttggggccaacaacttccaaataagagaataatatctcgattctcataggtactaaaaatccataagaattatttgacttcctgttcctacatgcataaataagtagccattttcttactataccaattatttgtactcattgattgtactgatcaactgagcacttaatatccaggaatcacacaaataatatctattatttaatcgcataataggaaatatggaaatacaaaagttcaaaagaggaaaaaaatcatcactggtgtaaataatgaaaaagttcacacaggacatagtaggtgttaagactgtgatgttaaaggttgggaagggtttcaaagagagaaaatatcattgacagaaaaaggagaaagaaagtttcagaaaatagcttcatttaatggtagctgaaataatgaaaaataatgtgacatgaggttgtaaagttgcttaatacaaatctaatgtgtaaaaatcattccaaaattacaacaaacatagttaattacatagtatgcattgcaaaccatacagagaatggcctttagcatcagataatcatagtttacattacgcattctatcagtgacctggggcaaactaggtaaccttctttgagaaggggtcttctaacccacaaaatgagataccagttatcacagtgccagtagaattaaataaaactagtaaaaacatctggcaaccgcaggcatcctctagggattaaacaaacatcgacttcatgttgccaacactgatattttcttggtcaccttgacctgcttttgtattcaaatatctcttcctcaaaacatctctaccatctagctcactccaaaactttaaagccattttacaatggaatataacttactatttcaaacagagacaacagcacagctcctataacagtctcaccaatcttctttcaagtcaccaaagcatattatcaaaataaattttcctataatagtgctttaatcatgtgccccctctgctccgaaatgtatagatcaccaaggcaaaaagacttgattccaagctccaaagcataggccagctcaacctctgcaaacttatatctcactacttcacagcagtgtgcctctcttaaggcaggatgctcacttcgtcgtctctaggtcagggtttatttgccttctaatcatctgagtaattgaaaagcttatgatatactttctcttacttttaaatggataatagaaattttcaaaggaaggaagatagacatgaaaacagtcattacttgaaactaaaaaagatggaaagttcctgcattcaacagacatgtatggatacttattacattaccaggcaaaaaaaaaaatttggaacacaagaaaatcattcattattgctcatatcaaagctcttcatctagtgttcctcaaacactatctggaagggtagcgtcaggagaacctctagagatttgaaaactaccaatgcctggatcccaactattgcaattctgacttaaatgattagggagatgacctagcatcagtggtatttacaaagtcccaaggtaattctcatgagcaggcaagattcacaaaatgctgccttaaatgaatgctctaatcctaacttcggttgttaaaatgtagattctgattcaacagatctggaatgaaagcttgagattctacatttctaacaagaatcaaagtggtccactgctgctgatagaagatgacactttgaatactatgggaagattgatactattcctaacatcctattcatatgtaactctgatacaatattcctccttcctaaatgccaccctacatcctacagaatctagctaaagtaacctgccccataacatacagccattaagtaggaaaggctaaaccaagacctctgattctaaacccatacacctagagcactacaaacacactgcatgaagaacacaactaaggatatatttgacattatatattccctataaaaaatatttttagagaaaaaatactcaatgtaagtcccaaaatagttcttcctacatgtgactaatttattttcaatctagtttttttacaggtaaatgggagagaaaaaaatatttcatgcctttgcatcttctggaatgttaaagcacagaaattctttacaaggacaggtaataactacaggactgactcataaaaaggttattcagtccagtatcctacctacaacaatacgctgacagatgatgcaaagtaattataataataggaaattacattaattgttaaagcagctgccaatcagctctaataattataaagttcttcattttattgagccagaatttatctccctgatatttatggccacatggctcaaccctcgtagctttcgggtaacagcaaataagtgacattctcggccgggcgcagtggctcacacctgtaatcccagcaatttgggaggctgaggcgggtggatcacaaggtcaggaggtcgagaccatcctggctaacacagtgaaaccccatctctactgaaaaaacacaaaaaaattagccgggcatgggggcgggcgcctgtagtcccagctgctcgggaggctgaggcagcagaatggcattaacccgggaagcagagcttgcagtgagctgagatcgtgccgctgcactccagcctgggcgacagagcgagactccgtatcagaaaaaattaaaaaaaaaaaaagaagtgacattctcattattgggttaaatctatgtgaagtagcaactggtcaggaaattatagtctttgtataataagatgtgcattcaatgaaattttgtttaaagaatgacaggacaggacaggcacagtgattctcatatgtaatcccagcactttgggaggctaaggtaggaggacagcttgagcccaggagtttgagaccagcctgggcaacaaagttgactccttgtctctaaaacaacattttaaaattagccagacgtggtggtatgtgcctgtagtcccagctactcaggaggctgaggcgagatcactcgagcccataaattcaaggcttcagtaagccataaccgcaccacggcattccagcctgagctacagagctagacactgtctcaaaaaaaaagaaaaaaaaagaaaaaaaaaaaacaaagtaattctactacctcagttgctgtttacaaacaccttaagatatataggacggaacatcatcatgtaccattgtcatttgccttctgcatacaagaaaactgaggactaaggatattatgagatctgccaagggtagttttgatatatacagttgtgatattataaataaataaatatatatatttatttttatatatataggttttcatccacggttcctggctcataactcctgcagcccttggtgtagtcttttgttataatgttggggtgctttaggcctcaggagcaggcctcaggaaacagaatctctctctctaaccttcttctgtcctccttttacctgcccaagggaggcctctaatatgattgccggttaaaagaccctcattccagaaagggtccctccccatattctgaaagaaaaaatgctgcacaagaagccaggaagaatctggacagacaggccttgctgggtttcccactcatgagatcatgttcttttgtccaatcacatttctacacagggtcaatagtgcctatgtaatgaagcctccataaaaacccaaaaggacagcacttagagagcttccagatagccgaacatatgggtgctcctggaaggtagagtgcccaggaaggacatggagactctctactccttcccccataccttgccctacacatctcttcattgtatcctttgcaatatcctttataatatactggggtaaatgtaagtaagtgtttccccaagttctgcaagccactccagcaaattaattgaactcaaggagaagctggttggtcagaagttctggaagagtagattattgactggtgtttgaaggtggggtggggtgcagttttggggactgagtcctcgatctgtgggatctgatgctacttccaggtagatagtatcaaatttgaattagaggacacccagttggtgtccactgcttgctggtggggaaaaccccacaaacgtttggtcacagatgtcttcatgttgattgttatggtgtgagagcagaggaaaacatggttttaatgtttttcccaaataactggtgtcagagaagtgagatttgctaaaaaggccctggctcactgaaacatgtggtttgggaagaaaaaggataaaagggtagaagatgagaaacctttgttctggtgtggccacatggtcacccaaggtatgaagccatagctgctatgctcggttattaaaggtaaaagttatcagtggaatttagagatggttccaactcctggggaattggttcactggctgcataaggaaatgcaaactaataagaaaaaaaatgaactggctgttataaataaatagccataaaactagctattataaataaataatcccttaattattgttatttataatagctaaaatgaaatttaaagagagtactgtgttggtccttgaagctggataaacctcagatcttggtctgtttgagctcaggctgctggcctcaaagccaccctccaaggacagaattgtgcaggggcaacaaagtacctctgagacatgtggttaccaagaaggtagtcaatgtggaaaaagggcaaaacgaagtaactgcaccccaccccaccttcagacaccagccaataattcatgcctccagaacttctgaccaaccagcttctccttgagttcaattaatttgcatagtgtgaaggaatagttccattttgtagattggtatcattagcttcctaaagaacctttactaaaatggattatgagagtaactacattaggggcagtagctttggtttaaatgctaccgtggaaaacatgtttgggttgatgtaggacacagggctcactactaagcaatctcagacatctatacatgattgagacacacaggacgttattcccaaggcaacagccagcatagtggactggataaaagccactgtatgatctttttactctggaaagggggattgcccaactttccctagaaatgccaagcagaacaacccagatgaagcagctgatatgcttcatatgcaagctacgtaagactagctttatgatgataaggatattcgcccaatgaatgtgtctgttatctacttacgaggttacagtaaatgctgtagttaagggggtcccttctacataggtccatgaaatgagcagatatgggggtactacagcagtgctgagaagcgctaaatctagacattcctcttacaccttctctcaagcacaaaatgccaataagaactgttctttttgtcagcaagagagtctgagacttccaatggctatgtggcagtttccttagtgggaagaccctgaatgtagaaggtaagtgagactgatgctggtagccctggggggctacaaatgaatgggtcttgacaggaatagtcaccgactctgaagtgagctttccttacccagtggaagatgcaaatgctcagagtgccatttaaaaaacaaacaaacaaacaaaaaccaaaaaacagaaaatatcgcatggatttggacaatcatcatcttttcagaacgagaaacacattgtacagcctaccatgtccaacaaagaggaaaaaaaaatcctcctcagagtaacagtttgatgaaggagtaggatgggcaattaaaacactggttgtctaaaacacaggaagataaaagaatgaagggctggcttgcatgctttcacgagtgtgtgctcacattcaacatgagtgggactaaaggagcatccccttagatttttcttgtttttctggttcatctgggaaagaggcggttggggaaggtgctggtatgactatccaattcttcccaagggaggagtacactggtataacaactataatttttttcttccccagatgacctcaaaaagaaaaaactttttttctctccgctaccagatgcagtggtcctaggacaagggctgcaactgcaagtgctggaagcagggatgatttctaagcaagaaactgtaactacatttttaaaccttaagtcaaaattcctaagggcataatgggggtgggttgtaccttcactctatctagcaaaattggggctaagagtgaatgcaactactacttttcctggccataaaaacagctcactagttctgcacccatgtaatttaccctatctaaaggggagtggactgaggaggaggtacttgctagactagagttgttgtctgcaatctaaaccagcacagtggcaattcttaatgtgccttccaaaggaggaaaagtttgggaactactggagaggaggaatagcagctgagggtaaagacaggaataaatgggttattcattgagggaaatccaacattacattaacacatttaaagaagctcagagcaagagatgacactgtctttaactcagttataagagatgctcaaaaggtaaaagttgtatgtttgcggagactgctcctgcttctggaatctgacaagactgaaaggaagcctgcaaacttgagtggtctctccctgggagacatattcatacaacatgataatgaactggactaattactaatgactgaatgggattctagtaatgtagcagtatgtttgagttgtatattcttttgatgatgtaaaggatccatgtttgaaagccagggcgtggcctatgacatgattttatcgtgtgtgtgtgtgtgtgtgtaggttttcgtccatggttcctgacttattaactaccacagccctttggcctatgacgtgattttatcgtgtgtgtgtgtgtgtgtgtgtgtgtgtgtgtgtgtgtaggttttcgtccatggttcctgacttattaactaccacagcccttggtgtagtcttttgttataatgttggggtgctttaggtctcaggagcaggtcacaggagtgctttaggtctcaggagcaggtcacaggagcaagcctcaggaaacagaatctttctctctaacctcctgtcttccttttacctgcccaaggcaggtctctaatctgattgtgaatcaaaagatcctcattccagaaagggtcctgccccatactctgaaggaaagaatgctgcacagagaggccaagaagaatctagacaaacaggccttactgggtttctcactcagtctattagtatgagatcatactctttttgtccaatcacatttctacacagttgtcagtaatgcctatgtaatgaagcctccataaaaaccccaaaaaagagcattcagagagattctgaatagctgaacatgtgggagttcctggagggtggtacacccagggaggacatggaggctctgtgctccttcccccacacctcgtcctacgcagctcctcattgtttcgttttccctgagttctgcaagctgctcgggcaaattaattgaactcaaggagaacctggttggtcagaagttctggaggcatggattacaggcgggggtctgaaggtggggtgaggtgcagttttggggactgagccctcgatctgtgggatctgatactacctccaggtagacagtgtcaaatctgaatagaggatacccagctggtgtccactgcttattagtggggaaaaaaccccacacatttggtcacagaagtcttctgtgttgattactgtggtgttagagtaaaggaaaaacacagtttgagagtttttctgtaacagtagttatagaaatgggatacaagtcctggacttctgactctaacacctaaatattacagggaagcaatataatacttcaaagcacaagcttattagtcagaaatacttgacaggtttgactctcaggtcctccatttcctacctatataatcttttttcttggattgtttcttaaactttcttttgttactataaaattccccaaacaaaaagaaatgctaatcattccattatcaaccacaacggttctcaacacggaatatcaaaatcacctataaagccttcccaaataaacatataccagaggtagggtatacaaacagtgaattacaaaccttacaattttatgagagacaataattatgttggggcatatagagtaatgcaagaaacttttacaaaactctggacagaaaattaaggtactttttacttgtgttaacagcattttaatttctttagattaatggaagttgactagtgatagagtaggtcagagtgacactaaactgttagcagtcttctttctgttagctttttattctaccaccttacacaatcatcttacctctaatagtaaatcctcaatactttctatcttgtctaatgaatattaaactagaaatcaggtaaataaattcaatttctaaattttttactaaacagtcataaaaacctcacaaccacctcatctcagtttctccaaatctagatttgccatctcttaggataatcaactgtattttatacattgttgagaatactctgaagaatgctacataaagcattatttctgaagcatatatttaactcagttatattgaacagtgttatcaaggaatagtaaataactggcagatgttgccacttacactgcacgatcatggcagacattactaatttaccataacattcttttttctgttttgtttttttggagacaaagtcttgctctgtcgcccaggctggactatagtgcattggcgccatctcggctcactgcaacctctgcctcctgggttcaagcggttctcatgcctcagcctcctaagtagctgggattacaggcctgcactactatgcccagctaattttcatattttcagcacagacaagatttcaccatgttggccaggctggtctcgaactcctggcctcaagtgctcctcccgccttggcatcccaaagtgttgagattacagacataagccaccacgtttggcctatcacgatattcttttctgctaaacatgaaaactacaaacacatctcatacatgaagctcaatttacaaagaaagaaacatgtaaccaaaaaaaaaagtcaacaagtttgacatcaaggtgtattgaataaatctagaagaacttaagaaaaaaatgaattcaagtaatgaagcccatcctaattacctagaaacacacagatataaaaaaaaattgtggccacacgcggtggctcacgcctgtaatcccagcactttgggaggccaaggcaggtggatcatgaggtcaggcgatcgagaccatcctggctaacacggtgaaaccccgtctgtactaaaaatacaaaaaattagccaggcatggtggcgggcacctgtagtcccagctactttggaggctaaggcaggagaatggcgtgaacccaggaggtggaggttgcaatgagccgagatggggccaatgcactccagcctgggtgacagatcaagactccgtctcaaaaataaataaaaaaataaattgtacaaaaaaaatttggctctttatttggtaatgtaagaaaaaagtttaaacttaaaaggagataaaaagccaaaacagccaataacaaaattgaaaagaatcacactcacttgctttcttcatccaaaagatgaagcagtcctgttggttttttgctaataagatttatgcagcaggtattatcaatgtaatctatgttgtgccagctgataccttcagttctatattcctcctagaaaaaccaaaaaataaaataacaatttattcatcttgcagaaaataggtatataatatagattgaaaagcttttaccctgcttaaaattctaagattttaaaaatcaccaatccacacaatgaaagaatgtataatttcagttgtacaaatcttaatacaacgtatttgttttctcttaaaaagacatgccacaaattttttttgttagaatgccagttctaagttcattctaatcaaaatgtagggctagatttgttttagtctcactacctgatgactccactaagtaaaaacgtacaatgaagaaaaaaggctaatatctcccacatgactttaagccatcaaaaagcactatatttcctggattatcaacaatgaatttaatgaaacaatttctgggaaaagtgggaccccatcaccctccagtaattatatggaattcatacacactaaactttggcaaaatataatctttaggactttttttttttttaaagaaaaggttttgaattctaaggttaaaaaactcgaggttcaggtcttgagtaactacttaaaatcatcttacaaagcgctccattttttcttattctttcctgtatggagatatattcttctattcatccttgtgatactttcactttttagatggtttttttaaggaaaaaatgcacctgagaatgtaaaggagatatgtttctgcactgcagtggtatttaggcatcaggtaaaatatcccatgtacctaattgttttagcattcacttacagtacttgcagcacaagtcaactgccaatctgcaaatagtgattttgaaattcttttttgttgttctttttgattttgaaattccatcattctttctgtattcattattatccagtaaagaagaatgaacactaacataaactatagttactctaactaggaaaggtaaatacttaattcttttcttttaattaacaatttcacacataagaaatagtcatataaaggtcactccccaatggcagtaagaaaggtatttccccccaattttttgcagcatgaaaaatatacacactagatagtatgagcttaatgatttttataggcattactagaagtccaaaagtcctcctcattatctcttcccaaggactatccaaaccctcctacccaaagtcagcttctaatacaatcaataagattcccctatttataaatagtatctaaatggaatcacataacacatactcattttgtctcttttcttttttcattcagctaatgtttcagagacacaaccattttgttggatgtacctgaagttcattcattttaattgcattgtgaaacaacacaatcactcagctacatattgtctatggctactttgtcaatgtaacagctgagttgagacatatggcccaaaaagccttaaaagatctggcccttatagaaaaagtgtgccaaactctgctacaaagcattagttctaaaactttaacatacaacggaatcacaagaacggcttgttaaaaaacaagagtattgggactccatccccagaatttctgcttaagtaggtatagagtacttagaattttcatttctaaaaaggttccaggtgatgctgatgctattattgaggagagagaaggaataaactttgagaatcactgctgtagagtattccattgtatctgtatacaataacttgttcacccattctacttttttctttttttttaagagacaggatctctctttgttgcccaggctggtctcgaactcctggcctcaagcaatctcaagcaatcctcccacaacactgggattataggcacaagtcaagccccactctactactgatagacactgctcttaattctaatatttggtcattaaaaataacgtcttatgaccatttccacacaaaacttttggtgtgcatttatacttatctttgagtgaaaacacaggattataaactacatgtttaaccacagcagataatgccaaacagcattctgatgtggttgtggcaatttacatacccaccccagcgtatgtccctatagacatatctctccaatactcgtattgtctgtctttttcattttagtcatttcggtgaatgcctactagtagctcattgtgattttagctttgatttccctgatgaataacaaagaaaaaacattttcctatgtttactgctcatttggatttccccttgtatgacgtgcttgtattcatgataaaaactcttggctgggcacagtgtctcacatctgtaattccaatgctttgggaggcctagctgggaagatcacttgaggccatgagtttgagactaaccaggacaacatattgagaccctgactctacaaaaataaagaaaaaaattagctgagcatggtggtatgcacctgtagtcccagctacttgggaggctgaggcaagacgacctcttgagcccaggagatcaagtctgcagtgagctatgattgcgccactgcactccaccctgggctgcagagcgagactctgtcttaaaaacaaaaaacaaacaaacaagcaaaactctcggaaaacattattgccttgttcttagtctcagaggaaaagcactcagtctttttcattcaataagatattagctgtattttgtagatgtcctttatcagaaaatcattttctactcctagtttaaaagaaaaaaaggaatagctacacagttttatcaactgctttttatatatctcgagataactgtgttttctccttatttattaacagatgattaaatggcttgattcagttaaatgtaaagcacatgctgaaaaaaaaatctccctttggttacaatgtattatccttttgtacatattgatggattttattaatgtttgtttagaatttttgtatctgtgtttatgagtgaaactgacctataatttccacttctaatatccttaacagatgtgtgtatcattgttatcctggccccctaaaatgtactgagaattgtccttttttctattccacctaacagcttatgtcagactgacactctttcttctttccatgttggtataatttacccgtggagccaccatggcttgcaatgttcttcagggaaaggttttaaattacatattcaatgtcattaatagttatagaaacagattttctatttcttctatgtcagttttgaaaagctcttttgttcgtatcatttgacaagtctattaacataaagttattcagtgtgtctatctttttaatatgtgtaggatccagagtaataccctctatcactgggattttggttatttatatccctctctctgtcttgtctctctctctctctctctctctctctctcagatgaattccttgaggggttcatcaatattattagccctttcaaagtattacttttggtttggttgatcctctcccatggtatatttgttttcacacttttattaatttcctcttttatctctattatttcattttctctactttcctctggtttagtttgctgatctttttcccaactgttgacagggatcactgattttaaacaaaaatcttctaagagctatgaaatgttcttctaagtatagctttaggcatttcccatagttttaatatgtaacgtgtcattaggtacaatatattttctaattgttcaacctctagcctatttagaattttttttttttttttttttttttttttttttgggacagagtctcactctgtcgcccaggctggagtgcagtggcccaatctcagctcactgcaagctccgcctcgcgggttcacaccattctcctgcctcaccctcctgagtagctgggactacaggggcctgccaccatgcctggctaacttttttgtatttttagtaaagacggggtttcaccgtgttagccaggatggtctcgatatcctgacctcgtgatctgcccacctcagcctcccaaagtgctgggattacaggcgtgagccaccgtgcccagcctagaatatttcttaatttttaatcatataggtatttttcagttattttttagttactgatttcaggtataattttattatggtattaaaatctgtgtcatttcaatccttggaaatctgactttcgctttatggtccaggatataaacaaattttgtaaatatcccacgcaaacttgaaaaaaaagtgcattctgcagctgttgatgcagtgttctatgcatatcagttatatatttgatttttaaatcttctatatccttaattgattaggtttcaggcctaagggcaggaaactgacattctgctctgaaggacagtcagtgatggatgcccacaaaggcactaatctcatcttctagatattttaaatcttctgtatccttaccaactttttgaacacttattctatcagcaagtcagcatggtatgttaaaacattccactatgatggtaaatatatttttcttttttgagttttattcattattgctttatatattttgaggttctgctatcaggtgcttataaattttggactgtatactacttcccaaggaagtgaataatgctaaagggtaacattattaaatattcctttttatctctagtaatgcttgaaatatgatattaatatagctacaactgctttttttcttaaggtttactaaatctttgctcatccttttaatctttctatatacttatatttaaaatgtctctcataagcaacaatcagtttagttttgtattatatctagtctgacaatctttagcttctagttagagcaatgaatcaattatatttaatgtaatcactaatatttgtgagattaaatcaaacaccttactacttgttctttgactttcatggcattccttttatttcttgctttcttctggattgagtgttcttattttacttatcctctgtattttttttcaagttttatattattttactatttttggcaattctagaaaacatgtatccttaacttatcactaacagaaataatatctctgtaacttagcatttaatacaaagatcttagagtatcttaaattctatttactcctaacttatatgctattactgtcatgtattttagttacatttaaacattaaatagttttttattttttttatttcttttttttttttttttttttttttgagatggagtctcgctctgtcacccaggatggagtgcaatagcgtgatctcagctcactggaacttccgcgaacccttcccagctacaagcaattctcctgcctcagcctcctgagtagctgggattgcaggcggctgccaccacgccctgctaatttttgtagttttagtagagtcggggtttcaccatgttggccaggctggtctcacactcctgacctcaggtgatccacctgcctcagcctcccaaagtgctgggattacaggcgtgagccaccacgcccagcctaaatagttctatttaagccataaaagttatttttaactttgcctcattaatattcatttagattcaacgacttttttataattttcattgctcttcattccttcctgtacctgagctacaataggaaacaacttgctgcctaaacaatataccttggttttaaggaaaatatgccattgtctcctagcttccactatttccactgaaaggctgactgccaagtcttattgttgtatctttaaagatagagatgtccctgacttacgatgattcaactttacaatggggtgaaactgtcataatttctgcagactttatctttgcctaggctggtgatatgtggtacatgagatattcaacatttttactataaaataggtattgtgttagatgattttgcccaactgtaggctaatgtaagtgttctgagcacatttaatgtcctgcacatttaaggtaggctatgtcaagttatgatgcttggtagtttagatgcattaaatgcatttttgacttaaaatattttcagcttggcaaggagcaactgtagtctctggtttcctctagctgctttttagacttttttcattgtctttggtttagtataattttctaggtataaatatctttgtatttaacatgccttggattcttaaagagcttttcaaatgtatgcttgttgggtttgtttttttgttttgacagttttggaacattctcaaccattatgtcttcaaacacggcttctaacttattctacgtctctcatacacatctttccaaaattcctatggcacatgttagacctttttactatgctcttagagtataagtctctttcttatcttcattcattaggctcagtattttcttctggtctatcttccaatttactaattttactaacctgtatcttactattaaaaaccatctgtgtcttttcaatttcacagtactttttagttctaggttttccccaatttgggatttttaaaagtaatttgtagttctttaataaaaatattgcaccttattttttaaaatttcttgaaagcatggttagtttccagtccatgtctagtgctaatatcattggctggatccactgtggtattattatctcatttctcttgggatattttgttgttgttgttgagacgcaatctcactctgtcactcaggctgcagtgcagtggtacaaactcagctcactgcaacctccgcctcctgggttcaagcaattctcctccctcagcctcttgtatagctgggattacaggcatgtgccaccaagcccagctaatttttgtatttttagtaaagatggggtttcaccatgttgaccaggctggtcttgaactcctgacctcaagtgatccacctgcctcagccccctaaagtgctgggattacagacgtgagccaccatgcccggccacatttctcgtggtttttattcatgctggtttgcctccatgtatgtctttatgtctctgtctgtctctctctctctctgttttggactgagtgttagatcctgtatatgaaaaattataaagataattttagcagttggatgatgtcttcttctggtggagattgtatttgctcttggcaggtggttaagaatactacaaattgtattttaacctaattgggaactgagatgattttaaactgggcttcagtccttctgatgccaggtttacttctgatttacttttgtctgagatgtaaccctttagggatctcaacctaaagcctataggaattaccaagggcctcctccttatttttgagtcagaagaaaaccctgctcaattcctcatactctcaagcctggcccttttagaatcagaaacactacaaaaataacgaaatgtctctaggaacaaagcagcacccaaatgctgggctcacttccctagatttctttcttatagtctaggccctgtaaaacttatttgaaggtactccaatgccttcaaatatatgttgttgaagttttttggttgttctccaaggtaaggttcatcaaaagtttctagtctgacaacaacaagtaaaatggatgaaacaaaaacttgctagattatgagctcctcaaataagatccctgcactctaaattttctatcttctatgcttagcacactgcctggcacacaactgttgttcaatttactgatgaatcaatcaaatgaagagtaattctcagcaagtaaggaaaagaaaaaagagggcagtaatacaagtaacagaaaacatacaattggccctccatatctgcaaaagtttccacatttgtagatccaaccgaccacatatcaaaaatatttagagaaaaaaatgcaaaaaatataaacttagaaacagtatagcaactatttacataccatttacagtgtattaagtataagaaactgagagatgatctaaagtatactggagaatgtgcataggttatgtgcaaatactatgccattttacataagggacttgagcatctgtggattttggtattcttcagcagggggtcctgaaaccaatcccctgtggatacccagggatggctgtactttcaaatatcagaaacctctttgggtctgtctcttagtctacattacagtctctaccactaccttgattcagttcagaatcactcacccattctacagtcatgtgccacacaaacacatttcagtcaagaaccaactgcatatacaacagggatccctaatctcacgaaaaattcatattatctactgacgtcttgatcctgaccctgtgtaggcctatgctaatatgctatggtaatatgtatgtatacatgctaacatgtatgtatgtgtctttgcttttaacaaaaaagtttttaaagttttaaaaaattttaatagaaagagggcttataattatataaagagaaaacatttttgtacagctgtacaatgtgtttgtgttttaaatggctactacaaaagtcaaaaagttaaaaaagtttataaagtaaaaacattacagtaggctcaggttaatttattacaaaaaaattaataaatttagtgtaacttaagtgtacagtgtttataaagtctaactagtgtgtgtacagtaatgtcctaggcctttatcaccactcacccaacatctcacccagagtaacctccagtcctgcaagctctaatcatgggaggtgccctatgtaactgtactattttttatcttttatattgtatttttactgtatcttttctatgtttagatacatttagatacacaaatacttaccattgtgttgcagttgcctacaatattcagtgtagcatgctgtacaggtttgtggcctaggagcaataggctatatcatatagcctaggtgtgtaggaggctataccaactaggtttgtgtaaatacaggatgatgttcatacaacagcaaaatcacctaatgatgcatttctcagaacatatcctcatcattaagtgacacatgacagtacttcaactagttcatagatttttctccttctttccagttcactgctcttcagttcaattcaagtcctctgctaaatatacttcaaatagcttctcattgtctgaaaaattctaatcttccctgcatgacatataagtccactgttttaagtacaatgtgtataatgttacctttgcctaaaatatcttttcccattgacaatctagtgagcttcagctcactatttgaaattatatgccagaatcaaccctggaaaatttttgcagcctttcaggtagttccaatcaaccccatcctttgtgtaactactttaccttatatctgattatagcatttacatcctgcatggcaattattacatctctctcccatcctatatgcctatgtactccttttggacaaaatttagaaccaaaccacagtcatcatattgaagatttttcctacaaatgtacctgtgatactgtaccttctttttaaaaattttaaccttaacttattttatactcaactgaacttaacaagtaatcactgagtacccatttcataccagttaccaatgaggtacatataaataagacacttaacaagattctgatccataattgcaccacattgcccaaaatgctgacattcagggtagcaagtaaatgagaatcacccatcttccaagtagttttgaacacattttccataaactctaaggttttttatttttatatataatacgtttatggccaaggcatttcttctggctgtctaatctagacttctagaaaagaataatttcagtttacaataaagaatgtttgtctttttcaaaatcaatttaaccaatgttctgtttaatgatccacagagcaactgatgttctgctctgtaaaatatagaacccagaaaactaaatgcattccctcacccttctaacacatgtacttatttgcaagagataaagaatattaacttagtatgatttatgtaagagttttggactgattcaatagacatggatggcaatcccagcttagcttttgattaaaagaaaatattatagagccagagtgttaaggtttgaatactggctttagacaacatctgaaaaactagaataaaaacagtactgactgataagtaacactacataactcgtaagtgttagctaatattataacaaataatatctttccaaagctctagggtagcatctagctaacagattatatgtttaaaactttaagcattcatcaagttggccaggactaatattgtcatgctattgttaaccagccattatgtcctttaagcaaaatagaggcacttttttaaaaagctaagacagcaacaagatccaatgataggagacttgatgatataaagatcttttctccctcttttctgtagacctgctagctgttgtagtctttctgttcattctctattcttaactatttcccttgagttcagtttgatgaaacctgtgtctgcctatgtcctcatacacaaattctggggtacaatgtaaacctattactgatttcaaccttagtttggagaaaaagtccacattttgtttgcccctccctttgcactaataattttcatggaaactgaaagcccactcttttttttgagatagagtctcactctgtcacccaggctggagtacagtggcgcaatctcggctcactgcaacctacgccgcccacattcaggtgattctcctgcctcagcctccttagtagctgggattacaggctcctgtcaccacacacggctaatttttgtatttttagtagagatggggtttcaccatgttggtcagcctggtctcaaactcctgacctcgtccgcccacctcggcctcccatagtgctgggattacaggtgtgagccaccactcccagccaaaagcacactctttttatactaacttaatcaatcttgagatcctcataagaaatatctagttacccatcttggtctctccatacctagtttctttgtatctacactctgtactgacttgagattctgttaagctcctctatctcatcctagaactaagagaccaaagcaatcaaacaagcatacagttggccctccatatcctcgagggattggttccaggactccctgtggataccaaatccacagatgcgcaagtctcttatataaaatggcttagtacagtcagccctctgtatatgcaggtttgtatcagtagttttgtatcagccatgggttgaatgcttggatgtaaaacccaaagataaggaggactgactgactgtacttagcattacacacagtgaccaagcccatggtagcaattaaaaatcaacaccattgtttccaaacccctgtgtgaaagaaaaagaaaaaagaaaaaaacaatcaacaccagcaataaaaacaaaacaaaacacacacacacatctttttaatcaaaggttcattcaaggccaggagtggtagttcctgactgtaatcccagcactttgggaggtcaaggtgggaggactgcttgagcctaagagtttgagaccagtctgggcaacatagtgacaccttgtctctacaaaaaataaaaacaaaaattagttgggtgtggtgacgtgcacctgtggtcccagctcttgagtggctgaggtggggggactccttaagccccagaggtcgacacagtgagccaagatcacgccactgtacttcagcttgggcgacagagcaagaagacccatctctaaaaaaacacactcccctgcaaaaacaacaaaggtgcaatcaaataagcatatataagcaatttttttttttttttgagacagtctcattctgttgcccagtctggcatgcagtggctcaaacacagctcactgcaacatacacctcccaggctcaggtgatcctcccacctgagtctcctgagtagctgggacaactggcatgcaataccacatctggttaatttttatattttttgtacagacagggtttcgccatgctgcccaggctggtctctaactcctgggctcaagagatccacccaccttggcctcccaaaatgctgggattgtcagcttgagccaccatgcccagccagcaaatctatttagggaactataaaacctctgtcatctgcttacaatgatatgtggaccacaatatttgtattgaaagacaagatttaggctgggcgcagtggctcacatctataatcccagcactttgggaggctgaggcgggtggatcacgaggtcaggagatcgagaccatcctggctaacacagtgaaaccccatctctactaaaaatacaaaaaaattagccgggcatggtggcgggcacctgtagtcccagctactcggggaggctgagccaggaggctggcatgaacccgcgaggcggagcttgcagtgagccgagattgggccactgcactccagcctgggcgacagagcgagactcagtcaaaaaaaaaaaaaaaagacaagatttaaaatgcttattatgtgctctccactcttttagtaaaatatcacaactgatattatgataaacaattgaagctaccagactactctgttttatctcacatttctaatcccatcagttgagtttacataaacaaagaggcaacggtatttgttcccaagccaatttacttcggttattcttgtttgtaaaggcacgtttcaatatttaataaaaacactatgtaaatcaataaaatgtgtgaaaaaatgaagtgaattattatgaatatgactcaaagatatgtgtgatggggggacaagtgtatacatatttaggtactcacttgttccaatttaaagatatgctgattaaagtagtgctgtaaacgttcattagcaaaattaatacagaactgttcaaagctgttattttcataatcttcaaacccaaaaatatcaagaacaccaatagacaatgtctgtaaaacaagagaaagttttgattaaaagtaatgtttaaatttatttaatgaataatatccacaacataagtaacaaaatgctcaattcctctaaagcagtgtacaggggattgtgtttggccagtattcaaaacatatcatgacttaaaagtattttagttatctttatcttacttttatcctaattaaaaaaatatatccaaactgttaatacatataatctatagattacagaaatatgtgaagcaaggttagtggccttttatcttaagaaacctcagaaatccctaacatcttaaagggaatggaaaaaaacagagggtgaggaaatcaaaaggttatttcaatgaaggatcaagagaggtaggttactcctggctataccaagaggacaatgcaatttttcctatttcgacttctacatcccaataaatagaattcttcattaagaaccaaactagtatattttatcagcctcatgaagactgagtgaaactagatgtcagaacgtatggtttcttttttatttttgagacggagtctcgatctgtcgcccaggctggagtacagtgacgtgatctcagttcactgtaacctctgccaccggggttcatgcgattctcttgcctcagcctcaccagcagctgggtttaccatggcatgcaccaccattctggctaattttttgtatttttggtagagactggtttcaccacgttggccggtctggtatcaaactcctgagtgcaggtgatccacccgcctcggcctcccaaagtgctgggattacaggcgtgagccaccgtgcccggccagaacatacggtttcgtaaagttaaaaatatttattaaaaaaaaaaagtatgaggtttaaaatgttgaatagtgctaaaaggattacaacaaaagacagcaatccctgcctcatcatcaagatctgctccctaaagtcaaccacattcaaatctttcagctgtttggtagaatacagaacataaatgcttatattcttctattgcacttctaggaataatctaacttcttactgtggatttggctctaatacctgcatatgaacacttttctcaccaccccaacccattctagaaatacagttgtatgacaattttggttaaatgaaaataatttttctccactggtgctaagagatacaacgggcaaactgatatgatgaatgaaaaatagtaagatcttttttaaaagcctgtactaagagtattttgtttaattctgctaagtctaggcccttaaaaaaattaaaataatgcccttcaaaaataaatcaatttgataaattagattacaatttaaattaatttttatgactgtgagtttacctgaagcatgaaaaattaacataagagcaatttcacatttaaggcaataggattaaatttaaaaggtgacatttttaatcagtctgacaaggtggactagtccatgaaggctgcccagaaaacacaactagatgtgaaatgattaaatacctataatctgccatattaaaaatatagttagaaaaagtctaaacataaaaaaattataattataaaaatataagaataaatattttataatcttgggctagaagaggccttcctctgtaagtaaaatacatatacaaaatgcaaaactaaaaacaagaaaaatgacagaattaactgcaaaaaaattacaacataaaatcagaaaaagatggtataaataaatctaaaaagtaaataactaagagagaaaataattgcaatatatatcaaactataggcctccacaaatatccacaataaatgccttctaaaaaggagtaggccaggcctggtggctcacgcctgtaatcccagcactttgggaggccaagaagggcaggtcacttgaggtcaggtgttcgagaccagcctggccaacatggtgaaacccatctcaactaaaaatacaaaaattagccaggcattgtggcacgcgcctataatcccaggtacttgggaggctgaggcaggagaatcacttgaacccaggagacggaggttgcaatgagccaagatcataccactgtactccagcttgggcaaaaaaaatgagacactgtctcaaaaataaaattaaatttaaaataaaataaaaataaaaaggagtatcaaaaagacaaaacagaagacaaaaataacacaaagttattttaaaaatacagagaagaaataaaatagcgaaaacatgaggtgatgcagaacttttatctatcattaaaaataatgcaataaaatgaaaccattccccttatcagattaggagatgtaaatcctgataacatccaatgtgggtaaaggtgtaggggatcaggtgctttcacacactgctgctggaaatgtacagtcttttttggaaagtgtcaaattttcaaaatgtatctatccttaaacttagcaatcggcagggcacggtggctcacgcctgtaatcgcagcactttgggagaccaaagcagatgaatcacctgaggtcaagagttcaagaccagcctggccaacacggtgagaccctgtctctactaaaaatacaaaaatgagctgggtgtggtggtgggcacccataatcccagctactcaggaggctgaggcaggagaatcgcttgaaccggaggttgtagcgagatcatgccactgcactccagcctgggtgagagcaagacaccgtctcaaaaaaaaaaaaaaaaacagcaatcccactttgataatgttatcctagagaaatgtatacacaggtaagtaaaagaatatttgttacagcattgtttataacaataaaacaaaatctatttttaatggatggatttatggtacacatcttactatatatttataactttttttaaatagccaggtccagatatataatgagacagaaaatatttcaagagattctaggtaaaaaaaatacatatatttatgtttgaaagaatacagagagcatgattctatttacattttttaaagcaactctgaatatacacgttcgggaggtaaaaacacataataaaaaaggtctggaaagacacacagaacaattcttctgaacagggtaataaataacaaataaaagcgatttcttacttattactctatataattctgtgtttttaaatttcatgtattaaccagtttattaaaatagctttcagggaaaaacatattataatccaatatatcattaccttggtattatgctctaaatctttactattcagaagtgcatgattaattcgaaaaactatccagtcaaacagggcactatacagagacttagccatggagttcctcactgtcacagcctgaaaaacaaaagcattacaagtgcatgtagaattgacaatgattaagatactatgacaaagttgtttgctcccattcaagaaagaaacttactatcctgaattagaaatgaatttttctctcaaaataaaaaatctataactaaagttttttgtttgtttgtttttgagagtttggctctcattggccacgctggaatgcaatggtgcaatctcggctcatggcagcctccgtctcctgggttcaagtgattctactgcctcagcttcccacgtagctgggattacaggcatgcaccaccacgcctggctaattttgtatttttagtagaaacggggtttctccatgttggtcaggctggtctcaaattcctgacctcaggtgattcacccgtcttggcctcccaaagtgctgggattacaggcgtgagccaccgcacccagccaattgaagttttccacatgtactcattcaattagtcccactcaaagaatctacgttaaaactgccattaaagataagagaaacaaaatgtaggtcactcagttcaaaacatgtttattaaaaattgggatatatattccccctaggaaagaaggtataattggaagtttacaaacaaatgactttgccagttacagtaggtaagagtattctaggcagaggaataaatctgttaggaaaaagccattaatttctgtggaatcctaatcaccctcttaaaacatacactaatacaaccacaattacattggtagttgtcttcggcttgtcacccatagaaacttctagaattactccatcctcaaagacagcaacaattccctcattatgtagttacaaaatttattttttcctcactctaagctttccaagtttatgaaaattctcaatactatctgctctattttcctgtaagtctgaaattgttcttaaaaaacaaagaatttcaccatttagaaagcataaatttacaaaaaaaaaaaaagggagtagagtatggcacatgtcttacagaactgagtcttagcacttagaagaatataaatcctagtaatttacatatttattatctaggggcttattctgaagcttgtatattcaggtacatatttataactccattttgaagtataaagaaaatagtaataattaagaactagagtatcttccaattccagtttttctacttattctagctgcataatcatgactaagttacttaacctcttaggctactggttatacatctataaaaagaaggtaatactacaacctaccacataggtgatgaattaatttctgaatattgaaggaaaaaaaaagcttcaagttcctagaccaaaaaataactgcctacatagcagaaagaagactggtaccaaattctctatcttcaacactagaaacctgtattattttttattgttgtggagttttagaatatttttaatgtgcaaatggttgaatccttggatgtggaatctgtgcataaggtgaaccaactatcaagaaaaccaatggcagaatgaaaatataacagaataccactgtatttttttccccagaaagaaaagaaaaatgaagataatctaataaaattcaggaaaagtacaatattttaaaactaaatcaacaaatataagacatagaataagcatataaacattatcacaataaattttatgaatgggttgaattttttagttaaaagaccttcagacaaagataaaaactaaagtctaactacagtatttatggtttacataatgtaccatttttataaaataccatagtcatagaatccagataggccaatacgatacctatttgtttactctgtaactccaaattttatactttcagcccttttctctgaaatgcatgtctgtctttcatagcttaacctcaataaacccaaatatcaagtaatattttcccacccaaacaagatctcatttagtgtttcctatgtcattgaagggtaccaatattcttacagctgtgtaaaccagaaatgcaggactcatccttgacacctcctttgtttgccttgcttcccattattcaagtcattactaggtcctgctgatttaatcaaatttttttctttttaaatccatacatttctccctatcaatatgtcaccattctgcaaagcaaatatcattctcactaccgcagcctccgaactcatctctctacatccactcctgccttctgtgcttgaccaaaacccaagatagcccacaagattccctgggggtacaagttctatataattccctcctcataagtgtaggcagaactgtaaatacgatggatttcactcccatatgaaactgatgtcacatgataaaaatgaaaggattttaaagatataaaaacccaaaccagtttattttttaatcaaagggagatcaccccagacttatgacccatggaaactgccaagatattaagtctgtattatattaagttgctaagttgcttacatagctgtaaaaaactaatacattcctccaaatggttctaaacacatctgccagagtgctccttttaaaacaaaaaaacaaattaagatttttttttcttaaaacactttaagagctttgcattacccttcagataaaatactaaaactgtttagtactgttccccatagtacccctaatgctttgcacatttctcggcacaaaaatagagtttttatatatttattaaagaaataacagccgggcgtggtggctcacgcctgtaatcccaaaactttggaaggccaaggcaggtgatcacaagggcaggagttcgagatcagcctgaccaacatggtgaaaccccatctctactaaaaataccaaaaattagctgggcatggtggcgggcgcctgtaatcccagctactcgggaggctgaagcaggagaatcacttgaacccaagaggcagaggttgcagtgagcgagatcacaccactgcactccagcccaggtaagagtgcgagactcgtctcaaaaaaaataaatgaatacaccaaacaaaaataaacaaaaaaaaagtagggaatacaaaataatctcagaaggttacattcaaagttaaaaatgaaaataaatactaaaaaaaatttgtaatgaaaaaggtggtgtggtcattagagaaacgcaaatcaaaaccacaatgagataccatctcacgtgagtcacaatggctattgttaaaaagtcagaaaaacgacagatgctggtgaggttgtggataaaaagaaacatttatacactgttggagggagtgtaaattatttcaaccattggggaagacagtgtggcaattcctcaaggacctaaaagtaaaactactattcaacccagtaatccaattactgggcatatatccaaaggaatagaaatcattctatcataaagacacatccacgtatatgctcactgcagcactattcacaatagcaaagacatggaatcaacctaaatgctcatcaatgacacactggataaataaatgtggtacttatacaccgtggaatacaatgcagcataaataagaagaaaaccacgtcctttgcaggaatttggatgaagctggagaccattatccattgcaaactaacgcaggaacagaaaaccaaacacagcatgttctcacttctaagtggaaactaaatgatgagaacacacggagacataaagggggtgacagagaatgggaggagggagaggatcaggaaaagtaactaacgggtagtaggcttaatacctgggtgacgaaataatctctacaacaaacccccatgacacaagtttacctatataacaaacctgcactataccccggaacttaaaagttaaattttttaaaagaagaaaaaggtagtgaaagaaaatgtaaaaagcaatgaatctttattttatataaaagaaatataaaactcttaaagatttggctttcttttttttttttgtctttttttttctttttattattattattacacttttaagtattagggtacatgtgcacaatgtgcaggttagttacatatgtatacatgtgccatgctggcgtgttgcacccattaactcgtcatttagcattagggatatctcctaatgctatccctccccgcttcccccaccgcacaacagtccccagagtgtgatgttccccttcctgtgtccatgtgttctcattgttcaattcccatctatgagtgagaacgtgcggtgttcggttttttgtccttgcgatagtttactgagaatgatgatttccaatttcacccatgtccctacaaaggacatgaactcatcattttttatggctgcatagtattccatggtgtgtatgtgccacattttcttaatccagtctatcaatgtccaacaaagatttggctttcttttcatttagaaagaagctctcacagtggaagactataatatgacataagaagaaatgtggacttggagatacagaaggtgagataaatggatcaatgtcaagcttaaaaaacattctctagaattcaatcacaatttcctcacctgtcttctaatcttctaatttcatattcctgtccaatttttataattataataatttgacttgacatcactttcataaaactactccacaaagtagcagcttttcaataattttcctgcccctatagatctgagtggtataatagtagcaacaagtatccctaggagcctcagtatacagatggtatttaaagtgatgggactgggtaagataacctcaatgaagaatatagagaagaagaaacaaagactgcgtcctagggtactctaccttttagagataaagaaaaaaaaatacaagcagaaagaactgcaaacaagtagccaacaatgaaaaagttaaccaaaaaagtatgatgtgctagaagaaactgtctcaagaagaataattaattgggtcaaatattgctcatttataattctacctaccatctatctaccccacattagtaatatgaaaattggaaatgatgaagaggttaagatccttggagaaaaatgcaagcctatttctcacaatcacattcaaatttaagtttctaaatcaatggaaaattcacaatcaaatgtaaaggcctagaaaatatttcaatcaaaactttttgccattgtcattttcatgctgttaagagaaaacccaaacttcaaacctaaacttctaacaatgtccagaatgctttcatttcaaagaaaatccatcatacctctgccaacttgtatggcaaaataagcttttctcccactgtcaccgtcttccttgtaactaatgcttcaaatagcatctcttctttaacctataaaacagaaaagtaaactcaatatgtaagatttatgacaataggttgaattatcttttgaaaaagccaaatagaggaggaaaagcttaatgagattagcaattacatagcagagaaaaaaggcaatacactgggcaattttaatactggccaaatggaatttaagtgtcccactcaaaagacaaatgggttttttcaagttaaagtttgctttctgatcataacagagaaacatgtttcattgtgcagaatacagaaaatatagaatagtataaaaaacattttaagatgatcaatcataatcccacatgctggaggcaaggactaaaaagtgacagcacttcttgaattccagaaatattccaaaggatatttatttatgtttcagatatttcttcttcatgaatcttgaattctaggaatattccaaaatatacttatgtttcagatatttcttcttattcatgaatgataaacttttaagataaagttgacacttcctttgttctcactctctccccagaggcaaatactatcatgaatttcacattatcatttcagttaatatttctacacttttacatgtattaaatatgttcataaacactatgctatactgtcaaatgactttaatgtttatctataaagtaccatattgcccatatgttcttcagatctaactatgtggataatttattattattattattttttgagacagagtttcactctgccattcaggctgcagtgcagtggtgcgatctcaattcattgcagcctcgaccgcccagattcaagcaatcctcccgcttcagcctcccaagcagctgggactacaggcacacaccatgtcgataatttaaatcaaccttattcattttaactgctacatagcattgcagcatataaatataccacagtgtgtaatccattctcctctttgtaggcatttacacgatttacaattttgtatgattagaaaataaaccacaatgaatattgttgcacatgagttcaaaagtttctgtgaagaacaaacctaaaagtagaaggttagagcatacatattttcagctttagagaatactaccaaactcctatatataatttttaccaatatgctctctcagcagtagcactgagagttcttatttcttccaaaccttgactatacttaatgttaccagaccttagaattttgtcatgatgatgggcatgaagtggtaaaacaaggacattttataaaagtatccatacataataaaaacataacattcataaatgtaggcaatataaaaatttatcaggtaaaaaatattagattataacagctgtgagtggtagctcacgactgtactcccagcacattaggaggccaaggtgggcggatcacttgaggtcaggagttcaagaacagcctggccaacatgggaaatcctgtcttgaccaaaaatacaaaaattagccagatgtggtggtgcacacctgtaatcacagctactcgggtggctgaggcaggagaatcacttgaaaccgggaggcagaagttgcagtgagccgagaccacaccactgcactccagcctaggagacagagtcagactccatctcaaaaaaaaaaaaaaaaaaaatagattataaggaggagattgagttataaaatgataggaagaggcattatcctgccaccaacaacatatgatagatcaataatcttttaaagaacaacttttaaccatactgaatggataaatattatctagcaaatataacacctttcagagcattcactgatcaactctcaaatttcaaaaactggaaataatttgaggcatattaacttcacaaaaacgcagtaaagccaaaaatcaacaatgaactttaaataaaaggcctcaaccttttagatttatttaaaatacattaaagaacaaaaatatcagattacacaaaaatgacaaaactaacaaagctaagaaaaaaaatgtaataaaatccaaagctatattgtgaggtatattgctgcaattattaaaagtaaatattggctgggtgaggtggctcacacctataatcccaaggcagtaggactgcttgagctcaggagttaaagaccaggttggacaacacagcaagacctcctctctactaaaaataaaatttaatgtgcctgaactcacaagtactcaggaggctgaggcgggaagattgtttgagcccaggagatcaaagctacagtgagccatgatcgtgccactgcatcccagcctggagctacaggcacatgccaccatgaccagctaatttttttttttttttttttagacagagttttacttttgttacccaggctggagtgcaatggcgcaatcctggctcaccgcaacctccgcctcccaggttcaagcaattcttctgcctcagcctcccgagtagctgggattagagacggggtttcatcatgttgcccaggcgggtcttgaactcctaaactcaaacaatccacctgccttggcctcccaaagtgctgggattacaggtgtgggccatcgtgcccagcctcataccatggactcttacacaacaacaaaaaagaagaatatagaatatagaaatcagcattgaaagatctcaaaaacatactatggaatgacaaaaagccaagtttcagaataatatatacagtgtaacatttatataaagaccgaaaacatgcaaaactatgtattctttataaaaacatctatctatactgaaaatatagaaacaagagtaggaatgatgaacaccaaattcacaacagtggttacctctggtggagacagggtacaagggtacacagtgggcttcaattatacacaatattttattacttgagtggggctgtaagggttgattatattgttttctatataatattgtgtgctggcaacatttcataacaaggaaaaaaggaagaaaatatcctaaaacaaattaatatgtaacaagtaaaatgttagaactgatcaatctaaagtccaactctttgaaaacatgaaagatggctgggcacagtggctcatgcctgtaatcccagcactttgggagaccgaggcgggaggatcaccttaagtcaggagttcgagaccagcctgaccaatatggagaaactccgtctctactaaaaatacaaaattagccgggtgtggtggtgtatgcctgtaatcccagctactcgggaggctgaggcaggagaatcgcttgaacctgggaggcagagattgtggtgagctgagatcgcaccattgcactgtagcctgggcaacaagagcaaaataccgtctcaaaaaaaaaaaaaagtaaaaaaaaaataaaagacaaatctcacacaaagcaaaagaaaaaaactaagaaacacaaatagctaataccatagagaaaaattttaaagagtgaaattaacagactatttacaaagaactcaaaagcaggccgggcgcggtggcccacgcctgtaaccccagcactttggaaggccgagacgggcagatcacaaggtcaggagatcgagaccatcctggctaacacggtgaaaccccgtctctactaaaaatacataaaaaaaaaaaattagccggacatggtggcaggcgcctgtagtcccagctattcgggaagctgaggcaggagaatggcgtgaacccaggaagcggagcttgcagtgagccgagattgcgccactgcactccagcctgggcgacagagcgagactccgtctcaaaaaaaaaaaaaaaaaataagaactcaaaagcaacaaattctaaatatccaatacatcatttttagaaaaacatagatcatccaaataactcaagccagatttgaaaatcctaaaaaattagttaaaaaggaacaaataaaagacatcaaatacagttgctcataaggctgacctctctcaaacccttgaggaacatattattctctgctaatgatccttctaattgcagaaaaaggagcaagggtacaaaaactctcaactcatttcatgagttctctttacctagcacaaaaacctgacaaagattgtacatagatctacgcatacccacacaaccccaaaacatactaatcttgcatatcatatttggtaaggatcctaaatattacccaattcacgattttttaatcagctcttctataattttctaaaaattcttaaatatattacttttagaatattcaaaaactattaatacagaacaagtagcaatgggttcaatatccattctacaaagcttctcatatttacctaattaaaaatctgatatgtaattaaaaatctattcttggccgggcacagtggctcacgcctgtaatcccaacactttgggaggccaaggcgggtggatcacctgaggtcaggagttcaagaccagcctgacaaacatggtgaaaccccatctttactaaaaatacaaaattagccgggcatggtggcgcatacctgtaatctcagctacctgggaggctgaggcaggagaatggcttggacccgggaggcagaggttgcagtgagccaagattgcaccactgcactccagcctgggcaacaacagcgaaactccatctcaaaaaaacaacaaaaaaaaaccctattctttatattgtttcaacagatgttaaaatatactcaaaatacataaacctgataaaaactgaacagtttttggtaatgatgatagttctaatatctcacaacaaaaacatcttccacaattacccacaatttatcaactggagcttgttcacctttcaataattttcacaagtatccatgccaaataggcattagtaaaggctcaaaacattcattattgcctcaggtaactacaaaaaaataactgaaaagtaaataaataaagttaaaccactactttaaaaacatttgttcctctattctatatttagcattggattaaatcaccatgggaaggagaggaattaaattaaatcacaactaaagagtctgaatgttaaataatccagtcaatgtgcttatctttgtactctatctcaaccaaagccttaagattgcaattattattatcagtcttaaccaactagaggcaatcattttctaaaataatttctaagtactaactaaagatgggataggtatcttctttagctcctgaactttgaagctattttctttctacttaatactaaacctcagccctagaaccaatccaaactatacacaagaagaaatttaagaagccagggttcaaaagtaagattttctgtcaaatcatatttgccatttgccattgtctttgatactggtttgcccaattctcagaattagatttctctcttttttttaaacctatagctgagttcctctttgagttgcctgaattgttcttatcagtctcttaccaaagaagaaatgatgcactagaaacagaagccctggtttctgctgaactgcctagacttataagtaagaccattagccacaatgccctgtcacaataccaaatgcttgactaaaatatcacctgaaatacctgactaaaatgccatctgttctctggcctttatgatcttcaaaattacaaccctcagataccacactccatctcctggtagaacttctttccagtaagtctagttccaattcaaggtactcccttcccctgcctcttcctctgccaggttatcattccactgaagttaataagcaatgcccaatcacgtacagaaaaaataaacgctgggtggttagataaataagaaagaggtatctattgctctcaaagagcactggagccttacaacagacacaaactaataattaactttatgctctaaaactaaattatgctacgtagaaacaaatgctctgtatttagggagtcagtttagaccacttaaggttaaaccacatgaagtggcctatgaaccaagatttggaagatgaataatattttttaaaaaagcaagttattcataactgtcaaaaactggaaacaaccaaaatgtccttcaacagataaatgaataaactatagcacatctatataatggaatattaccccgtaataaacagaaatgagctatcaagtcacagaaagacatgaatgaatcttttttttgtttctagagacagggtctcgctctgttacccaggctggagtgtagtggcacgatctaaggtcactgcaacctccgcctctggggttcaagcctcccacctcagcctaccaagcaactgggactacaggtacacgtcaccacgcccagctaatttttgtgttttttttttgttgttgttgttgttgtttttagtagagacagggtctccctatgttgcccaggctggtcttgaactcctagggttcaagcaactcacctgcctcagcctctcaatgtgctgggattgcaggcatgagccgccagacataaataaatcttaagtgcgtattactaagtaaaacaaatcagtctgaaaaatctacatattgcatgattcaattatattacatcctggaaagggcaaatctatatatctactaaaaagatcagtggttgccagcagtttagggggagggactgaacaggtaaagcacaggggatttttacggcagtgaaactattctgtatgatactataatagtggacatatgacttcttgcatctgtcaaaaaccaaatagcatgaagagtggaacttaatgtatgcaaatattaaaaattatttaagagattgggggattccacgaaggaatgtagaccatgacaagaaaacagcatgcatgacaaatatatgaaacctcaacaaatagggtggaaggaaaaggtgctgttctaagtaattttggaaatgagtgaagtctgcaggattaaaggcagaaggaattgctcataagcactgtattctagttgaaaaagtcatttcccagaggggtacaggttaacaattttgataccactatacatgtatactggaattaaacaaataagtaaatggatggcagaggacagaagacagctttctcactgttgaagcgggagttcacagataagcaagggaagaaggctagaatgatccacgtggggaatggattacagttggagacattatcatgaactcatgtttacctttatatagatacagatgattacatattaaaatatgtatagatacgtggatatacacaggttagtatatacacacatatatttccttgctatgccagacgatagggcctataagaaatgacaccccatctgatgggataaatctggcaagatgagaaggggtaggcaagagagaaattagctaagaaaacatgataaatcatcactccaggaagaaagaatcaggtaataaaggcccttgatgtaagaagaagcatggtaggagatgagaacctttatgtcctattcaacccataagggaaaaaaaaaaaagtagtatccttttttctccacccacccaaatacccccatcttgaaacaaaataatctaaccaaaatcttagtatgagaagaaatctcaaatatgaagagaaaaattagcatagtcccagaatattacagtccagtgtggaaatattcatcctatccagcaaatttagggactatggatgtctggagcaagtggaggcagaggagaaaacacaaattttataaagattctgccacatccaatagcaaactgaggcaggtatcaggaaaaattagatcttttggaaatgctatttaaaaatagtgcctaataaaagcattattaacagaaagcattaacccgtttacacctacaaaatacacaaaataaaaaataaaaagttacaaagatttgaaatgacaactgaaaatgtaatcactcacctctaataattctgagacaataggcagaacttcaggattacagatatcaatggagtcatcccggtatgtcttctttttgtaacagatattacccaaatgtagtatggctgagagaagagagaaaatcctgggaaaataaaacacaaattatagcttagttgtgtccattcccaaagctcatttcattctaaaattctagttaagcaaattaacctacaaatatgaagtatttagtctttggaaaataagcaatatgggaataattactaaaatttactgagggtttacttatatgtcaggtactgttcaaaatgcttttcatggccttaagtataccacttcttatatagtcatttcaaagggacttctgctattgcctgaatttgtcacagtgtttacagtgttttaaaaaggccatgcctctctaaatgctatttatcctgccaggaatgcttttttcctacactgtttcagatacactgaatcagaattgccaaaggaaaggccttgaatctgtattttttaaatcaagtatcctagctgattttttattattagttatgttgttaaaatgcttttctataccatagtatggtgtttgaggtaaatgggtgtgtgtgtgtgtgtgtgtgtgtgtgtgtgtgtgtgtgaatggggtaaatgggtgtgtgtgtgtgtgtatgtgtgtgtgtaagtatgaagccatgtggggtatattaacctctactgtgaaacaacttcatatggaccctccgttataaatttccctcctgagtcagaagagtatgtgccctccaatcaaaaactaatccctccacttatgctatatatcccatcaactcctgttaattcaggaaccttaggttaccaagtacctccatgtagctaagaacagtatattatgttattgacttatctgacatctcagaggcatttaacacagctaaacaatccactgaaaaactcttcctcagtctccttatatatatacagctttgtgtcacatgcagttattttcttagaataaatacggcttacaaaatttggcttatgaaaatttaacactatgttttcctaaaattaggaagtattccaactaaaacaaagatattgctttaggaacctgagatattaccttaggaacatttgagaggtactgaatcaccatctaacttataaatctaatttttcaaataatttaaagtttttaaatctttgaatcattcacgtgactcacaggaaatacaagtctattataaaaataattaataatgttattctggattaaagaataaactatcaactgaaacataaaaactaatggaagtcaaaagacaaaaacaaattcatgagcctcttttaaaaatgatttttaatagaaattcactaattttcattgaactgtagtttatgtcaccaattgagttggtatgccaacttacatattgtattatttgattttaattgacttctcataaaaagattctagtaaatagcctgctaattaaagagtcataccaatgatgtaagtgcaagcaaacaagaaaacaggagaggtgattttctcctactctcagtatagggtcatcaatcatgaggttaaaaattaacaacagagggcgggcgcagtggctcatgctggtaatcctagcactttcagaggtcaagaaaggcagatcacttgagcctaggaattcaagaccagcataggcaacatggcaaaaaaaaaaaatacaaaattagctgagtgtgatggtacaagcctgcagtcccaacttcttgggaagttgaggtgggaggatcatctgagcctggggaggttgaggctgcagtgagcactccagtctgggtgacagagtgagatgctgtctccaaaaaaaacaaagaaaaaaaaattaacaatataatcagatctgacatattcatcagcacgactctccccttcaaaaaagttataagtaactatttctttctggtgagagccaaggttgagtctttaattttaaataatttgtttcaaatataatttatctcatctttatctcaaatttttatatttttaaattgtttagatttacaattaaaaaacttaatagtatagtacagatataaactatacagaggaaatacactgaaaattaaatactatgcatctgataagtatgcataatttaataagattagagatcactgatatatacaaaatgaagagctataaaaatagtgttacaaagcaaaagttttaagtaaggtccatggataggcttcaggggcaccataaattcctgcatttatatgcaaattgttaaggatgtacattttacaacaacagtgtcagctttcatcagattctcaaaataatttatgataaaaaaaggaattagaaataatgctcgagatggatgaggtactagatgaagaataccacttagaaaactatttaaaaaggtcaacggcagaaatctttcaaagacatatcatgtgttctctattagagatataaaaatacaacaagtaaactcactgtcttcgtgtcttgggaagaaatcctaccatttccatggcaagttgtaggcgctcaaagtcatgtctcaaatcttctccttccaccgtgaagcaatcctgcttatttaaaataaaagtttaaaaatcaagattatatattttaaaataatgtgggccattcagaaatatggtaatttaggataggtacctgtatgtataaatgcaaattagagctggtagaatagtaagacctagtcaaattcattagacctcttatcttactacaggtatggaaactaaacacatacttactaaaataccaataagttacttttgttctccctttcacaatcaccaagattaggatttcaaaagttaacttaagataaagagttagctgtactcagtaagtgtgctgatactaagtttgattttgagtggttctaaagggtttcagaaattcaaagcatttacgggcgctcaattctaccagcaaatactatttattcaacaaatatttaacaagtgcctaccctatgtaaggcactgaactagatattagtgacacaaaaataaattttagaagaggcaataatttagttgaagagtgaaccccagatttacgtaatatagtttgttacatctatctaatctatatttatatagatctatatagatatgttattttttttttttaagacagggtctcattcctgttgctcaggctggagtacagtggcatgatcttggctcactgcagcttcgacctcccgggctcaggtgattctcccacctcagcctcccaagcaactggaactacccagctagtcctaccatgaccggttagttttttgtatttttaatagagacatggtttcaccacattgcccaggctagtcctgaactcccggactcaagcagtccacccacctaggcctcctaaagtgctagaattacaggcgtgagccactgtgcccagcctgttacatctacattagatatatacatatataattatttatatattttatatatgtaattatttcctaatgaaataacagacaacatggtaatcaaacaaggaaagaaagaagtatatgtgaaagtataaaaaccctcagaaaacacatcagatgagtcagtaaaactagttgtgaatagtcacacatgcctgtaatcccagctacttggaaggctgaggtaggaggattgcttgagctcaggagtttgagaccagcctgggcaacacgcatgacaccatctcaagaaaaaaaaaattgttgtggaataccagattaataaatactactttttaagcataatccttgcatttcagttcctaaaatagtcaaacagtggtagacatactctaaatcttcaaaacaataagtgagtcataaatctctttactgtaagttctcacagtcccttgcactttcaaaaacctcctcacatttgcatttacatttttaatgcctatcttcctagggaatattctctcaagtacttggtgaagtatatgaactgttaattgtcttattaactgcagatccccagtgcgaagtcagtgccaaaaacaagtcattatttaggtaaatacatagtcattgaattattgaataatatataaatattgaattgaatgaaacattcctttttcagaaataaagtgctcatttgttttataaaaagtatttatcaagtatttaccatgtacaagaaaatctgttttaggcactgtaagcattagttaatgaatatctaaagtttaaaataaagttttgaaatgctgttaccaatatttttattctctacatggaaagctacacatgcatagtttaaaaatttaaattcaccacaagtaaagttctttctgagaacccatgcatttaattttattactataaaattgctttcgataagcaattttaagacattctactgacatgccaatgtcctactcattaaaataatttttttttgagatggagtgtcgcacttgttgcccagctgctgtgcaatgacgcgatgtctgctcagtgcaacctctgcctcccgggttcaagcaattcccctgcctcagcttctcaagcagctgggattacaggtgcgtgccaccatgccaggctaattttcctatattttttagtagagacggggttttaccacattggccaggctggtctcaaactcctgacctcaggtgatccacccgcctcagcctcccaaagtgctgggattacaggagtaagccaccgtacccagccctaagataaatttttaaacacattcttcttttacctatagtaagtaaccttttgtaaaaagctctcttgctactcttccccctagtctcaaaacacaaacagttcattcactttatgatttaacaaatattttcctattacaagtggcaaggcagggggaatctatgcttccacatgtgtcaataatgattcttctaactaacagtgttctaatcttccccgaaagtgaatggaacaattaatgtatataaaatagtgggaaagtacactgaaagaggcactaaaatatgtttgtatttgctcttatccttaatcaaatgttcttagaaacccaaagtggtctcagtgaatatcaaaatcatagtttaaaaaaaatgtgtattaatttccttctctgtttctctgatgataactgtagaagaaaaactaaggataaattaaatctcccagaacagaaatgactttatcttaatttgggctccctgggaggcagatcttgagacagaccaagagtcaaatacaagtcacagagaaagtgagaaagtaaaagagaagacagactaaacagtctgtgctaactactatgaaagtagttaaatggagtttaatcccaaggttatctctgggaaacaatataaaacctacagaggtgagggagctactgtatttatttatataccatctcatctctcatcagtcattgtttgaagacttctggagagggagcaggcagctgttaattcccaagtcacttctagagggccctacaaatgccaaggccttccagggttctggaaaaagccttcaggccccaggatccaaatactggtcagccagagttcaaggaaatggtaaggttcgttccaaggataaggcagggaactaaccaacaactgttacaaccccttccactgaaagaacataggcaatccttctgtcagctccatataagttcttgtttgtacttgataacatgccactacattccccccacaaacatacccaccaaatgctctttcatgctatcagaccttgctctttctgtaaggtgacacactttcccatttacaaatgcctaggataaacctagcatggagtaggcaattagtgtgggtgtgagggagagaaagagaagagtcaaattagatattttcttctatcttgtctctatttcttaaaattgtacttaagaaatcatactatcttgtctctttttcttttttctttgagatggagtctcactctgttgccgaggttggagtgcagtggcacaatcccagctcactgcaacctccgcctcctgggctcaagtggtccacctcaccctcttgaggaatagctgggactacaggcctacaccacagcatccatctgatttttatatttttttggagggacagtgttttgccatgttgcccaggctggtcttaaactcttgggctcaagtgatctgcctagctcagccttgcaaagtgctgggattacaagcatgagacactgtccagttccatattatatttgatccttataaaacctctggtggtagttatgattgcctttcacacaagcagcaagcagcattggctcacaatttaagccaattgctcctatggtggtgaagcttgttaatagtgtagctgggattccaaccaagcctatgttatttatctccttttttcttaagtgatctccagcatctttactaaccttcaaagtcaattgttccagtttatgtcctgcactctacactagtagttataaaaatgtatgatttcttaagtaccattttaagaaatagagacaagtggccaggcacggtggctcatgcctataatcccagcactttgggaggctgaggcatgcagatcacctgaggtcaggagttcaagaccagcctggccaacatggtgaaaacctatctctactaaaaatacaaaaattagccaggcgtggtgccgggcacctgtaatcccagctactcaggaggctgaggcagaagaatcgcttgaacccagaaggtgggagttgcagtgagctgatatggtgccactgtgctccagcctaggtgacagagcgagataccatgaaagaaagaaaagaaagaaaaggaaaagaaaagaaaagaagagaagagagagagagagaaagaaaggaaagaaagaaagaaagaaagagaaagaaagaaaagaaagaaggaaggaaacaaagaaagaaaagaaaagagaagaaaagaggatgttaagtgctttttttaaatttttttgagacagggtttcactctgcccacccacgctggagtgcactggtgcaatcttggctcactgcaacctctgcctcctgggatcaagtgattctctcacctcagcctcctgagtagctgggactacaggcacgtatcaccacgccctgctaattttttttttttttttttggtagagacagggtttcactatgttggccaggctggtctcgaactcctgacctcaagtgatccacccacttcccaaagtgctgggattacaagcgtgacccaccgcacctggccagatgtgaagtgctttttaaacagaaaaatatatgcagagaaagttgtggagtatgcagagaccttatactagaccggcagagggtaaggaataaagccagaaagacatgtttaagggcgtgaccacaaacttacaaactgacagatgggttttggcagtaggaatctttatactgcaaaaatacttaaaacagagtagatgaaaacattatggtttcagggtatcttgcccaagttgcatcatgatctctgaaagcactataggaggtctacctcataggaaacgagcttccacagatttatagatgtttggattcctgtaaaggtagtagtgaccaaagttggagctttgtctccacagaataatacaggtcaaatccctttgcagcatggtggaaccaacagtgtcctgagactatcacttatggcaatgaccattaaaaccctacctaatagttggaccctaaaattcatggctcagataaataaaagagtttggtgaggctgaccgaccctttacattgaagttactcagatcaggttttttttttttttttttttttgagacagagtctcgctctgtcgcccaggatggagtgcagtggcgtgatctcggctcactgcaaactctgcctcccgggttcaggccattctcctgcctcagcctcctgagtagctgggactacaggcgcccgccaccacatccagctaattttttgtattttttagtagagacggggtttcaccgtgttagccaggatggtctcaatctcctgacctcgtgatccgcccacctcagcctcccaaagtgctgggattacaggtgtgagccactgcgcccagcctcagatcagctttaaggtacaatggcagacatcagccaacatattaccagtatttaattcattctccatattttataactgaggaaacaaaggctgagatgttaataataataaaaataaaaagacatttaatagattattaccacttgaagaggggaaattaacatttattaaatattcttctacatgtcagtcaccatgagttactaaaacctcagaacacaaggagatacttatatatacatttacggaagagaaaatagattcacaggttaaataacttgccaaagcttaaaaaaaaaaatcttataaataacagggctggccaatccaaaatctatgtagttccaaatcctctgctctctcccatgcaacactgctgtttgtgcttatttaataggataacccttaaatggaactaaatcaccacacaagggcaacaacaggtaccttgtaaaaagcaattttctaactataggtctccttgggaccatttatacaattccacgaaatacataagtaatgtagtacaacagaagagtcctcaaacaatcctctctacctatgatgctagtcacataagttctaataactcacagggaaacaaagtttagtttgtccccaaatatattatgaggaagagctaacaggaaagaataaaagatcctcagactgcttgcttttattaattaacataagaaaaacaatcagaaattaaatttcaaactataatagattttaagacacaataaacggataatggtgatgaaagtatgattaagggaagaggagattatggctacaaagttcttctaaagggaaagatgggtaatgatgacttcaatggtggcaacaacattcactatgcacttactaaggattatgtactctatcaagttctttacatgcacaactttaagactcacaaaacttaaagaccattattaacccctaaaataaatgaaactggaaaataagccagccaatatttatgttaggtcattctgcttcagagcccaaatcttttttttttttttttttttttttttttgaaatagagtcttgctgtgtcacccacgctggagtgtaatggtgtgatcttgtctcgctgtagcctcaacctcctgggctcaagcaatctgcctgcctcagcctcctgagtagctggaactacaggcgtgtatcactatacctggcttaaatttttgtagagatagggtattgccttgttgctcaagctagtctcaaactcccagtctcaagcaattctcccacctcagcttccagaagtgttgaattacaggcgtgagccactactctcggcccccaaattcttaagtattacttagactatctctgaaaagtagcagatcagttcacaacttcactgtaagctcagaacagatgatcaagtcttctatttgcagtatgtgtttgcagtcccctacctgctttccaaggaggcatggtcacttggtgtagtacgtgaaaaaggaaaagggggagcttcttaagaatggcaaaaacaacttaaattttttgttaaaatgtatcagaatctataaatttatatgtcaagtgtttttttccccaaaatgttaaatctaaactccaaaattacttggttatgtaatagtaatacaattaaaatttctctaaaaaaaattattattcatgtatactgatcattctcacctgtgaaataagctagtcatgcaattagtaaagtttataaacatgctgtgagaatcacagttgtggttctttaaagcaaggactaagaaatgttttcagaaagaatatttaataaattaattcattaattaatagacataggaagattagtatgtgttttcagcctttttacaagtaacttaattgaaaacttaagaaaaaaatttttgtgttctttatggttacaaacttgtcataaaatataacaaataaagctaaatttagcggggcatggtggctcatgcctataatcccagcactttgacaggccaaggcaagagaatcacttgaggtcagaggttcaagaccagcctggacaacatagtgagactctgtctttaatttaaaaatatacttattaaaatacagtaatataatttttaaaaaattaaagcaaaatgtacctattcactttatattacatcatacatccccttaaatcactcaatttacaacataaaataggctgggcatagtggctcatatctgtaatcccagcactttgggaggccaaggtgggcagatcacttgaggccatgagttcaagaccagcctggacaatatggcaaaaccccatctctactaaaaatagaaaaatcaaccgggcatggtggcgcacgcctgtaatcccagctacttgggaggctgaggcatgagaatcgctagaacccaggagatggaggttgcagggagccaagatcatgtcactgtactccagtaaaagagcgagactctgtcacaaaaaataaatatttaaaaaaaaccttatttataggaatttcaatacttatttttggataattttattaaggctacagactctggctactgggaaaaaaaatcaaagaaaaatatacatgcattcattatgtgtaaagactgttgatatataaaacataaagaatgcaattttttgaaataaacaataattactactcatagtatgtaggtaatgaaactactaaaaaataattttaaaaaataaaaggggaaaaaaaccatagttcatacaaatccacagcaatgatgaagaatcaggaatataatcaatttaatgtttgtcgaaataaatattgaatgtggactaagtcttaatgaccagaaaatagcccaaaaaaagtaaattaactggttttaaatcaacaaactatacagatataaatcaatcattcaaaagaaatgaaacattgatttatcttccttcctaggattctttgtatttcagctgatttgcattctaaatcttcagatggatgcaaatgcgcaatgtgaggaccctttgacagaaacacagaatatttaggtacttgtactgaccggctcagagtcatagcaataatcatcccagctctgtctgaggggtttctttgttatctgaaagtaaggcagattagttaggtagaagtaatggttattatactcttctaatgatctcttagatgtggtgtgcaagtagtactgctgctctccattgaaaagttattttgcatagcagcataaaacaagaaataatgaagcaaatattcacatgctgggagactgtatactgtactaccgaacgcatatataccatgggctccagtgactgttatttatataaactgagtcccatatcctatgaatattgacattatgacaggaatatattatggtcattaattacaaaaagatctgaaagaacagcaaaattccagacttctctaatactaacaactatcagctcatttatgagagaatattactttataaaaaagaaaatctttaatcacccaaatataatgcaaatagtttaaactggggaggaaaaaactcagaagctgaattagcaaatatttttgaaaagctatttaattctatgtgtaaaaattaataatattatatcagaaatggatactttaaataacttggaattctcaatatattaatacaaagtcattagtttatattaatataggtagtttcaaaattaagaaataacagttaatacaacacactgtattaacttggagaaagccaaaggtataactttctttttttcttttttttgagacggagtctcgctctgttgcccaggctggagtgcggtggcacaatcttggctcactgcaacctctgcctcccgggttgaagcgattctcgtgcctcggcctcccaagcagctgagattacaggcgtgcctcaccacacctagctaatttttttgtgtttttagcagagacaaggtttcacgatgttggccaggctggtctcgaactcctgacctcaggtgattcaactgcctcagcttaccaaagtactgggattacaggtgtgagccactgcactcagccaaagatgtaactttcataaccctaaatatatactgctatctgaaccatcatcaaagtgtcaatttgtttacaaaagcttcgtaaggatttttttaatggtcataaagggatttatttccgtagacattacatcttgcctccaacaatggaaaaataaggggagacatctattatttaaatgacctattgttttactaattccattagtgctggttgtaaaatttctgttattatgagaaataataaaattagtaaagtcaatgtaatgaaaagtaagaattactcctcaatgtggaagtttagggatgaattttgagttttgaggaaagatccaaattctctaagtcatttgcctttgatgaccttcatactgaatatttaagaagattgttcattaaattataaaaatagtcatactctaagtcagtgtcatagtatcatgcaaagacgtatgtgtatgagacttcaaaacatgcaaattaggtttcaagtaatcccttgcaaaggacaagaattaatcattagtaacatttaatatcctgggggttgtaaaaggtaaatcactttagtaaaagtaaagcatttttctaatacagtagaaatatcaataaacagcttattattattttcccaaagaatctcacagaaaacgaaaagcacatatattatctgagcttttaacatttatatgaggatggtaatcatcctcaaatttgagaactgcatcacctaaatttgtagagtacatatatgaaaatgctagctaatccattcctaggtttgagaaagtactagaaaaaagacatttttcaagcattaaatttaatactgccctatacttcaaaatgctttttatgaactctcacctgattgagataatgatattcctctggttgcttaagatggaatgctgatctctcatcttcacttgctcctgccaggaggtaatagaatacatgatagttcctgtgggaaacaaagaagtacaagtttcataatgtgtgacttatggttatcatttaacagggggaggggggaagcaaacagtaattagtaaaatgtatcagctttgcttcattttttaatataaatgtgataaattcagcgtttaagtactcctaaaaattgaatgatgttttggatgtggaatacaaaagagagggatgaaggcagcaaagttaacaaagttaggacctctgaaaattctcttctccataaaaccaatgagaaatctggcaaatctgtcataattaaccttttcagaactgtggaaactaatcgaaagcttgcaacaacccagagagtgtttactcaataaaaagagctaaatctcaataaaaatggctttgtagtgttttaaacttgccctattccatccccttgaaaaccaacagcctgcaaacttggagatgagaagcctgacagctaccagaaaggtcagaacagagtttgagcttgttcaaagcctcattccctaagaaatatcattatttgaactgtctggtggttctctgtgaacagccatattcaaggctgactctacaagattcaattcggacttcatatcatgcaaagatcttttccccagaggcatccatagaaactgaggcaatcgctgaacagcctacttcctaaagcagtggatcaaagttggggcaaacaataggctaaccaagaaacttaaaaggaaaagctggctttgaaaacctccagtaaatgtcctgggaatctagaaggtcatatgcatgcataatgctgtggacatgcccagggttgtgtgtgctctcagaaaaataacagatgaaatataaactctcacctctggttaactttgaaaccctgcacaagcagaaaataaaggctaaggtagatttgtgaaatacctagctgagtgttgaaggcatggaacaatatacatagagagccctgtggcaaagagtgagagacttacttattgtttccaagcatttaaataaatatctgtccagttattacctgacatctaagttaaataagcagacacttcaatagccacactcaaaaaagaatatcaactttataaaattagttcagaaaagtcacaattaacaatcagacagtaggaataaaagcaacaatcaaaccctgggaaggagaggactcatttctagagctgccacattatattattttaaaaatcaaattttttggccaggcgtggtggctcacacctgtaatcccagcactttgggaggctgaggtgggtggatcacgaggtcaagagatcgagatcatcctggtcaacatggtgaaaccccgtctctactaaaaatacaaaaattagctgggcatcatgacgtgcgcctgtagtcccagctactctgggaggctgaggcaggagaatcgcttgaacccaggaggcggaggttgcagtgagccgagatcacgctactgcactccagcctggtgacaaggcgagactctgtctcaaaaaaaaaaaaaaatccaattttgttgtgttttgtttcgtttttgttttgagacaggatagctgtcacccaggttggagtgcagtggcatgctcatgattcactgcagccttgacctcctaggcccaagtgattctcccacttcagcctccctagtagctgggaccacaggtgtgcaccaccaaatctggctaatttttgtattttttgtagagacagagtctccccgtgttgcccaggctggtctcgaactcgtgggggctcaggtgatctacccatcttggcctcccaaagtgctgggattacaagcgtgagtcaccacacccagccaaaaaaaatccagttttcaacaacaacaacaaaaaattataaggcatgcaaagaaagaagacagtatagccgatacaaagtagaaaaagtattaattaataactgtccctgaaaaaacccagacattagacttacaagattttaatcagctattttaaacgtgttcaatgaactacagaaagtcacatttaatgaactaaagaaaactatgagaacgctatctcaccaaatagagactaatatacaggactttaaagaaattaatccaaaaagaattctggagttgaaaaatataactgcaatgaaaaagtatccagaggagctcaacagcaaatatgagtaggcagaagaaagaaccagtgaacttgaagaaaaaatcaacaaacatgaagacaggtcaattgactctcgtctaaggaacagaagaaaaaataaaatggagaccacaaggtctcagagacctgtgggacaccattaaaaagactcctatggcaggcacggtggctcacacctataatgccagcactttgggaggtggaggtgggtggatcacctgaggtcaggagtttaaggcagctcacgcttataaccccagtactttgggaggcagaggtgggtggatcacctgaggtcaggagttcgaggccagcctggccaacatggtgaaaccccgtctctactaaaattacaaaaaaaatagctgggcatggtggcaggcacctgtaatcctagctactcaggaggctgaggcaggagaatcacttgaacccaggaggcgaaggttgtactaagctgagatcacaccattgcactccagcctgggcgacaagaatgaaactctgtctcaaaaaaaaaaaaaaaaaagaaaagaaaaaaaggctcctatactgggggttctaaaaggagaaaaaagaaagggacataaagaatacttgaaaaaacaattgccaaaatctctctccaaatttgatggaaaacattaatctgcacatccaagaaattcaatgaactctagagagtataaactcaaatccacattttgacaaaccaaaattcttgaaaggcaaagacaaagaattttgaaagcaccaagagagaaattcctcatcaaggaatcctaacataagattaacagctgatttctcatcacgaaccatggcagacagataacgtattcaaaacgttgaaaggaaaaaaaaattgtcaatcaagaagtatatatccaggaaaaataaaggagaaattagaatactgccagataaacaaagttggacttcacagctatagatggtccttacaagaaatactaaagggagttcatttttctgactgaaataaaaggatactagacaagattcaattaaacatgaagaaataaagaacactggtaaaagtaactacataggtaaatataaaagatagtataaattaattaactcattgattgattgattgacaggatctcactctgttgcccaggctggagtgcagtggcatgatctcgactcactgcaacctctatctcgtttcaagtgatcctctcacctcagcctcctaagtagctgggactacaggcgtgcatcaccacacctggctaatttttgtagagataaggttttgccatgttgtctaggctggtctcgaactcctggcctcaagtgatctgcccaccttggcttccccaaagtgctgggattacaggcaggagccactgcacctggcctattttttatgtataacacttttttcctattaaacttgagaaattacataaagcagtaattataaatgtgttgatggatgtaccaccataaagaagtaatttgcataacaattacaggacaaaggagcaagaaaggaatagaactacatacaaagtttgttgtatactatcaaaattaagttgtcattattccaaactacattgttatcagattttaactacaatgcccaaggtaaccaataagaatataaaaaataataaaaagaaatgccaatgaaattaaaatggtacactagaaaacatttatttaatgcaaaagaaggcaggaatagaagaacagaagaacaaaaaaaaatcgtaacacatatggagaacaaacagcaaaatggtattaataatcctaccttatcaataattacattaagtagatcaaatgctctaatctaaaggtagataaatggcagaatggataaaaggaaaatgtatggtccaactgcatactgtttacaagagacaagctttagactcaaagacacaaataggttaaaaataaaaagatggaaaaaaaagttaccatgcaagcaatatccaaaagcaagctagagaataccagataaaacaataattactaattattactaatatcaggtaaaataaagaccaaacttgttcctagggacaaagaaggccatcttataatgacaaaagggccaatccatcaagaagacataacaatttaaaatatacataaatgtgtgtctaagaacagagcccaaaaaaacattgagcaaaaaaactttttttttgagatggagtttcgcactgtcacccagactggagtgcagtggcgagacctcggctcattgcaacctccaccttccaggttcaggcgattctcctgactcagcctcccaagtagctggaaatacaggcgcatgcaaccacacctggatagtttctatacttttagtttcaccatgttagccaggctggtctaaaactcctcatctcaaatgatctgcctgccttggtctcccaaagtgctgggattacaggagtgagccagtgcacccggccacaaaaagaacttgacagaactaagagaagaagcacacaattcaacaataatactgagagactgcaatactccactttcaataatgaagaaagcaactagacagaagatgaacaagaaaaagaggacttcaaaattactatataccaattagacctaacatatgtttatagaacactccagtcaacataaggaggatatattcatatattttttcaagtccacatggagtatcctccagggtagaccatgtgtagtctactacaaaacaagtctcaataatttaaggagattgaaatcatacaactactccaaacactttgcagtgaaataagaaatcacatttccacggccaggcatggtggctcacgcctgtaacattttgggaggctgaggcgggcagatcacaaggtcaggagatcgagaccatcctggataacatggtgaaaccccgcccctactaaaaatacaaaaaattagccaggcgtgatggcaggcgcctgtagtcccagctacttgggaggctgaggcaggagaatggcgtgaacccaggaggcagagcttgcagtgagccgaaatctcaccactgcactccagcccgtgcctcagagcaagactccgtctcaagaaaaaaaaaaaaaaaaaaaaagaaagaaaagaaatcacatttccaaaatacaaatacatggaaatttgacaacacattcctaaataaccagtgggttaaagaagtcacaagcaaaattataaaatactccaagatgcacaaaaacaaaacactacaccaatacatggaaaacagttgaagcagtgcttagaggggctttatacctgtaaacccatataaaaaagatctcaaatctataacctaaccatccaccttaagaaactagaaaaaaaagcaaactaaacccaaagcaagcagaaggaaggaaataataagcatcagagcagaaataaatgaaataggaaataggaaaaaaaatagagaacatcaatgaaactaaagatcggttctttgaaaagatcttcaaaattaaacttttatctaaactgatgagacagacagagaaagaagcagagagaatcaaattcaggagtgaatgaaagcggaacattactaccaatcttacataaacaaaaaagattgtaagggatactataaaacaagttttggcaacaaattagataacctagatgaaatggacaaattcctagaaagataaaaactaccaaatctgaccacagatgaaacaaaaagtctgaacagatctataataactaaagtgtttcaattaataatcaaaatttcacacaaataaaagtcagaaccagatggctttgctggtgaattctaccaaatgtttaaagaattaacccaatccttcacaaactcttctagagaattggtttgtaaaaactggatttcacctctcattcattctccaaaaccaaggaaataagagttatatacccttatttcattatcattaaaatgtgttagaaaaagttactaatagttttctatctgtaaaatgggaataaataaccaagaagcagaaaagttaaatgagatgcccaaggcatacccaatatttgaatggaagtcaaaccctctcttaaccaaatctcactgtagcatgaaacaaatcatgaatttacttctttatcttatttctccatctgaaggataccacatatatcatctctaaagacctgtatacctcaagtaatacaatggaattaagagctttattgaaaattttttttctcaagttagaaaaagaacactaaggaaatgggagcaaagtcccaaggcacattgctcaccaagaggaatgaggaacaactgagaaactgcttacttgttctgacagtttgcaatagttctatataccaaataaagatctcctagcagcctctgaaaaactgcaaagttctgcccatgacagaaatagcaattatgcataaagctatgcatgacgtaaactgaattaagggtcataatacacaaagaccttaaaagtcagtctgcgtgatacaaatgttaacttcatctaattacacaaataaaaatacgtaccgttcattatgctcctgataaacgagtctggacttctccagtagatatttttcaacataggcactacaagaaaaattaaattggttgatataaataataaagtttaatataaggcagaaaaatatttggagacagtgtaaaagtataaagaatactatccagatcatttcaaaatatgcgccattggccgggcgaggtggctcacacctgtaatctcagcactttgggaggtcgagatgagaggatcacctgaggtcaggagttcaagaccagcctggctgatatggtgaaaccccatctctaataaaatacaaaaattagccaggcatggtggcaggcacctgtaatcccagttactcgggaggctgaggcagaagaattgtttgagcctgggaggcagaagttgcagtgaaccaagatcaggccactgcactccagcctgggtgacagagtgagaatctgtctcaaaaaaataaataaataaataaatatatatatatatatatataaatatatatatgtacatactattataattgtggtatgggtactgttagtgttatccatgttaaattcatatggtcacgagtcttttttctttcactaaagcaaaataaaataagaagtttaaaccaggccaggcgcagtggctcacacctgtaatcccagcactttgggaggccgaggagggtggatcacctgaggtcaggagttcgagaccagcctgaccaacatggagaaaccccatcactactaaaaatacaaaatcagccaggcatggtggtgcacgcctgtaatcccagctactcggaaggctaaggcagaagaatcacttgaacccgggaggcagaggctgcagtgagctgagatcatgccactgcactccagcctgggcaacaagagcaaaacttcgtctcaaaaaaaaaaaaagaagtttaaaacacagtacacaagatccctgaagaaagactctacattatttctaggctatataccactacacattcttccagacatactttggacagattactacataaggctcaaagatatacatagtttctttttatatatttacgctattgtcacagcctaaaatcaatttattatataatgatttactctatagttatttattgggcactatatcaagcacaaggaatatggaaataagtgatctactgcctgttctcaaatgacttacaaattagtagagaaaggagataatctagcagctatcatactgagttgatagggcttattgtagagcaatgaccaggatattatgcgtacacaaagagagacacctgagattcaatccaagaaggaaaaaggatgtaaagaagaattcccatggataagtgagtacacagcacagagtaaactttcattacatatatctggtgaaagagtgactgggtaaatgaattcaaaatctgaaggattaaccagaaggaaaggagaactgcctttatgtaaagttataaaggaaggagggtacacataccaacttcagggaaaacaattagttacgtatcacttaactacagaggtacattctgagaaatgcatcattagacaattttgttgtttgtcagcatcacagagtgcacttatacaaccctgatagtatagcctactacacacttaggccttatcttatagcctattgctcctaggttacatagctatacagcatgttactgcactgaatactataggcaactgtaacacaatggtaagtatttgtgcatttaaacatagaaaaagtacagtaaaaatagggtattaaaatctcataggactaccatagtatatgaggtccatcatctactgaaacatcactgtgtggtgtatgacccaagttacgtatgactagagaatgatataggtggacggactacgatcaagagctactatactatatgccagaagaacgaactttatcctgaaagtaatgaggaattaaacatcaattgtatatctgatatttttttctctttatccagactgtgccctccaagtctttaaaacttcttacccaaatgggtgcaatcagctaagatctcattggaaaggggttctagaatctgaaatgtaaaagctttagattactgaatccaaattattaggacaaacctcttagaggccagaatctgactcttaagctgtatttctcccagttgcctcccaccacatgctatatacttcagtcactcacaaacacacaatccctcaaagattccattcactcctaactgcactgctcactttcttcctcccacttccaattccctagtctattcccagtctctgtccagtaaattgcattccttcattaaaataaagctcaaatgtgggttctttgaaaatccattgccactaccaccaccaataattaaaatttatttctttttctgaattaccattgccatttccagtctaaattaccaaaacaggctcttacctgtctaaaatgggagaaaggaaattaacatgaatatgttaaatcctcacaaccaccttgcgtggcaaatattactgcccctattttacaagtatagaaactgatgctgaaagatattaagatcacacagctagtaaaaagcataacttttaactcaggtttgttttaactacaaaggctctctttttcaactacagtagcccccttccactttattcatgggggatacattctaagatgccaaccacaaataataccaaacccacatatatatcccattctacataatacatatctatatactatatctatatctatatatacatatatatatggtttttttccttgaactttgtttttttggaggagtcttgctctgtctcccagacgatcacagctcactgcaaactccgcctcctgggttcaagtgattcttccacctcagcctcctgaacagctgggtccacaggcacgtgccaccacacctggctaatttttgtatttttagtagagatgggcttttaccatgttggccaggtgagtctccaactcctgacctcaaatgatttgcgtacctcagcctcccaaagtggtgaaattataggggtgcctggcctgcgtcttttcttcctatacatacatacctatgacaaagtttaatttataaattaggcacagaagacagggggccccaacccccagggcatggactcgtagcggtccatgacctgttaggaaccgggctacgcagcaggaggtaagcggccagcaactgagcaaagctgagctccacctcctgtcagatcagcggcggcattagattctcataggaatgtaaaccctattgtgaatcacacatgagagtgatctaggctgcacactccttatgagaatttaatgatatatgtaacaagcttgaatcattccaaaaccattcctccatcccccagtctgtggaaaaattgtcttcgacgaaaccagtccctggcaccaaaaaggttggggaccactgcagtaagagattaacaataactaataataaaatagaacaactaggctgggcacagtggctcatgcctgaaatccaagattagcctggccaacacagtgaaacagcatctctaccaaaaaatacaaaattagccaggtatggtggtacacgcctgtagtcccagctactctagaggctgaggcaggagaatcacttgaacccgggaggaagaggctgtagtgagccgagattgcaccactgcattccagcctgggcaactgagtgagacccttctcaaaaaaaataaataataaataataaaacaattataacaatacactgtaataaaatgtatgtgcatgtggtctctgtctgaaaacatcttactgtactatactcaactatctttgggtaactgaagctgcataaactgaaatcacagataagggtggtggtagggggagtttaaaggaatataggggaatttgctgtacttttccacttatttttgctgtgaagctaccactgctctaaaaaatagtctatttaaaaaaaaaaaactatgaagaatattgctcacacaaccagaggactctgaacatagactatataataagaaacaatattgtaacaaaattaaatttctcgaatataataatatggttatataggaaaatgtagattagaaaataccaacttacttgaaaacaactttttatttttttattttttttgagagacagagtctcgctctgtcgcccagactggagtaaagtggcacaatctcagctcactgcaacctccacctcccaggttcaagagattctcctgtctcagtttcctaagtagctaggactacaggtttgcgccactgtgcccggctgatttttgttattttttagtggagatgggttttcactatatgttggtcaggctggtctccaactcctgacctcaggtgatccacccacctcagcctcccaaagtgctaggattacaggtgtgagccaccatgcttggccttgaaaacaattttttaaaagaacaaatgtatgcataatatatagaaagcaaatgcaacacattgacaacaatcaaatctaggttaagagtatgtgtgactgttacattggtgttaaaatttttctgaggttttaacttttccaaaactaaaaaaagttgacagggaagaattttaatgctgacaccaatgtctgggaatgaacaatacatagtttataaaagggtaaagacaaaaattaaaacatgctccaaagcctacgcctgctaagtagcagtacttacccaagtacagtgcctgtttcctggtaatttacttgaataaacttcccaaaacgacttgaattgttattatgagctgtctttgcatttccaaaggcctgtcaaaataaataattctcattagtttcactaaaaaaaaaaaatttttttttggaggggggattaggtcagctgcttaggtcagctcagagacaaaatgttaaagagacagtaaaaagacaatttgcttgtatgttcagactcattcacagttcaggcaaaatttttttaaaaaaaaagcaattaacaactgaaagaagatcaagtagattttattttgtgctattcagtaaaataaaccataattttattttatgttatttatttatttatttattttggagacagagtctcactgtcgcctaggctggagtgcagtggtgtgatttcggctcactgcaacctctgccttctgggttcaagcaattctcctgcctcagcctcccgagtagctgggactacaggcccacgccgccaagcctggctatttttttgtattttagtaaagatggggtttcaatgtgttgccctggctggtctggaacccctgagctcaggcaatctgcctgcctcggcctcccaaagtgctaggattacaggtgtgagccactgcacccagccaaaataaatcataattttaaaaatgtaatgttctttaaagtttggatttctctttcacattccagagcccccctacaaaaaagtcttaatatatttatacttttactttttaaaaaatttgctaaactgaagtaacaaggagttaggaaaataataattacatcaaaataattacaattttagaatagaatgaaatgaaattccagtacataatgtactatactttattatgcctatttaaaacaaagctagagtactcattacaaaagaataagaactataaacttcctaaatcgtcacccaaagtatgtaccttacaatggaatactgcccaggaataaaaataaactaatgatatcaacaaacactatgctaagcacaagaaaccaggcacaaagtacatatcatataatctatttatatgaaattctagaaaaggcaaaacaagaataacaggaagcagatcagcggttatctgggaatccgggtggaattgagaaatatctacaaaggggcacaatgggtgataaagataatctatagctcaattctgtgatggtggtcacatggatatatacatttatcaaaattcactgagctgtacgctttaaatgtgtagattttattgtaagttatagctcaatatagctcaatgaaatttaagatgtaaatgtttttaaaaatgaagccactgccctagcctgagcaatcacattatacttgaagaaacaaaactagaaaagacacagagatgattcattgcggagcttttttcttctcctacaataatctcatgggaatggcatgccctctaactccaaaatcctaaagtagccatttactgaacacctccctaaatgcaaagctgtttgtgctaaactgtaactgtgcagagcatatatacacggacgcacgcacacatacaagacaaggcgaggacgtcaaccaagctgatgccccggcaactacatctgtactcaagtagtcgtactcaactacaactgtatcatggtcctgagaccagaaacatcagcatctcctgaaaatttgttagaaattcaaattcttgggtccctcacaaaactattgaatgagaaactctgaggataaggtccagcaatctgtgcttataaaacccccttcgagtggttcagatgtaagccaaagtttgacaaccaccgctctacttattatgcatgcatttacatttctgagaaattacattttactatgtcttaagaaattattctataatgatagcagcaaatgcaaagattcataaaaatctccagaaatgtccctcatgaatgtttagattatactgtatcttagtaagtcatggaaaagagcccaggctctcaaccatcaccgaaccatctgcaaactatatacacaaaaaagcttgacattgctgagtcctgaatgcctagaacagtttgtccattctgctttttccctttccaccatagaaagttttttacaaggaatttagaaaaaccacatagcacagattaataaaatgtagaaacaaacagaaacatacatttcatcaaagaaatattcatttaagtgtcaaatgcattacattttgaaaaaacttacaaaataaaaccgtgggcttggagatacgaaatatggatgtgtgatgtactactcttattttcatatatgctacttttgattctgcccaaggctacaatgtcaacagcaaatcagaagctttacctgttacttaacctgtgattgcaatacaacttttatcactacataaagtcatttagggccattttgagaggtaggcttgcaatagttacttcaccaaataagttatatgggtggcaaataagcatgagaaagcatgttcaacatcaccaactattacagaaattccgtcaagaccacaatgagatactactacacacctattagaatggctaaaataatcaacaaaaattgacaatgccaagtgctgctgaggatgcagaggaactagaacactcatacagtgctggtggaaatgcaaaatggtagaacaactctggaagacaatctaacaaaaagtaaaacattcacagaaagttaaacacactcttaacaatatgacccagcgatacccctcctggctatttactactgagaaatacaaatttatatatacatacacatcaaggcacaaacattatcatcagctttttgacagtcaaagcttgaaaataacgaaatgtccaccaacaaatgaaggatttaacaaactgtgattcatctaaataatggaatactactcacaagcaaaataaacaactgccgtattttaacaacctggatgaatttcaaagatacaacactgaatgagagaaatcagtctcaaaactttacatgtggtggttcacatgtgtaatcccagcaatttgggaggccaaggggacagaactgcttgaagccaggagtttgagaccatcctgtgcaacatagggagacctcatctctacaaaaagtttttaaaaattagaccagcatggtggcacacacctgtaatctcagctaatctggaggctgaggtgggaagatcactgaagtctagaaggtcgaggcagcagtaagctgtgactgtaccactgcactccagccagggtgacagactgaaacccgggcctcaaaaaaataaaaaactttacatactataggactctatgtatatgacattctcaaaaacaaaaacagctgcaatggagagcagacaagtgattctgagtcatgaaaggatggcagggcagagggtatgaagataaggagtatcagagttttatacacagaggactataaaaggtaatattttaaattcatagaattttataatatgattacttatttcaaaaaaacttaactcctcaaaatatttattcaaaatataaggcacaaaaaagacaatttcagatatacatagttgaaaatattcatcacaagctaacctgcactaaaagaaacattaaagaagtcatttaagcagaaggaaaattgtatcatattaaaacatggatctatataaggaaggaagaacagcagaaatggttgccccatgaataaatacataaaatattttttagtacttaaatcttttgaaaagatcattgagagtgagattagcaaaaatggcagagtaaggacctctaaacatcctctccttcataaaaggcacaagaatgctgacaaaaactgtcaaactcaaatttttaagaactctggaaattaaccaaaggattgcaagaacccttggcagaggcatttaatcaagaaaaaacagatgagtcttggttaggaaaatcaggcattttaacttgtgctattactactcctttctctttagctccacactgaagagaaaaaccaacatcctacaatgatggggttttttttaaagacacccaagaagccacctgaagaatcagaacagggatggaactcatccaaactccacttccccgagaaaatcatcacaatttgacttatctggcatttccctggaaaaactcacacaaagggtactctttttgtgtgtatgtatgttttgttttgttttgttttgagacaagatctcgttctgtcacccatgctggagtgcagtggtgctataacagctcactacagcctccaacctccaggacttaagcaatccttccacctcagcttcctgagtagctgggactacacacagccatgcaccaccacacccagctaatttttgtatttttctgtagagatggtgggggaagggggatctccctatgttgtccaggctggtcttgaactcctgggctcaagtgatccacctacctgagcctcccaaagtgctgggattataagcatgagccacagtgcctgcccctcatcctacttttttttttgcaacagggtctcactctgtcaacccagactggagtgcagtggtgtcataaggactttcttgaccttacttggaaatcacttgcttaaaacagcctcttcacactccccactgcacccacccaccatcactatgtgtgcttgtcaaaaacaatcagaagcaattgtttaaacactataactgcttaaggtggcaataacagaatggggcaaaaaaaaaaaaaaaaaaaaacaccaaacaacttaaaaggaaaagctggtgaataatatgtacaaaggggactctgaaaacatctgaaatattcatgggcatatggaaggccacgagcatgcacagcactgcacatgcccaggatatgtcgatgctcacaaaacacaggagacctgtgttttgaacttgaggttctttgtaagcaggaagtaaaaggtaaggcagagttgacaaccgcttggctgagtactgaaggggtgagtcaacaaacacacagaacctcatagtaaagactggaggccttaacttcaggcatttaaggaaatccaagtctaatcataactaaccactataactgagtacagtttttgatgatctcatgcacaaaaatatagactttacaaaattagttcaaagaagtcatgaaacaaccaaataacggtaagaaaacaaccacaaaccttgggaaaatctcattttgaggtgccacatcattattattatttaaaaatgtctagttttcaccaaaaaattaagagacatgcaaaaaagtacaaaagtatgggcatgggaaaatgaaaaatagcactaaacagcaaccgttcctgataatgcccagatgctggacttactaggcaaagactatcagctttttttttttttttttctctgagacagggtctcactctatcactcaggctggagtgcagtggcaccatcacagctcagtggagcctcaacttcctgagctcaagccatcctcccatctcagccttccaacagtagctgggactacaggtgcataccaacacatccagctaattttcttttccatttttttgtagagacagggtctcacccatgttgcctaggctggtcctgaactcctgggctcaagtgatccactctccttggcctcccaaagtgctgggattacaggcatgagccaccacacctggccaaaatacagaactcttaaatgcacaaaatatatccaccacgaaagaccatgttctgggccataagtctcaataaatttaaaagagttgaagctatacaacacagtgttatttaacctggccaaaatacagaattcttaaatgcacaaaaaatatccaccacgaaagaccatgttctgggccacaagtctcaataactttaagagagttcaagttatacaacacagtgttatctaaccacaaaagaattaaattataaatcaagaacaggggacagaatctcagaggacaggattggggcagagcaagatgtggaacagatccacagatccactgactgctcccccacacacaaaaagacaccaatttaacaactaactacacacacacaaaaagcaccttcatgacaaccaaaaaccagtagggtaaatggaaacagccatcttagactaagatggaagccatgtactgagaatggcagagccacaaagaaggagcccgtgcccatcactgtacaatcaaccagatcagcccaagactgctaccatgtgtattatgacgtgagagaaataagagtctatcttctttaatcccttattgttttgacctttgttacagcaacctaatgtttgtacaaaagggctttcatttcttacttcattcgtttctgcattgtttgttttacagcatgtataattagtttaataacttaaaatatatacataatctatatatatttacctataagatagatataagtagatatatatctatataaagggagagtgaaatccatatttatccatatagtctatacagaggttagatagatacaatgtgcagtgggccaaagatagagacttttagattttggttttctgatacaccaaaatatttcgaattatttataccttcctgagaattaaattcacaaatctttattgagaattggtcatgtgaaagaaactaaagtgacacaagtatgtcattgttttagaaagtactgtattcactcgtgagtagcaaattaatttcaacaaaataccatccatacttttcaagtaatactgttaatctaaagttcactgatttgaagttccgtttgtacttaatttggcaaaatctgttttgctttatagttgtatacaaactttaaggaaaaaaatttaaatacagttttatatttgtacatttttcagtgtctttaaaatttttgtttatatatatttataataaaataattaggtttccaaaaaaaaccagataggatttaaatatttacaaactaaacacaaatctaagcaacccatggttcaaagaagaaatcaggccaggcacagtggctcatgcctgtaatcctagcactttaagaggctgaggtgggtggatcatctgaggtcaagttcaagaccagcctggcctacatggagaaaccccatctctactaaagacacaaaaattagctgggtgtggtggcgcacacctatagtcccagctactcaagaggctgagacaggagaatcgcttgatcccggcaagtggaggttgcagtgagctgagattgtgccactgtactccagcccaggcgacaaagcaagattctgtctcaaagaaaaaaaagggggtgggtgggatctgtctctgctgttctacgtcctccacctcaggagcccctggtgactttgtcacagcctccgttcctctgtgatctccaggtcctgggagatgcacagctaagaagccaggacatcctggaagctgggaaataaccctgaacctgcagcagcaatctggtctctccatcaccctaggcttgtggaccacaaatcacaacctcatccactgcatggacacaggaatatgtcagaacatagccctgcctgggccatcaagctccaaatagtcatccaactaggagcctcggacaacggccacttttgctgggagcccgtagataggcctctaggaagatctgactgctgtttttccaaaacagtgccccgtcagcaggaggcagttaaaattggtcttcatcctcatccttatccttattctaatggcacttagatgcacttctttagaggggagaatgagacaggcaagtaacaaaaggttccaggagaatctccaactgacctgcataccaggaagacagggtgaagacttgtgaagtctatgccatttgcaggggggaggagcctggcctctcctgtttctgtgtgaagacttgggatcaaattagtgaggtgaacagcctgttaggaggacctcatctcactttcctgaattgtttttccttttcattcattaattttactcctcacccttctatgtgtctgcgagcctaatctttcctggtcgtgtgacaagaacccagtattttccgtttttttgagacggagtctcgctctgttgaccagactggagtgcaatggcatgatattggctcactgcaacctttgcctcccgaagaacccggtattttctacaacaatattttatacatttctttctacaatgattatataattatggcttaccagcaggaaacaaaaaaataaagaataagtcacaaaaaaagaaatcaaaagggaaattatcaaatgttttaaactaaataaaaatgaaaacacaatatgtcagaatttgtgggatagcagtacaagcagtacctaggaaagaatttacagcactaaataaatatattagaaaagaatgatctaaaatcaatgacctcagagatcatactaaaaactttaaaagcttgtaattctagcactttgggaagccaaagcaggtggatcgcttgagcctgggagctcaagaccagcctgggcaacatggtaaaactccatctctacaaaaaatacaaaaattagccaggtgtggtggtacatgcctataatcccacctatttgggaggctgaggtgggagaattgcttaagccagggaggttgaggctcccatttatttgcagggttttatggctacagcatattcttcactcattgcacacatgacagacacctgtacatcttcacctgcgttgtattttccttgtatttatttgcctagttcactttctggcagtttaagatcctcaggaacttcatcagcttctgtcggcagggaaaggcaactatcttgaatgcatatcagttgataatcatgtctctgaatatttggaacatccacgttgtgaacagaaggacaaatatcttcttcttctttttttcccatgaaaacagcaattccaacaaggtgaaccttggcatgaccaagttttccagttttggaagttaacatcttcactattttgcatggttgtcctttgaacatcatgaagtcacttttccgcaaggttgagcactgcatagggtgagtgctggaagccccagcatctccagtagttaaatcaatttcgtacaccatggtgagctggggagatggtagtttttccgtgggaactttcagcaggcaaagagctcctttcacctgcgtacctgcacaggtcccctacagctgcagagccggtggcagcggtggcagccacagcagttgccaataagggaatattatataaaactttatgagaataaatatgataacttagattaagcaagtttcttgaaagacacaaactaccaaagcttactaaaaaaaaaaaaacagtaataataataatcacatgaataactctatatctacttttaaaattgaaaccttgtttaaaattctcccataaaaaacaccaggtccagatggtttcattaatgaattccaacactgacagtaaaaaaaaaaaaaaccagttctacacaactcttccaaaaatacgaggagaaaagacttcccaattcatcctatgagacttgataattctatcaatgcaaaagattgaatgcaaaaaaaaaagacattaaagaaaacaatgttaggcatgatggtgcaagatagaatgcaaaaaaaaaaaaaaaaagacattcaggaaaacaatgttaggcatgatggtgcatgcctataatctcaactatttggaaggctgaagcaggagaaccattgaagcccaggagattgagaccagcctgggcaacactgtgggatccactctcaaaaaaaatttttttaatgagaaagaaaacaatgtccctcatgatgtaattcacattaacaaagtttaaaatataatcatctcaataagacacagaaataacacttgacagaatgaattttgacatccattcctgaaaaaaagctctaaacaagctaggaacagaagggatcaagctcaatgtgacagagaatttacaaaaaaccaacagctatcattataacttaatggctaaagactaaatgttttcccctaagatcagaaacgagacaaggatgttgctttcaaccacctctactcaacattatactggagtagccagtgaaatcaagcaagaaaaaaaaaaaaagacatccaaactggaaagtaagaaaaactttttattcacagacatgactgactatatgaaaaatccaatggaatctataaaaaagctgttgcaggggtgggcaggtgtggtgactcatgcctgttatcccagcactttaggaggccaagacaggagaatcacttgagctcaggagttcaggaccagcccgcctaggcaacatagtgagacctcgtctctactaaaaattaaaaaaaaacacagccgagcacagcaacacaggctgatagtgccagctactcaggaggctaacgtgagaggatcactcgagcctggagatcgaggctgcagtgagctatgatgacaccactacactccagcctgggcaatagagggagaccttgtctcaaaaaacaaacaaaaaaaaaaggttaatggcactaatatttaagtctagccaggttgcagaagataaggtcaacgtgtaactatcaactgtatatctatatactagcaacaaacaattgaaaattgtagaacaccatttataataacatcctcaaaaatattgagagataaatcttaccaaagatgtaaaagacctgtacactaataactataaaatactgccaagagaaattaaagaacttaataaaaagttaaacacatacttatcatctgatctagtcattacattgctagatatttactgaagagaaaaaaatgcatatgtctacataaacttgaatgtaatagccaaaaattaaaaacaacccatatatccatcaatgagtgaacagatctaaaaaattgtgatatcccatggaatactattaccttagcaacaaaaaggaatgtattatcgacatatgcaacaacatggataaatctcaaaataattataccaagtgggagaagccaaatataaaagggtacatactatgtggttccatttatataaaatggtagaaaatgcatactaatctacagtgacagaaagcacttaactggtttcccatatatgggtgggctgagaggagcgtgaaagagggattacaaagaggtatgaggaaactctggggataatggatatgttcttgactgtggtggtggtttcatgggtatatacatgtcaaagtttatcatgttatacactttaaatatacgcagtttactgtatttcaattatacctacaaaatatcttttaaaaagacaacaaagtaatattaccttttcctttcaggtctaaaacaaacactatattccctttccttttttttttttttttttaaattggcaagcaaaaaccgcatatatttatggtgtataacatgatgttttcatatatgtctgcagtgtagaatggcaaaatcaacctacttaatgtatgcattacctcacaatacttatcattttttgtaatgagactaattaaaatcttctcttggaaatgttcacgtataggctgggggcgatggctcatgcctgtaatcccagcactttgggaagccaaggcaggtggatcacctgaggttgggagttcaagaccagcctgaccaacatggagaaacccctactctactaaaaatacaaaattagctgggtgtggtggcacatgcctgtaatcccagctactcaggaggccgaggcaggagaatcccttgaacctgggaggcagaggctgcggtgagccgagaccgcaccattgcactccagcctggcaagaagagcaaaattgtctcaaaaaaaaaaaaaaagaaattttcaagtatataatgtattgttacttaccacagtcatcatgaagtacaatagatcccttgaccttattcctcctatataactaaaaaatttgtgtcctacaaccaacatctctccaatcctcacagcctttagtaactaccactttgctctgtttctatgcattcaactttttcaaattccacatataagtgagactgtggagtacttgtccttctgtattatctttccttttgacattggatggtattacttgtaaaacatcccacaactaaacatttttcccatattctctacattattacaagtttcgatgctaggcacagctgttaagcttgcagaaatacaaatatatcagcaaaaatattttcaccaaccatcacaatgcagttagacacgacctgactctgctttctccccttatagggggatatacaatgactacagtcatctctttctttgcatcattaatgacccaaagacattctctttaaaaaaaaaaaattaccactgtcacactcttcaatcttccacaccaccttttttgcgttcccatcttccaggtcctcttggttactaaaaataatgtctacacttctatttagttttacttcatcttctcacatctatcaaatattttttaaagatatgtttaagaataggaacagtatttttctttctttttttttaaattgctgctccttgtagagcagggctacgctgcaggcagtgtgcccagaatagcaagaacagtatttctatagcttctcagccttttggctaagatcaagtacagttatgtttttatagtttaatatctgaaatgtcttctatccaaagacaattttttttttttttgagatggattttcgctcttgttgcccaggctagagtgcaatggcatgatctcagctcaccacaacctctgcctcccaggttcaaacaattctcctgcctcagcctcccgagtagctaggattacaggcatgcaccaccacgcctggctaattttttttgtatttttagtagagacaggtttctccatgttggtcaggctggtctggaactcctgacctcaggtgatccacccacctaggcctcccaaagtgctgggattacaggcatgagccattgcgcccagccctaaatgagtttttggagctgggagatggaacagtatcttgcttgatctactccacacatcgacctggtattgcagtacctccaggaatggtacacccccccacctcaaaggataaaaatcaaaattaaaatcaaaaataagatttctatatatttacctcaagtactggtccagctccaagaataatctgttctactccactggcaaatcctttctgactgagagcagtaaggtggtgaataagaaagtttgtgctttgagtcttcccagaaccactctctcctgaaatcacgatgcactgattctttttgcgctgaagcatggcatgataagctacatcagccacagcataaatgtggggctcaagttttcccagttggtggttatcatacattttgacatatttggggttataaataggaagaaacttgaatgggttaataactattagaatactgccaacataggtataaattttttcatgcttaaagcgatttcgtaggttttctaagagagttttctcattcaaatcaggtaaactacataaatcatcaaagtctttctgttgaggctgtggaagaaaaccccgttccatcatcctgcgacgttcttctgttacccgtagccatgactgcaggctaccataatggattgatccatcaaggtttttctctctcagaaggaagcggtagtcctctccacttaagcgattttccagagccattcggggccacagcatcattcgctgaactggacaatctgttggattgagaatccattcttctccaccaaattcctttacctctgctagaacataacattttgttttgtcaagatgaagtttgtttataagagactcaatcacctcagcagctgtggagttttttctggcaggaatcggacagtagattgtcccttctgaaatagccccaggatatatccgtaatgtatgttcattatcttcaaagcgtcgtcttcctccatcatttatattcatattggatcctgtcccatcagcatggatagtatatgttcaaagtcgtgcaaaccattttcttggtaaaataactgtaacataaaagatgcaaaatatttagaagtaaatacacattgctttctgatgctcaagaaagaaaagcttaacaagcatgttgattacatcttctaaaacacaaaatactaactcttgtcttagcacagcaacagtttcattgagaccacataatattaagtttcactgtccaaatctaggcactttctaaaatagtaacttgccaaaaaaaacatatatttcaatgttttattatacaaaaatccaaagagtacaaagaaaaattatttttcccctgctgtctcaaatgtttgtaaggaacttgggattagaaccaagttctttccttatacttaacaaagactggattaagacagaataaccatgcaaatctaattgccctgtacccaaaatttcttaaggataaagcaaaaacaagaaagcatcccaacaatggagcaaaaattttgtaaaatttgttaaaaacagcaagaagatagataaacatagaaattacataaaaccaagaaaatgatgagagaaaccaactaaggagatagacatatattttcaaggaattctaggctctgactcactccctcccacaaggtgggaaggagaagggagtttggcaagagtgacaaaagaatcctgcccctgacttgctaggcaaatttaacacaattatacaactaggcaccactacaaattttattcagcttccctttttccttcaatgctaccattatatctttttacctaaccttatttattgcattccttacaagtattctgcattttcttcccatcttctcgaacctcgtatacagtatattacacttctagaagaatgatttcaacttttatacctcactgagaaaatagtgatttccttcaaatggcttctccaactcaaaatttattcctatctttacctcatctatcttattccattcctgtcttctactgagaaaatatgccccacacactttccagggctgataaaacctgtttcttatcttcattagttagttatatgcccccaaaaaactactctcatgtgtcatcaatatttaccttatttatttcatcctttaacatataaggatgatgtgctattaaaaaaataataagaagaaatactttcagttacttcctttttttttttttttttttttgagacagggtcttgttctgtcacccaggctagagtacagcggcatgatcttggctcactgcaccctccatcacccgggctcaggtgatcctctcacctcaacctggctgggactacaggtgtgcgccaccttgcctggctaatttttgtatttttagtagagatggggtttcaccatgttgcccagggtactatctatcctctcatactactacatatttgtcaaagtcttctaatcaagaaactattttttcctgtttgcctagatggtctttcaaacacagagattaatacaaaacatataaaaaaaacccagccatataggccaggagtggtggctcatatctgtaatctcaacactttgggaagccaaggcgggcggatcacctgaggtcaggagttcgagatcagcctggccaacatggtgaaaccctgtctgtactaaaaatacaaaattagccaggcatggtggcacgtccctgtaatcccagctactcaggggcctgaggcaggagaatcacttgaacccgggaggcagaggttacagtgagctgaggtcgcacccctacactccagcctgggtgacagaatgagactgtctcaaaaaaaaaaaaaattaaaaaagaaataaactagtgaggaaaggacaaactattcactgtggtactggttcaattgctaatctgagttggagtgaagaaaattaacagtcctatctcatagcatactgaaaatagattccatctatggatctgtacctatcaatctgttctgggctctatagtctgttccataggtctatttttccacccctgaacctctgttaattactacagtcctataataaattttggtatctgaagggcacattaccttaatgtgttgttctttacaaattttaccttggctatttacactaccataaaaatgtttaagtttgcatgtttactatcgtgaaaaaaaaccttttcagattttaatactgcattgactttacagattaatattggacagaactgacatctaattgactcttctcattcatgaacaccatgctgttggcttttaaaaattacaactatatttttcacttctaaagtttttgtcattttcaaatccacctcatcttttttccgccgatttacatttcaaaattatttatacttaagggctattactccttttctttttgaaaaccctcagtatgtaatttaatatttttcagactaacactgaaatgtcatccagacggaactgctcttatggttatttcatatcttccttagcatgagatgagttcatatatttgagaatttagctttacaagtgcacttttgatggaacttcttttgtttttcatacaaacacttactgagaacatgtttactacttttttaagagaactacagtatcataaatatatttttaaaaattaaaaattttggtattaaatgatcaattgatattcaaatttccaaatttcctcagttatctcataaatatttttcttacagatagtctagctggagattctgctctgcaataacagtgaggatatactctgagttaccaggttcctagttgtatagctatgtttgctttcctgaatccctaagtgtttgcttcatatacgctatggcatctggcagcagtcagcagcaaatcttcttacagccagggaggctgtgacctgtaccactccaggagatgtactaagttaaggggtccccaacctctgggccatggaccagtgccagtccatggcctgtcagaaactgggccgcacagcagaagatgagcagcaggcaagtaagcattactgcctgggctctgcctcctgtcagatcgtcagcagcatgagattgtcatagaagcattaagcactattgtgaactgcatatgcaagggatctaaactgcatgctccttatgagaatctaactaatgccagagaatctaactaatcatctaatacctgatgatctgaggcagaatagtttcatcccaaaaccatcccctactaccccatctgtggaaaaattttcatctatgaaaccagtccctggtgccaaaaaggttaaagaccactgtactaagtaactacaatctaatccctaaagttgtataatatggcagccctggaagtaaacttagaaacatcttttttaacaggagtcctatcttggaccactgtttccaacaataagcccaactctaattacacttccccattacttcaaagcagccaaaatcacacctgctccttcctgaaacagaagtgtttaccttttttgagtcctagttttgtcagtttggttttatctttgttattttatcaattactgctttgtgggtttttttgttttgtttttttttttacaaaaaggagggtttgtctcaaaataccactcagaaatccatcttgatcacaagccagtccttactaaacagcttggaaaatctgtacttgcaaatccgagacatgagctttcatcaaaatcatctggggagctttttcaaaacgtacattaccagccgggtgcggtggctcacacctgtaatcccagcactttgggaggccgaggcggatagatcacgaggtcaggagatcaggaccatcctggctaacatggtgaaaccccatctctactgaaaatacaaaaattagccaggcatggtggtgggcacctgcagccccagctactccggaggctgaggcaggagaatggcgtggaccctggaggcagagcttgcagtgagccaagatcatgccactgcactccagcctgggtgacagagcaagactccgtctctaaataaataaataaataaataaacaaacaaacaaacaaaatttttttttaaatgtacattaccaggctcaacaatagttatgagttgaggaaatgcaggtaattctgttattgctggtccagaaaatagtatttgaaaatcaccatattcccaaatatttgggaactcactttctactcccttaccactcttcccacatagcaagctacttgacaatgctccggagaagtcacaaaattccacagagttggtaatccaaaggtctttcctcattcttcattttaacacaccacactatggcatgactaaagcagccaatttctagttcttgaaagtgtactcacatagttatttttcttgtagtcttcctgatagtcttgctctttttctgactcactcctacagctccttttccattaactcactttattttgttgttgttttgttttgtttttgtatttgtttttgttttatagagccagggtctgtctctgtcatgcaggctggagtacaatggcacaatcatggctcactgcagcctcaaccttctggactcaagtgatcctcctgcctcagtctcccgagtagctgggactgtaagtgcatgccaccgatggcagcagcggcccatctatagcggccactgccatgataccagctgcagtgggggaggtgcagccaggactgcgtgctccatggaggcagcagaagccaggaacaggtgggaaccctgccaccttctgagttgacagggcaggagtttcgtgctccctaggtgcagctgcggccacctgcccaggtgggctgcagacccaggcatcactgtgctcttgggggatgggagcaggcaggagccccaccctcccaggcacagctgcagccgcccaagctgcagctgcagacccaggcatgtctgcactctcagaggcccaggaaggccccccgcccagtccctgcaggctcagaggtgtttgctcccactgcctggcctctcctcactcccagcacccactccaatctcagagaaaggttgggtccgagactgggcactgtcacagcctggccaagtgtgcacacgctccagatagcactgatacaccagccccctgccaccttggccccctctaaactttgggtgcctacaaacactagagggaggctgagggggtactgagggcagctcagtacctgtaggcaccccctgtcacaaacagcctgggcaccatgaacagcaggaggaggcaggcaggctcctgggcaaaaggaggcaggtccctggtgaaaccccaccttcaagccagggaaggcctgaagcctggggaccaggctttccattggcacccgatgaccagagtgggaacttgtggtgctttctccaggctcacccatggttgtcaatgaaccaatcagtacacacaccctccctgctgagacctataaaagcctgaactcagccagacttggggagacaaccacctgccagttgcagagaaaaggtgcccaccccagggtctcctctctgccgggagttgagaagatgatgggacaaccagctgcagggagaagctacccaccccagggtctcctctgctgaaagctgaagagatatccaactaccagctgcagtgaggagctacccactccacggtctccactctgctgacagctgaacactcatcaggacacccgaacactcatcaggacaccctggctgcagagaggagctacccactgcgagtctcctctgagctattctatcactcgataaagctccccttcaccttgctcaccttccacttgtccgtgtacctcgttcttcctgggtacagaacaagaactcaggacctgccgaatggcaggactaaaagagctataacacaaacagggctgaaatacgccccttgttcgtcccattgtaggcaacagaaggagagaagagagaaggagaaaagagctaaggcccttcatggagtccagacctgggggctccccaagccagggctctgacaccctctttggggctctacggttcctggcatcttcaagcttccgagcaccactgcattccccagtgccagccatggaagctgcttgaggtatgcctgatccacagccttgcaaggaagccagcgcctatgccagcacccggagctgcctgccccgctgcagccagcatgctcggttgtgtagagtggccaaactcctcactcactcacacaccctcctttggtaggtgtgggatccaggctggtagtgcaagccaaacacagcctgccattcagagtgatcagaataagcccagcaggcccaagaaaaactcaggcagaggcgccagtggccacagacgtttccagcctgaaaagtatcaccccaagaagtatcaccccatagcaagatggaatgctgcccaggccggtccacaaagccaaaaacttttactatatgctcctttacaggaaaattctgctgacggttgttctagggtagccactaaaaaagacttttttttaggctgggcctggtggctcacgcctataatcccagcactttgggaggccaaggcaggcggatcacttaaggtcaggagatcgagaccagcctggccaacatggtgaaaccctgtccctattaaaagtacaaaaaaaaaaattagccaagcagggtgctgcgtgcctgtaatcccagctactcaggacactgaggcaggagaatcgcttgaactcaggaggcgcaggttgcagtaagccaagatcacaccactgcactccagcctgggcaactgagtgagactccgtctcaaagaaaaaaaaaaaggttttttaagtgtaactttccatgtggcacatatacaccacggaatactatgcagccataaaaaagaatgagataatgtcctttatagcaatatggatggagctggaggccattatcctaagcaaactaacgcaagaacagaaaaccaaacaccacacttataaatggaagctaaaaactgagtagacatgaacacaaagaagggagcaatagacacaagagcctacttgagggtgaagggtggaaggaaggcgaggatcgaaaaactacctatcgggtactgctgtgcttattacctgggtaacaaaataatctgtacaccaaacccctgaaacacacaatttatctaaagaaccaacctgtacatgtactcctgaaactaaaagttaaaaataattatgtataacttttcaactagtagagtgaaaaaacagaataatgagttcaaaagaaagcaagaaaggagaagagaaaaaagtcagaataggtagatcaaatagaaaacaaatagtaaagttttaaagctaaatacaacagtaattatattatattacatgtaaatgctccagttaaaagacaaagatggtcaaagttttaaaattcaactatctgctgttttcagtagacacacatctataacataaggatacagaatcagaaagtatttttttaaaaggagaagaaataccatgcaaacactagccaaaagaaagctggtataatcaaaataacatcaagcaaaacaggaaaataaaattgaattaaacatctcttaagggttttttttagcccttccatactattattttaggcttaggcctgagagaaaggtctctggatatcactggtattcttgaaaagaagtacaaaacagaaaaagattacaagaagttaaggaggaagccacagagtggcaagtaagtagctagcagatgttgatcgaatctgctacaaagaaagcaggagtagggccaggcgcagtggttcacatctgtaatcccagcactctggggggccgaggcgggcgaatcacaaggtcaggagttcgaggccagcctggccaagatggtgaaaccccacctctactaaaaatacaaaaattagccaggcatggtggtgtccgcctgtagtaccagctgcttgggaggctgaagcaggagaatcacttgaacccaggaggcagacgttgaagtgagtaaagtgagtagagatcgtgccactgcactccagcctggagacacagcgagactctgtctcaaaaaaaaaaaaaaaaaaaaaaaaagcaggagtattgtgagtgaaatgtttattagttagggggcttgggaacacaactgtatgattataaataagatcaagcaaggaagcagaaactaaaaactgaagaaaaagaaggtctaactggtaagccaaagttccttggtaagcaagactaaatgagattaaggtcaaaggtggacagatgtctctcagaaaggaaaaaaaaaggacacttttactgaaagaattaaaaaaaaaaaagatgggcagagaaacagaatttgagataagatgtgacgagactgtatatcagctaatcattactagaaagaatataaaagcccaagttttacctatagcagatcaacgtcaagtaaaagcaaaagtgggtgctgaaagaaaacatattttgtaccatttcagttgaagaaaatgtaatggaagaaataaattatcaggctgggcacagtggtgcgtgcccatagtcatagctatttgaaaggctgaggtgggaggactgcttgagcacaggagttcaagaccagcccgggcaatataccaagaccccatctctaaataaataaaatgttaatagttggcaggccacatgtagaatgaaaacctctcaccttatacaaaaatcaactcaaaatggatcaaggacttaaatctaagacctgaataaaaattctacaagataatgtcagaaaaaccctcccaggccttggcttaggcaaagactttatgaccaagaacccaaaagcaaatgcaacaaaaacaaagatgaataaatgggacttaattaaagagcctttgcacagaaaaagaaaaaatcagcaaaaagacaacccacagagtgtaagaaaatcttcacaatgtgtatatccaataaaggactaatatccagaatctacaaggaactcaaacaaattagcaagaaaaaaacaaacaatcccatcaaaaagtaggctaaggacatgaatagacatctcaaaagaagatacacaaaaggtcaacaaacatgaaaaaatgctcaacagcattaatgatgagggaaatgcaaaacaaaataacaatgtgataccaccttactcctgcaagaatggccataaaaaaaatcaaaaaaataatagatgctggcagggatgtggtgaaaagagaacacactttgacactgatggtaggaatgtaaaatacattcactatatgtaaaatacaaccactataaaaaacagcatggagattccttaaagaactaaaagtagggcaggtgcggtggctcacgcctataatcccagcactttaggaggccaaggcaggtggatcacctgaggtcaggagttcgagaccaccctgaccaacatggcgaaaccccatccctaataaaaatgtaaaaattagctgggcatggtggcacgggcctgtagccccaactactcaggaggctgaggcacaagaatcacttgaacccgggaggcaaaggttgtagtgagcccaaattatgccactgtgctccaacctgcacaacagggtatcacccagttgccactactgagtacctacccagagaaaaagaagtcatttatacaaaaaaagatactcccacaggcatgtttatagcagcacaattcacaactgcaaaaatatagaaccagcccaaatgcccatcaatcaatgagtggataaagaaattgtggtcaatatacaccatggaatactactcagccataaaaaggaacaaaataatggcattcacagtgacctggatggaactggagaccattaatctaagtgaagtaactcaggaatgcaaaaccaaacatcgtatgttctcgctcataagcaggagctaagctatgaggattcaaaggtgtaagaatgacacagtgaactttggggacttgggggaaaaggtgggaggtgggtgagggataacaaattgggtatagtgtatactgctcaggcgatgggtgcaccaaaatctcagaaatcaccactaaagaacttactcagctgggcgcagtggctcacgcctgttaatcccagtactttgggaggtcgaggcaggcagatcacctgaggtcaggagttcaagaccagcctggccaacatggcaaaactccgtctctactaaaaatacaaaaatggctgggcacagtggctcacacctgtaatccctgcactttgggaggctgaggcgggcggatcacctgaggtcagaagttcaagaccagcctagccaacatggtgaaacgctgtctttactaaaagtacaaaaattagccaggcatggtgggtgcctataatcccagctactcaggaggccgaggcaggagaattgcttgaacctgggaggcggaggttgcagtgagccgagattgcaccaccgtactccagcctgggtgacaagagcaagactctgtctcaggaaaaaaaaaaaattagccaggtgtggtggcacatgcctgtaatctcagctatttgggaggctgaggcagaatcgcttgaacccgggaggcggaggttgcagtgagcagagatcacaccactgaactccagccttgacgagagagcaagactccatctcaaaaataaaaattaaaaataaaaaaaacttactcatgcaaccaagcatcacttgttccccaaaaaactatgaaaataaaaaataaaacataacgtgaattattgtatgacacactagtatatgtgtatcagcttagcctgaccagtaagtactctgtaccttcttcaaaattactgttttcctttgaaaaactatttctcctccttgtcattccatctttgtcatcgaacatagtttgaatgaactgacctcattccccagataagggagaagagagacatttgctgtgacccaggcccagtcaatcaatttatttcattactcttagccacagtggctgactactgagattctgtactggaatttttgctgcaactgtcggaaaagaagctttcttcccacaccagggccgctaagctagaaagatctaaacctacagctgctggcagccatattccctgaatgcataaaagaaggctctgcaataaaagaaaatgaaactaacacacacagcaaaatcttatcaacatatttgagccactgaatccagttgtgcctcaaataagctagaccactgaaattccttgttaagtgtgccaatcaattcccttttattccctgagccactctgaggtaggtttctgttctctacaatcaaaagaacccattataatgggtagtatttcagtgcaataccctttgaggatacaggtcgcccttgttatccaaattcctgatttcaaaaaatctcacaacctaaactcaagaaccaaatacgtttgagtaaacttctggaatttccttcattatcttgttatttgctatgcaaactttaggaaacaaacagattcaaataaggcagtaccccctgacattcaaattcactatccaaactgaagaattaagcaaacatgaatagtgggagatagctgtaaagtcaaccatgcagaaatatggaaaagaatttataacgtaaaatttttaaatctagaaaattgcacataaaggtatacatatattttaaaatgggttaaaacactgggcttttgggaaatcttcacattttccatctatagttataatcaaaaataagtttgatatacattacctaatttgagttgaacagcaattcttagacaaaaataaactattacctttcaaatcagaaaatcaagacctaaagagcaaaaaaaactatgaaaatatacgataaagatgacatttcaagtcagcagagaaaaaacgattactaaataaatgatgtggggatagctgaccataagaataaaacaatacacgtaaagaactaagcacattactggcatttatatagcaatcagacaatgctgtatcttttatatagaaaattatttaatattctttttattctctatctcaatgtagacacttcaaaagtatatgctaacagtatatgctaacgaggtaagaaagttgctgtggtttagcagggtgtggttcagaataggccagcttatgatgttattcactggactgagttagaagggactaattacagaggaaaactgtggtgaagaaagaaaacagggaataaagagtttcctttaaactagaagttcagttaaagaaattaaaaagtacctaaggatttttaatgcagtgttctgtgcagtgttctgcagtgtgttattaaaatttacttttcaaaatatatacattaattttgtttttgcttttttatcaaaaactttgattctgctttagaagttttacataaattaaaatctttatcaaatgttaatatgaagggaggcacaggatgcaacatatatagtcaagttacctctctgtatatttagaaattactttctcctccaaggtatttgcaacagaaagctctgtctgtcctgcttaataatcagtagtacaggttggaatcaaagttcctcttggggaaatggcaagtctttaggacaggcgagaccctgtatgaatagtaccaaagcattactgcatggtagagaacacactcaattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcactgaaaatctgcacaattcagtttcagctctggattacttcagttgacctttgtgaaggtttttatctgtgtagaatgggtgtttgacttgttttagcctattacgtttttattttctttcactctgtattaaaagtaaaacttactaaaagaaaagaggtttgtgttcacattaaatggttttggattggctttttttagtgaggctttctgaacattgagatatcctgaacttagagctcttcaatcctaagattttcatgaaaagcctctcacttgaacccaaaccagagtactcttactgcctcttttctaaatgttcaggaaaagcatcgtcagttcagtcttttcagaatgagggagaaacatttgcctgccttgtaataacaagactcagcgcttatttttttaaactgcattttaaaaattggatagtataataacaataaggagtaagccaccttttataggcaccctgtagttttatagttcttaatccaaacattttatatttccttcttttggaaaaaacctacatgctacaagccaccatatgcacagactatacagtgagttgagttgcctctcccacagtctttgaggcgaattacaaaagtccagccattatcatcttcctgagttattattttgaactgatttttttgtacattttggctgcagtattggtggtagaatatactataatatggatcatctctacttctgtatttatttatttattactagacctcaaccacagtcttctttttccccttccactgtcttctttttccccttccacctctctttgcctgtaagatgtactgtatgtagtcatgcactttgtattaatatattagaaatctacagatctgttttgtactttttatactgttggatacttataatcaaaacttttactagggtattgaataaatctagtcttattagaaaataaaaaataaaaataaaaaataaataaaaaataaaagagccactggtgagggtaggaaagacagtcttgaactgccaacaccaccctatcctctagcagcagccatgttgtccagagacagaatctgtgtacctgtgggagagatagcacagagattgtgggactttgcattgaaactcagtgctgccccgtcacaggagaaagcagcacagggcagaattcagccggcatctatggagggagcatttagacgagccctaatcagagaggaattgtccatcccagtggttggaacctgagttctggctagccctaccatggcaagctaaagtactctgggatcatacataaacttagaaggcagtctaggccactaggacttcaattcctgggcaagtcttggtgttgtgtgcacttggaatcagtggacttgaggtgcacatgacccagtgagacaccagctagggcagcccaaacagtgcttgcattacccctcccccagcaccaggcagcacagcttgtagctccaggagaacctccttctgcttaaggagaggaaagagtcacgttgtcttacaacttggatatcagctcagccacaatacagtaaagcaccaagcacagtcctgatgcccccattccaggctctacatcccagataacattcctagacacaccctgaaccagaaaggaaccagctgctatgaaaggaaagacccagtcctggcaggatttatcaactgctgcctaaagggtccttggaccttgaaaaaacttcagtagccagcagtggccaggcagtactcgccatgggccttgggagagacccagtaccatgctaacttcagatgtaacccagtgcactcccagctgtggtggccaccgtgagagactccttctgcctgagaaaggagagagaagagcaaaaatgactttgccttgcaacttgggtatcaactcagctacagtaaaataaagtactaagcaaactcttaaagtccctgattttaggccttagctcatggacagcatttccagacccaccctgggccagaagggaacccattgctctgaagagagacccaagcctggcaggattcaccacaagctggctcaacagccttcaggccttgaaaaaacatcagtggtaagtaggcagtactcaccacaggcctggggaggtggtagccacagggagagactccttctgcctacggaaagaagaggaaagagtaaaaaggactctgtcctacaacttaggcaccagctcagccacagaaaaataaagcaccaaggagattcctaaagttcccaactccaggccctagctcccagccagcatttccagactcaccctgggccagaagggaacctatctccctgaagagaagcacaggagcctgtctgaattcactacccactgactaaagcaccctaggacactcaacaaacatcaatagtagccaggcaatagtcaccacaggccttgggcaggaccccgttttgtgcagacttcaggtctgacccagcacagtccaagaggtggtggtcacggcggtgcttgggtcacacctccccaattccaggcagctcagcaaggagatacagactccactagtttgaggaaaagtaagggaagagaacaagagattctgcctggtaatacagagaattctgccagaactaacccagaccaccaaggcagtacctctacgagtctgcaaaagccacagtgttactggggcttggggtgtaccctaatgaagagacagctacaataaccaaagacagatcataatactcaatccactttgaatacttgaaaaccttctaaaggaggacaggtacaaaaaagcccagacagcaaaggttacaacaaatacctaactcttcaatgcccagacaccaacgaacacccacaggcatcaagaccatccaggaaaacatgacctcaccaaacaaactaaataaggcagcagtgagcaaacctagacagagatatgtgacctttcagagaattcaagatacttgttttcaggaaactcaacaaaactcaagataacacagaaggaattcagaatcctatcagataaacttaacaaagactaaaataatttttagaaatcaaacagaaatttgggagctgaaaaattcaactgacaatctgaagaatgcatcagagtctctcaacagcagaattggtcaagcaggagaaacaattaatgagcttgaagacaggctacttgaaaatacacagaggaagacaaaagaaaaaagaataacataagaataaagcctacaagatctagaaaatagcctcaaaagggcaaatctaagagttattgaggctgggtgctttatcacacctgtaatcccagcaatttgggaggccaaggtggaaggattacttgggcccaggagttcaagacagccaggacaacatagagagatcccatctctacaagataaatattttttaattaactggatgtggtggcacaagcttgtggtcccagctactaaggaggctgagatgggaggatcacttgaacccaacaggtcaaggctgcaatgagccgtgatcgtgccactgcactccagcctggatgacagagcgagatcccatctatggagctatagtaaccaaaacagcataacaacagacgaatgaaacagaatggagaacccagaaatgaatccatacatctatagtgaattcatttttgacaaaggtgctaagaacacacactggggaaaagacattctcttcaataaatggtgcttggaaaactggacatccatatgcagaagggagaaactagacccctatctctcaccatatacaaaaatcaaaattagaatggattaaagatctaaatctaggacctgaaactctcaaaccactgaaagaaaacattggagatctctctaggacattagtctgggcaaagatttgttgagtaataccccaaaagcacaggaaaccaaagcaaaaatggacaaataggattacatcaagtcaaaaagcttctgcatagcaaaggcaacaatcagcaaagtgaacagacaactcacagaatgggagaaaatatgtgcaaactgtctatctgacaagggattaataagaatatataaggagttcaaacaactcaataggaaaaaaatctaaaaatctgattttaaaatgggcaaaagactggaatagacaatgagatattatcttatcacagttaaaaagcttttatccaagacagacaacaacaaatgctggcaaggatgtaaagaaaaggtaacacttgtacaccgttggtgagaatgtaaattaatacagccactataaaaacagtttggaggttcctcaaaaaactaaaaacagaactactatatgatcaagcaaattaactgctaggtatatacccaaaagaacggaaatcagtatatcaaagtggtatctgcactcccgtgtttactgcagcactattcgcaatcaccaagatttggaatcaacctaactgtccatcaacagacaaatggataaagaaaatgtgatgcatataatacaatgaagtagtattcagccagccataaaaaaagaatgagatcccatcatttgcaacaacatggatggaactggaggatactatgttaagcaaaataagccaggcacaaaaagacaaactttgcattatctcattcatttgtgggagctaaaaattaaaataatttggactcatgaaaataaagagtagagtgatggttatcagaggctgggaagagtagtaaaggggcggaggaaagtggggatggttaatgggtataaaaatatagttagaatgaataagatgtagtatttgacggcacaaaagggtgactacggtcaacaataatttattttacatttaaaaataactaaaagaagtataattggaatgtttgtaacacaaagaaatgataaatgcttggggtgatggataccccatttgccctaatgtgattattatacaccgtatgcttgtcaaaatatctcaagtaccccataaatatatacaactactatgtatccataaaaattaaagttttaaaaagcatagatggggcagagaagaagggattgactgaaacaagagggaactctctggagttaacggaaacgttacacttatttttggtggtaattacaccagtgtataccatttcaaaactcatactgaacatttatgatctgtgcattttattgtatgttgtttctcagttaaaatgaattttaaaaagataccgccacacatctaagaataaaacaaaatatacgtaaggtcgcaagaagacctaaatacatggaaaaatatactatatccaataatttgacttctgtatcattaagaagccaactctccctcaaaatgatctacagattcagcacaattccaaacaaaatactagtaggttctgaacaaattaacaagctgattctcaatgtgtatttgaaatctaatggacctagaatagccaagacaatcttaaagaataacaaagttggaggacttatactaccaaatatcaagacttagtacaaagccacaaaaagtatagtacttggtacaaggagagacacaagagaatccagaaacaggctcctatacaatgatgttctaacttaaaacaaagatgccactgcaattcagtatgggggaaggaaaggcttctatgtcaatggtgctgcaccaactggattgtctagaaaaattaattcatggacaaaaattactttatgatggatcatagaccatgaaaggtaataaaattaacatttctagaatagatcaaatgagaatatttacatgagccaggcacggtggctcatgcctgtaatcccagcactttgggaggccgaggcaggcagaacacctgaggtcgggagttcaagaacagcctgaccaacatggagaaactctgtctctactaaaactacaaaataagccaggagtggtggcgcatacctgtaatcccagctacttgggaggctgaggcaggagaatggcttgaacccgggaggcggaggttgcagtgagctgagatcacgccactgcactccaccctgggcaacaagagcaaaactccgtctcaaaaaaaaaaaaaaaaagaatatttacatgaacctagagtgggatctcgaacaacaacaacaacaaaaaaaacacactaggtactaaccataaaaaataataaatttgactttattaaaattaagaacttctattcaattaaaaaaatcattgagagtaaaaaggcacagaagatacctgcaatacacatatcaaaaaaaagacttatatccagatttttgtaaaaacagctaaaaaataagaaaactgcccaatctttttaatgagcaaaagacttaaacagattattatgaggatatataaaaggccaatatggatataaaaaataaaattcaacatctgtagtagctcattgttcaaaaatattcacttcttatccttacatgcattgaagacttatacttccgcaaccatgaattttggctacaccacaacttagtttaaggagtggaaggtcagcagacatgacataaacacgtcttgaaatatgcttgaacaactggatatgacttcttgcatttatgttaccactatgaaaagaacatgtcccatctggcctactggtgcacataagaagatgagatacacacagcagagctgtcccagctgacccacaaatccttaaccaagaaacaaatacttgagtaccactggagattttcaggttaagcagtaatagctgactaatacaggccaagtgtggtggctcacgcctgtaatcccagcactttgtgaggccaaagcgggtggatcacgaggtcaagagatcaagaccatcctagccaacatggtgaaacccgcctctactaaaactacaataattagccgggcgtggtggtgcgtgcctctagtctcagctactcaggaggctgaggcaggggaatcgcttgaacccgggtggtggaggttgcagtgagcagagatcacaccactgcactccagcctggcaacagagtgagacttggtctcaaaaaaaaaaaaaaagaaagaaagaaagaaaaaagccagataaaagagtacaaactaaattatcccatttatatgaagttcacaaacagacaacataaatctatggatacagacaccagaagcatggtttccttagcggagaggaagttatataggcagggcacaaaaggaaggccttacaaagttttataaacattctatatcttaatatgggtggtggataaccggtatatacatatgtaagaaatttttaactgtaaatactgaagatttatgcactttattgtatgttacatgggaactgcttgaacccgggaggcagaggttgcagtgagctgaggttgcaccattgctctccagcctgggcaacaaacagcaaaactccgtctcaaaaaaaagaaaacaacaaattagttatttgtggtaaaaaggaatctgagggaaaaaaagaaataaaagagattggttatttgaagttaaactggtattccatataataaatgtattattatactgcaatcattacattatatattacaatatataatcatatattaatacattatataatatataggtaatcattagcaatattgataattatatattacataatataatcttatatgatataatctattaactatattaattacataaatttatattataatctaatatacttattaaatatattaatattattactatataaattaagactgtctcaacattatattttaccataatcactaaatacctgagaaaagtacaaatattagcatctggtttaaatattattcccaatactaattaattaatttatttcattttattttatttttgagacagtctcactctgctgcccaggctggagtccagtggcgcagtatcgactcactgtaacctccgcctcagcctcccgagcagctgggattacaggtgcctgcccacacctggctaattttctgtatttttagtagagacggggtttcaccatgctgaccaggctggtctcaaactcctgacctcgtgatccacccgcctcagcctcccaaaacgctaggattacaggcgtgagccaccatgcccagcctccaatatttatttttaaaatattacactatttaaacagtttcaaaataaactaaccttttgcccttctactgggacgccacatggagactagactataaccaaaacatgaatcttaaataacttaaaatctctccctccacaagacatatttctattgtttgcaaaatgagattttattttcttgataaaacagtgtaatataaagtacttagaaagcttctgtgcttttatccatttaagtaatacaattccagaagcttcaaatgtttactcattctattaaaaatcttttaaggctataaaaaaaaattcatattgttttactctgcaaatcttctactctgtagaaaccccctcaagtttactcataagaacaacacaaagcagagtttaacagaataactaaaaaccttagaattcttagtgaaaatacataaaaactattagtaattataaatgattttcttttctaagtcatttattctgagatttccttttactagtttaacatacttgcctataggactatcaaatcgcccttcgacagtccttatagaaaataagaatatttccaacagctttctcactaggcttccattctctacataaagatattaagtaaacatgcatctagtgagtcctatgagataaagaatgtcctacacctaagcagtacttctctgaaattctgtaatatttattttactaatttttttaaaaaaagctttattgagaatatatagttggacactgtgctgtgtgctttatatgtattacttcatttaataagaaatatgtgatattatacccatttctagatttaaaaaactaatgccatagatgtgatgttcccaagatactacaactactatgttgatgattacaaactagatcccaatttctcttttttttttttttcctttttgggacagggtctcattctgttgcccatggctcactgcagccttgatcttcctggctcaagccatcctcccacctcagccccccaggtagctgggactacaagtgacagccatcatgcctggttaattttttttatttttatttttatttttgcagagacagggtctccctatgttgcccaggctagtcttgaagcctgggatcaagtgatcctcccaccttggccccacaaagtgctgggattacaggtaagagccaccatacccagccatatcccaatttctttaccaatatgctactcttagcacaaataagaaccatggcaataattaatgataatgaataactgcatcaaacactcatacagcatttactgtatgttttaatcattccatcctcataacaaccctaaggaaaggcacactattatgtcttattttacagatcaagaaactgaagtacatagactttgccacttgtctaaggttacaggccagtacatggcagagctaggatgtgcacatcagcagtccagccctagaatctgggagctaaaccactatgccactttgcctttcacaaactgccttatactgcctcatagctgataaggtatatatcatatctcctttatgaactcacaagctcttaggtagcaaagaccaagacttctaacctaatcagcattagacttttgccagcatagggactggtaaataataaaaagaaactagaaggtgcactgaggtcctaaggaaagcttctttgtagtagtgactcttgaggttaaccttgccactgaactctacaattgtatatgtaattgtttagtgcatatttgatagtctcccctactagtatataggcttgttaagggtagaatatttttttgtctttccatctgctatacaacattcaaaaataaataaaataaataataaaataataaaaattcaaaatgtttgttgaataaatatgtgaaaaactttattacagagggttatacttcacaatccctactatcaacagaatcaatacaagatctctagataagagattcacagcaattaaataatttgtgacaaaccacttatcaggttatggaagcagacaggagaatagaaaaagatagtgatagaaggtagaaacatgtattacttaaacccaacagtaaatataggagcaaagtaaacagtgactcttttttctcctttaatttgcatactcatgaatttttatccctccttcattttctttcagaatacccttcagttgagtacctcttctgactttcaattagaatgggggggtggggcgcagggccgggggaggctggtgtggtggctcacgcctgtaatcccagcactttgggaggctgaggtgggtggactgcctgaactcaggagttcgcaaccagcctaggcaacacggtgaaaccctgtctccactaaaaatacaaaaaaaaaaaaattagctgggcatggtggcggcatgcacctgtagtccctgctactcaggaggctgaggcaggggaatcacttgaacccgggaggcagaggttgcagtgagccgagatatctccactgcactccaacctgggtgacacagtgagactatgtctcaaaaaaaaaaaaaaaaaaaagaatgaacgtaggcccagcgaggtggctcatgcctgtaatcccagcactttgggaggccgaggcagatggatcacctgaggccacgagttcgagaccagcctggccaacatggtgaaaccccatccctactaaaactacaaaaaaaaaacaaaaaactacccagatgtggtggcacacgcctgcagtcccagctactcgggaggctgaggcaggagaatcacttgaaccggaaggcagaggttgcagtgagcagagattgtgccactgtactctggcctgggcaacagattgagactctgcctcaaaaaaaaaaaaaaaagaatgaggggcaggcctcaatctacgggttaatccacttatgagctctacaaatatctgcacattttggaggccttgttgacaatatagatatactcaatgacacaataaaatactgagacttaggcaggagaattgcttgaacccaggaggtggaggctgcggtgaaccaaaaccgcgccactgcactccagctgggcaacaaagtaagattccatctcaaaaaagaaaaaaagacacagtaatcaatggaacagaatagagaacccagaaacaaagccacatacctacaaccaactgatcttcaataaagttgacaataataaacaatggggagatgacaccctattcaataaatgctgctggaaatactggctacccatatgcagaagaataaaactggacccctacctctcaccatatacaaaaattaactcaagatggattaagcacttaaatgtaagacctcaaactatagaaatcctaggaggaaactagaaaaaaaattcatctgaacatttgcctaggcaaagaatttatgactaagacctcaaaagaaactgcaataaaaccaaaaactgacaatcaggcttaaactaaagaacttctgcatagcaaaataaaaatatccacagagtaaacagacaacctacaaaatggtagaaaatatatgcaaactatgcatctgacaagagactagcacctggaatctataaggaacttaaatcaacaagaaaaaacaaaccatctcattaaaaggtgggcaaaggacaggaacggcacttctcaaaagatgacatacaagcagccaacaaatatgaaaaaaatgctcagcatcactaatcatcagggaaatgcaaattaaaaccacagagatatcatctcacaccagtcagaatggctattattaaaaagtcaaaaaaataagagatgttggcaagtatgtggaacaaaagggaacactcacacatttggtagaaatataaattagggtcaggcgcagtggctcacgcctgtaatcccagcactttggcaggccaaggcaggtggatcacttgagatcaggagttcaagactagcctggccaacatggtgaaaccccgtctctaccaaatatacaaaaattagccaggcatggtagcacacggctgtaatccccggttacagaggcaggttacagaggaggctgaggcaggaaaattgcttaagccgaggagacagaggctgcagtgagccatgatcccaccactgcactccagcctgggcgacacagcgagactccatctcaaaaaaaataaaaataaaaaagaaatgtcagttagtttaacccctatggtaaacagtatggagatttctcaaagaactaaaaattaaactaccatttgacccagcaatcccactactgagtatctacccaaaggaaaataaatttttctatcaaaaagatacctgcttagccaggtgtggcggtatatgcctgtagtcccagctattcggaaggctggggtgggaggatcacttgagctcaggaggcagagaggttgcagtgagccaaaatcataccactgcactccagcctggggtgacagagtgagagcccatgtcaaaaaaaaaaaaaaaaagtatatataatatacataaaagagaaaaaagatacctacattctttttcttttttttttggagacggagtcttgctctgtcacccaggctggggtgcagtgccgtgatctcagctcactgcaagctccgcctcccaggttcatgccattctcctgcctcagcctccagagcagctgggactacaggcgcccgccaccacgcctggctaattttttgtatttttagtagagacggggtttcaccgtgttagccgggatggtctcgatctcctgacctcgtgatccacccgcctcggcctcccaaagtgctgggattacaggcgtgaaccacagcgtccagccaaaagatacctacactcttatgtttatcacagcactattcacaatagcaaagttatggaatcaatcatcaatgtaagtgcccatcaatggcagattgagtaaagaaaatgtgatacatacacaaaatagaatatcacactaccataaaaaataatgaaatcatgtcctttgcagcaatatgaatgcagctggaggccattatcctaagtgaattaatgcagaaacaaaatgaaataccaaatattctcacttttaagtgggagctaagtagcgggtatagatggacataaggatgaaacactggggactccaaggagtgtgaggaggggaggagggaaagtctgaaaaactacctattgggtattatgttcactatttgggtgatgggttcagtagaaacccaaactccagcgctacacaatatacccttataaggaacccgcacgtatacaccctgaatctaaaatttaaaataaaaaaaaagacaccttcactcatatgtttattatagcactagtcacaaatagcactgttcacaagtcatggtctcaacttaagtgtccatcaatggacattattattctctgacctccctataagtagacatatttccctttaagaccagtcatggttagtaatcaattcttactgaatcatcctctaataatatggatacttaggacagtatggagatattaacaaaccatttgttcccacaagctgaaactaagccattacttaccacctttcaagtgtgaccatccattactacattaatacattcacctctaaatatcattaagactcagatcagcaacttgtaacatttgccccaaatacttaaaaatcattcacttggttcctgtaacaaaaatggatcagaagaggtaattatttcaaccaactaccgccacaattgtcagggtccatggaacatcaaaaaattataacaaaataataccatcttgcaacagccattgtatctaggcatacccctgctctttgttccatagagtcaacatataactcttattcacatctcaaggaatctaacttaaaatatattccatggatgacctcctaaaaactgaaagaaatttagattaaaaagagccacactttgattgaacaaatacatacctatagctgagattagctgtttaacaatggttcaacatggcaatgattttatagcaaaagtccctggggagttataaaaacagaaacctagcactgatatacagtaatcttctgatataatttgatatacagtaatttggataactcttacagaccaaattgaggtatctactaaccgaaaggaaacaaaaggaaaggccaccaatgataagtattatgtaaatatggcaggtatcacagcctaataaaattaaaagactccacaaatttttgaaaaaacagaagtagctgtgtgacctgggacaagttatttaacttcaaatattattcattgggatttaatcatggtctacttctggggtccacaaaactttttctctataaagggccagactgtaagtattttaggtcttacaggtcatatggtctctgtcccaactactcaactcttcctttgcagaatgaaagaagctataaacaaaaatttatcctcacatcacctgcctttacacataaaaaatgaagtctagaaaaaaattaactgatggaaatttagatttgactaggtattaatgtgtgataataataataaattaaccatgctctcagtggaaatgagaaaagcaagtcatctcagaatccatcaaatttgttcatgctattaaaaacttagaataccaccttttcaacctgtactaaacaagaaactaataaaatactgaaagttcttccagttagaatttaaaggtcacaagggagaatcactccactatattaaaaagacaaagctaaactataaaatccaaattttaaaactcatcggagagctgagaatacaaagaagtctgaaaaaaacaacaacaacaacaaaaaacaattccagaaaggaaaaagccctttctaggctaacagacaagtgactactttcaactctgagatcatggtgaacacaggaatgaataatcctatagactgatacgatggaccaaattccaaagaagtcccacaagtaaagttaatcaaaacaacctaaaaattcttccccatggagctttaatagagtatacatcaatgtgcactaatctaggggtagactcggagggcaaagtgagatgatctgcagagtagaaagtcaagtgcagtgctaaagcagagagatccccggaacttagctaaacttaaatctcaagatctattgtagagtgaagactgaatcctcccttaaaacacttgaaaccaaaaataactacagttgcagctcagcccagacataactcaattccatgtcagaattaatagtttagtcccttttttgatctgtctgaggaattagcatgtcttttctcaggaagaagcagttagaaatttcattttcactgcctttttttttttttttttttttttttttcttgagacagagttttgctcttgttgcccaggctggagtgcaatggcacgatctcagctcactgtaacctccacctcccaggttcaagcaattctcctgcctcagcctaccaagcagctgggattataggtatgcgccaccacgcccagctaattttgtatttttttagtagagacagggtttcaccatgttggtcaggttggtctcaaactcctgacctcaagtgatccacccgcctcggcttcccaaagtgctgggattacaggcatgagctaccacgctcagccttcactgctctttttacatttaatattcacatataataaaaattacaggatagtcagtcatgaaaatgtgacttataggcaagagaaaaaagtcaacactaacccacggatgatgcagattggaatgagcaaagactttaaaataaattttataaaaatatatgatattattatgtataatcttatagagagaaaaaacattgattaaatatattttgtcacagaagaagaaatttgggggaaaaagagccaaatggaaattctcaagtaaaaaatatttgaaaagttcactaaatagacttaataacagatgagacacagaaaagatccatgaattcagagaggtcaacacaaactatccaaattaaaacgaagaaagccaggcacagtgattcacgcctgtaattccagcacttcaggaggccaagacaagaggactgcttgagtccaggagttcaagaccagcctgggcaacatagcaagaccccatctctacaaaaaaaatttataataaaaataataataaagtaagaaatactaaagtaatttcttcagactgaaggaaaataatctcagacagaagtctagatctgcaagaaggaatgaagagtactagaaaatattgtgaacaagacagctatgtctactgttaccacttctgttcaacactgtaccagtggtaacagcaagtgccataaagcaataaaaagaactgaaggcatgaagactggaggaagaattaaaactatctttatgggccaggcgtggtggctcatgtctgtaatcccagcactttgcgaggctaaggtgggcagatcacttgaggtcaggagtttgagaccagcctggccaacatggcaaaaccccatctctactaaaaataccaaaaattatccaggcatggtgccatgtgcctgtaataccagctactagggaggttgaggcaggagaatcgcttaaacctgggaggaagaggttgcagtgagctgagatcatgccactgcactccagcctgggcgacagagtgagactctgtctcaaaaaaaaaaaaaaaaaccttattagtctcagataatgagactttatatatggaggatccaaagaaatagacaaactagtaaaactaataattgaatttggcaagttcaaaagatacaaggtcaatctacacaaatcaaatatatttctaaatactccatgaaagaatggaaaatgacatttttaaataccatttataatatactcaaaaaacaaacacttagcaataaaattaaccagaatatgtgaaagatctctaacgtgaaaactatgaaactttgctaaaagaaattaaaatctcaatgaatgtagatataccatgttcaagaagaggaagactcagtattactaagatgtgaatttcccaaaactcatctatagattcaacacaatctcaatcaaaatcccagcaaagttactttgtgaatattgacaaacttatatcgtttatatggaaaagtaaaagaccaagaatagccaatacaatattgaaggagaaaaacaaggtcagacactacaagatttcaaatttactataaaactacagtaaatcaagactggcaaaacaatacacaaacagatcaatgaaacagaaaagagagtccagaaacagacccacacaaatatagtcacctgatctttgacaatgaaacaaaggcaagtcaatggaaaaaggatagtcttttcaacaaatggtgctggaaaaactagacaactacatccaaaaaaaaaaaaatctcaacacagaccttacacgtttcaccaaaaattaactcaaaatggatcgcatatctgagtgtaccacacaaaactattaaactcctataagacagcatgggggaaaatcttggtaaacttaggcttggtgatgacagtataagagaaaatcttgctaatctcagccttggcaatgacgttttagatacaacaccaaaagcacaaaccatagaagaaataattgataagctggacttcattaaaaataaaaacttctgctctgcaaaaggcaccgttaagagaatgaaaagacaagccacagactgacagaaaatctttgcaaaacacatatatgataaaggactagtattcaaaatataccttaaagatgccgggcgccatggctcacatctgtaatcctagcacttggggaggcagatgtgggtggatcatttgaggtcaggagtttaagacaagcctggccaacaggctgaaactccatctctactaaaaatacaaaaattagccaggtgtggtggtgcatgcctataattctagctactcaggaggctgaggcaagagaatcacttgaaccggggtgacggcagggtggtggcagggtggcggggggcggcgcgggcagaggttgcagtgagccaagatcatgccattgcactccagcctgggcaacagagtgagactctgtctcaaagaaaaaaaaaaaaaaaaaaaatatatatatatatatatatatatatataaacacataaacacacacacctccaataactcttaaaacacaataataaggaaatgaataacccaattaatatgggccaagtgggaaatctaaacagacatcccaccaaagaagatatacagacaacaaataactaaatgaagatactcaaaatcatatttgttagggaactgaaaatcaaaaccatggtgagatagtactatatgcctattagaatggcaaaattctgaaacaatgacaaaaccaaatgctagtaagaatgtggaattacaggaactctcattcattgctggtggggatgcaaaatagtacaaccacttttcaagacagtttggcagttcttacaaaactaaacatacttttgccatataatctaccaaccatgctcactggtatttacccaaatgagctaaaaattcacttcactacagggcttgccagggtggctcatgcctgtaatcctagcactttggaaggctgaggtgggaggaacgcttgagcctaggagttcaagaccagcctgggcaatgtggtgtgacctccttctctacaaaaaataaaattagccaggcatggtggtacatgcctgtggtcctagctactcaggaggctgaagtgagaggatcccttgaaccagaaagatagaggctagagtgagcccagatcataccactgcactccagcctgtgggaccctgtctcaaaaggcaaaacaaacaaaaattacctccacccaaaaacctgcagacagaaatcagacacagtggcacatggcaacagtcctcactattcaagaggctgaggtgggagaattgcttgagcccaggagtttggggccagcctgggcaatatggtgagaaactgttgctaaaaataaaaaaataactttaaaaacctgcacatggatgtttacggtagctttatttatgattgtcagaaattgaaagccaccaagatgtccttcaaaaggtgaataaacaaaccctagtatccatacaatagaatatatttcagcaataaagacaaacgagctatcgaaccatgaaaaaatacagaggaatcttaaatatacattgctaagtaaatccaaaaagcctatgtactgtatgattccaactacatgacattctggaaaaggcaaaactatggcgacagcaagaagacagtggttgaaaagcgttgtgggaggtgaaaggatgaaaaggtaaaagcatgagatttttaaggcagtgaaactattctctatgatactgtaacggtacagacatgtcattatacatctgtcaaaacccacaggatgtaggacacagagagtgaaccctaaactacagaccacaaatagtaacgatggattaatatggctcatcaactgtaacaaatggacctcacttaaccaagatgctaaacaataggggaaactgtgggggcaggaggaggagcaaggtgatatccggaaactccgtattttctgctgcatttcactgtaaacctaaaactgctttaaaaaatagaccctattaaaaataaaagaaaatttaaaattttaaaaataaagtatattaattaaaataatttttagttgcttacaaagtcatcaacctgcatactataaaattttggcattttattgtaaattaaaacttaattttttaaaatgtaatactcaacagtctcttaggccttctatctgaagatgaatatcgaaaaaaggatacagtataatatgcatgtgttttaaaaatgcaaggtgacatatggtctacaagtgcatatgcatatatataagtaaatgcacaaataaatatatgaaaacacatataccaaactggaaagagcaccactaggaaacgaacactatggaaaaccaacactactgtgaagggaatgaaaggaaaagatgggggatgtggagtgtgtcctaatccatatgtcttgatctctcttaagaggatctacattaatgtttccaattcgctattattaggttttatactacatttaaaatgtaggcttcagaatctgaagaggaatttcaaaatgttttataaatctttaagactaaacagcctcagcataaactaacattggagacagatttttacctgtaagtatttctgcacctgtatttaaaagtataaaaaagtatttaaaagtttaaaaaagcatttttacctgtaagtatttaaaaggaattttaaatcactcaatagtgattgatcaggcaaggaacaagtattatctgctgattcttagtttgtctgtaatgccatccctacaaagactgtatttccattgcaccctccttttattactcggctgattataccctaaaacacatacacactcctccctggtgtagatgctgacagcttaattcacattatataattcatataatagtgaagttgtaatacagaatgcaacagtatccattatatcagaataaggaagaaaactggtctgagatgtgctattatgatataaaatcaactaacaacgtaccaatcaataaactaaccatgcttctcttttttttttttttttttggtaaatgtgggtattttaattttccttgataaggacaaatatggccatgagaagtttctctgggagtttcatcatctgccatttacagagagtgggaagttatgcagcaattagcctaggagagaagtgtccaccaacctatgaagacagtctccacagctcaaggagacagtaagagccagaaagcgttaataccagtcaccccaaaaatgcaaagatcctcccagtaagctacttaaaaaatgtaaaaagtgaggtctaaattgtgaaattatactttttgggttttttttttacttttaagttcaagggtacatgtgcaggtttcttataaaggttaactcacatcacaggggtctgccgtacagattatttcatcacccaggtattaagcctagtacccattggttatttttcctgattctctctctgctcccaccctccacctcatcaattagcttccacttatgagtaagaacatgtggtatttggttttctgttcccatattagtttactatgaataatggcctccagcttcatccatgttcctgcaaagaaaatgatcttgttctttttgatggctacacagtattccatggtgtatatatacaccacattttctttaccggtctaccactgatgggcatttaggttgattccacgtccttgttatcataaatagtgctgcagtgaacaaacacacatgtgtacatgtctttaggatagaatgatttatattactttgggtatacacccagtaatgagattgctgggttgaatggtagttctttttaggtcactgaggaatcaccacactgctctctacaatggttgaactaatttacactcccaccaactctgtatatgtgttcctttttctctgcaaccccgctagcatctgttatttttgactttttaataatagtcattctgactggtgcgaggtggcatctcattgtggtctgattcacatttctctaattatcagtgatgttgagtgtttttccacatgcttgttggccacaggtatgtcttcatttgaaaagtgtgtgttcatgtcctttacccactttttagcgggttttcttcttgtaaatttaaattctttataggtgctagatattagatctttgtcagatgcagtttccaaaacttttcttccattctgtagactgtttactctgttaatagtttcttttgctgtgcagaagctctttagtcactctaagctctttgtcaatttttgcttttgcaattgcttttggtgtcttcgtcataaaatctttgcccattcctgagtccagaatggtagtgcctaggttgtcttccatggtttttacagttttaggttttaaattagagactttaatccatcttgagttaatttttgtacacggtgaaaggaaggcatcgtttcaatcttcttcatacagctagccagttatcccagcaccatttattgaggagggagtcctttgcccattgcttgtttttgtcagctttgttgaaggtcagatggttgtaggtgtgccttatttctgagctctccattccattggtctatatgtctatttttgtcccagtaccatgctgttttgtttccggtagccctttgtagtacagtttgaagtctggtagatgcctccaactttgttgtttttgcttaggattgccttgactatttgggctcttttttggttccatatcaatttttaaatatttttttctagatctatgaagaatgtcattggtagtttgataggaatagcactgaatcgataaactgctttgtgtagtatggccattttaacaaactgattcttcctatgaatgtggaatgtttttctattagtttgtgtcatctctgatttctttcagcagtgttttctagttctccttgtagatatctttcccctccctggttagctgtattcctaggtattttattccttttgtgatgattgtgaatgggatttgtgttcctaatttggttcttggcttcttgactgttggtgtattggaatgctagtgatttctgtatgttggttttatatcccgagactttgctgatgtcatcagcttaagcagcttttgggctgagattatgaggttttctaaatatagtcatgtcatctgccaaggacatggacagggacatggacagggatagtttgacttcctctcttcctatttaaatgccctttatttctttcccttgcctgattcctctggccaggacttccaatactatgttgaattaggcagtgatggagggcattcttgtcttgtgccagattaagacaaatgtttccagttttggcccatgcagtatgatgttggctgtgggtctgtcttattattttgaggtatattccttcaatacctcgtttattgagagtttttaacacgaaaggctgttgaattttatcaaaattcttttctgcatctattgatataatcatgtggtttttttagttgtttatgtgacgaatcacatttactgatttgcatatgttgaaccaaccttgtatcccagtgataaaagcctactagatcatggtgggtaagttttttgacatgctgctgaatttggtttgccagtatcctgttgaggatttttgcattgatattcatcaagcatgctggcctgcaattttttttgttgtgtctctgctaggttttgatatcaggatgatactggcctcacagaatgagttaaggaggggtccctcctcctcaatttttgggaatagtttcagtaggaatagtaccagctcttctttgtatatctggtagaatttggctttgaatccatctggtcctgggcttttttgctcgatgggctatttattactgattcaacttcaaaactcattactgacctgttcagagatccaatttcttcctggttgagtcttaggaaggtgtacgtatctaggaatttatacatttcttctagattttctagtttctgtacacagaggtgttcataacagtctgatgattattcctatttctgtgaggtcagtggtaatagcccttttgttgtttctaattgtgtttatttggaccttctccattttcttattagtttagcaagcaatctattaattttttcaaaaaaccaaatcctaaattcactgatgttttgaatggtttttcgtgtctcaatctcctgccattcagctttgattttggttatttcttgtatgctgcaagtttgggggttggtttgctcttggttttctagttcttttagttgtgatattaggttgttaaattgagatctttttaactttttcatgtgcacacttagtgctgtaagttttcctctttacactgcattagctgtgttccagagattctggtatattttatctttggtctcattagtttcaaagaacttggtttttgccttaatttcatggtttacccaaaagtcagaagaaggttgtttaatttccatgtaattgtatggttttgagcaattttcttagatgtgacttctaattttattgcactgtggcccaagagagtggttgttacgacttcagttcttttgcatttgcagagaaacatgtcgaattgtgtggtcaatttcagagtatgtgccatgtggtgatgagaagaatgtatattctgttgttttggggtagagagttctgtagatgtctattaggtccatctgatccagtgctgagttcaggtcctgaatatctgttaattttctgccttgatgatctttctaatactgtcagtggggtgttaagctctcccactattatggtgtagaagtctacatctctttgaaggtctctgagaacttgctttatgaatctgggcgctcctgtgttgggtgcatatatatttaggatagttaattctcttgttgaaatgaaccctttaccatcatgtaatgcccttctttgtccttcttcatctttgttggtttaaattgttttgtttgaaatttggattgcaacccttgcttttttgttttccatttatttgcttggtaatttttctccatccctctattttgagcccatgggtgtcactgcataggagatgcactacacaccttagtttttttatccaatttctcactctgtgccttttaattggagcatttagcctgtttacgttcaaggttagtattgataagtgtggatttgatactgacatcatgatgttacctggttgttatgcagacttgtgtggctgctttatagtgtcactggtctgagtacttcagtgtgtttgtgtagtggctgctaacagtctttccatacttagtgcttccttcaggagctcttgtaagacacgtctgacggtatcaaattccctcagcaattacatgtttgaaaaggatcttatttcccctttgctatgaagcttagtttggctggataagaaattcttggttggaatttttctttaagaatcttgaatattcactcccagcctcttctggcttgtagagtttctgctgagaggtccaccattagtctgatgggcttccctttgtagttctcatgaatgagatcctgaaatatattttccaagttgcttccattctccccaactctttcagggacaccaatgagtcgggtgtcatagatttggtctctacataatcccgtatttcttggaggttttgtttgttcatcttcattcttttatccatattcctgcctgattgactgtcttatttcagaaagccagtcttcaagctctgagattctgtcctcagcttgacctattctgctattaatacctgcagctggccgggcgtggtggctcacgcctgtagtcccagcactttgggaggccaaggtgggtgaatcatgaagtcaagagatcgagaccagcctggccaacatggtaaagccccgtctctactaaaaatacaaaaattagctgggtgtggtggcacaggcctgtagcccccgcttttcgggaagctgaggcaggagaatcgtttcaacccaggaggcaaatgttgcagtgagccaagattgagccactgcactccagcctggcgacagagtgagagagtctgtctcaaaaaaaaaaaaaagaaaaaatgaaaaaatctgcagctgcattatggaattcttggagcatgtttttcagctcattcgggttggttacattcttttctataatggctatttcatctgtcagctcctgtattattttattgtgattcttagcttccttggattgggtttcagtgcactcctgcatctctatgatcttcgttcctatccattgtctgaattctatttctgtcacttcacccatctcagcctagttcagaaaccttgctggaaagccagtgtggttgtctggagaaaagaaggcactctggctttttaagttatcaggattcttacgctggttctttctcaactttgcgggctgatgttccttcaatctttgaagatgctgtccttcgaaatggttttttgtttttttcctttcaccctatttgatgaccttgagggtttgattgtggtatataaggtgggttcagtcaactggcttcatttctggaagattttaggtggccaaggttcagctcctaactcccagattacatgctctaaatctgggggactggtattgggaccctattttgttctctggctcctcaatgttaggaacccactgcactgggggtaggagggtgtcaaggtgcccctggactacttgtcactacactccagcgggtggtgccaaagagttttgtaaggcagtggcagtgggatctaccctcattcccatgtgccagtggcagcacagaggggtgcacacttgtcagctgtggcagtgtgctagcagatgccagagtgtcagcctcagtgtgggcgtttgtagcagtggtacaggcagcatggcttaagcgggccccactggcaactatgcatgtggtcacactggtggtggtgttagccgggtagtgctggtaagggcaaatctgtgtgcaccctctgtgcacatttacacaggtggggatggccactcagggagggggagggttcattgttctctgtgcctagtttcactccagcagcaatgttggcaagggggtggggcactggcggggtggggcactggcagggcagggctgaaaggctctgtgcctgccaagactctgactgcaattacagtacaaccaggggaagggaggcagagtgcactcacactggcagcagtggcacagggtaatgtgcacgtgcacacgtgctggcgaggcgagggaaagcaagatctgcctgtgcacacacaccggcaaagtgatgtgtgttgggggggccggggcagtggtctgtgggcagggaggggttggggtgtaagctgcaataggggaagggagcaggcaggcaggctggtgcatatccaccggggctgttttgttttttttgttgtttttgttgttgttgttttttttgagacagagtttcactcttgttgcccaggctggagtgcaatggtgcaatctcagctcaccacaacctccgcctcccaggttcaagcgattctcctgcctcagcctcccaagtagctggggttacaggcatgcaccacacacccagctaattttgtatttttagtacagacgggatttcttcatgttggtcaggttggtgtcaaactcccgacctcaggtgatccacctgcctcggcctcccaaagtgttgggattacaggcatgagccaccgccccggcccacaggagctattctactgcagctctctgccattcaagtgtggtcaggtcagccagcccaggagctatgatgcaggtccccagggtacccaaggcttcactgcaagcaggcgcaaccaggctgggtccccagaagaggccagcagaccaaagcatgctcaggttgatgggcaagactgccctgcagagttcaggtctgactttctctagggctaaagtctcctatgggagcaagtcaagcctagggagatgggcatccctggccatgctccactatagacactcctgcaccaaaccctctgggctctgcactgactggagtgctgcctctaccacttttcaagtgtgcttgagaatcaagcagctctccctgccaactcgagtgtccatgaagtttgagggatctcctcctgccaggattccagaggcctgtggtgagagcataccgttccttgccagttcaactcacccgtttccctggagtcactgggcaccaggaacaagtcctggtgcatagtagccttgtgcagggttcccaggttcctcccacttcatcccaacatctgtgtcttccctctgtctactctcagtgccttccctctgaagatctgttaggagtgtgccagttgtcccagtccctcagtggcagccattccacctggctgtgtctagtcagccatcttgcccaccttcctcctttctttctcatattttttttccactatgcctttctccagagaaaatttaccttctattcttttctgctgtttgggtttatactactgtcgttatgtactgaactgtgctgttctcccaaaatttgtatgttaaagccccaatctgcaatgtgagtgtatttggagacaggacctttaaagaagtaatgaaggttaaatgaggtcataaggaaaggtcctacttcaataggatgggtgtccttgtaagaagagatgtcagggatgtgtgcactacaaaaaaaggtcatggaaggatacggcaaacagcagctaccagcaagccaaaaaaagaggctccaggagaaactaaacctgacaacaccttgatcttggacttctagtcaccaggagtgtaggaaaataaatttttgttttttaagccactcaatctgtggtattttgttatggcagccccagcaaattaatacaactgtacagcagtctttggcacacaattattaatatgttcaacttgatactgttttataataaactctatagaatactaactagttttctgtcattgcccaaaaagtgcaatgccctctgggcctactgtcataggtcaatgccttctgtgcctactttgcctttctttttccaatagtgcttcaaatattctatagagttcctttctcttccatctcctctactgtgatcatctctgatctctgctcttagtatttaccattgtcagaggtctactttccaacacattatcaaatttataatctaacacatttgccacttactactgtgacatatacaccctcacctcccttgactcactcctttagcagctgcttcatgtatacttctcagccttgctaatactgacattaggcatttagaaccaacaaccaaaaagagctctaccagtcagtaaaaaatatatatatgtatatgctagtttctgctgattatcttattgctcttaccagtagtattttgttctgactgacagagacgttccctgagtttggaaaactcaaatgttactccagaacttaaaaaaactgctcttcaaatactatctaaatacagtccagctaacccaccatcaacaaaatatatgccagggttgatttttctacttacatgtatgtctatgctcatttatccacagtcatccagtctcccttctctggtcaatgatgtacacttttgcagaataaaacattccaaaggcaagagtatgatcagaaaacagagtatcccttatgaactcaatcaagaataaattctgaaatcttgttctccctggaatgggacactgcacaactaagttaacacttcaaaatactcatcaaatgttgtcttattacctcaagagtcaaaacaatgtagaaaaataatggtttttgtttttgtttttgttttgagacagggtctcactctgttacccagactacagtgcaatgtcttgatcacagctcaccacagcctcaacctcctgggctcaagcaatccttccacctcagccaccccaatagctaggactataggcacacagcaccacacctggctaattttttaatttttttgtagagacagtttcactatgttgcccaggctggtcttgaactcctgagctcaagtgatcctcccacctcagcctcccaaagtgctaggactgcaggcatcagccactgtgcccggcaggatgggtcatttttattccttcaagaaccgtatgagctgggccacagaggctcacacctataatcccagcactctgggaaaggaagggaggaggatcacttgaggccaggagttcgagaccagtctgggcaacatagtgagacttcgtctctacaaaaaattttaaaaattagctgggtgtggtgacatactgctgtggtcccagttactcaggaggctgaggtgagaggaaagctcgagccccaaaagtaaaggctacagtgagccatgatctcactactgcactctagcttggacaacagtgtgagaccctcctcaaaaacaaaagcaaaaaaaacaccaacttatcaacagcaatgttgtcataccacttactaaaaagttcaaacttaaaagtttctctgggttttggtcctttttaagaggtgtcatattcattctgtatcaaaaactgtattgtgccaatggcttcgagtgggatattaaacaatctcacctctattttgttaagctgtgagataacaatgctatattaataacttattaagactaagtatacaggaattgaaattacttttatgtaaaataaaagtgcaagttaatcactatgtactgcatggtcattagaattagataggtagcaagtcataaattactacttattagcccactggtaaaattacagctgttctgaagttttagagaaatcctaaatattcaagttttccaatgaactggaatttcagctctttaagcttctctaagctttagaagttcttcttttaatactctggattaattatttctataatatactaactttatatctttttaaacaaagtatattaaatataccatgcatttcttaaaaatttagaattgcataacaaatgttaattttgatatgatacagttaatatttattagaaactactgatataaacaaggttggctgtccctgtcaatattcccagattgctttatagacaagtgcttcatcctatcagcctaacaacctataaatgtccctgttctcatttactgtttctatactacgtaaccttagaaaccaaattcttacttaaattacctgaaataaaactagcccctaaataaaagcctaggggactctcatataagtatagaaatgttaaacatattttcataatctccattaaccatttaaagactctggggttttttgcaatataatctgaaaataaacatgggctttgtagtcagtcacacagtgaggggttcagatcctaccattacacttactagctgtgaaatcttggaaagataataaaccaccttccctaaatgtttatattcttttttaaaaaaactccatcacctagttcatcattgctgtgagattaagtgtgatactgtatataaataaacaatgattgggtgctgggcgcagtggctcacacctgtaatcccagcactttgggaggctgaggtgggaaaaccacttgagcccacgagttcaagaacagcttcagcaaaaaaaaaataaataaataaaaaataaaaaaataaaaaagcaacacctcatctccacaaaaaaaatttaaaaatctacccaggcatggtggctcatacctgtagtcctagctacttggcaggctgaggcaggaggatcactggaccccaggagttcaaggctgcagtaagctatgacttcaccactgcaccacagcctgcataacagagtaagatctgtctcaaaaaaaaaaaaaagtcaactttcatacctattttaatcattgatacaaatagttaatataacaaatttactgaattttacaaacaaaattcaccatttctttttcgtttttatttcttgatatccatatggggtgttagctttctataccaaatagcttttaaccactttattcttttcttgtttttcttttctttcttttcttgtcctctgtgactgagacatttccacatggctaaaacagtagaaatccttaagactacagtcatatatgggaaagaatacgcaagcctaactgctcacactcctagatcataaataagcttctgaaagtcaaactctgctatttactagtaatacaactttacctgaactactctctctctctgagccttaatttcttcatattcaaaaaagaatggagatatccatctccaataacatggccaattacacagaacacaactacaactaagatttttaaaactaaatacatcagaaaatatatattctttttttcttttttttttttttgagacagagtttcactctcttgcccaggatggagtgcagtggcgcgatctcggctcactgcaagctccgcctcccaggttcacaccattctccctgcctcagcctcccgagtagctgggactacaggtgcccgccaccacgcccagctaattttttgtatttttttagtagagacggggtttcactgtgttagccacgatgatctcgatctcctgaccttgtgatccacccaccttggcctcccaaagtgctgggattacaggtgttagccatcgcgcccggcgaaaaatatatattcttaaaagcctcaaagagctaatgttaaagaattataagcccaaaacataagatagggcaggaattcagagagataagcagagcactgaagccaggttagctactgacagaagccaaactcaggctttggttttcatagtctcataatgatagaagccaagcccatgacccagccttagtggtgagtctgataagacacccctataccatatggctggaaccagtaaaatgaacaaaagtaaacctgtcctattctaacctaatcccctaagaacttcaaagaaagctgctttggcactgagcagaaaagaatgatgggagaaaggagagttcctgacaagttattaacaggaaacagcaaactttttctgtaaagggccagaggtataaatattttaggccttagctgagtgtggtgcctgcctgtagtcccagctactccggaggctgaggcagcaggatcccttgagcccaggggtttaagactgcagtaagctatgacttcaccactgcacgaccactgcccaccatcctgggcaacagagggagactgtctctaaaaaataaataaataaataaatattttaggctttgaaggcaatatgatctctgttgtaaccaatcagctctgctgttgtagcatgaaaacagccacagacaatacataaaccagtgagcatggatgtattcaataaagatttataggcacttaagtttgaatttcatatgattttcatgtcacaaattatttttttccaaccatttaaaaatgtaaaaaaaactctactagcttgcagcccaaacaaaacaggtggcacaagccagtttccatttacttgtaacaacaagacacacaccaccacttcagccaccaccttacttacacacacacacacacacacacacacacacacagagatttgaggctctaattcccatcacctagatgaagtaaaaaacatcaggccataaacatttagaaaatacatgtgcaaaacccaccaagtactgtcccaggaaaaattaacaagaaaaaaagcaccacaaatgaaaagcaagcaagcaaagaataccaacacacatgcaaaaatttcagatattagaaaagatcacatagagaatataaaataactgctttctaaagtttaaagcaacaaacaagcttgaaagggtcgtatatatgagaggggaaagaatcattaaaaaatgacttagcaagctaggtgtggtggctcatgcctgtaatttcagcactttgggaggttatggtgggctgatcacttgagcccaggagttcaacaccagcctgggcaacatagtgagaccctgtctctacaaaaaataaaataaaataaaaaatagctgggtgtggtggcctgcacctatcgtccctgctactcaagaggctgaggcaagaggatcacctgagcccaagggaaagaggctgcagtgagccgagatcacaccactgcactccgccctgggcaacagagaaaaaatgacttagcaaatataaagaattaaaataatttctaaaattgtaaaacacaaggaactgaaattaaaaatcaaatcaggccaggcacagtggctcaagcctgtaatcccaacattttgggaggctgagatgggtggatcacttgaggttaggagttcaagaccagcctggccaacttggtgaaaccccgtctctactaaaaatagaaaaattagctgggcatgacagcaggcacctctaatcccagctacttgggaggctaaggcacaagaaccacttgaagccaggaggcggaggttgcagtgagccgagactgtgccactgcactccagcctgggcaacagagtgagactccatctcaaaaaaattaaataaaaaaaaccacacaaataaaaaataaaataaaatcattgaaaagtagtgaacttaaaacatacatctgaagaaatcacccacagtaaaagaagaaaaatacacacccaaaaaaagaagaaaaacacaaaaatacaaaaaaaggttaaaaaaacatataagaaagccagacacggtggctcgtagctataatcccaggaacttgagaggctgaggtgggaggatcacttcagcccaggagttcaaggctgcagtgagctatgatcacaccactgcactccagctgggaaacagagcaagaacttgtcaaaagaagaaagaagaaagaggaaggaggaagaagaaagaaggaagaggaggaggaggaggaggaataaaagaaaaaatacataagagtaagaaaatctaacatatatagacatacctcattttatcgcactttgctttattgcacttcacagatagtgattttttaacaaattaaaggtttgtggcaaccctgtgtcaagtaagtcaacaggtgccatcttctaacagcatgtgctcacttcgtgtctctgtgtcaaattttggtaattcttgcagtatttcaagcttttttaaacttttttatgtatttatttatttttagagacaggatctcgctctgtcacccaggttgcagtgcagcagcatgaccatcatagctcactgcagcctcatattcctgtgctccagcaatcctcctgcctcagcctcccaagtagctagcactacaagtgcatgccaccctgcccagcttattttttaagtttttgtacagatgaggtcttgttatgttgctgagtctagtctcaaactcctggccttaaagcaaacctctcacctcagccttctaaagcacctgtattacaggtgtaagccgccacacctagcttcaaacttttttattattatatctgttatggtgatctgtgatcagtgatctttgatgttactgtaattgttctgaggcaccaaaaatcatgaccatataagacagtgaacttaatcaatcaatgttatgtgtgttctgactgctccatcgaccagctgttccctgactctttcttctcgttgggcctcactattgcctgaaacacacaatattgaaattaggccaattaataaccctacaatggcctctcagtattcaaatgaaaggaagagtcaaatgtctctcactttaaatcaaaacctagaatgattaggcttagtgagaaaggcatgctgaaaacctagacaggccaaaagctagacctcttgtgcaaaacagtttgccaagttgtgaatgcaaaggaaaacttgaaggaaattaaaagtgctactccagcgaacacacaaataagatagcaaaaccaccttactactgatatggagaaagttttagtggtctggaaagaagatcaaattagccacaacattcccttatgccaaagcctaatctggagcaagtctctacctctcttcacttctatgaaggctgagagaggtgagaaagttatagaagaaaagttggacactagcagtgttgatgcatgagatttaaggaaagaagccgcctccacaacataaaagtgcaaggtaaagcagcaagtggtggcatagtagctggagcaagttatccagaagatccagctaagataattgatgaaggtggctacactaaacaacagatttttaatgtgacaaaacggccttgtgttggaaaaatatgtcatctaggactttcataattagaagtgaatgcctggcttcaaagcctcaaagaacaggctgcctctcctgctaggggctaaggcagctaatgactaagctgaaaccaatgctcattgaccattctgaaaatcctagggctcttgagaattaacgctaaatcaaggccagatgtggtggctcacgcctgtaatcccagcactttgggaggctgaggcaagcggatcatctgaggtcaggagttcaagaccagcctggccaacatggtgaaacctcgtctttataaaaaatacaaaaattaaggtgggtagatcacctgaggtcaagagtttgagaccaacctggccaacttggaaaaaccccatctctactaaaaatattagctgggcatggtggtgggagcctgtaatcccagctacttgagaggctaaggcaggagaatcatttgaacccaggaggcagaggttgcagtgagccaagatcacgccactatactctccagcctgagtgacagagcgagactgtctcaaaaaaaaaaaaaaaagaaaaaaaaaaattagctgggcatggtggtgcaggcctgtagtcccagatactcaggaggttgaggtgggagaatcacctgaacccaggaggcagaggctgtagttagttgagatcacaccaccgcactccggcctgggcaacagtgagatcctgtctcagggaacaacaacaacaaaattacactaaatctactttgcctttgctctctaaatggaaaaacaaagcctgaatgacaacacatctgttgacagtaaggtttactgaatgttttaagcccaccgttgagacctactgctcagaaaaataagattccttcaaaatactactgcttattgacaatgcacctagttacccaagggctctgttaaagatgtacaaggagattaatgttttcccacctgctaacacaacatccactctgcagcccatggatcaaggagtaattttaactttcaagtcttattatttaaaatatttcatgaggctttagctgccatagacagtgattccccttatggatctgggcaaggtaaacgtaaaaccttctgtaaagaattcacctttctgggtgccattaagaacattcatgactcgtgggaagaggtcaacataacattaacaggagtttggaagaggttgttcccaagcctcatggatgactttgatggcttcaagacttcagtggaagaaggaattgcagatgtggtggaaacaaagataattagaatttaaaatggagcctaaagatatgactgaactgcagcaatctcacaataaaacatgaacagatgataagctgcttcttactgatgaccaaagaaagtggtttcttgagatagaatctactccttgagaagatgctgagaacactgttgaaatgacaacgaagtatgtataatattacatcaacatagttgataaagcagctgcagggtttgagaagactgactccaattttgaaaaaagttatattgtgcataaaatgctatcaaatggcactgcatgctacagacaaatctttcattaaaggaacagtccactgatgcagcatacgtcattgtcttatttcaagaaattgccacatccactccaactttcagcatccactatcctgattagtctgcagccaccaccatgaagtaaagaacctccaccagcaaaaagattacaattcaatgaaggctcagatgaccgatgaccgttagcatttttttaatattttctaatcaatgtgtggatatttttgtagacatggtgctattatacactttaaatagactatagtacagtataaacataagtcttatacgcaatgggaaaacaaaagtttcatgtgacttgctctactgcaatattcactttattacaatatttgctttattgcagtggtctgaaactgaacttaaatatatcagaagtatgcctgtatataaactggagatccagaaaaagaaagactgagatggtgaaacaaaaatatttaaaaactgggaggccaaggtgggcggatcatgaggtcaagagatcaagaccatcctggccaacatggtgtaaccccatgtctctactaaaaatacaaaaatgagctgggcatggtggcgtgcgcctgtagtctcagctactcaggaggctgaggcaggagaatcgcttgaacccaggagacagaggttgcggtgagccgagatcacaccacttcactccagcctggtgacagagcgagactccatctcaaaaataaataaataaaataaaaatttttttaaaaaaaagaagaaacagaaaaagaaagaccactgaaactataagatcatttcctctgaaaacaattaactagaaatcagtataaaaaagatgagtgggcataacaaatgtatttttcaaagatgtccacaccagcatataccccatcccacacatacttttacaatgtgacttgacacttttccctatgcttcctcctcctcaaacatgaatggagctctgtaactctggatcaccagaatgcagaaacaaggctaggtcataaatggcaacatggcttctatctggtatgctctctctctcaggaattccactgaccatgccctgacaacagttaaagtttcatggaaaaacccacatggaagggaactaacacagaaatgccaagtttaaccactcctgaattcctaacccaccaaaactgtaaaggataataagccactaagttttgggcttaactggttatgcaacaatagataactaacatactaaaaattgtcacttatttggaaatttttaaatatactcctaaataatatatgtgaccaataaatgaaaaatattttgaaataaataacaaaactacatttcaaaacttgtgagatgcaattaaagcaatacttcatgggaaaatgtataaccctaaataagtataataggaaaaaaaattagagagctatctattcagaagataaaaaagaattgcaaaataaacctgaagaaagtaggaaggaaataacagaagtgatcaggtgtgtgtggtgccacacacctatagccccagctagccagggggctgaggcaggagggttacttgagcccaggagttcgagaccagcctgggcaatataatgagaccacacccccatctcaaaaacaaaacaaaacaaaacaaaacaaactgctgtgatcatattttggttagaaaagaaatgataaaaacgaagaagtgataagtagagagaaaacaaaatagtaaaggccatcaaagccagaagttgtatttaaaaaaaaaaacaactataaattggcaaacctctggcaaaaataattaagaaattaaaaagaaaaagaggccagacacagtagctcacacctgtaattccaatactgggaagcggaggcagaaagatcatttgagcccagaagttcgagatcaaccctggcaacacagccaagacctcatctctacaaaaactcaaaaagtagccaggtccaggccaggggcagggcctcacacctgtaatccagcactttgggaggctgaggcagacagatcaactgaggccagaagttccagaccagtctggcctacatggtgaaacctcatctccactaaaaaatacaaaagtcagctaggtgtagtggtgcacacctgtggtctcagctactcaggaggctgagtcacaacaatcgcttgaacctgggaggcagaggttggcaatgagccgagatgctgggcaatagagcaagaccctgccccaaaaaaaaaaaaaaaaaaaagaaaaaaaaattagccaggtctagtgacacacacctgtagtcccagctactcaggatcctgaggtggtagaatcactcgagcctgggaggtcaagactgcagccagccgtggtcacatcactgcactccagcctaggcaacagcgagaccttgtctcaaaaaaagaaaaaaaaaccaaggctgggcgcggtggctcatgcctgtaatcccagaattttgggaggctgagcgggtggatcacctgaagccaggagtttgagaccaacctgaccaatatggtgaaaccctgactctactaaaaacataaaaattggtcgggcatggtggcatgcgcctgtagtcccagctactcaggaggctgagacaggagaactgcttgaacccaggaggctgaggctgcagtgagccgagatcgagccactgcactccagccctccagcctgggtgacagagcaagacttggtctcaaaaaaaaaaaaaaaaaaaaaaaagcaaaggatcaggaatggaaaaagggataaaaactaacatcagaaataacagattagggtaatcccagcactctgggaggtgaggcaggcggatcacctgaggtcaggagtttgagaccagcctgggcagtatagcaagaccccatctctaaaaaaatagaaaaattagacaggtgtggtggcttgcacctggaatcccaacactttggggtgccgaggcgggcggatcacctgacgtccggagttcaagaccagcctggccaacatggtgaaacctgtctctacaaaaaatagaaaaattagacaggtgtggtggctcacacctggaatcccagcactttgagaggccgaggcgtgcagatcactctgagctataacagatgtgaagactcagtgctcggtggtgcccaggctggagtgcagtggcgtggtctcggctcgctacaaccccgtctgggaagtgaggagcgtctctgcctggccacccatcgtctgggatgtggggagcccctctgcctggctgcccagtctgggaggtgaggagcgtctccgaccggccgccatcccatctaggaggtgaggagcgcctctttccggccgccatcacatctaggaagtgaggagcgtctctgcccggccgcccatcatctgagatgtggggagcacctctgccccgccgccccgtctgggatgtgaggagcacctctgccccgccacgaccccgtctgggaggtgaggagcatctctgccccgccgccccgtctgagaagtgaggagaccctctgcccggcaaccaccccgtctgagaagtgaggagaccctccacccggcagctgccccgtctgagaaatgaggagcctctccgcccggcagccaccccgtctgggaagtgaggagcgtctccgcccggccagccgccccgtccgggagggaggtggggggggtcagccccccgccggccagccgcccggtccgggagggaggtggggggggtcagccccccgcccggccagccgccgcgtcccggagggaggtgggggggtcagccccccgcctggccagccgccccgtccgggagggaggtaggcgggtcagccccccgcccggccagccgccccgtcagggagggaggtggggggttcagccccccgccaggccagccgccccgtccgggagggaggtcggggcatcagcctcccgcccggccagccgccccgtctgggaggtgaggggtgcctctgcctggccgcccctactgggaagtgaggagcccctctgcccggccagccgccccgtccgggagggaggtgggggggtcagccccccgcccggccagccgccccgtcagggagggaggtgggttcagccccccgccaggccagccgccccgtccgggagggaggtcggggcgtcagcctcccgcccggccagccgccccatctgggaggtgaggggcgcctctgcctggccgcccctactgggaagtgaggagcccctctgccaggccagccgccccgtccgggagggaggtggcggggtcagccccccgcccggccagccgccccgtccgggagggaggtgggggggtcagccccccgcccggccagccgccccgtccgggaggtgaggggcgcctctgcccggccgcccctactgggaagtgaggagcccctctgcccggccagccgccccatccaggagggaggtgggggggtcaggccccgcccggccagccgccccgtctgggagggaggtggggggggtcagccccccgcccggccagccgccccgtctgggaggtgaggggcgcctctgcccggccgcccctactgggaagtgaggagcccctctgccaggccagccgccccgtccgggagggaggtggcggggtcagccccccgcccggccagccgccccgtccgggagggaggtgggggggtcagcccccgaccggccagcggccccgcccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgtactaagaaaacttctgccttgggatcctgttgatctgtgaccttacccccaaccctgtgctctctgaaacatgtgctgtgtccactcagggttaaacggattaagggcggtgcaagatgtgctttgttaaacagatgcttgaaggcagcatgctcgttaagagtcatcaccactccctaatctcaagtacccagggacacaaatactgcggaaggccgcagggtcctctgcctaggaaaaccagagacctttgttcacttgtttatctgctgaccttccctccactattgtcctatgaccctgccaaatccccctctgtgagaaacacccaagaattatcaataaaaaataaataaatttaaaaaaaaaaaaaaaaagaaataacagattaggtggttccatggtgtaatggtgagcactctggactctgaatccagaaataacagatatatcagaaagccaatcaatacaatcaaccacatctcaaaaaaatccaagaaaattcagtagttatacacgtctctaatggagtcttggcaaaagaaaaacagaagcttccttgattcgataaaaggtatctacaaagcctacaccatgcttaatgaggaaaggttgaacatttttcccttgagatgagaaacaagacaaagatggccctataaagtcctatcaacattatgctggagatctcaggcagcaaaggaaagcaggaaaaaaataaaaggtataaggattagaaacaagagacaaaattgtcattatttgcatatgacataattatatatataggaaatccagaagaatctacagataaattcaaattatatatggttttttttgttgttgtttctttgttttttgagatggaatctcactctgtcacccaggctggagtgcagtggtgcgatctctgttcactgaacctccactcccgggttcaagtgattctcctcggctgaggaaggagaatcacttgagcctggcaggcggaggttgcagtgagccaagattgcgccactgcactccagcctgggtggcagagtaagactaagtctcaagaaaaaaaaaaagcagcagcagaagcagaagcagcagcagaagcagcagcagcagaaggagaagcagaggcagcagcagaagcagcagcaagcagcagcagcagaagcagaagcagcagcaagcagcagcagcagaagcagaagcagcagcaagcagagacagaagcagcagcagaagcagaagcagcagcagcagaagcagcagcaagcagcaagcagcagcagaagcagcagcagcagaagcagaagcagcagcagaagaagaagcagcagcagaagcagaagcagcgcagaagcagaagcagtggcagcagaagcagcagaagcagtggaagcagaagcagcagaagcagtggaagcagaagcagcagaagcagtggaagcagaagcagcagaagcagtggaagcagaagaagcaacagaagaagcagaagaagaaacagaagaagcagaagtaacagaagaagcagcagcagaagcagaagaatttcacaaatactgaactaattttttagattacataatatacacatagtattattatatgcacatgaagttcaaaaacaaggaaaactatattgtttaaggatgtatagctaggacttaaaattatgaagcaaagcaaaaaacagtcacaaaggtcaggataataactacctccactgaggggggatatgttgacaaggatggtgaggttggagggaagcacttctggcttgttgacctgggcaatgacaacactaatattcactttattatttcccttaaactgaacattttatgccttctcttgtatacagatggtccacaacttatgacggttcaacttacagtttttcaactttagcacagtgcaaaatcgatatgcattcagtagaaaccatacttcaaattttgaatttttatcttttcccaggctagcaatatgcagtatgatactttctcataatgctgggcagcagcagaaagcagcagctctcacaagggtaaacaactgatcctcaatagtatatactgtgttgccagatgattctgtccaactgtaggctaatgtgttctgagcgcatttaaggaaggctaagctaagctattatatttggtaggttaggtgtaataaatgcattttcgacttatggtattttcaacttacaatgggtttatcaggatgtaaccccactgtaagtaaggaagcatcagtatatgaatgaaaaggaaaaataacaactgcatgtaactagtatggtaatttaatatacggtaatataagtctggtacctagtgtgcattttttaaaagctaccataattacaaaatgttctgtatcctccccagtgcctacacatcaggaagttggtcatggtagatgctcaaatattttgatcaataaatgaaacaacttccattctgattaaacgaagtaaaagacaatttagatctgaatgattccctaaaccaactgtcattctacaagcccagagactgaattctttatatcccaacagactattccctctgcctttagcattttcctgatctctttctcttcattcataggatacatctgttctgccctactatactgtaagaagctgtacattaaatgcttagaatcctatacataatctgagatttaagacaaaaaaagagaaagaagaaaggttaaagttaaggggaaatggtacataagatgtacataagagcagaattttcaggaaaacccagtgaagatacaatgtatccttacatgaaaacattcaagacatgggcttttttttagttctaatgattcaaggagtcaggaaacagtgaaataaagcaggaaacagtgaaataaagcaggcaaatcatctactgtcccttcagacctaggtaccataccaaaatatatctactgtttttttcctaaaattatctcaacaacaacaaaacagaacaaagatacctctgaaagctacaagactcttctggaaaaaatcagctccttctcagtcacttgggaaaaacacttttttctttttccttttttctcttttaagagacagggtcttgctctattgcccaggctgttggactactaccgtggcatgatcattatggctcagtgtaacctcgaactcctgggctcaagtgatcctcccatgtcagccttcccagtagctaggaccacaggcacacaccacaatgcttggctagttcttttgtttgttttggtagagacagggtctcattatgttgcccaagctggtttcaaactgctggcctcaagcaaccttactgcctcagcctcccgaaatgctgggaaagcttttttttttttttttttttttttgagacagtttccctcttgttgcccaggctggagcacaatggcatgatcttggctcaccgcaacttccgcctcccaggttgaagcgattctcctgcctcagcctccctagtagctgggattacaggcatgtgccaccacgcccagctaattttgtatttttagtagagatggggtttctacatgttggtcaggctggtcttgaactctcaacctcaggtgatccaccggcctcggcctcccaaagtgctgggattacaggcataagccaccatgccctgcggggaaagctttattttttaatcaatttattcaatatgtattacttacacatagttcaaaagattaaacataaatatccttcagaaccaaactcactgaataaaactatggtacatccgtataatagaatattgtgtctccgtaaaaaagaatgagaaacatcttatataccaatacgaagtcctctccagcatacagtaagtggaaaaaaaagaaaaggtacagaacagaatacatggtatgctacctttagcatatgaaaagagaatacatatattttatttttgaaagaaaaatattaggatgattaatcaaagacttacaaaaatggttacgtatagaggagtgagaaaacaggatgaaaaagatggggatgaaaatgagattcctggccaggcacaatgactcatgcctgtaatctcagcactctgggaggctgagacaggaggactgcttgaggccaggagttcaaaaccagcctgggcaacatagcaagaccccatccctactaaaataaaatgtaatttaaaaaaataattaggaaggcacagtggcacgcacctatagtattagctactcagaaggctaaggcagaaggatggcttgaacccaagagttcaaggctgcagtgatgtatgattgtgccactgcacttgctctatcactccagcctgggtgacagagcaagacctcatctctaaaaacatttaagaaaataaaaatcctttttttatatggtttctctttctgaactatgtaagtgctttacatattcaaagaataaaatcaagggtttttttttattttttttttgaaatagggtttcactctgtcacccaggttggagtgcagcagcgcaatcacaggtcactgcagcctcaacctcctgggctcaagcaaacctcccaccttaggctcccaaagtgctgggattacaggcgtgagccatagcacccagccaaattaagtctaaaaacaggaaaagcaaatcctaaaataaaataagtagacctaactgcatattaaactggtaacaatcaaactgagaaaatcattatttcaagtgacttttgaacatagtactacttacaataggtacattcttagtaggatacagtctaaggacaaaaagaaatgcaaagaaattttgagtctcactgagcagtttcatttatttttgaaactattttataaatacttagaaaaaacatacatcaatgttaataaaaactatgattttcaacgtaaaggagattaaaacaaaaataatttaacaaactaaaaggaggaggaggaagaagagtagggagaagagaaggaagaaacccataatgttaaacttgagtaagaattatcaagatgatatcatgctttttactccctcctgtcaagagcctcaatgacagcccaataacaaggagcatacttagcacctaaatagtggtttctaaatacaatctcggcagagtgtagtgactcatgcctgtaatcctagcactttgggaggctgaggcaggcagatcacctgaggtcaggagtcccagaccagcctggtcaacatggtgaaaccctgtctctactaaaaatacaaaaattagcgaagtatagtggcgcgcgcctgtaatcccagctactccagaggctgaggcaggagaatcacttgaaccccggaggcagaagttgcagtgagccaaaatcgtgccactgcactccagcctgggcgacagagcaagactttgcccctcccctccaaaaaatattttttttaattaaataaatatataaataaatacaatcctccactgtaagaagacaaagcttcttggagaaattgctgattccaagtctaaagcaggaaaagtccatggtgagccaagatatcgtgtacccaaaagtaaggaatcattcaaagactaatgggttcaggaaaaaataattcaggaacctgtttgaagaagctcccactgtccttatttgagacaatttgagcatcaaaaaaaaaaaaacgtctgcaaatgactataatacaacaaaagtcatgagaccattaaaaacctcatttgctactattgtagatgactattacacaaatcctcactctaaaaattaaggaaaaaattaagcatttactgttctcttttaataggaactgttgttcactcccagttgataaaggttacaaagctcttattaactgaagaataactaataaatgaaaaagaattacagaattagaaaaatcgccattttgcaatccttaattaaatacctaaggatcaaaaaagatgctaaaattattagagaaagaatactgagaaatggaatatttgtatggtaccaaagtatcagtcccacagattattgtacataacaggagaaaaaatttacttttaaaatggagacataagcaaacaccaccttaaacctatcgaacttacatcactgataggaggacagctgacattatgtgcctcccattaacacacaacatgatatacaacatcacctacagagtgttcttgccaaaactttttaatatgaatctattcaatcctttacaatataacttccagtttacaggacatacaagcaccagaagaacaagttaaacaatctaagaaacaatcagaaaactctagaaaacaggccattctacaagatgattggtctcttcaaagacatttcaatgtcacagggaagagaaatgtgggaaggaacttcctacattgagagactaaaaagagataatcaaatgaaatgcaaaaactaaaagtgagttctcttttgaaaaaaacatttttcaggacagttgggaaaattcaaatataaattcaatattaaattagggtattatttttcctaggtgttggtaatagcacactggtgatacgaaaaatatgtatttcttagaaaatatatacgaagtattttgcagtaaacttgtcatgacacatacatttttttttttttttttgagacagagtttcactcttgtcacccaggctggagggcaatggtgcaatctcagctcaccacaacctccacctcccaggttgaagtgattctcctgcctcagtctcccgagtagctgggattataagcacccaccaccacgcccagctaatttttgtatttttagtaaagacagggtttcaccatgttggccaggctggtctcaaactcctgacctcaggtgatccacctgcctcggctttccaaagtgctggggttacagatgtgagtcacggcacccagccgcaacttactttcaaaaggttctgcaaaaatatatacaatcacagccgggcgtggtggctcaggcctgtaatcccagcattctgggaggccgaggcagcaggcagatcatgaggtcaggaggtcgagaccatcctgactaacaccgtgaaacgccacctctactaaaaatataaaaaattagccaggcgtggtggcgggtgcctgtagtcccagctactcgggaggctgaggcaggagaatggtgtgaacccaggaggtggagcatgcagtgagccaagatcatgccactgcactccagcctgggtgacagagcaaggctctgtctaaaaaaaaaaaaaaaatacacacacacaatcacacagggaacaataatgcaaatatggatggcataacgctatcttttgaatctagttgatagacataattagtgttctcttccaacttttctatttctttaagatcttaattataaaacaataggggagggaagaaagagaactaaaagaaaacagagttgcaaaagcaaaataagacaaaaatattagtcgggtgcagtggttcacgcctgtaatcacagcattttgggaggccaaggcaggcggatcgcttgaggtcagcagtttgagaccagtctggccaatatggtgaaaccctgtctctattaaaaatacaaaaattagctgagtgtggtggcacacacctgtaatcccagctacttgggacgctgaggcacaagaatcaagaatcacttgaacctcgaaagtggaggctgcagtgagccaagatcgcaccactgcactgtagcctgggcgacagagcaagactctgtctcacaaaaaaataaataaataaataaggcaaaaaaaatctaaaaatcgtttataaacatgtccacacagtcacctaagaactttctcccttacattaaaaaaaaaaaaaaaatctagccaggcagcgtagtggcacacatctgtagtaccagctactcaggaggttgaagtgggaggactgcttgagcccaggagcttgagtccagcctgggcaatacagtgagatgctgtctcaagaaaaaaacaaaaaggaaattccaggccgggtgtggtggctcacacctgtaatcccagcactttgggaggccgaggcaggtagattacctgaggtcagcagttgaagaccttcctggccaacatggcaaaaccccatctctactaaaaatacaaaaattagctgggcacggtggcaggcacctgtaatcccagctacttgggaggctgaggcaggagaatcacttgaacccggaagccggaggttgcagtgagccgaaattgcaccactgcactccagcctgggagacagagcaagactccatctcaaaaaaaaaaaaaaaaaaaaaaagaaaattccagagattactcagcccactatcatctgatcaataaaaataaacagatttcaaacaaatacttacacactacaaacagcaatagtactaaaatctgtcaattatttaaggaatgtttgtcattgacaaacagaacacattttgttatgataactcacactgaatcaaatacattctaaaatccattaatcttatatgctaagacatcaagagaagcatttctttgcagtattttttcaaaaatattttttaaatgccccaatgccacaagaaatattttaactgaaaaaaatcacacttgaaagacaactagtagacagactgccctaatatctgcttcttttagcaacaaactttgattagccatttattctaaaagccacacagtgaaattcttaaaattcttgatttcggccgggcatggtggctcacgcctgtaatcccagcactttgggaggccgaagcgggcggatcacaaggtcaggagatcgagaccatcctgactaacatggtgaagccctgtctctactaaaaatacaaaaaattagccgggagtggtggcaggtgcctgtattcccagctactcgggaggctgaggcaggagaatggcgtgaacctgggaggcagagcttgcagtgagccgagattgcacccctgcactccagcctgggcaacagagcgagactccatctcaaaaaaaaaaaaaaattattgatttcacatttaaacataacaagaaataggctgcgcacagtggctcacacctataatcccagcattttgggaggccaaggcaggcagatcgcttgaggtcaggagttcaagaccagcttggtcaatatggtgaaatcctgtctctactaaaaatacaaaattagccgggcatggtggcgtgcacctgtagtcccagctactcgggaggctgaggcacgagaatcacttgaacccaggaggcagaggttgcagtgagccgagattgcgccactgcactccagcctgggtgacagagtgagattgtcttaaaaaaaaaaaaaaattaataaataaaacaggaaatagacgtattcaagagggaaaaggaagacttactgagtacctactatatgcttggtgctttacataaaaatttttttaactccaatgatagtcttatgaggcaaatattacccccaattttttttttttttttgaggcagggtctcactctgttgcccagcctggagtacaatggcatgattacagatcactgcagcctcgacctcccaggttcaagtgatcctcccacctcagcctcccaagtagctaggaccataggtgaatgccaccacactcagctatttaataataattttgtcatttttgtagagacaaggtctcctatgttgcccaggctggtctcaaactcctaggctcaactgatcctcctacctccacctctgcctcccaattatccccaattgagagatgaaaattctgacaagctctcaaacgttaactgacttgcccataaatgacagttccaaagttataaggctagaacttgaatccaggtctgttagaaatctaggtttgagaatccatattctctccacttaatggatttaagattcacagatataaaagcctatctaaggaaaaagaatatttaaaagaatacagttatatattcaaagagctacacaatcttacagtttaagaaaaatcaaaactgagaaaaagtatgctccaaaattattgctaattgtaaaaaaaaataaataaataaaaaaaacacacacaatttttagcaagccagctgtctatgacaggacagctagtccattcctcactgtacatgtaaaattacacttcagttgcccgctggatgaccccactgccaaaatacgccagcaacataattcacattaaaacccagaggcctaacactatttggaaagtgctttacatgtttactatacctatcccaagcatatttaccactcataattcataggccattttcagcaaatatactttgttctatcatattattttctgccactctaaaatcatattaaatgtataaaacaaaaacacctacctaaatataacatctcacaaataaaccttagtagtattatgttattttgaacttgtctattgtatgaaactatgccataattgtttctataacataaattaggtatgttctttctacaggatcaaaattccaatacctacactccttgcatgtctaaagatacacacaaaataggtacagaaacctatatgttaaagggtttcccatgtaaattaaatcctctatgagctggattagtgactagaagaaggcatgaggcagcttgtagagttctagtgatattctatatcttgatgtagatgttagttacactggtatgttcttagtgaaaattcactgagctatatatttaccagctgtgtactttttgtatattttataatttataaagtcttatatttttaggctgggcacagtggctcagcctgtaatcctagcactttcaaaggctgaggcaggaggatggctctagtccaggagtttaagaccagcctgggcaacacagtgagaccctattttttctgaacttatattttttaaaatgctcaatctaaaaacttgttttactaaaaagcactgatatcatccctcttaccaaagtagtcaaaccctagtgaagaaaacagacaagtaattaagctatttcattagaggactatgatagaagtaattactatgtgctacaggagcacataagaatggtacctaacttaatctgaaaagaggtaaaggaaatcttcctgaagaatatacacctgaactgaatcctaaaggtcagacagaaattagccaagcaaagaaaggggaaagtggaaatcagggaaatagaacatcaaatgtaaaagacgagagagaaagcacattacctgagaggaagcctaaagtcagtaagagtggattaaagtatgtaaggaagacagcaagtgaagaaaagctagagaattaagagttagatcatgaatgatctcatacacatgccatgctacagtttaaactctatcctgaaagcaatgagacagcttttttgaagattattcaataggaaaggacatgatttgatttttatctgtactatacatgtcaaaattatggtgtgggccatgctcacaaccccattttgcggtaaattagcctgcacactgtcccatactttccaccattaagatctttcctgatacccatatatacatacaaacacacagccaacaataaatggccaagagtggtgacataacctaagtacacagacttgttagcaatcaatgagaaaaagagctgagccaaatctggaattcaaaccagaaaatcctagggaaaaggaagaggttagcaacaggagctaacctcttttaaaacgttttaaaacaattgcagccaggaggcaagatgttggcatgggggtcacatagtagttataaggagcagaaattagtaataaatggaagctatgacatagggggaaaaaaactgaagaaagaaacggtatctaggacaagctaacaatggagcactggagtggggtctccagctttattaggttcttgttcttcttgagagcaagttttattaggttctttttcttcttgagagcaagttaacttttcctgggttcccttgtgtatggttcctttcaataagcacttcattacttaaggtaacttgagtctcttccctccaagtgaaagagcctgactaaaagagcattttagaatacttactccaacagcagtcaagagaatgaacaggagggcatgacaagaggcagaagacagaaggcaagaagaccactcagcattacagaagcccaacaaacagatattttcagttaaaataagatagaggcaacaaaaagtaataaggaatgacctgaaatatcatgagggaaaatgtacaaggcagtgacagactggatgttggcagtgaagtacagagtgaagcggagggcaattcccaggttcctgaaggtttcatgaggaaagagtggtgccattaatcaaggtaggaaatcggggggaagaaaaaattttgttgcagtttctgtctccggctctctctccactgtttttgtggggggaaaagaggcaggaagagttttgtttcctaaatgtttggattgaagtgtttgtgaaatgtgaatcaaagtggtgatatccattaggcagtgcttttacaggggtctagagcaaaggcaagcactctagacagcagttctagacttaggaatcaatacattaagtcaatattgtggtttttaaaatgtctgaaaagtctttgactaatatttatttcaaactgagttaacataaccaaaaatcactccaactaaaaaccttaatattcttggcaaatcatattttcaaacctcctacatttctctgctattaaagactgaacaaacttccacatagtataatccaaatgattaggaaagatggagtttatatcgctaacttctattgaggtacttgttaaaaaaaatctaagtttacccaatttccctcaggaactatatactactaaaataactaagggaaaacaactgttaaaaattcatatattagatagtgaatctcactgttaatgcttaaactagaataagttttttaaaggcacttaatcatgtaatttactaatttaaatattcaactctacctgtaatttaaatgttgggtttccatcctaaaaccttttctcctcccttctgtatgattttgcctccaaaatctactgctatcaacccagaacctgatactgagcttcagccacaaatccaaatgcctaatggtcatctacatctgacagaactacagtcacctaaactgaacatgtcacaaattaacccctctatccttcctccttgacaaaataaaaacaaaatcccactccttcatgggaatccccacctcagtgaaaggcacaagccagaaacctagattttatcctgtatgcaacttctccccaaccccaaatacaataaaatcaccaactcaactccgaatatccaagttcagatccagtctcaccatttgcctggataaccctaatattcctggcctttagtcttattctactcttcaattcactgcagccagaatgacttttttaaaatgcaaatctgatcattccagtcccctgctttaaaatccttcaataatttaataaatattataatcatcatcacagctagtcacactgtggaagctcagaggttcaatgagaaatttagttacatcctttctgtaggttcaacataaaagaatcatcaggaatttttttcaactcacaaaattatttaaacatacatataacatcagacacatttaaaagaaaagcatgtaacattgttggtaaaagcaaaacaccaaaaataacctccagtccacaaaaatggaatactatccagccagtaaatgaggcacttccatatgtattgttaagaaatgacctctaggatgtagtattaagtaaaaaaaacaggctatgtatagaatgtaaagtatgcaaccatttgtgtacagtgtcttaaaaatataaatgtgtaggtttatatattggaaatatcacagaaaggatacacatgaagctggaaatagtggttgcctctaaagaggaaaaatgggtggctggagagtgaaggcggaacagaaatttttactacattactcttccgaaacttttggcttttacgtctagttattatctataattttaatgtgattttctcctgttactttaacattttttactgtgtgtgtgtgtatgactacaaagacctctttatatttcatctttataccaatattaaaattacgtactgatcatttgatgcaacattacatttctttcttgacaactcaggagctcaacttctacaaacattttattcaacattttactgctattgagaaggctgttgttggtaatgacctcagtgaacactgcatgatttctgtacttgcttcttggagaagcaagacagcagcaccaggcaacagaagtttattattaaaccgacatcgaagcattcagggattaaggaatgctacaaatcttatttttctagcaaatccaaaaaacagtgaatccaaaaaaagtcccctagtatcctttaaaaataaaaataagaaacagttctagtatctgcagcaatcgacaaggaggtgaagtaatactacaagacgacatagttatatccactagtgcaacgtgatttaatccttacagaggtccctaaaacatcagtgctggacaacctcacacgttctacacagaacagacaagacgaggtgcaggctctgtgaccttataatggcacacacacaactggcctcatgcttccataacttcactctgcctcccacttttttcagcccaacccctccaaacatgggtctcggtcggtccccttaagccacaatggagggaatacattaggctaagcaaatattccctcaggatttcatggcaaagccctttcaaccaaagaaaggatcgcgactaaggagaaagataacaaggtttgcttgaggagaggtctgttgagagaggctacagtcggtggtgggagagaagccaaagtctgtgacggtgtctagagggactgacaccacatctaccgggagtaagaacaccatgacagcggctatctgaaagccgtgatggctagggttagtgctagtcggcttggtgatgagcgagctgggaggggttctactaagaagagtagggcgaggggcacatgggggacgcaatgggttagggggcggtcgagactttgcctgagaactgtaatcacgtcagcccaagggaggatgtaacgtagtctagaagctccattaagagtcctaagggactctgaggggtactaatggggtctgctgggttggggggaccgtgacagaatctccggggaggctggagggccggaatggtgcccggccaatggaagatacagggggtggggtctactggggatccggggccgtgatctggtgtttgggaggctcggcgcagacccgctcgcggggcgtctccgctgggacggggcggggcggcccgaccggagccaaatagcgaggctgagacgtgggccaggacgggctgcagggccgctgggcgcttgggcgggtcttacctcgggctccgccgcggtggccaccgcagccccctcctcttcgacggaagctgccttccaccctccgccccagggtaggaccggagatggcagaagaggccgaggccaccgagggtcggacggttccgggagggtgggcccagcagcctcagggtccgggcgagcggccgcggcgcatcccccgccctgtcagagagactccgcccggcctgagcaggcacatcccccgccgcaccccgcccagagagcacgcgttggaccgccgcctcaaccgctgccagcggccgcctctgccggtgcaactactgcctccgccgccgcctctcgcagtccgggctgtcctgtactctctcaacagacacagccaaccgccgccgcgtcccttatccgcttcggtcgcgcgcccccgaccccgcgcac

SEQ ID NO: 945 - DNA, 641936 bp, Homo sapiens
ggacttgaacgcaactcccaattgcagaaaattggcaacgtctctgaagagcccttgcttttgcctggacccccagcatcatggtttcccatttcatggggtctctcaggtaagtgaagaaactttttttaaaaaaacaggagaataagaaatttgatatttgcattttactctgtcatttcttaaagtaagtgatcttaagggtctgcagctgactgatatttttgatataatacgtccacttgtgtaaaagtttgctattcagaagggcctccaaggccttgggagctgtgtgctgtgctgagtggcttggggtcgaagtcaatctactatcttctgggagaccttctgtaggcttcaagaaaatttttttaggccggatgcagtggcttacacctgtaatcccagcattttgggaggctgaggcaggcagatcacctgaggtcaggagttcaagaccactctggccaacgtggtgaaaccccatctctattaaaaatacaaaattagctgggcatggcggcaggcacctgtaataccagctattggagaggctgaggcgggagaatcacttgaaccctggaggtggggtcagatcaatgtatatttaccgtggttgcataatacaattttctaaagaacttaaaaaaattgttctctggttgcaacgccatagattttgactgaatctggtattttaaaatggtgctctctcttgtcccttatgtacaaaacatttttgactttcacctgcgttttaaaattcaatctttatatcaaccatgcgtggcaagttgagtaagtactattatcccttttgtgtagatcagaaaaccaatgctcagagagcttacatcatggctgtcaccttcctttatgtgcagagttagaataagggctctgagcattgcaactgtagtccatgttatcgaagttgttttcaaactttttaaaaaggctgacagagccttttaaaaattcttcaatcaaaatcctatgcaaaatctcaatatataaaatagacaatgacagtattttattaatataaatttactttataagtttaaatttataatatttatacattatgagatcaatgcattaattttgataaataccgacatttgaaatcaggatttatggttggcagcttaaatatctgcccaagcatctagtttattttgcagctgttttagctgtgtagcattaagaaaatcctaacccattacaggtaagtacttgcaattggtaacaattctgtgatgaagctcatcttactattttaggatactatttaaataaattgactgagaatctggaatgaggggaaggaagaacgttttgtttccaagttgaatcattatgatatcttgtagtcttttttccatacctgtacattagtcccacatgcctagaacttataacagaaagtaaaatggtctgtaatatatagcatattacatatgatggtgccacaggtggttggccaaccagggctagagcatttgccaagcagatgcccttgggctaatgcctggcatttaactgagtgcagtgcatgtgtgtgagctttagtatgtagttgcttgtataattttacatgggcagacgtgtgcaggcctgcaatccaaatacccgcagagaactacaaacctctttatcaatgacatattcacatgcatgtcagatatggtcagaaaagaaagaaaaagcttcattctgaaggctgtatgatattgagccacgaggaggacagcccaaattaacgtttggtgatctcttcaggatagaagttggcatctagtacaaattagcatgtgtgcttttttaaaactatagtttaaaaaagagtttaaaagatatttcaagacatgaaatatgcatctagtttgtggaagttccaaaatactgttataaaactatagggtagtgagaaatgcagttggcccacagggtcattgtaggaccatggcattttaagcacccaggaccccatgtaggacaaagaagtggaggtcacagtcggttattgaacttattcgaaaagggcaagcagattatgaaaggtaggttcgccatgtgctaagcttgtgtaagtctggctgtcgtcaaaaaggcccctaaaagtgcttgaggaccctcaaaaatgtggccacccaggctgcacaggcagggagtttcttgggaggaaatcccttttgcaaagttttttcttaatgtcttggatttttttctttcttttttttttctttctttttttttttttttttttcaaaagagacaggattttgcttatcacccaggctggagtacagtggcgcaatcatagctcactgtaaccttgaacttctgggctcaagcgatcctccacctctgcctcccaagtacgaatagccatgtcctggaattttaattaatgcccctgcaaacagtctcctgtaatgatctgagcagggtgtgtggtatggagatcatctccctttgcgggaggcctggggaactcacctctaaactgtgcattatttcaaggaaattgcccacagaagggaaattagcaggatgggagtagttgaaagctagatgctacccttgtggtggagctctggaagccttgacaggcctccagcacgagagtcctgctgcagggattgtttgaacagagctgctcagcgggacattttgccaagaattctgctgtcaatactagaggaagaaaatgtgaattatgaggacagctgattctttaggagatctcagcttgagattcccatcaaactcccttcttcataaaccaggtgcacatcaaccattttgcatccctgtttttagggccatgtaaatatatttttaagagaaaaagaagcaaaagtagagtgtcttctgtttaaatgcttttcagaatgttatggggaaaagggctgtgggttacttgaagcgtgagaggtctttgacaaaagtggtagatgagaagcacacacagacgcacacacatgtgaagggatttttaatatttatcaaggcaactaaatacataaagatcaattggagaagctggagaatttctctaccttaagagaaaacaggttaaaattaggaattagctgccaagaaaatccctgaaagaacatttaaggggaatcacaactctgatacacagagatttcatttaaaaacccctccccattttttgccaagccacagagaaacagaaaaccagcttccttctcattgaaggagacagagaagccttgggcattaacatcgcaagagtatctctgccttgctcagagtgtgtagtaataaaaagaatcacagttaaacctagtagcagaggaggcactaagattctaactctcgatggatctggttgggaattatcattgaatcttggacaagctctggatgccatgtaaaattcagggcaatgaaagtccatgtggaccaaagtgtaggctaatccttaatgaggaatgtttgtcacctgttaaaaattagaaaggaaatggcactaaatgatacagaattatttatgtttcttaaagacttgctccaaattatgcacttttttttttttggatgcacaattacatctttatttgtttgttcagtgagtgataggaaggaaacataattttgtccctagaacagtacaataaatgctgatggctacctgacctggccagccaacaaaatctctggagccagtctgcttgaccaggtgcttcttcctttacttcaaggagtgcttttgtatggttgacgtattttatatttcaagtgaaagcaaagagaaaaacagaactatcaaatgccaaacaagtagtgaaactggcaggaaataaaattgattttggtgatttttattttgaacagtagtttttgaagaattacagatgtaatgagagtgattacagagttagaaggtgatttttatagatcttatgagggagacttctggattattttaagggttttataggttgatggccctaggtcaagtgtctggttttagtcttctgaaacgtaaagtttttcttttccttgatgcatacttcagtaaagtattattactttaatgcctgtcagctactgcacttagaaatacaaccaaaagggttgaggaaatgagaaagagaaaggtggctgttcttaggagtaattgaaaaagatcctgaatacagaaaggaagaaaggggttaagaaaacgtgtttttatgtgtgagaaagagaatgccccaagtagtgatatttaaggtacaattgatcagtgaaaactgaaatttcccttgggggtaaagaaatatgtaataattgtgtggggtcatggagtcgatcagtgtccctgtgccagtgatcaggaaatggggagaaagaggttggggaggagggagtggaggaaggagagggaaggagaaggaggaggagcaggaggaggaggggaagaggagcaaagggaaggggaggccaggcctggatcacaagtattaaacttcatggtattaataaggcaggccagaatttgtgtaactgacatctaaactactacttggttaatgcttaataaatatttgttgaagagtaaatgaataaattaataactaccttttatgtacaacagataaggttgaaattttctctttcctgaccaggatagttagctagttaattacaaaagtagggtgaagcatggaaatcaaacaaataacacacacacacaccttcaacagtttacttttaacttaaaacacatgtacatccattcaccagtttttgatttggggccatgggcctttctttgctcatgaacccgattgtctttcttgcacaaaccacacccataagcattatgtgaggtttccatttgggtttctttaaagtgcagtgagaatataaagacatttgcaaagcagtctgagtaccagaatgattctggatttttattatttttgcccctaatcatttgcagttgtctcatccacacctaatttgccagtagttttttttttttttttttaatcttggctgcttgcctttattgaaactttccaaagcaattaacttcatttttgtagaaacaactaacaaatgttctttcttcttgtgcttgctttcatgggtttgtgtactatttgaatacttatgtcactacaaagcaatagcaactggcataaacaggtgtggaaacatggttgacactatatgaacacagtacatctggggggtgcagaagtgtgcaagtgtccagggaagaatcggccgcagtcttgtctgtgggaagcccgggaggagccatctgagtggtaggcatagaggctaggaggaaataaaatagatttttggaggactgccctggcaaacccccatctgtaaaatgacggcaagcattcagacagtattgatttttctttatgcctggcacagccctgtacctggatcctgtcctcatcactcactccttgactgtgggatttgctagaacattctgtacccaaaaaggctcaatggagtcaaggtgtgatcactgggctgccaattacccattccttatatctctaagtgtatttttatgccttgggttaacattgacccctcctcttcctgccagggattagaaccagtaattccaatttgtagaaatctgctttttaccattgtcttccttttcccagctctttggcttttccaacagggaattctgggatgcacttagaaaacattttcttgatgaaaactgtcacagagcagcactttttgtttttgaatttttattttttagagacagggtctctctctgttgcccaggctggggtccagtggcacagtcatagctcactgccacctcaaatgcctgggctcaaacgatcctcccacctcagcctcctgagtagctgagactacaggtgtgtgccaccaggcccagctcactttaaaaaaaatttttttgtagagatgtgatctcaccatcttgcccaggctgatcttaaacccctggacagcaacacgttctttagtgactgatatttcctccctcctctctttctccttttcttccttcactttattctatccttccattcttttattcagttgatatttattagtcttgaggatgggtcaagattatgcggattgttttgtttgctgcaaaggtgtatcagaaaccatttcttcaagaaacctgccactgaggagggaaatttaccaaagcgtgttgtgtctttaaaagctgtgctgtgtaggccagaaaggtggctcactgtagtcccagcactttgggaggccgaggcaggcagttcacttgagccgaggagttcaaggctaggctgggcaacatgatgaaaccctgtctctacagaaacaaacaaatgaacagttaactgggtgtggttgcatacacctgtggtcccagctattcaggaggctgatgtgggaggatcacttgagcctgggagatagaggctgtggtgagctgtgatcttgccactgcactcagcctgggtgatagagcaagactctgtctcaaaaaaaaaaaaaaaaaaaaaaaaaaagctgtactgtgataaaccacctcacattgccagaagtactggtcgagaaaatacaaatggctgcaagacctgagaacctggaaacaagcaataaaaaccaatttgcagttaaaatatgtgtccttaagtccatgctctataatggaaatatttcactctgcgcgagccaggcaggccttttcccggggcctgttggtcttggtttggctgcagcttagttatctgaatgtttccaagaccaaggcagatccagagggagcccagttaagaggacacagggtcactgacagtacagtaaacaacacctgatagcaggaaggagacaactaagtgccaaccagattcagaaagccctaggtgtctggagttctcaagccgaaggctgctgtgcgccgaagacctccaccttgggctgcacaaattgattgatattcaccttggtgcctctgagccatctaagaaaggtttcttaagctcagatgaatttgtgtaagaaaacagagaaaataaatagaatgcattttttttttaagtttgggatttatatggtcagcttcatttattttgaaatttagaatatcctctggtgggactggatgaatgcagctttattgcgtccacctagtttctgatgattcttgcaagcagtggcagaaaataaaggaggctgtgaagccaccaggcttccccacctcatacagagtgaggaagaaagtggatgtaatcagatggcaaatgcttgttttgtaaaaatgtgttgtgtcctaatgaggccccgcagcacagtggttaagagtccaggccaagggtctgaccgcctgtgttagaaatcaggctttgccacttagtaggtatgtgtggctgtttggtaaatgacttagtctctctttgcctcaaattcctcacctgcaaaatgggtataataaaagtgtctgataggatggttatgaagtactacttgtgagtgctgagatcaatggtagccatcagctctttgttggctaatgtcattggtaacccatcccccttccttgctgcctttactttttttttttttttttgagacggagtcttgctctatcacccaggctggagtgcagtggtgcgatctcagctcactgcaagctccgcctcctgggttcatgccattctcttgcctcagcctcctgagtagctgggactacaggcacttaactgttgtcagaagaaggcagagggctgagctgagcatagtgaaatgcatgcttagcaaacatttttgtttttttgagatggagtctcgctgtgttgcccaggctggagggcaatggcgtgatcacggctcactgcaaactccacctcctgggttcaagcgattctcctgcctcagcctcacgagtagctgggattacaggcacacaccaccacgcccagctaatttttgtatttttagtagagacggggtttcactgtgttcgagaccaggctggtctcgaacttgtgacctcaagtgatccgcctgcctcggcctcccaaagtgctgggattacagatgtgagccactgtgcctggccagcaaacatttgttatctccagagtgcactaggcaggatttcacttcaatgctaagattttggctctcttttgctaaggtcgatataattttattagtgatctggttgctcccaaaatatctcttgggttgtattaactgaggaagaaaggaagtagtttttttttcttgttttccttgttttgttacttgatatgcccaagtggtgttgagttcattgaggtaatttgaggtacacaggggctgtgacagtatccaccctcactgcagctgagatggtagcgggggtggagagtgggattggccaaggcaaatacagaagcccagagctccagttccatgatgtaaatcttgtaccaaatttcaatgagcattattttctacatggggaaatgaaatgatggagtgtttaaaacctagaacagcactgggtagatggcataactttttttttttgtttggtgtgaaatgttaggttatttcaactgcaaggtgaatcggaaagtcttggtaggaatgtagcttcccccacgccacttggaaaggagtgtgggatttgtttgccaaaggccctggtagccttcaatctgtcaaaacgttgcaagctgggagcggtttgccaaagcaaactatcaaagtgaaataacacacgagttgcacacacagagacacatgcatgctctctcattctccaaacattaattttgaattgggtcaggaggaacaaggatttgggctagattgttggtgttttgaaaagaggtgggcacagctacagataccaattagctaagtatgcgcaagcagggtgaggtatcctaaaacagagtgtgctgagcaggggtgggaaactttcagcccttggcagagtttcctctggcccctggggttatatattgctgtgcctgctgttattgtagcccaaagaataattgcccctctgggggaatttattctattccattcagagcagagaccatttaatatctcagagtttactccagaatgaattttgttgggtacccctatgcattttagcttcaatagggcccagtaaatgaagagaagaagcatttgaacatctaaatgtaatttgtgttgcacttttgtaacaagaggcaccagcaaacattttgctgccatatcttgtgatcttctaaggatggttttttggagaggggtaacatagaaattcaaaagcagaactgatttttataaatccctcataaaagaaaattttaaaagctcccgaagtggctttggacattttcaaatatgttaattcacagtattttcacttaatcttgaaatttcaggggtcaccaagatggtgaagcatcattctttaattcagtgaattaagctcctactatatagcagccactgtgctaggtgctggggaataaagtagtgacaaaacaaactccctgatctcatggagcttacattccattggatagagagagaaatttaaataaagacatagtatgtgagacggtaaatgctatggagaaaagggctgggctgggagagggaccactgttttttgtagggtcaaggaagccctgtgaagacaagatcctctgggcagagaccttaagaagtgagggaacgagtagaattgaccaggcaacctggaatgcagttcctcggagtcagaggaaaacctagatgtgatctcactccctttcctgccccaagtccccctgaatgctatgaaagtgcaatctcagatcagtgattatccaaaactgctccttacaaatatgtggctactgtgtgtgccaagagctttgaggcactgaggtgtaacatgtttatggagctgcagctttttttttttttaacaaaaccacaccaatctggttttctttttaaatgagtaagcagtgccagaatgtgttacaaatgattcacatttttaggcctgggtgcaagaaagcacattaactcatttgaggtaggaggacaggttatacaattcccattttacagatgaggaaactgaggcacagagagacggtgatttgcccaaggtcatgcaaccatggagcatggacttgtgagttgtgatgcacatgttcttgatttagaggtcaaattggatccagcagggatacagctagaagattactgtccttttgccaccactgtctgggaacccgctgtctctaattctcctgccctattgctggaagacatcttgggcaatatttccagtacattctgtgtgtaatgaacaggctcattttcaagtattaaaaagtccaaaggaagttgtgtgtgatgggagtgagaaggtgaatcattttcgaagttatccaggacatcagtagcatcaccatctagacctgtaccattagcttcctgtgtcttgaatagcacagatctgtgtatctgcactggacagtaccgacagagaatgtttccgtcatcatagaaaactctattggacagtgctgctctagatcctcagcaagttataattcaactcttttattcttctccccactaatttcatattattgtcccgaatacaccccttgtttggaagaatgttgttacaaatacagtatattaaaaggaaagtctaggctgtgcatggtggctcatgcctgtaatcccagcactttgggaggctgaagtgggcggatcacctgaggtcaggagtttgagaccagcctggccaacatggtgaaaccccatctccactaaaaatataaaaattagccaggcatggtagtgctgcctgtaattccagctactggggaggctgaggcaagagaatcacttgagcccgggaggcagagattgcagtgagccgagatcaagccactgcactccagcctgggagacagaacgagactctgtctccaaaaaaaaaaaaataaaaatcaacaaaaggaaagtctagtcagatgtaaacattttgatctctcatccagttaaaagcttcttttctcctctaagctgggcctgttgtagcctcagacccctgtagtagggaagaggcggcttggttggttccttcacactcctagttccctgcccggcccactcactgccattgtgaattcctccagggtgaagcagaggagaggagaggtaactggcaaagacgttcccagcgggactggtgttccttgtaatctggtgctgctgtccttggttggcagatgtccaagttccagattctcctctctcagggcactttggagaatttccccctcactgggctctcctgctgcgccatgccctggtgcaggctgtgcaaatctggctgactccttaagatccacctccgcacccccagctcccgtactccatgggtataagctgtacatttactttctaggaggggggtcacctcattctggtgaaaatctttggtggagtcctttccagataacctaagttccatgtctttccatggtgctaaaacataacatctcctgcccctccaggctctaaaaatacagactgttcccaccctagccctctctccagtcttccctcctggatactccagctagggtttggcctttagatgtttttcagaggagaatcaggcaccaatccttgtacccccagataccagggcatccggatcaagctctgaatgttgtccctcttgcttggcttgggggagagttcctacttttccttccccataggggagtggaggggctgtatgcagcactcctacatccatcttcagggaaattcacacctagcaaactccatcctccagcctccttgtgcatacaggtgggaggtgagtgagggatggcgcgcacccgctttgtagtttctgaacagacagggcagcccctctctttggaatgtgtgcatacttagtatccatgttctcagctctggatcctcagctgcaactccatgacaacagcaagaaggatgcctgcaacaccatattacagagaccatcttccctgcttctcaccacattgcacagtctctagccagtctgtccatgtctgttctgtgtgatctcctgggtcacttacatacaaaacaggagctggggtggaattttggattcttagaaatggtggaagctttatctaactccacaagacctaacccccggcttcgggcaggttttcctcatctccaccctgacgtgatggtttttcttggttcggggcagtgtttcacatctctcagttgtgttggaagcctcaaaaaggttgggaaccactatattatttaacttaggttaaatacgatttgacaaatggtcaaaagatgtagtggccttattgcagggatgcttaaaataatgacattgatgatttgaaatcatgagactttgggcatttaaattaattgacaatacttgtctcacctttggtccgaggttacatttccaatcacattcagcgggacttggggcaggagagggagtgaaagatctaggttttcctctgactcagaggagctgcattccaggtttcctggtcagctctactccttccctcaccttcttaacttactaaccatgccaggtgttttacctctgtcatattcagtgatcctcacagaaggtgagaatgtttgaggcatggaaatgctaacgtggaaatgtgacccaggatcacccagatgggaatgatggagctgcgattctagcctggctccatgccctctccagcacaccctgctgtctcagccggctcctatttccccacctcctctttatttgatgacattctctaatcagggctggtgacagtgaggcttagcacagctaatcccacccatggagaacatatgtgacatcaaaaggctggaaagaggcagaggaatggttcccaggaaagcatgagctgtaaggagaggaacttccctggcaggctcaaagcccatgcttttccctgaccttaccacccgtgaaggaccgcatgtgggctacactagcactccctctgccaggcacggtgcatcctcttactcagttctcccctaaacctctaagccagttcccgttgtcatccccgtttttcaggggaggagactgagacttagagaggttaaagctctgatctagaacccctgcgggtaagcaggaaggctgggatgtgatcccacatctgccccatgccatgccttgccacagcaccatgctgcctccctcctttggggccaacactttgtgtcttcactgggtcacatcccagggcctgggttgggctgttccccccccatccactgatgagatggcgatgctgccttccctgggtgctgctgcctggaacatactcaccatcctgcctgttgctattttcccttttcagtgtcctgtgtttccttctgctgcttggattccagttcgtctgcccacagccctccactcaacacaggaaggtaagccatggccatccagaggttttcttctctgcccaaggggctagggccactgtggtcactgccctgaactttgttctgtttgaaggtgagtcaccactgatcctgaaaggaagcaccatttacagaatatggagtgtactattctgttctcacattgctataaagaaatatctgaaactggggaatttataaagaggttttattggcccacagttctgcaggctgtacaggaagcatgatgctggtcatctgcgtggcttctgtggaggcctcaggaaacttacaattatggcggaagacaaagggggaacagcacttcacatggctggagaagaagcaagagagagaacggggaggtgccatacacttttaaacaaccagatctcatgagaactctttattgccatgactgcaccaagggggatagtgttaaaccatgaggaactatccctatgatccaatcaccttccaccaggccccgcctccaatattggagattacaattcgacatgagatttgggtggggacacagatctgaaccatgtcacggagcttaaaacatgaagctggtacctgcagttggtctctgatctgagagcagtgccagctttgcaacatgtgtttgctagaatggacagttgagaggtcagtgagagcactctacaaaggcatgggcagggcttaaggaacccacttgggaatggaggagaccagtatggagcttttaccctctcttggggcaccttcaaggtcaagggcagggatagagctgcagctgtagctatggctgttgctatgcaagagaaccccctgatagggagtcatgatcttcagtagagggacgcagtcactgccaactgatggccggcagggatggaactggaagataagaacctggccttctctttcctctcaccccttatttcctgctggtgactccctttggccaaaccaaccagaagacaagaaggctttgatgcagtccccaaaggccagcctcccgggccataggactgggtggagaaggagcaaatggacagtattgcatatgcttcccttcaggctttgtgtgttttatagtaaatgaaccatccaccattgcctgaacaagcctaatgctgctctgcaactgagcagatccttgatcaatgtttccttagagacaatgcatgataggactcttagaaagtccctagaagccctttctgctacctaggagctcctcctgtttacctggaatcaaattcagactcctgagaagagatcagttatttgtatctaagtgtgagcaagttggtcggctccttttctgagagggggttttcttttttttttttttgagatggagtttcgctcttgtcacccaggctggagtgcaatggcacgatcttggctcactgcaacctccgcctcctgggttcaagtgattcttctgcctcatcctcccaagtagctgagattacaggcctgcgccaccacacccagctgattttttttgtatgatcagtagagacagtgtttcaccatgttggccaggctagtctcgaactcctgacctcaatcaggtgatccacccacctcggcctcccaaagtgctgggattataggtgtgagccgctgcactggcctgagagagggttttcataggggaaattcaggacagaagggggccaagaaaaaagagtatgtgcacatatttggctaaacatgacccttcttgggagcagttctttgcgttcttatctgattatagtctaatttattttctgtttgggctctgtttttctgggccaggtataaacctctattgtactgtatctcccactaggatgtcaactccgtgaaagtaggaacttactggtcttgttcatggccctattcccagctcctagaatacagcctggcatgttgtaggtgctcaataaaatccttgttgaatgactgactgaatggaaaacctggccaaggtctaagcatcatttcaatggattcacctggaaattggcacccccctcccctgcttactctgctgcatcatctctattcataatatcaggagtcagaaaggacaactgcctacttttattatgaagttatattatttattaatgtttagaattatcagggttgttaatcctaagagttgagtcaatttactgtgttcctcttgttgttgttgctcaaataggctatcataacggaaaatactttatacgtgatcaatttactttgctgtctcctgtaatttttcaagttaagctgaatgatatgtgcgtaacctgaacaaaaggtccccaaataggtatcactctcatctttcttcaagtgtttgctctgagagatggggaaaaaaagatttatgagttattttatcattaaaatttttaaattgacacatagtaattatacatatttatgcatacaatttggtggtattttaatacatatgtattatataatgatcaaatcagggtatttagcattctagtcacctcatgcatttatcatttttttttgtggtgagaacattcaaaagcctctcttctagctattttgtcatatataataccttactgttaaccatcatcaacctactgggtaatagaacaccagaacttattccccctatctatggtaactttgtacccattgaccaacctctgcccactctcccctcttttctttcccctcttctcctcagtctctggtaacctctgttctcctttctgcttctatatcaactcttttttttttttttttttttttcagattccacatatgagtgagatctgtggtatttgtctttctgtgtcggcttatttcactttaaacataataacctccaggtccatccatgttgtcacaaatgacaagatttcattctttttaatggacaaatagtatttccattgtgtatatatacaccacattttcttttctgttcatttgttgttggacagttgggctgaatacataccttggttactgtgaatagtgctgcagtaaacataggggcacagatgtttcttgaacattctgatttcatttcctttggatatatatgcaattgtgggattgttggatcctatggtggttctatttttagtttattaaggaggctcctactgttgttcatggtggctgtactaatttacagtcctacccacagtacgtaagtgttcattttcttccacatccttaccaacacttatctttttttttttttttttttttttgagatggagtctcacactgtctcctgggctggagtgcagtggcgcgatctcagctcactgcaacctccacctcctgggctcaagtgattcttctgcctcagcctcctgagtagctgggattacaggcatgcgccaccatatctggctaattttgtatttttagtagagacggggtttctccatgttgatcaggctggtcttgaactcccgacctcaggtgatctgcccacctcggccttccaaagtgttaggattacaggtgggagccaccgcgcctggccaacacttgttttcttttgtcattttgatgatagctgttctaactggagggaggtggtatctcactgtggttttggtttgcatttccctgatgatcagtgatgttgagcatttcaaaatatattttttggccatttgtatgttttcttttgataaatgtctattcagatcatttgcctatttaatcagattgttgagttggttttttttttttgatgttgagttatttaagttccttacatattctggatattagccccttgtcagatgtatagttgcaaatattttctcccattctgtatgttgtcttttcagtttattgtggaaatttacaccccctcacttcactgtttccattgctgtgcagaagcaaagtttgatgtcattccatttgtttatctttgcttttgtttcctgtgcttttgagatcttatttctaaaatctttgcccagcccagtgtgctttatgacactgaataaaaccttatgttttgttttagtagtttcataattttgggttttatgtttgaatctttaatccattttcagttgattttagtaggtaggggtctagtctcttcttctcagttggatatctagttttcccagcattatttattgaagagattgtcttttcctcaatatgtgttcctggcatctttgttgaaaatcagatgatgtttgaatttatttctgggctctctattctgttccattggcctatatgtctgctttatgccagtaccatgctgctttggttactatagatgtgtagtatattttgaagtcaggttgtgtgatgcttccagttttgttctttttgctcaggattactgtgcctatttggggtcttttgtggttccatatgaattttaggattattttttcaatttctgtgactaatgtcattattattttgataagaactgcattaaatctgtaaattgctttggcttgtatggccattttaacaacattaattcctccaatctatgaacatgggttattatcctattgtttttaaagttttcattgtagagctctttcacctccttacttaagtttattcctaggtatcttatttttgtttgtgtgtaccattgttaatgtaattattttcttgatttctttttcagatagtttgcaattaacatatagaaatgctactgatttttgaattttgattttttgtgtcctctgagaagaatttgtttattagttctaagagttttttggtagagtctttagggttttctgtatataagattgtgtcattgcatacagggacaatatgatttccttctttccaatttggatgccctttatttttttctcttgcctaattgctctggctaggaattcctatgttgatttgggtggtgaaagtgggcatccttaccttgttcctgttcttagaggaaaaggtgaaagctttgctcagtataatgttaatataatttatactattctgtatacattatccagtataatgttagctgtgactttgtcatatacgacctttattgtgttatggtacataccttctatacttaatttgttgacagttattatcatgaaggaatgttgaattttgtcatttgctttttctgcatcttttgaaatgatcatatggtttttgtctttctttttgttcatgtggtgtgtcacatgtattgatttacatatgttgaatcatccttccatccctgggatgaatcccacttgatattagtgaataatatttataatatgctactgaattcagtttgcgtcttgttgagaatttttgcatctatgttcatcaggaatattggcccatagttttcttttttttgttgtatccttgtctggttttggaatcaggataatgctggtcttataaaatgagttttgaagtgtttccccttcctcaattttctggaatagtttgaagagaattggtattgagtcttctttaaattgtttgtagaatacagcagtgaagctatctggtcctgggttttattttgattaaagactttttgttactgattcaacttccttatatgctattgatctcttcaggtttcctgtcttttcataatttaatcttggtaggttgtatacatccaggaatttatccatttattctgtgtttttaaatttattggtgtatagttgttcataatagtgtctttctgtgttatcagttgtcatgtctcctttttcatacctgattttatttatttgagtcttttctcttttttttcttagtgtacctaaggtttgtcaattttgttcaccttttcaaaacacaaactgtttattttgttgatcttaaaatttttttttttttagtatcttttgttcatttctgctctgagctttattatttccttccttctagcaattttgggtttagtttgttcttgaggttcatggttaaattatttattagaaatatttcttgatttttgaggtaggagtcacaggaggtaatggagaaaagcaccaaaaaacctattaactattcttgcttgtctcaaggaaattaaaatttcccttttaatttcttcatcaacctactggttgtttagaagcatcttgtttaatgttcatgtatctgtaaggttttcaaagtttttcttgttggtttctagttttacaccattgtggaatgaaaagatacatgttacattatctttttaaatttgttaagacttgttttgtggcctgacgtgtgatctaacctggggaatgttccatgtgcaattgagaagaatgtgtattctgcatctcttggatggaatgttctgtaattatttgttaggtccatttggtctatggtgcagtgtaagtccagcttttctttgttgattgtctgtctaggtgatctgtctgttgttgaaagtggggtgttgaagcccccttctactattgtattgcagtctatctctaatattgatacaataatatttgctttatatatttagatgctccagtgttgggtgcatacgtatttataatgattatatcctcttattgaagtgacccctctttcactatataatgaccttctttttacagttttggatttaaagtctatttcatctcatgtaagaatggctgctcctgcttgcctttggtttctgtttgcatggaatatgtttttctacctcttcactttcagtctgtgtttgtctttaatggcgaggtgagtttcttttaggcaccatatagttggatcttgtttttttttaatccattcagttactctattttttttaaattagagcatttaatccatttacattcaaggttgttattgataggtaaggttttctgtcattttgttgtttcctggttattttgaagatcctttgtttctttcttccttgcttgtttacatgtgtggtttagtggttttctgtggtgttaagctttgtttcttttctcatgtttatttgtgtatctgttgtaatttctttctttgtggttaccatggggatagcataaatagtcttagttataatagactatttcaagctgaaaacaacttaactttagttgcattaaagtactttacatttttctttcaccccccaatttgtgttttggttgccttaatttacatctgcatcttttgtatgttcctcagccactaattgtagttgtttatgtttttgactttttttggctttaaaccttcatactagagaattgaaagatttacataacaccattacagcactagggtattcagagtatgactatggatttacccagactggttttgtattttcacatgttttcatgatggtaattattgtcttgctgtttccagctatagcaattctataaggatttcttgtaaggccagtatagtagtgatgaattctctcagtttttgcttgtctgggaaggtctttatttcctcttcatttctgaaaaacagctttgctggaaatagtattcttacttggttgacagctttttcttctttcaacactttgaatatgtcatctcattctctcctggcctgaaaggtttctgctaaaaaaaaaatctgctggtagtctaacggagatactcttgtatgtaacttgatgtttttctcttgaaggttttagaattctgtctttgacttttggcagtttgtttataatgtgccccagagaggttttttgggggttgtatctcactgaagacctttgaccttcctgaatgtggatgtctgtatctctcccaagacttagaaaatattgttgttgtcgttaaatagatttcctgtgcctttctccatttcttctccttctgaagtcctataatgcaaatatttgttcccttaatggtgtcccataagtcccatgtgctttctttgttctttttaattcttatttctttttttccttctgactgggttatttcaaaaggcttgccttcaagttcagaaattctttcttctgcttgatctggtctgttgttgaagctcttaattgtatgttttaattcattcattaaattcattagctctaagatttatttggttcttttttgtatatctgtctctttattgaatttctaattcggctcacgaattgttttcctgatttcattgacttgtttgtctgtgttcttttatatcttactgaatttccttaaaatcattattatgaattgctttttgggcatttcataaatagccttttctttggggtcagttaatgaagacttattatgctcctttaggggtataatatttccttgctttttcatgtttcttgtgtccctgtgttgatgtctgtgcatctagtaaaacagtcatttttttttttaaacctctgcaattattagtttattagtatcatccaggactcagatgttcagtattcctcctgaaattacataaacaaatgcaaatggaaagaatccaagtcaaaattatataacaaaacagcactccatcacaaaagcgtgtaaaattataagaacgctattttaaaatactggcactttaagaaaacgataatctcgaaaaccacaaaattgccaaattgttccctaaactgctaagcagataaacatgactaatgatgagtttgttttgtaaagaaaaatcattcaaataaattgaataattcatactgagatgcaaagtttaagtgtcttctttcctcctatctacttggatttataaaggggcaaaccgtaatataggaaaatataccctattttgaatgtggcatctttgtttgaaaagctggcccaattaattaaaaatacttgtaatggaaagtctcgtttcctgagcagtccatatttagataaatgggaaaagacatctatagccagcattttcatagtcttcactgagactaatgtcaacaaaaaatttaatatggcagtcttgtattttaagctcacgcttttggggatacattctcaggtcttctttaatgtgggaactgcaaaatataactgccattacatggtaatgggagttaaagaatagagtcctcatgtaaaggttagaacatacttttctattagtccttcaaggacagactttcaaaatgtttgattctagtaatcccatgctttgagtagattgattactcttcagtttgtaaatgtaagtgggctatgtgaaatttcttaactgatcaagattttggatgttcagttatggatgaaaactatctcaacttaactttaccctcattatgatatgcagggtgggtagacaaaagctttttattagctaactatatgaaaggataaacactgtaataattcatgtgattcaaaatgggcaaaagcaaaagactagcttcccctcaagaagaaaaatttcagacctatgaaaaggacaacaatactaataaaaaaattgtatttacttagaagcattcagaatgtcaacaaaacagctgcaacttttttttttttttttgcaattacagagtggtattcagttaacagaacaacaattatttcgtataagctgcatcagagacaactgaagatgaaaaaactaccatccccatatataactaatttgtgctgtgcaccaacaagaacctgctttaaatttccatgccaatttacaacccccatactgtaccaagcaaggttagtggctattgaaaataccaccaggacagggctatctaaagacacattcggtagtgtgttaactatacaaaaaaagacactgtacagtttaaaaacaaatcttacacagccttacatttcagtttttttctttaaaaggagtgagttgtgtacaggggggttaaatgctttatagacaagaaaaaaaaactgcgctagaaccaacttattcatcatcatcatcttcttcttcatcttcatcttcttcatcttcctcctcctcctcatcctcttcatcttcctcatcttcctcctcttccttctttttcttgcttttttcagccttgacaactcccttttttgctgcatcaggctttcctttagctcgatatgcagcaatatccttttcgtatttttccttcagcttcgcagccttcttttcataaggctgcttgtcatctgcagcagtgttattccacatctctcccagtttcttcgcaacatcaccaatggacaggccaggatgttctcctttgatttttgggcgatactcagagcagaagaggaagaaggccgaaggaggcctcttgggtgcattgggatccttgaacttcttttttgtctcccctttgggagggatgtaggttttcatttctctttcataatgggccttgtccacctttgccatatcttgaaattttcctttgtctttagcagaaatggtcttccacctctctgagcacttcttagaaaactcttgagaagttgactgaagcatctgggtgcttcttcttatgctcctcccgacgtttgcacaaaaaatgcatatgatgacattttgcctctcagcttcttaggatctcctttgcccatgtttagttatttttcctcagcgaggcacagagtcgcccagtgcccgtccggctctcacttgccctggcgctgtctctgtggagctcaatgtactgccaaaacagtcatttttgtaattttatggattaactttcatagcaagagcctttttcctgtaaatggatcctgggttgttggtcgggaatggtatgttgactttggttctgggtggactcagtaacatggtctctgtacagatttttcaactgtaatcttcatctgtggtgtctgcaattttctcagtggcctaggctgcaggaatttgtgatgcagtggtgcaggtttgctagtggtgggggtgccaggttggttgtcaggctaagcatgtgtgggtgtggtgggccagcaggctgtttggtgggctttctaggaaggtggagccactgctgcactggctgttgagttgtggtgtggtgtgctgtgtggctgcatggggctctttctgagccacctccagtcaggctgtcaggccaagggtgtgtgtggggtgcctgagtggttatgtggtgctctctctgtagggagagggaggtgagacatctctaggccagctattgaaccagaggtggctgggcagctgtgccaggatctcaccagtggggtagagccactttcaggctggctgttatgatgggtatgagagcatatgagctgggtgacttcacagggtttccccactgtgaagtttgcttatttccctagggaatagggtacctgatgaattcagatgttgtggtcttggttgttcctttaggcctaggctctgggcagctggcgtattggtgctgtagactcccttatgaatgtactggaatgacggtggaacctcagagatggaggggattggtggctactgacccccaacacaagatgcactccagcaatgggtcaagtttcaagatggcaccatgctatagcagcttaggtcatggaggttggaatgctaaagtgtttcctgttctggggcaatgcagccacatgaactcccagtaactgtccacactggtttctggtcctgtgaggactgggagacccttttatagcaatgactgttcctgtctatggaggtgatggggcaaaggattccagcttactttttccccgtgagaagaagtttccctggctctgagctggtcctggtgggggataccatgtggcagagggaggatatctcacttccctctctgtggtgctatcctgggcttccatgctctatagaaattttgttgctcccccggtgctttccagtgtacttcatcagtaactccagtcaaagtgtagtttatttattgttttggtacctttttgtgtcaggcaactctagttggccatcatgctgacatcactctataagttactctagaatgtttaatttaaaaactgagcaaagtgtatcacatcttgggatatggtacctccttgtcaaagcattattaagaactttgtagtagaaagatagattaaactttttctcagaatcatgtggagattactttatatagagaacatatattttagaatagtttttcaatataataaacgtgtatttattatcttggccaccaagatcattgccattcactcaagacaagaaaggattctctggtttccttggtggtgagtttctttttgatgttttatcagagctttgtggaactgtggttgtcatcctggttatgtgctcaaaaacttggcagcagaagcagtactagtagtagtaacatccatttattcctgcaagatgtgaaatgaggaaatgcttattaaaacaggagtcaacatgtttttaaataaagggttgttgagaatattttaggctttctgtgctataaagtctgtcacaattcttcaactctgcttttgtagcacaaagccagccatagacaatgtgtaaatgaataagcatggctgtgttccaataaaactttatttacaaaaacaggtagtgagctagatttggcccatggggcacagtttgccaactcttgctctaaagtcaggatagaaaggtgttaactgcaagtatacgtgttttggaatttgaagtgggaaattttctgctcctgggactttaagaaacacagaagattttgggtaaaagtatttttttcatcaaggcataagacttaccattgtgatcaaattgttttcattacttagataatcataattcaatttttgctgacccactgttttgtggcaaaatctactcacaatctttagcagacagctggggcataaagaattagaaaaccatttatggtaaattcttaagggacaacattattaatttgtgtacactgtagtttagtatgtatatgaaaactgctactaaaagacatcactttttttctcaatacaatggtgtgtccaactttagcatatggaagcatttctacagtgtaagttattctgaggaaaagacataatttgtaaatgctgtcaagtaaactatgcatttccaaatgctgctcaggtgacttgatacatctctgcaaaaactgtcccacaacagtgcaggaaaagaggacgctggtacagagtttaagtagctctttccagatgtttctgcccagaagtcgtcctcatgttcctgcaatatgaacagtatcacaaagaactattcaacttccattcttggcaattaattaaagatacttggcaaatgactacatttttaaaactttctgtggcttcatttgtggataaagtgaaaccaagagtaggaaaaaacttgagcaagactttaataaaacaataagttattagtaagggaaaatatgtcgattgtagaatgctttaaaattaatgaactattctactgtctgcctagcagacactccatgaacaagtttttttacaagtcataatgtgtatggtcaacatactgtatgcaggaaagattgtgagacattgtattttttagctccacatatgaaaaatcacacatacactttaatcacaactgctcaaactttttttttgttaactttttaaattaaaaatatttatgtttattatagagaatttagaaacaatgaaagctacaggaactaaaaactcattgtcacggccaccagccaaggggaactgcttttttaacctgttatttatagaaactctaagagaacagagatactgcagaatgaagtaagggtgaggtaaaatatttgtgttgctaactgataagcaggtcacgatgcaaacagcagaggacctcgtgatgggttacaggcactattaatgcggtaggatgtgcaaccagtgacttcaaattgccccttgacaatgtcttgcagttggatattgaacagaaagcctatagaaggggaaaaaaattttaggctacataaaactcaaattattgctgctatattcaataagaagaaaggaaaaaacagtaatgctcctagaggaaaacatttgagaatagcttcgtaatttgatgtaggcaaaggtttcttaaacaagacacaaaaatcagtaaccataaaattgtactacattcgagtcgaggttgtttaaaaattgaaacacatcataaaaacagtgaaaagatacgccatggacagggtaaagatgtttacaacaatatatttggtaaaagatttttattcagaatatataaagaaccccttcagatcattaagaaaaagttaagccagtcaatttaaatggcttaaacagacagttcatgtgagatgatatccaaatggctgataagcatatgaaaaggtagtcaatcaaaatcattagtccttaggtaactacaaattaaaatctcagtgtgacactaccagaatggctaaaataaaaaacactaccagtgttggtgaggataggaagcaattggaactttcatacactgctggtgggagtttaaatggtaaaccactttgaaaaactgtcagtgtatcttaaagctaaacattgcccatgctatgatctggctactgtattcctaggtatttacccaagataaatatggacatatatccaccaaaacacatggataacaatattcagagtagtttcctttacaataaagctaaactggaaataacccaaaagtccatcaataagagaatggagaaatacattatagtgtgtttatacaagagaacaccaaacaacaataaggaaaaaataacttgtttctagccaagatggagcaccagggattggatttaccttctcacttgaaacaaccaaaaatacccagataacatatatgaaataatgtttttcaaaaccttggactttagacaacaaaagatagttatcactcagagatagaaaataaatgaattgagtcataaaatgtccccagcttactgccttgagagtttcctggtcttggtgcagggaggggtatgctaggcagaacctgttagacatcttgagttaaggagatagacttaagagtccagcaagatggccaggcatggtggctcaagcctgtaatcccagcattttggaaggccaaggcaggcggatcacctgaggtcaggagttcaagaccagactggccaacatggtgaaaccccatctctaccaaaagtacaaacgttagccaggcatgatggtgagtgcctgtaatcccagctactcgggaagctgaagcgggagaatctcttgaacccaggaggcggaagttgcagtgagccgagatctcactgggcaacagagtgagactttgtcttggaaaaaagaaaaagagtccagcaagaccaagtgatgatggtctgcaggatagagtaccagagaggagagaactacacagacagaagactgtggagctctgcaggagatcctccataaggatgcagcatactactgatcagcacacacatttgaggaaacaatctgaggttgaggaaagaatcatccaagagaatgaaaaagaacagtgcccagcattcattcaggaccaagaacagtgactgttcccactaggcatactttaaaaactcataatccaggaggcattgaatagaatactcaggaagctctcacctcagtattgggggaatagttaaccctagactgtgtcctgctctggatctaacaaattaaaacagcagtaatgaaatgattaatctgtttctaaataacttaactgtatcctagcataaagtatgggaatataaaaatatccagcacccaacaaggtaaaattcaagatgtctagcatttagtcaaaggttaccaggcttgcacagaagcagaaaaatattaacattattccccataatgaggagaataatcactgaattgaaagcaattcagaactggcacatattttagaatatgaaaacaaagatattaaaaattactaaaaccatattccatatattcataaagttaagtagaggcatggaagatattaaaaagacacccaaatctaacttcttgagatgaaaatgacaagatctgagatgaaaaatatactggatgggattaatggcagattagacattgcagaagaaaaaaacaagtgaacttgaagatattgcagtagaaactctccaaagtgaaatataaaaaggaaaaatagaatttaaaaaagatgaacagagcatcagtgaactctgagacaacttcaggttggctaatacatgggcaattagagtaccaaaaggagaagagatagggagacagaaaaaatatttgaagaaataatagaaaagtttccaaacttgatgaaaactatgaatccaagaatgtcaatgaactccaagcactagaagcatgaaaaaaaatggcatcaagtcacatcataatcaaattgctcaagaccactggtacagaaaaaaatttaaaaagcccttagaaaaaatagacatattacatatatgggaacaaagttaagaatgacagtagattctctgcctcctgtcattcatgcaagtgaagcaacatctttaaagtactaaaagaataaaattgttaacctaaaatttcatacccagcaaaaatatcttttaaaaatgaaggtaaaataaagacattttcagacatacaaatgctacactacacctgccccataagaattgttgaaggaagttctttaggcagaaggaagatatcaggtggaaatatggatcttctcaaaggaatgactgcaccagaaatgatagctacataggtaactatattttaaaagtttctcctaaattaagcatcttttaaagattgactctttaaatacaaataataatcatctgttgtagggtttataatatgtgtataagtaaattatgtatgacagtaatagtataaatgccagaaaaggataaattaaggaggtgaaaaacttgtccaatgaaaactacaaagcattgctgaaagaaattaaagaagtcataaataagtataaagacatgccatgttcatgaattggaagacgatcataaaaggaagtatgatattataaggttctttttataatgcatgtaaaatggtatcacgttacttgaaggtatactgtggtaagttaaagatgtaagttataaacctcaaagaagccatcaaagtgacaaaatgaagcattttagcttatatgccaaaaatgaaataaaatggaatcctaaaaatattcaaatatcgcctgtaatcccagcactttgggagtctgaggtgggtggatcacctgaggtcaggagttcgagaccagcctggccaacatagcaaaacccgtctctattaaaaatatgaaaattagctgggtgtggtggcacgcgcctgtaatcccagctacttagtaggctgaggcaggggaattgcttgaacctgggaggcagaggttgcagtgagccgagatcatgccactgcactccagcctgggtgacagagtgaaactctgtctcaaaaaaaaataattataaattcaaataaatggataaatgtatgatgtttatggttcaagaaactcaatattgttaagataaccattctcttcaaattgacctatagatttaacacaattccaataaaattcttagcagacttttaatataaattgacaaactgatgattaaaaattcttatgaaaatgtagaagccctaaaatagccaaaacaaatttcagaaagaagaagaaaattgcaagacttgtactccataatatttatattattagctccagtaatcaagatagcatgttattggtgtaaagataggcaaatagataatggaacagaatacagcatgaaaatagacctatacatatatatatatatatatatatatatatatatatatatatatatatatatatgtggacaattgattttttataaaggagaaaggtagtctttttaacaaataatgctgaaacaattggatatctatgtgcaaaaacatgaacttcaatctgtatcttgtacaatatacgaaaactaactcagactcaacaatctaagaatagaaggaaattaccccaacataataaagaccatataagaaaaacctacggtgaacatcatactcaatggtgaaagcaaaaacaatacaaggatgcccacttttgccacttctatttaacacagcactggaagttctaggagaagcaattaggcaagaaaaagaaataaaaggcttccaaattggaaatgaagaaggaatactttttctcttcacagatgatatgatcttgtatgttaaaccctaaaatatctgtaaaaagattgttagaactaataaatgaattcaccaaagtagcaggatacaaggtcaacatgcaaaaatcaattgcatttctatacactgaaaagatcaatctgaaaagcaaataaagtaaacaattctatttacagtagcattgaaaaaaataaagaacttggtgattaacttaatcaaggaggtgaaaacttgtataatgaaaactagaaagcattgctgaaagaaattaaagaagacataaataagtataaagatatcccatgttcatgaattggaaaacttaatattgttaaaatatcagtactatgcaaagcaacctatggattcaatgcaattcctataaaaatcccagttgttattggtgtaaaggtaggcaaatagataatggaatagaatagagcataaaaatagacctacacacacacacacatatatatatatatatatatacatttttatatatatatggacaattgatttttatacatatatatggacaattttctatttcaaagaaatagaaaaaagccattctgaaatttatatggagtctcaaaggaccccaaatagtcaagataatcttgaaaaaataacaaagttggaggactcatactttctgatttcaaaacttactgcagagctatagtaaccaaaacagtgtgacactgacagccatggagaccaatggaatagaatagagagcccagaattaaaccctagaatatatgatcaaatgatttttgacaatggtgccaagaccattcgatgggaaaagatgtcgtgtataaaaattaactcaaaatggatgaaacatctaaatgtaaaacctggaactataaaactcttagaagaaaatgtagagcaaaatcttcatgatattagttttggcagtgatttcttggatatgacaccaaaggcaccaggaacaaaagaaaaatagccaactggacttcatgaaaattaaaattttgtgccttaaaaagacactatcgagcagaaataggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgcgcgcgccgaagcagggcgaggcattgcctcacctgggaagcgcaaggggtcagggagttccctttccgagtcaaagaaaggggtgatggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctggggggaggggcgcccgccattgcccaggcttgcttaggtaaacaaagcagcccggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcaggggttctcccagcacgcagctggagatctgagaacgtgcagactgcctcctcaagtgggtccctgacccctgaccccgagcagcctaactgggaggcaccccccagcaggggcacactgacacctcacaaggcagggtattccaacagacctgcagctgagggtcctgtttgttagaaggaaaactaacaaacagaaaggacatccacaccgaaaacccatctgtacatcaccatcatcaaagacaaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacagtattaactttaaatataaatggactacattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatcgctgggacacattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagaataaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaacataatccagcctataaacagaaccaaagacaaaaaccacatgattatctcaatagatgcagaaaaagcctttgacaaaattcaacaaccctccatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcactgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttccaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatacacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacgagttagtgggtgcagcgcaccagcatggcacatgtatacatatgtaactaacctgcacaatgtgcacatgtaccctaaaacttagagtataataaaaaaaaaacattaaaaaaaaaaaaaataaaaaaaaaaaaagacactatcaacagagtataaaggcaacccacagaacgggagaaagtatttgcaaatcatatatctgataagggattgatatccagagtatatagagaacttacaaaattcaacaacgaagcagacaacatgattcataaatgggcaaaggacttgaatagacgtttctccaaagaagatatgcaaatgtccaataagcacattaaaagatgctcaatgtttaggagggatgatagtaagggaagaaatgaaggttaccaacggctacaaaaacttttgggtgatggatatgtgcattatctgattgtggtggtggtttcaggggggaatacatatgagaaaacttatcaaattgtatgcttcaaatatgtaattgattatgtgtcaattatacctcaatgaaactgttaaaaatgaactactgatataagcaacaaccgaaataatttcagagccattatattgacaataagaagccagatgtaaaagtatgtacagtatcattccatgtatatttagttcaagtatagacaaagatagtttttgatgaaaataaaatcagaatagtggataccaacagggggtgagggtggctattcaatagtgaggggcatgagggaaccttccagggtgttggaaatattctaagtcttgagcagggttgggattacatggatcttaaaagtataagaattcatacatttacagtgagcatacttggtgtactttatgtatgttatacctcaattaaaaaaaaagaggagaaggaaaaggaggaagaagacagtgcagtgaatcaaataccagtactgaaatggcaataaaagtctctggaacagtgtgagattgtcccttgggagtgaccagaaaacaaagatgctctttaaagaatagcacagggcgtgcactcatttgagggtgtccagcccagaacccctacagaattggaagctgattctaaagcagacactgtgtctcttccagctggtgtttgtcaagccttccgtttctaatggcataaatataactgactgctgctgaaaaattaagagcatttctacttatgaaaaaaataaactggagtaaagagaccttattaagaaaagaatttcagtgttcactaatttgtgctgctctaaatttcttggattcaaagtcaacagcagaaaaatctaatttgcttctattaaaaatggagcaataagcttaaaactttgtgtttgtgtttggaaggccctttacaatgttgcagaaggagaacatcttcaggcttttagtttgggaataatggtacggtcctggcatcttagcctcttctttgtttagggccaggattccccttcaaatctctgacttctttctgagtatgcttgtacccatgagttgaaggcaaaaagtggaacatagaaggaacatctctgtcaatgcttatggacttctccactgtggacagagtccctctttgccatccccagctttggctgacttgactttaattggtatttcattctcccatcctagtggtatctaccaactctctcctgtggaggagtcttggtcctggccatcctagtgttaacctggtgacaggaagaccagaaagaagccataatcattcctcttccatcaaggcagatctgcctgactcctgttgttaactcttgcctccttcacatccctccatctctagattgtgaaaggagttgtcctctggtgggtgatctccaaatcaagaaatgaaatatgagacctaaaaaaatcttgggtcacagattctgtttgcagaagatgttgagagatcatcagaggaagcggacactggggatgatgtaagctggagacacaaggataactggggctaccagccccatttttttatggcaaaaatgatatacattgacttttgagtgttccttctctatgacaccctctgccctgatttcttaaagaactctttttggtatttaatcactactaagttcaagggcaaaaaacctttgtttttctatatatgaatatttcttttgttctagagtttgcctgcttcacagaaacccacacaatctgagtgtataaattccttcctttggacgtttgtcattccatttatagcaatattgaaaaataaatacattataaatttgttattagtgtctgaacaaactctactctggtacccatatcttaaatgtggtcttcttataaataaacccaagttatacagagtagatatttttgtgcgcttcaaccataatgaagtgactttaggactataaatggttctaagaaaaaatgagtattttatgtactttaatttttttctcaaaatttccattccctcccacacttatacacataaaacccaaaccataaaaaggtgttttttaaataacttctaaattcccactatgttatgtttccaggccacattacagttaaaacaaagttttgacagacagaataacttatcacttaggccacaaatcttagtctttggggagcaaaatgaatcatagcacagtcttctgggcactgtctttgtatgttagtggtctatcttttcctcccagtgatgatgtgatctgatttttgatgatgtaggaatttggcaagtggagccttcccatgtcagctgtcttccttccctaccaaggatgcacactccttggttagtttggagaaacagagcagaagtcaatgtccttttgttcctaattgtattctctttgtatttttttatacatttgatgcatgcttttgcttatagccatgtccatttatttttccccattaactcatcacacatgtatcaagggcctaccatgtgaacctggactctgtattagtctgttctcatgctactaatgaagacataccggagactgggtaatttataaaggaaagaggtttgattgactcacagttccacatggttggggaggcctcccaatcatggcggaaggcaaagcaggagcgaaggaatgccttacatggcggcaggcaagagagtgcttgtggaggggaaatcccatctgtaaaaccatcggatcttgtgagacttaattcactaccacgagaatagtacgggggaaactgccccaggattcagttacctcccactgagtccctcccacgacatgtgggaattacgagagctacaatttagaatgagatttggatggggacacagcgaaaccatagcagactctgaagccagattgcctggttaatacctcagttctactgcttagtaattctggaccttgggcaaggtccagtgcctcagtttcctcatctgtaaaatgagggtgataatagtacctatcacgtaggttgtcttgaggattgcatgagttacagataaggggtttagaatgttgtctgactcatagtaaatactatataggtggtggtgttactgttgttgctgcaacacatgccaggccatggaatttaccttgctggcacataaacgtccctaagaccaaactctttaaagttgggtacccaaacatgtttcttctcaaggtactttccttctatctacccaggcctgatttatccacatcagagttccccagccttgaaactgttggttttgtggaccagataattatttcttgtgggattgtcctgtgagccgttagaattttagcagcatccatggtctctacccaatagatgccagtaagaaactcttgcgttgtgacaagcaaaaaatgtcccagactttgccgaatgtccctctggggacaaagttgcctgcagttttgagaaccatctatttaaactggtaaatccgcctgcagaggtggcactatagctgccccctgcattctaaggtggctgctggttacatgttgtcatcttctcttttccctgggcttgtttttgaagagtcatgttagatctgcctcttaaaccacatgtttggaggcacagggtcattcctgctgttacactgaggtttctgtagtaggaggggctcctctttaaagtattctccctcttctcaatctcaggattctctggaaagaggaagaaagcacatagccttcttcagacttctgattgtggctacccttgaagacaagcctcccagcctttgtagcttaaggaatttactgcttatcactacggaaaagaagcaggtgtcccaaaatctcacacttgggaaatcttgctgtgtgagatgggacagcatggtccttggtccaggttctccatgccccgtgcccttgttaagagttacacagatggttaactttgatggaatgctcaccatgtcccagaccctgggctaagcactttataaggattggcctgttaacttttcacgtttaccatctaaagcagatatttttgtctcaatttcatagatgaggagacctcagcctagagacattaaatccactgctacccagaggtagaagcatggatttaaacccaggcatctggctgcaaagctgaaccccagtgatgcatatcctcccatctgctcacatggcaccatctcccttggtctctagaaagtggcagcttcctccttggactgtcccctgttctgctctagttagatttaagctcctacattccatcctggtcatatacaactgtctatcattaggttaccctcacgctgtcctgaaatgtgatggaagtagtttcgttttgttgttttgttttgttttcatgttaataatgtcactgagacccacccgctccccaaaccctttggttttttttggctctccctatgctgaacactaaacccatttcttccctgcctttaggctgaccttgagcttctgctaactgataagtctccttttgaggcgtaaaccgaccttttaaattgcatcaaaacctttgagctaagcccattggccacagagtttaccttgctggcaccaggtttcctaatacctacatttcctaagaccaacttctttaaaactgttaattctctaagcaaagagtggtcacttttagtacacattcagctccatcccagatacaggattccttataagccaaatataaagatcttagggtggaaaaagagttatacctaatttaaagggcctttactggaattttattgtattgaatattgttcaaaatatgttggccattggaaagtgtggtgtctttttcctcctgtgacattggtagtttgtgtgaacaggttatgatttggaccataaatccatgcattacctgatttctctttggcctaccttgttttcgttatgctgaggccacatggatctgctttgattttccaatttctattacaaccgtggctttgagagcattgtccttagagtgaaaaaaataacaacaatatctgtagaaagcactcagagaaaatgaaggccataaaatgtcaaagtacaaatgaattatgtagaatctttgtttgagaatatttctgagtagcatcgagaacattctgttctcttcctttattttcttcctgtgcctttcacagggaagacgtgtcacagagatacagacccgcaggaggagggcttattgtttagtatggatttattcgttgattcagataatgcaggaggtttattgaacacctactgtgtgccaggcactggagatatgctggtgatgtacccacccctccctggaagagcccggagcctaatggggaagacaggaataaacaagtgcagtgcagtcaggaggtgcactgcaatggttaaagtctggccagagtttgtgatcacagaggagagtgacaatgatgacagtgacaaccaacgtttgttaaacactttctgtatgttgggcactgtgctttctacacattatctattttttaatcctggcaacaactttgtgtcgtagaagctactattgtcccctttatacagaggaagaaattgagactcaaagacaacatttctaagctgaatcttaaaagcaaagtaagaattatccagggacaattttgtaattaataagtaagatgcaatggggggaaaagaggcattatccacagggaagaaggaaggggccatgattctgggatgaggaatagcaaatacaaagacatggaggaaatggatgagatgacctttgtgtgccagggtggcagtgggagccagggcagctgaacctcatttacacaacctggtcctgcccatggttttgggatttcaactgtgtgacctgttgtcatggaagagcaacctgtgtttcccaatacccgacttcagctctccttgcccctcaagtggcagagccacttaattagataatgttcccatgtgattggggtgacgaattcaaccttgaagtggttgttccagtgactctgagattaagctcaacagctgggcgtctctgggaaagctggcagggctggcaggatccacagggatgttgagttcttagtcttccaagctggacttcaaggggccttgagcaagtcacttaacttctgtaacatttgctttgtcctgcagatggcctgaaagcatgtctggttcaagtctgtattcccagaacctaccgcagagcctagtacatgataaactgtaaaatggggataccagttattattgcaaggcatttcaggtgattaatgatatttccaatgaaagcctctaaactgctcagtgaaaggtaaggaataaatgaatagtcccctttctcaagtttgcttaattaactagtcatcattgatctaagtctttctatttagagttggcagatattcgttgtactaggaaaaccatcttagcctctgcttcatgcaattttagtttgcagtgggtgggtacaaacgaaagcaaaccagaggtagaagttttttccatacatagggcatgcctagtggaaaagcagccttttcagcagaggaaggcgggtcgaatgtgcagcaggacagaaaaacccagagccctgattgtgcccattgtccaatgactgctcctttgcaagggctgatccctgacattgaatggcgggagggtgatgactgcattgaaatatctgctaataggcaaggccctcccttcctccacaccctttctcctccgttaaagactttctggaaaacagagcaaaaacaatgcggcaaccccaagggttgatgagaattgcattctccctgcagcttctattactcttgtgcctttgtccccgtggacttggtgaagggtatagctgtcaggtgcctctcttccctggtgcagggtaatctggactgattgacttgtccattgtcctaaggttggagctaaaaacaaaacaggaaaagctgcttgatgaggatgaagaggaacttggtggccaaatgctgttgctttccaggcattggacacaaggctcattctctctgagaaacttacatccaaaggcagtgactttgaaaggaccgtggctgtggaattagagacagatgcgtagctgaccatgagtagatattaaattgtattaaactatgcaaaccgcatttctcatgcaaggcttgtttctaccttacatcagcccttgagctgcatttgcatttctatagagaacgaaataaaagcagcatgtcacttactcatttctattcataactgtgagctgttattctagctctcatctaccctacacagcactgccagattaatcttcctgaacctccatcaacagcgagtttggttcccagcatttcactgaatcaactcatgtttataaggcccaggtgctgagagggatataaacagacttaagacgggactaattttaaggtaaccagacatcctgctttgtctgggacaatcattgcttatgcttgttatcctgatacaattattaatagtgcctcttttcactctcaaaagtgatcctgattagacaatgaattacaaggttgccctactcatgtctgtcaagtgttcataagataaaaggggtggaaaggatgaaggtaaatacggtaatttcaaaacaaggtagagattggaggtagaggagttaggtgtttgcagaaggaagggagccattgaggctgagagtgataggggaggctcatttaattctaggacttggccttggcttcgaaggatgatgatgactcaaaaaaggggagagaggctggcgaaggtgtgggagccgtgagagttaagggtgtattccatgactctcaaagggtcacctagatggagcttcctctgggaagaggagagcaggagctgtgagatgggagggacagatctggaaggcttgaaaggcaggtgaggaacttgtgctttaccctgggggctgaaggaagccatagagatactggtgtgaaatagccaaggtgaacaggaggattcaactggtcctggcgtaggactggtcatctcatcaccagtgaagacagaggatctgacctgcagaagctgcctccaaaccatcacaccatgctgcctgcccctctcccatggcctgcatgatttcctaggtaaattaaaaattttcacccatgacagggtgaggcaaatggatgttctggtgtcttggtttccagaagcctccagccaagagttgacatgagcttgctgttttaacatcagttaaaataattattgtagcatgatttctgacaggaacaaaacaaaaggatacacttacaggagcaggctgtgcagtcaggacatgcgcgatccttcagagggcctttcgggagtgagtgactcgccacagggtgtttatctgtcatccatatggggaatcatcttcttcataattttgctcaactggaatcagagctaaggctccatgtgcacagcggagagattcattttgtcttgtgcctgcctcttcctcctttcttccttccttttttctttctttcaactagaatcattgagtactcaacatatggacacaccctaagccagctgctcttactccgtggttgccacagcaacccagtctcgtgagatcagagcatcttcattttgcagatgaagaaaataagcttctgagagggtaggagaactgctggaggtgaccagctatatgcattgttgagcaccttgccagggtaattacatcaagcaggtctctatgaatagtttgattatttctagtaatgctgttgaggaaatgaaaccaacagagagcaatactaggtcagtggtattcaagcctgactgtgcattagcaccatttcagcaccaggtgcttaaaaaatacgtttctggctgggtgcggtggctcacgcctgtaatcccagcactttgggaggccgaggcaggtggatcacaaggtcaggagatcgagaccatcctggctaacacagtgaaaccccgtctctactaaaaatacaaaaaattagccaggcgcagtggcgggcacctgcagtcccagctactcgggaggctgaggcaggagaatggcgtgaacccgggaggtggagcttacagtgagccgagatcgcgccactgcactccagtctgggcgacagagcaagactccgtctcaaaaaaaaaaaaatacatgtttctgggctctgtgccccaaatgttctgttttagtggctcctggtggagcttaagaatctgtgcattgtttttttaagtccgctagagtaatagttcttcaaccacagtatgtatccattgttaaaacacagattctgggcttccaccccttgagtgtctgatgcaggaggcctctggtgggcctaagcattgcattccatactgctactctgaggaggatactcagaactgctgcgggagaggctgctgatgctcatcccgcccacgcactgctggggtggaaggctcctggactctgcatgctcagatggtttgagtctattttgtggagggcatgctaggattagaagagctagacccgggatggctacatatgagccatccccccttcctcgaaacctggggtagacatcatttactgaccactgtgctctttttaactgagtcctggctcaaggtccctctcatctctctgtagcctgcccataccaatcaaatggtgttggctcacaagccaaaccttttattgtttgctaagctagacattctaaccgacacttccaaaatcagtcattgaaaaattctgtttgtttgtggaacgtgtgccttaattgttcatgagagggaaccccctggggagtggttcttgacattggctgcacattagaatcacctaggaaattcaaaacaaaaagaaaaccagactattgggctcccttccatgtctgaggtgggctccagctgctagcagctttatgagcattacaggtgattctaaggtacggttagggctgacagctatcggactgagggggttgctagaagctgtgcaaactctaaaactagttgctaactcctgtcctgtcgctgaagattccccttgcagagcatccccttttcttctatgcatctctttatttttctgacaaacagaatagaaaggagaagcagccaaaggcctgttgacaccatttttgtctcagaggcttcctgacaggaggctgaaatgggtggtagccactgtcctagaatagctagaaaggaaccatttttctggagcagttcccaaaaaattcgtctctaacagcagaaggtgtcactcccctcgctttcttaccttttgtgaattttggaatgcagaaggtcccatcgagaggaaacgttttcacacagagactccccaactctcagccccatggttttcctctctgctcagtgccagccctcccaaatttagactcgcgtcccccttcatggctgccactcatgctttactaaattgctctttgtggaagtcaccaacacaccctaaacagcaattcttctctttgttctccctgaatcatccgactctgttgatcactctctctgttcctgggaacgtaatttttctgcttcctctccattccttctctgtgtcctttactaacctctttgccttctcctgctccttagtgggagcatttccccagggccaccatctttgtcccatagcacttttctacacaccgtccttcccctgggatcccttccccagatccatggcacaggtctgactgatgttctgagtcccagtctcccaacagtgtctgtagaacttcttgtgcccaccaaattggccctgtctctggactcccctatttttcttctgggcaccagtgtttatgctgatctcctagacctgggctgttggtcgcattaaactctgttatccggttcatgtctggtttgcctttcctttgtgctgcctctcacattggccattcgtgcctttgcccatctgttaattatttgctgcgtgccaggcatagtgctaagtacatctgttattctacttaaacttcacagcaaccttatgaatcagtaggcaggattattatcatccctgttttatctctgaggagacagcctttgagatggataggaaccttggctgactagtggtggaacagaaattcaagctcatactgagcccctgagctctcactcttcagtgctgtacttggttgttccctccttgccgcagcccactgttgcaatctcatctccttttacccttccacatatgagtcggccccacatgaaccggtttactcccaggtctccgggtctcttcattcttttcctcctctatatttttgcccaaatccttggtgatatctgataccccaagggcagcaccacctcctatgctttgccttcttcttcttcttcttttttttttttttttgagatggaatctcactctgtcacctgggctggagtgtagtggcacgatctcagctcactgcaacctccgcctcccaggttgaagcgattctcctgtctcagcctcctgagtacctgggattacaggtgcccaccactatgcccagctaattttttgtatttttagtagagacggggtttcaccatgttggacaggctagtcttgaactccttaccttgtgatttgcccacctcagcctcccaaaatactgggattacaggtgtgagccaccgcacctggccttcttgacctttccaaactgtccaaattccaaaagcctttttttgatgtgtactgtcttgtgttttaaattcctttggtggatttatttatttatttatttattgagatgaagctctgtcacccaggctggtgtgcagtggagccatctcagctcactgcagcctccacctcccaggttcaagtgattctcttgcctcaagtacccgagtggctgggattacagatgtgcgccaacacgcctggataatttttgtatttttagtagaggcagggtttcaccatgttggccaggccagtcttgaactcctggcctcaagtctgcttgccttggcctcccaacgtgttgggattacaggtgtgaaccaccgcgcttggctcctttggtgaattttgaagtgaacctgttctcgacagtttttttccaggtatttcagcattattctcctagacgggttataaactctttaggataggaactagacttatttcagtgtcctgcagttcctagcatgcttccttgctagagctgaccttcctagagttgacttattttgacttcatactcttgtccatgacaactgtctgtgtgcaggacaatatgaataaggatgtgagatgctgccctaccctcggggagctgttctgctaaggtgcccggattccctaacagccctctgcacagctgtaatctcttgttagattagttttccatccttcatgggaatcgtttttcttcctacgtttctgtttttaaagtttgcataaaatggagacttggctgcacaccagggaggtttaggagagaaatgagcagtgggacctccccagccaaacctggctgcaaaccgctgactgcacaggaatacgaatgacttctagtgggatgggcggggatcctggggggatgctcttcattcctgcttttgatcaggagctgggccagctttggaaatctgagtgttggcacaactctcaaatggtcctgctgctgttattgtctggggtttcttactgggcgtccacactcagaaaggaccccctctttcctgtaagcttgcttctcactgactggcacagcttggtgattggggtggtggtagagacgtgggccatacggaactaggagcataattttcacaagcacttaaacttgaacagaacaagattagcaatattaacacgcattacactgagatatgacgcacagggaaatacctctaggtacccttgggataactgtaatgatacatgacttaggatttccagatcctcctagctgcttggactgtggttccaggcccaggtcacagaaccttggttacctaaaggaagaatggccagggttggtgatatggtttggcccccatccatatctcatcttgaattatagctcccataattcccacgtgctgtgggagggacccggtagagatcattgaatcatgggggtggttcccccatactgttctcacggtagtgaataagtctcatgagatctgatggtttttcttttctttttttttgagacggagtctcgctctgttgcccaggcaggagtgcagtggcgtgatctcggctctctgcaagctccgcctcccgggttcacaccattctcctgcctcagcctccctagtcccccctgggactacaggcgcccgccgccacgcccagctaatttttttgtatttttagtagagacggggtttcaccgtgttagccaggatgatctcgatctcctgaccccatgatctgcccgcctccgcctcccaaagtgctgggattacaggcgtgagccaccgcgcccggcctgagatctgatggttttataaggggcttcccctttcacttggctctcactctctcttgcctgctgccatgtaagatgtgcctttatccttctgccatgattgtgaggccttcccagccacgtggtactgtgagtctgttaaacctctttttcttcataaattcccagtctcgggtatgtctttatcagcagctttaaaaaggactaatgcagttggtgagaatatggaagtacagtctagctatgttctgtttcttctgtccaatagatgacagaaacagatgcctccatctgttttcacaaaccgaggttgctcttcttgccactgagtagaagttgcctcctccagctttgccccagccacctgctactgagaagcccagcccactcaagtccttggtactaagggcactgcggaggggtctggagatagtttgccatttccacactcagggtcggggcatggatttggcccctctgggcacctgtgggagtgtaagggtataatttctctagtgaccccatctcatgtggcctgttgccctcctgggcccggttcctacgtgtcactcattctcttaccgaagacaaggcttgaccttgcatgcaggtcccatttggagaggcccctacaaattcatttagatcctaccagtcccatctccaaagcagcccctggttcatgatatcccttaagtgcctcaaaaactatgcataactctggcttctggacaccagctgttcctggtcttcagtgcacattcacttcggtggctcccacctgcactgttggattgtaagacacagcccatggctcttctgcagaggaatgaaaactacacatagttataccttgtgggatgttacatctggaattccagttggagaagctgccctgggaaagtcggcggccaccagagaagcaggaacaggaatgaagcacagcctggtgttccgaagcccagcacggggctgggaccatgtctgtcatagtccaccatgtggaatgggccctccacactctcactaggggctgtttttccaaatcagtgaatatgtatccactacttttatgggcaaggcctcgtgttaattcattgtagagggtagaaaagcaataatgtttgggaaggtacgtaactgtactcagtctacgggagacattaagaaatattaaaatctatagagatgtatatgcatccctatatgggttgttttccatcccaaaatattaaaagaggatgaagtcaaaataagtcaatcctaggaagggcaactctagcatatataaaaaggcaatggagaaatgttgagtttagcaaaagacaacctctctgctgggatgcagagtggtttgggatggcagaaatgggaaaagtccagtagatggagccagggaggaaggacatttatcttgtcactagaagggtgtagtgggaaggtgagaatgaatgaggttttctgacaataccaagtggacccctctagggggcacagaaggaatttgtgtttgtagattggaggtagggggtggccaggggagggccaataacaagtccagttaaaaaggcaggttgagtccatactagagagaccttagataccaggttaggcgagatagactttatccttctggtactgaggatccactgaagcccttcgagctaagggggagacactgataaaagtggtattgtcggagggttgctctggaggtgtgtgttgggtggatggggttgggggaaagactggtggcagggagaccacctgggagtcataataatactggtgatagctaccaattattgagcattccctacatgcaggacactgtacaatgtgatatctgtcatattcaataacctgcaagctgagtacacttgaccaatgaggaaactaaggcttattcatgttgaataaccactgcatccacccatttgtgttgctataacaaaatgcctgagactgggtagtttataaaggacagaaacttatttcttacagttctgggggctgaaaagtccaagttccaggtgctagcatcaggtgagggccttcttgctgcatcctcacatagtggaaagcagaagggcaaaagggccgactgctgagtcctcacagggcagaagagcaagccagctgaaggtggcagaagcctcttttataaggcctttaatcccattcatgagggagggatcttcaagacctaattacctcctagaggccccacttcttaatattatcacattggcagcacctgaattttgaaggagacacattgaaaccatagcagccacccagagtcccagagcttataaatcacagaaccagcgtttgaactcaggactgcttgctttcaaagccaggctatagtaggtaaagttttccactaagaactgtacgatccaaattaggggaattataatcaaattgaaaaagagagattattgcaagaatccagaagactcgataactgaccaggttggaggagtgaaggagacagagagagaaaaagaatgactccactttgtagctgtggctttagggacagtggcagtattgccaccagacaccaagtatcataggaggaggtgctcttgagtgggtcagatgagaagatagtgagatgagtttcagaaatgtggcaatcaagatggtggcagaaatgccaggcagctattgtcagtcatattctctggcttacattctagacaagctgtgagcatgggcaagcaggaacacgggaaagagaaagcttctggtgttagggggagattctggaggaagtaaaatgaggaatagcagcagaagcagctgtcagagaggcagggagaggaggaagatggcatcatggtatgcgtggcagaaaccagtggaggagttggttccaggtggattgtcaagactgccatacatttcagggaagtcaaagctaggactcctgcatgaaggtggaaggactcattcaacccactatgcattcattaggtagcttccatctgcctggccttgtatttgggcaagagaaagagaaaaacaagtctctctgctcttgaaagccccaggaaaccttcttaaaacagacctgggtcgcaacgtgcccttcagcttagtgcaacagaactattctctgagcttctgtttcctctacaaacctaatgcgacctgccccacagggttatcctgggaatcagggctgatgcatggccaacactcagcacagtacctagagtgtgatagctcgattatgcttagaacccataaggacaaataagagaggaaaggactgtttctggggccttcctgccagatgcagggaagcctgccttccttggaagtggccatctcttcaatggtttgggcagttcagtccatcacccttgatttctgctgcctcatgtggcttttcagtactaaaaagaatctcctgtttctagaactcatgccttaaatgtgttttgaagcccagatgttccaacagtgctccctttcactttcatttcccaagttcaacgaccagacccccttccacaagttggtagagctctcatttgtcatcgtgggaaagcacccagtgtgcttcctggcagatgagagggtccccaggctgctccaaggcttaggacagcagagtgagctccgctggctgaactcggtgctccatgggctgtgtggattggcctttgttctccaagggccaccaagaagaaggtcgcatctgctgcccccactggactgtcaggttctctgtttctctgcctgagggtcccactgaatacctgctgcctgtctgccccctgaatatccttactgggctctgggaagtgagcaagtggttatagggtgctggccctatgtgtgtttggcactcttgggtgattggggtatggggatggggttgatgccacaaatggaaaggctctcagaggaatatacatgtgtggcttagaagctggagaatgcagtcaggcatggtggctcatgcttataatcccaacactttgggaggtcaaggtgggaggttcacttgagctcaggagtgtgcgaccagcctggacaatatagtgagaccctgtctctacgaaaaataaaaataaacaaattgaccaggcatggtgccatgaacctatagtcccagctacatgggaggttgaggctggaggattgcgtgagcccaggattttgaagctgcagtgagctatgatcacagttgtgccattgcactccagcttgggcaagagagcaagacactgtctttagagaaaaaaagggctggagaatgcggtggggaaaagaaatcaaagcaggaatgggaaaagccaacaaggttgtggttcctgaggctggcacagaagactgtgctgcccaaatgccactttcttcacttggctcttcctggcaggcagctctgtcccctttctttgtagtgagcctgtcttaggcctatatccaggacactgagaattcttgcatatcaggctgggaggaccttcaggggtcacccattcctcccctactctctcctcttcctagttgaacagttgcctcagtttacccaaatcactgtcttagtgtcacttcaagtgtagctttggcctagagggtgttatgggtcagaaggatgctcaaatccatcgtaaggaggttgctaatctttcatggtctgcctcctcctcctggccaggtatccctggcattcaggaaccccagctggcatatgtgggctctaggtagagttaagtcttgtagccatgcatgtggggacactccaccattcactgaaagggatgatccctatgtctttgaataaaacttcacatataacccaattattgcaagggctctgcctctaccatttaatgaatcagagcgacattccttttcatcctacttggccagccctagtctgagtatattcacaatttaacttcattaatagcaagtttagtcaactggcttaagaagttctcctaatagtagattccctggcaatcccctactgtatattttattagtgaccttgtttaaaaatagcctatgtcaacagccactagtgatgcaccaagaagcaaactggcctccctggactctgcatggatgccacagcacattagaggcagactcagggataccactcggggtccccatgtgtcctcccacaatcccattccctttggaccgtttctttttggatctttgctccctatgattttgtgccccatccctttcctcctttcagtttccgtccccttcctcctttcaattgcgatggccatgctctggggactagattcttttgcttttctcttctctgcacaagtcagaactggggctttgcagagaaggctgagaggtgttcaggacatgcctggcttatcgtagagtaggttttctcaccctagacactgttgacattttgggccagataactgtgtgtgtgtgtgggggggggtgtgtgtgtgtggtgtgtgtgtgtggggtgtgtgtggtgtgtgtgtgtgtgtggggtgtgtgtggggtgtgtggtgtgtgtatgtgtggtgtgtgtatgtggtgtgtgtgtagtgtgtgtgtgtgggtgtgtgtgatgtatggtgtgtgtggtgtgtgggtgtgtggtgtgtgtggtgtgtgtgtggtgtgtgtgtgtgatgcatgtgtggagggtgtgtgtgtgtgtggtgtgtgtggtgtctgggtgtgtggtgtgtgtgtgtagtgtgtgtgtagtgtgtgtgggtgtgtgtgatgtgtgtggtgtgtgtggtgtgtgggtgtgtgctgtgtgtgtgctgtgtgtgtgtgatgcacgtgtggggtgtgtgtgtgtgtgctgtgtgtgatgcatgtgtggggtgtgtgtgtgtgtggtgcatgtgtggtatgtgtgtgtggtgcatgtgtggggtgtgtgtgtgtgtgtgtgtatggcagggtgtctgaattgtctgttgtctcctggtgggcaaaactgcctctggttgagaactgttgttctagaagcagccacagtcataggtatttcagaggcctctgtagccatccctaggcttctccttcagtcgggagtatcagagtgctaggggtggtggagagcattttccagcgctccctgcacattcctgggcgcagcatgcttccctttcatttttgtgactcttcttttagccagaaaccacattgcttctcacataggtctgttgttcaccgagtcattgttggtccagacaggctggtctgcagcttctctgactttgcaccttatgttgactagggggagggtggtggatggagcatgggacatcctgagctgctgtcctggattggcttctcactggtggtatggctcagcgtgctttgtctgtaatgttggcactggatcctggtgagcttttcacgtcatcagatggtattatggccgaggaccctgaaatgcctgaagcctgcttgtgggattctcaaaggaaagagaatctgagaatagtagcaaatgggaaacaaagtctgatgtgtcttgtaataaggcactagttatgttcctgagaggtcttgggctaaatatcaagtgctcaaagccattgttccgaataatggttctgaaaagggttaagtgtttgaaggttttatacttgcagtaaccaaatagtttttttctctatggatttagttaatgctttcagtggccacaaagtatattttagtaaactttataggccatgaccatcataatccattgttataatcaataaagtatacaattgaaataagatgtggggatgcacagagtgaaaatacaatgcaactccatccacaatcaccaagggcaacagatgtgtgagatgccatattggtggcaagcccaaaatggagctgtgccatgtctcgcgagcagccgcctttcccatgccccaagctggcttccctttgtgccctatatccatgtgatggtggctgtgctcacttataatcattcccattatactgagttcacagtaagacttacgctgtgaatcaaatgcctggaaacactatctgggttggtgcctaatgacccccagtgccgacttccattaaagtcaagtgtcatgtgtagcttgaacttgaggcctaaatagagccttctgtcttctttaggcccaatgaccaacactcccaagtggttgtttgaaaaaaaaaagagatggaggaccccgtgttgtagaagaaagggccaggaggatgagggctttcataatggtacttctgctcaccaataaacatggtctatttggccatctgggatgctaaacagattagcgactctcctatggataaaatgaggatgatattgatctcacaggctcagggtgtggattaaatgactttatgaatgtactcatgtagtatttttaagattaaacacactggatctcaggcctcagacagctagaaaatccaaagttacctcccatctctccaaactggtactgcctgtaacgtggcagaatcggcttgcccacgcagtgcctccaagggcacctttggtctcccatgtaattgactgtgagcattggaaatagctgtggtttttaatacagtgatatttcctcttcagggactccagcccctcgtctagtttcaacaactgctagctcagtcccaaggcgtggttcttgtttcttccttgtctaatggagagagtgtttgcatttgcacagggtttttaatgggctgtaagctgttggctctgagagggattcttggctcggagccagggggacttgaaatgtttggggaagcctaggagggctgctgagagaggctcctttctgctgtacatatggttcacgtcgacatgggcagaaggcaagaggagcccgccttggtagcacaggcactgctgcagtgctcagttctttgccagagcaaggaatctggcctgggaaacttcttctgtgaatagctggggccagaaggttcagatcaagccaaagatctgttaagaggggcccctttttctcatggcagaaatagtggtgggagctcccaatttggctgttggtggtggtctggaccgtagagttcttgagatggaagtaatttccagagattttctctttcaggcgagaccacacctaagccatccctgaaagactgatccgttcaatctggaactgctctgggaaggggactttgcacatccccttccttggaaacatcatctatttgtagtgatctgtgtctttgccttgtcacccaaatctctttagctgaggcctgtttacctttctctctgtagaactgctctttgtggccttgaaagtcgttgtttagggtggtcatctcttggctactttcctgtctgctaattcatttcaactctagcacttttgggtagtggccaggacagtgcagtgcttctcaaacatctccaccaaaatgccccaccagcaaaagagtgtgaatatatgcacccacacacacacgtacacagatggcctgcagaagcccaaagtggcctactgaatgctgggaattttcttgaaggctactgttttatttaaacattcctcagaatgtgacatctgttcccaaaagataactggttgttctaatttttaaaacaatgttttaaattacttatcataagaaaaaaaattcagccgttttcccccattttgtaaaaagcccttgaggaatctgataacctgggaagatgccacatgctttgttgggggactctctggcgcttcttgacatgctgctagcaaccccagctagagaagcctggtggttgcggggagggggtgggcatctcttggcttctggagcaggccgatctgagtttgaattctggcagcactgcttcccagcagcgtaaccttcagcagattgcatcagccaggtgacagactctctgttagagagagcgggcagaacacaaaaataaataagacatgattcctgccctggggagctcacattgctggtggggacgtagctgtgtacaaagataatgacagtgccaggtggtaagtgctatggagaagggtgtgtaatggccctggagaatgggagagagcctgcttgatctcaatgagaaaggtatgttcataggcagagtagaagagagagcattggagctgagagaacagccaggtgaaggtgggcagggagagaaagtgttcttgcgtggtgtgagcatagggggacagagatggagttgaagctggaaaggaaggctgaggccagatggtgacaggtttgggatgccatggcaaagagtaattttggattttatcttttggagagtgaggacccaggagacattggtaagcaagagagtaacacagtagggctaggttttaagaaaatagctttggcggccaggcgtgatggctcatgcctgtaatctcagcactttgggaggccaaggtgggcagatcacttgaggtcaggagttcaagaccagcctggccaacatgatgaaacctcgtctctaccaaaaatacaaaaaaaaattagctgggcatgatggtgtgtgcctgtaatcccagctactcaggaggctgaggcaggagaattgcttgaaccttgaactcaggagtcagaggttgcagtgagccgagattgtgctacagtgctccagcctgggcgacagagcaagactccatcttaaaatacctttggtgttacagggaagcctgagtgggtgagggaaaggctaaggcagggaatccaggtaaggtcaaatctcaatccatttgcagcctctttcactcagcaggtgtttgttgaacacttgctgcgtgctgtgttctctgctggatgctgatgctttccatgaaaatgctttcggcttgcctttgttaagcggcatgctgaactcaggggctttctggggagtgctgaatattgacccagatgcagacagccaagtgaccaggcagactcttctgctagaagattgctgttccccgaatcagcctctgggtccagaagccagcactctttatttcatgcattactcattattttgactgtcctggttggcttgggttgcaaatagccacttgccgtggagagcatgaggctatcacaaaaaccacaccaggcactgcacagagacatctgcttctgtttcctgagtaactgcacagcaacacagggccaagtgggtaccaaggcacatgccctgtgttattttctagttataacgaagtacagtttccatgtggctggtgatgaaagagtcaggtcaatttcagaaagaagagtgtttccgattatgcagatcacatccaaatatttacctcattgcatcgtagttttggctgggccctgcttttaaagatcatggaaatccatccgggcctcctttgcactgcgtttagggaagttctgtgctcagagcctctttgctggcagtggggagccctgggtacaacctgggattgcctctccctgttgtggtacttgaagcgaatcaataagtggcaagaaatgtaagtgtgcttccaggaaaaatcagaggctgttagcactggaagggacctcagccctcattaagtccaaccagctcagtttactgatatggaaactgaggtcccgagccacagaccagctggcctcaaatcacaaagagagggacggcagacttgggaccagcctgcagggtccagtccagagcttcccacgagtccaccctttcctcttctttcatctttctacatttcctgtttgctgttatacctcttttattaaaagtatacggtatttccagtggaatctgcttagcttacgtaccatgtgaggggcagttctcagtccatgaatgtttccttgtctcgtatgagaaattctgagttggcctcaacttgaatggcagaagtagaaggggtggttcaaaatgcaggaaatttgagggtaataaaatcatgtggctagagcatttgggggctaaggaagtagcagcctatgagctcagtttagcccttttctttttgagtagcccataggggtgtccagtggtcagtgattctcaaaccagaggatgcattcaaatcactggggagcttatttaaaatgcatattcctgggcctttccccagaggttcttattcactaggtttggtgtaggaaccaggaatctgcatttctcaagttatacgtcaggtagattgtgttgcacattaccccgtggctctcaccttgagaagcgtagcacagcagcaggagagatagggcaggggcatgtccacgtgttcagggtatacactcaataacatatacttggagaagtatggtgcagtttgtgtgtctgagatcatttactgtgagaattctccaactgggaggacacaggtattgagagaaagccttcgggtagagctggaaagtgcagaacaccagactcagaactacttagctgctgggtggctgcatgtcagtggtgctttcctctgcatggttcatattttctctaaagcgtggctgtctcattcctcatttatcttggtttccctgggcctctacccactcctcctttattttggttttgtgcaaatacatcatttaactgttcctgaaatgcatttgtagaactcatttacataataatttctattggggcaattctgatccaataatcaaggctgaatgtattgtgctcccgtcttccatactgtgaggttcttacactgatactgcagctgctggcattaacacgaatgctgaaaggtaaaatttggggccttttgcaatgtgtcatgtcagagtctagatagttgatcaagatgtaacattaaatcatctgtctcagatgatttatcaccatagtgataatactgaatttagatctggctggagtctggagattctctttttttttttttttttgagatggaattttgtttgctgttgtcgcccaggctggaggacaatggcacaatctcagctcactgcaacctcctcctccttgcttgaaatgtaaggtttcactggtttctaattctctttctacaaaataaacctcccatctgttcttcatagaaaacgagtcacatgcaaagtctgaaattctaaagtcttgtttcaagtcgaaagtctccttcttcaggttcaagtgattctcctgcctcagcctcccgagtagctgggattacaagtgtgcaccaccacgcctggctaatttttgtatttttagcagagacggggtttcaccacgttggccaggctagtcttgaactcccaacctcaggtgatccgcccacctcggcctcccaaagtgctgggattacaggcatgagccaccgcgcccggccacgtttggagattctctatgaagtggtcccacctccccgagctcctgcacaggccccaggttgtcctagctgagcagccagctatatgttcctgctttcatttgctctcaggttcccaaaactttgttctcagggctcaaactccaaggtgtatttttgaaacgtttgctttagagtgttgacttggttatgtggctaaaactaaacctactttttccagtctctcttagaatgagactttagaatttcagactttgcatgtgactcgttttctatgaagaacagatgggaggtttattttgtagaaagagaattagaaaccagtgaaaccttacatgatttcacattagtacagaaaccaaatccattgaaaacattgagagctgttctggttatgaatttactggtggcgatgagaaatttccagggttttctgtgacaagactatcaccaactcttagttcactctgtgcctcccactctccacaatctgctccaaatctttctccatttaatctatttatttttatttattgagcaagcaatattgtaaccatgactgaaattttttaaattacgagaaaacttatcctgggtccagcttcagtaacagatcgtatgttttcatttttccatgtcaccttccaggctctgttcctatgctacagaatctttacattattataatcatggtgtcgttataagtttatatttgacatttttcaattaatattgtattacaagactatttccatattgctctgtattattcatgattatgatgtttcatggactcatttgaccctcatttatttgaccatccttatattttggtcatttatgttcatttcccttaaaaaggctatgatgaaataaaccccatccacaattgctctgataattacctctcctgttcttctcaaagctcgcctgctgtctctcctgtgagcctctgattcacttggccccatcatgtttcatggagaccatggttctgtagttactctggctgtggtcaattactgccgctaaatgactctttctgccctgggctcgcttaatcatgaggcttctgccaagtccagaccacctccctcttccagcctttgctcgttccaggagctgctttctgtcctccaagtcctgtgccaaaggcagacccagttcatttcacattatcttgattaccacattttatgcatatattgtaatatttgcaatcatttagatcagggatcttcaaaccctgggctgtggaccagtactgggccgcagcctgttaggaacccagccgcacagcaggaggtgagcggcgggtcagcgggcattaccatctgagctccacctcctgtcagatgggcagcggcattagattctcataggagcgtgaaccctattgtgaactgtgcatgtgagggatctaggttgtacgctccttatgagaatctaatgtctgatgatttgagatggaacagtttcatcctgaaaccatctctacccccgccaccaccacatctgtggaaaaattgtctttcatggaactggttcctggtgccaaaaaggttggggaccactgatttagatatcatttagggttctttactgcaagcaacagaaactaacataagcgataaggaatttacaataacgagtctaggaagcaggtgggaagtgaggcacatcagagagcaattgcacatgattggtctcagcataaacagcaagttcaaaggagctgctgctggagccaaggactcaaagccatttggtctgctggtcaatttgctggaaattcaaattccagggaggaagtgtccattgatccacattgcctaccttggctttagctggcagggcccctgaatacatttccaccacacttaatccaatgtggagaggtgactacagacctaaggaaaggggaatgctgccccatatatacaccttcctatggatatatatttatgcaaatgtccctgcctaacattaaccaacacttccatagagccgatctcaaaatgtggtcagttagggcatccagctccaaatccaaagtctttggcaggggtttcagtttccctctaacactgtcacagtctcttgcacagcccaagttgagttaaatgggaaggggactacactgcttctctaacttctctaggtgctgtttctttttctttttttctcttttcttttcttttttatttttttttattttgagatggagtctttctctgtcgcccaggctggagtgcagtggtgaaatcttggctcacagcagtctctgccccctgggctcaagtgataatcctgcctcaccctcctgagtagctgggattacaggcacccactaccatgcccagctaatttttgtatttttagtagagacggggtttcaccatgttggccaggctggtcacgaacgcctgacctcaaattatccacccacctcagcctcccaaagtactgggagtacagatatgagccaccgtgccaggctctggatgtcgtttctgtttcctgctccctggctcatggcccatcatgactatttagagaggcaccataatatcaagcagtagtttttaaatgaggagggggatatcaggtttggaggatttcatccaaaatacatggcccccttaaccctagcctcaccccatgcagggcaggtcataatctcttgggggaagggtcacggcatggcatgtgtgctttgaacaagctcctcttctaattctgttatgttaccctgacacccacctcacccccatcctttaaaacctccagtgaagcggagagagcactgatttgattcttgggttggacctgtgtcttacacattataaagcttctgaatggtagtgtacattctcccagtgaagggacaaagtggagatttcctctgtccctgctgggggacatgttagatgccttacctagccatttcatttcatctaccaagtaatactagcagattcgcattcttttatctcacatatatttttaaagcccacatcatccactagaccacacggacactctgaacctcagtgactacatctgcaaaatggaaatatacatccttgaaatgaatcttgtgagtatcagagagtttgtgttaaagtagttagggcagataaggggtatttttgctcttccactgggcttcttctgtctgtaatcctccagcatatctcttcccttccctcagtggcagaccttacctctttcatagaaggctgaagccatccaatgttaacttcatcttccactcctttccttacaccaacatgtcgttttccataatggaagatctcttttgtttgttttgtttttctgatcatttaaataactttaccctagattttcttaggacccagcagtctatgggtgatatggttgtgtccccacccaaacctcatcttgaactgtatgtaggtcccacaattcccatgtgttgtgggagggacctggtgggaggcaactgaatcatgggggcgggtctttcctgtgctattcttatgatagtgagtaaatttcacgagagctgatgattttataaaggggagtttccctgtacaattttcttctcttgtcttctcttctcttgttcttctctcttgagatgtgcctttcaccttccaccatgattgtggaactgtgaatccagtaaaactgtttcttttgtaaactgcccagtcttgggtatgtctttattatcagcatgaaaacggattaatacattgggtataaagtcatttaaacgctatcactccaatttttgtgaccttctgttcacatgtacacagtgcagaatcttagctacccctaaggtcactctaatcgttgctggaaatcacaggaggtatcctgggtgctcatgaactgttacgaattttttgaactctagaaataaactctaagcctcagtttttcatctgtaaagggaggtgatgatagtttctttaggtgggtgttttgaggattaattagataatatatataaagtaattagccttcggttggcctgtattctgttactaaataaatagttgttattggtgtcactgttaaacacctgctaataggccttgccagctgctgcaaggtgtggatgtgatccccagggcaactggctagtataggaagttggtgaggggtgggtgatgaggacacactgcattctgccttatttttcttgctgctttgtttggtgggaaaagattttctagttgggctctgttagttgccaaggtcagaaaactactcatattagattgaatcatatgaaagtattaatcatatgaaattgtatttttatagatcaaagatggtcaaatatcagtgattttttaatgtttcaactgaacacttaaagagtgatatcaacaaataggtttattctcttacactgtcctatagttttgttttttcactaattaatatagtgaaaaaatatatggagagctgttccttttaacagatatgaatctacctcatcctaccagataaattacattccattgtttggatagatttcattctaactgggctcctattcatgaacatttaggttgcttcctttttttactgttgttcttacaaaatatgatgcaatatgtgtctttatgtatatatatataactttatatagtatttttgagtatatctgtaagatgaactactaaaagtagagctgctggtgaaagagtatgtgcattggaaattgtgataggtattgcaaagttctctcccaagaagttgcccaaatttagattctaatcagcagtgaacattcttgccatatcagtattgtcaaactttataatattcggcagtctaatgggttttaaatagaattttggtgctttattttgcattattttcattatatgtgatgttaaacaattttcatatgttatttattttcctgttgtatattagcttgagcagctataataaaccatagactgggtgcttaagcaacaggaatttatttctcatagttctggaggctgggaagtccaagatcaaggtgttgagcgatttagtttcctggtgagggttctcttcctggcttgcagagagctgccttctccctgtgttctcatatggtggggtggggagtggggctaagagagagagggagaaaactggtttctcttccttactctggtctctcttctgcttataaggacataaatcctatcatgggggcctcaccctcatgacctcatctaaacctagttacctcccaaaggccccacctccaaatacaatcatactgaggatttgggcttcaatatatgaatggtggggagggacaggttcagtccacaacacctgtgaaccacctgttcatacccttagatcctgtctccactgggttgtctgtttcttattgatttgttagaattatttataaatgaagaaaaccagcagtttagggtgcattttagaacaggttttctgctttggtcttcacatgtcagtatgtattggggacggagcagcacgctggcaggttataaagcttcgaggttcaattatttttgtctcttaccatgatttattatttggttttgctgcctgtcactaacagaggtcctgttagttcgtcctaattttaggaatattatgtctcaaaacacttgaaagttgtcccatcttgcatcttgccttacagaaaactccttgactatcagaacagaagaaggggagagggttgtcaggaggatcaggaaggagtggagggaggctgggtggtcaatgcaactagcaggctaacatctcaagccctcatcccctcattttttctttgattggctttttcttcctttctctttctgtttctactccttcgttcctttctgtttttctgtgtttttgtttgtttgtttgtttctggctacatactataaaaatgcaattctggagcatgtggttagtttctcaccatggggactcagatggaatttcaagtcactcaccataattcgactataaattagagaattattatgaatagaataggacggaatgtggcttcatgttttcttcccccagggacctgcccaatttggcaataggaactaaattaagggtgagattagttctaggaagtggattttgagtatagctgtatgtctaatccaagtattataggcagtgtcttagttatctgtgttaatgagagatcaggaggcggtggataactgaaatctccaaatgtgccagaaacatatttctgcctttgttcgtttatcccaatgatccttccaccaggacaattgtcgaagtggttttatttcttctcattttaaccttctgttttctagcaacaatgtaggcagggaggccacatgctgcagggagaaaaatgaatttagaccagaagtcgggagacaattttagtcctgtctgtgccctgcactagcctgagacggaggacaagacataaagtctcctaggttctcagtttcttccctctaaaaggagccatataacatcaacctctctgggtggctgggggagctgaggggccctggaaagtgttaactggcgctagtgctgcctgtgtcacagagccgggccatttacacatgtgccatctgggcagcatgggacacagaggaggagtgtggcccgtgcctgcccattttccttccttgttctccaagtatgagcacactccattattttcctagggctgccataatgaattaccacaaactggattgcttaaaacaacagacatttactctcttgaaattctgaagatcagcagttcaaaatctgtgtcactagggccacgctccttccaaagttactaaggggagaatccttccttgcctcttccagcttctggtggctccaggaattccttggcttgtggctacaccaccccaatctctgcttcaggggtcacattgcctttgtctctgtgtccgtgtcttctcttccatgtcttataagggcacttgtcattggatttagggtccacctggcttacctaggatgatctcttcttgagatgagctatgtaatctggcaccgagcaggtgcctgaacaattacagttatgactgtgactcccgtttcctcttctgaggtcttttcaattctccccgccttcaccctgcccagccaggacagccagtcccttccaaaagcctcccacaatcttgtactggctgcatagagctcatctgctgctgggtctaagcacttgtgtggacctgtgatgtgttttcccttgtcttctgggcctggctcagcactggcatacagctggtgctcagagcatgtcttcataatgaataaactacagtgtgcttgctcttggcatggagcctggcacagtaggtctctgaaatgaccagttaaatgagggtatagatcactctttggatagagcttttgaaccttctgacatttttcacctcttccaagtcaccatggcagcagggacattattatcattactaacaaatatttgtttagtgccaagctctctgctatgcacatggatggcctaacctaaatccccttacagcttacaaggtaggtactggtactatccatctttaaagcacagtgagcctcagagaaattcagaaacttcccagtcacactgctattgagaggtgaagccagggggacttcctaggtcgagtggggacttggagaacttttctgtctagctagaagattgtaaacgccccaatcagggctctgtgtctagctaaaggattgtaaatgcaccaatcagcactctgtaaaaacacaccaatcagcactctgtgtatagctagaggattgtatatgcaccaatcagcactctgtaaaatggaccgatcagcactctgtaaaatggaccaatcagcaggatgtgggcggggacaaataagggactaaaagctggcgacccgccccactccctccagtccctccagtccctcccagccagcagccgcaacttgctgaggtatctttgtatgctgtggaagctttgttcttttgctcgtcatagtaattcttgctgttgctcactgtttgagtcagtgctacctttgtgagctgtaacactcaacagcgaaggtctgcggcttcattcttgaagtcagcaagacaacgaacccactggaaggaagaaactccgtgacaccacctttaagagctataacgctcactgtgaaggtccgcagcttcattcttgaagtcagtgggaccacgaacccaccggaaggaacaaactccggacacactaggaagtggtggcaggggtgtaatcataggcagtctggctctaaagcggtggcctctcaaccacagtgtccatccagttccttgcctttccggcagggtgacacaaggcatgtcttccttgcagtttatgggaagtccagtccctctggcgggaatccggaagaccgagttggaggttaaaggggactcctgaaaccgcgtgagccctccaaggccatgacacccaaagccagggccgcattatgactttcgcggggcctaggcatttttgccttcgcggggccctctttcctccaaaaaccgactctaagccaggctggattgtattaatacttatctttgaaacagactgtgcctacttgtgcctgatggataagtcgaccctgctcaaagcttttcgggtgaagagaggagcggtgttctggtcccctaacctgcctctgtctccgcaggtcccgcagcggatggcggcggagggcgcccccgaggacgacggcggcggcggcgccccgggagtgtggggcgcctggggcccctggtcggcctgctcgcgtagctgcagcggcggcgtgatggagcagacgcggccctgcctgccccgctcctaccgcctgcgcggcggccagcggcctggcgcccctgcgcgcgccttcgcggaccacgtggtgtcggcggtgcgcacgtcggtgccactgcaccggagccgcgacgagacgccagcgctggccggtacggacgccagccgccagggccccacggtgctgcgaggcagccggcacccacagccccagggcctcgaagtcactggggacagaaggtacacgcccgcccttgtctgtgccgctccccgtccctgtcccagtatctgcccctgtccctgcccctgcctcgcacgctgctctgcaccacagacagtgcgactaatgcattgctctgccaggtggcaaggagctctgggctccacgaagctcctttcaccttttgatttattttgcagccttgtaaagtgttgaggccactcccacctcactctgtggttctgaataatcttcaaagccaggctaattctgagaatgcccttaggaagaattttagggaggcctcctagaggggtgaaagcaggaggggagtgctgtccgggtgccgggaaggagagatcctcagcctgtgtggattaaagctgaggacacaagacgagaagaagtgtgtctaaccggaaagctgatatgagttgccaatcctaggataagttgaatgtttggagccttagaatgctcccaagctgtaggcttccagattctgtgaacttttctagtaagtttctccgaagttttttgagtcaacacattggtttgaggatatgtctaaggacctaaactgtttcagagtcataaaatgtaaactctagaaatggcatagtgtcatcagaatagtggtatagctctaagaagcataaatatgccaaagtaggcattgcggtgctgagaagagcttgtcagtgagtgaagcaatagatactaacagatcactgcattcatccggcagtatttgttgggtgtcttagtgcctaggttcctgatagatcctgggagaatactaatgcaaaaacagtaacaaaaaacaaatatggacaagaacaaaaagtgtaagatgtgctctctttgcttaagaaatgcgtaattcatttgtcaagccctgttaatgcccagcaggcagggcctgagcttatcaggtgggctgccttgcccccttgcccactcacagttcagcatcagtctccatggccaccctttgccacggtggccacttgctgcatgagagtctgtcttagctcagtgatggaagctgtcactgccagccgcctgaaggtggaaaggagatgcgacacatccagcctccccagccacatgctctttacctggtgcagtaggggtttggagagagagaggaccatttcgggaagaagggttcttcagctgaattctgaaggatgagtcaagtttgagtagacagaagagaggagtgaagaacagtgagttccaagactgagcatggagggggaaggagagaggcagccccaaaggaatgcttccttctctctctctttctacatgggaacctgagcaccctctaggacggtctgctcctaaagccgaaggctagatgtacgttgtctcttttgatcccagccacaatgccgtaatagcatagctccatagtcccttatttttttgagacagagtctcacgctgtcacccaggttggagtgcagtggcaccatctgggctcactgcagcctccaactccgggttcaagctattctcatgcctcagcctcccgagcagctgggattacaggcatgcaccaccatacccagctaatttttgtatctttagtagaggtggggtttcgccatgttggccaggctggtcttgaactcctgacctcaagtgatctgcccacctcggtctcccaaagtgctgggattataggcatgagccactgcgcctggcccatagtcccttatctgaaatgcatatggccaatatgttttggaattcagaactgcccagattttagaaaggtaattcagacatatttcacatgttaatagcatttcttccgtcgtatgggacagcatcccataatcaaacacattattatttctgcaatgaaacatatggatgttctcaccaagcaggatacaacaaaaagatcataagtagcctgatatcggttaagatcaggtttgaggccaggtgcgttggctcactcctgtaatcctagtactttgggaggccaaggcaggcagatcacgaggtcaggagatcgagaccatcctggctaaacgtggtgaaaccccatctgtactaaaaatacacacacaaaaattagccagacgtggtggcgggtgcctgtattcccagctactcgggaggctgaggcaggagaatggcgtgaacccgggaggcagagcttgcagtgagccgagatcgcaccactgtactccagcctgggcaacagagagagactccgtctcaaaaaaaaaaaaaagatcaggtttgttggccaatgagttttgtcaccaaactgacaaaagcctgaaaaggaaagacaaatcttgattttcaaaactcttaattttagaattgcaaatttataatagctaaggtttattaaatatccatcctgtaccaggcactgttctttttttttttttttgagatgtagtctggctctgttgcccaggctagagtgcagtggtaccatctcagttcactgcaacctccacctcctgggttcaaatgattcctgtgcctcagcctccctagtagctgggactgcaggcatgtaccaccacgcctagctaatttttgtatttttagtggagatgaggtttcaccttgttggccaggctggcctcgaactcctgcccgcttcggcctcccaaagtgttgggattacaggcatgagtcaccgtgcgtggcctccccaggcactgttcttatcactttacactcatggtcctataagagagttgctaatagcatcttcattttagaggtaaggaaatagagtcaggcttgaaacccaggccatcgtggctctaaggacgtgacctgatgaagtagatgttacacctgaggaatcagaggacctagagccagtggacaagctgagttttgaaggcggtgctgctcacccccagatccctgcagtactcatcctcctgcgggtgccaactgaagggatggagggctggatttgggtgaggtctgagtgggaaagaggcttcttgaaagcctctgtggtggagaacctagaagagctgcctgaggatcaggctcttgttggccacaggcctgtgctgcaggcattgtgcctgtgtgttttggcagcaggaaatttttttcttcaaatgtattgacgggggccagttaaactgtttactatgaagttcctgcaagtttttatcatgctcttgtgatttgacagttactgatgaaataatccaaatattagcctaggaggcctgtgctgcctacatatgtcatgctcctcccggctgatgaaaatcacatttgcttatattcatcagtcattaggtacttgcatagtatatttgaccccaaggagaaatgtcagcatattttcaggatggctgtccgctccactctctgtttcaggtttgaagtttgaggaaaaggctgttggagtttagatgtttaaaaaattgttaggttgctctgctaggcaacaggaaacttcattggagtcagataacaaatgaagctattcaaccttccaccagatatttattaaacatctactatgttgtaaggccctgggacatacacaaaggtgaataaaagccaggttttgggacctcatggctcttactgacaggctagagcagttgtttgcaaaattaccattttttttttaagcagaagaatccgttctgcaaaatcaatcttagatggaggctcagtttatgtaataacacacgtaaaatctgagttgctctggttgaagcctcagaggtattgctatagaaacctggggtcaagatccaatggaacagtggttttcaaccttgactgactgttagaattttttttcccatcttttagaaaccctgacacccacgtcacactccaaaccagcatcggaatctctaggggccaccctcagatgttggtctgattccaatccagccaagtttgggaagcactggtctggatgaagctctttggagactcaagtttccatggaaaagattttgggaatcaaatattgtctagcagaattttccaagtttggtgagcacgtatcagaatcacttgccgtggagtgggtggcttgttaaaaagagagttgccaagtccccaccatctcccatgcctaatggggattctgatttgtaggtcagttatatgttctacgtttcttcattttaaatgcttctgatataccctagagtttgagaaccactcctctagagggttggaaaagatgcacatgtaaatgccttcaatataaggcagtctgatgagatagtagtgacaatggctcccatgttgaagcacgtctcctgtgcaggcattctttcaaatgcatgacaacatttacagttacacaaccctgtgaggcagaaactattattcacattttataaacaatgaaaccgaggctgggaggaatgaagtgacttgctcaagattaccacttgagaagcaacagcactagaattcaaaagaggtctgccagagtctgacactaaagttcttttcactgaaatgggtattctgaaaatgaagctgctgacttccagctggtgtgttcagaaaagctgtgtggaggttgggctgtctgagctgtgtcttgacaaatggatgggatttaatagtgaaggcttaaaatgagctgcatctcttcctttcaatgttcagctcctttaaccagggtaatcttctttgcatctaatcctaggcatcacgtgagttcaaaaaaaaaattagaagtcacagtctctattcttgggggccttacactttggtggtggagaagggcaaacccaaaaaacactgcccactctgggagatggtagagatacgaccagggttcaggaagaaggaatccttgtggaatggaacagtcagggaagactgcacagagcaggtaggatttgatgaataaatagaatttacttagctggaatatatctggaaacttcttgagtccacttgcttccatatcaggcctttgtctcattaaaacaagcacatacgtagtataaatcctactctaaaagcctcaaaaataacgtcaatcttcattggagctctcccaaggattccgagcttaggacaattaaacttctctgagcctcaggggcttcatctttcaaatgagagtaataataatacctatcatgtggggttgttgaataattcaatgaaataatacattcatattgcctggcccatagtggacactcattaaatacattcatattgcctggcccatagtggatgctcaaagtgaacgctgtaactcccattatgggtctaaaggctggtattagatagtgtgttagagagagtaccagttagaactcaagtgcagcagaagggatcaggtgaactagggccactcaggaagacagggagccaggaactgagctcccgtccagatgggtgggactctgggaagcatagactgggtgcagccaagaccctagtgtctgtgctccctgctctctgccccttcttagtgtggcttgctcagaaaaatcctccacaaagggtggcattctcctgtgatttagtgagggcaatggcagcctggggaggttccaggctagggggttcatccttcaggtcttggccaacagattccataatggcactcaaccaagtcatctttcactccaggcccaaggctgtgtccccgtgatggctaaaggggaaggggcgagtagggaagaaaggtgtttaggtgagtcctgcaaagcatgccgcattgtagcaactcacacttgtgaaactgaagagactccttggtaggggagacttccccctcagtttctggaaatgggtacctgtagactagagggtgctggaaggagcccctgttactataggactccccttcaacttttcttcctccaattattttattgtgttaaaatacacataacataaaattgaccatcttaactatttttaagcatatggttcagtgacactgagtatattcatactgttacgctaccatcaccaccatccattcacagaactctttttatctttcaaaactgaaactgtacccatgaaacaataacttcacattccttccttcccccaccgcagcccttagccaaccaccattctactttcttcctctatgattttgactactcttaagtatctcatgtaaattgaatgatacagtatttgtcgtttttgtgactggcttatttcactcaacataatgtcctcaaggtttattccatattgtagcatattcctttttagggctgaatagtattccattgcatgtatagaccacattttgcttatcctttcatccatcagtggacatttaggttgcttccacattttaggaattgtgaataacactgctatgaacatgggtgttttcagttcttttgggtggaaattgggaagtggaatttctggatcatagggtaatcatatttttagatttttgaagaactgccatactgttttctatagcagctgtactattttaccttcccacaacagtgcacgaggattccgtcctcaccaacacttgttattttctgtttttttttgatagtgcccatcctaatgggtgtggggtggtatctcattgtagtttggtttgcatttccctaatgatcagtgatgttgaacatttttttatgtgcttaatggctgtttatgtatcttctttggaaaaatgcctgttggaaaaaaagtcctttgaagaccttcccttttataactctgaaagcagggtggatttcttcccattcccaaaatgtctggggaaaatggcatccagaaagactccctgtggcccagaacccaagtacacaacctaacagaaatgtgttgtaaatgtctgttggtcagtttcacccagcttccacaaagacagggtatgagagcagtgccctctcttatttgaggacttcaggtgatttttttcaccactctcatgctaaagggcccgatatcaggcaagctttccttcccactggacttccttacatttgcctacattagccagcttttctggtcattcatcacactcattaaccagctggaatctggggaatgggatatttgatggctttaattcagattttcaagtatgaatttgagccaagcagtgccaggttgacaactttcttctcctggagacagctgtgggtggctgggatatgaaagcctcaactatgaaaatcatgaccctgttcccactgaggggagtgtgtcatattcctcaggtgtttgggggtgaaagaggttgaggagggtgggcttcccagaacttcccagagcagtttcctatagacgtttttctgtggagctgatttcctgttgggaaggagtctggtcgggtgaggaaaactcttgcccaggcgtgcagacccacacttcaagagcagtttgtggccagctctcaatgactggggctttgaaatacagtgctttattagaatctagaagaacaggagctacacaccctgaaaggctgtaaactacaggatagttatgagtgcagcttctgggattgacaggtttggatgctccatctgaccctgccacttgctggctgtgtatcctgccgatgttacttaacttttccctggtgggaataataatacacctacctcactgagttgctgtgagttggataactcacaccacatgcttagcacagtatctcctgagtgctcagtaaaggcgtctcaatgccttccacctgccagacacactggcagttgttttgacctgcagcattttatcgtgtcttcattacaacctgtgtgacagatgcgtggtgttctcatttatggatgccaaactcaagggtcagggagtaaatatctccttcaaggtcacgcagaaggcaagcaagagagcacaagcctgtgcgacatcatgctcctttcagacctgcttttctagaaagcccttttcaaagtgaaaggtaacactcattaatttagctaagtttgataaactaacacctctttgagatggaaaatgaaatatttctctaatatttatcccaaagcttttagtgttacataggaatactgaaactggctctactgtgaactccagaagcccagaggaaacactacccgctgtcattagaagttggccctgcaaagtcttcattcacatacttatttgctgttaaggctgcctctggatctcagggcttaatagacattgccttgtttaaagttttgttgtcatttgaattcagccaatattctttgtgtatttgctttgggccaggcactgtgctaaacacaggaggggtagacaggtgaaagaggcgtggttttccatgacctccatgtctgatgaggaaacagctcaggtatgaatacctaagggagtgtgctgagtgttctacctgggggatgagccgagggctgtgggagcagagaggtgggactaattcttagggaacaaggtcacttcatggtggagggtactttcttgaatgattagtttgcattttttaggtggaaaagatgggaaagagctgggaaaggcttggtgtggctgggggatgtggtggtttgctgacacaaagtggagaagaagtactccttatccttgaggggctcatgctggtggggtggagcaggaagacaagcagacatttacaagtcaagtgcccagggaggagaggggaagacaacggagaactggaggagccagggaaggcttcggaggaataattgagctgtgctttgaaaaggaaagattttagcagagcccaagagtgaggagggccttcctgcaaagagcaaatggtcagggtggagacctggaggcatgagtgagcatgtcatgttcataaatggtttggtgaggctggagcacaggctgcaaatgagggagtgtccaggcgagactggggaagtccacaggctcctttccagagaggaactttaaagcagtcctaaggggactgaacaagaaattcttagagtaagacagtccctataaacatggatggccaacattttttccgtgagatgatgtatacagtgtaaagcccatctaaatttctccttaatgccttgtgcttttcaagctgtttggctatgccatctaccaccccgtctctgtcaatccaagaagccggggttaactggggactaaggcttgaccctgtagttttgttacaggtgtattagtttcccattgatgttggaaaactcactacacacttagttgcttaaaaaaaacacaccagtttatttgcttacagttctggaagtcagaaggctgaagtcaagctgctagtaggattgcactccttctgggggctttgaggagaaaccgtgcccttcccttctccagctttgagaggctgcctacttgcattggctcgtggcccctcctcccatcactctaatctcttgcttctgtaatctcatctcgttctctgactcttatcctcctacctcccacttataaggaggacccttgtgattacactggacccacccaggtaatccaggataatctcccatgtcaaaatccttaatttaatcatcaccacaaagtcccattgccatataaggtaacattcacaggttctgggggttaggatgtggacatctttggaagggaggggggacattatcagcctaccataatagtacttgcattttggggtcttatgattactcaagcaataggacaacttctgtgccagcaggaccacctgccactttcccccatccactctggttgtttatgggaaatttagtgatcctgtttcccagaaaaatgaagaagaggaaaaaccatgcatccccaccctacccttaagcattcttctttagaagtgtttatgaaggagagtgacaataatgaagttaaaaatagtaaatgcccaaggcagccagtatagaataaagagctttgtatcccaagttcagagttcagtcctcagctcttatgaatgctttgatcctggacaagtcacctcatttctctgggcctgagtttctacattcataaaataaagaggtccttattctagttattaaggggtcttgctttttattgatgcattattgagaccaactgctgttttaaatgttcctgtcatcttttctgccacccagagtaatgagaagagaaggtgactaggaagcacagctctcaaacacattttctttttctttttttttttcttttttttttttttgagacggagtttcgctctgttgcccaggcgggagtgcagtggcacaatcttggttcactgcaacctccgcctcccgagttcaaatgattctcctgccccagcctatagctgggactacaggcacgtgccaccacactcagcaaatgtttgtttttagtagagatggggtttcaccatgttggctaggctggtctcgaactcctgacctcaagtgatctgcttgtcttggcctcccagagtgctgggattacaggcgtgagctaccgtgctaggcctcaaacacctttccaaacatgcttctggaatgtgctggtttttctctgtagatgcactgacattgtaactcttcaattccctccattcagacttctgtctcatgagtttttctttaaagtgttgttcacacgtctgtcctccttttgctagtctcttcttggacagcccccttccatggaagggatcactatttcgtgccttgtagaaacccctgggctgggaatcattagaccccacttcctgtctcagctccatcatctgctaactgggtggcctatgggagtcacttaatgtaatctataaaatatgaataattatatgtcctctgcctaccacacaagcctgttgtgagggtcaaatgaggtaacagctgtaaaagtacttcaaaaaacataagacaccattcaaaaacaacatggcttgattattttattactattgactagataatttttgggatttagagacttgtgtccctttctataatttgttgtctgtgtgtccatgttcatgtgtgtacaggagtacgtgtgtgtgtttgcatgtgcacacatggatgtatgtgtgtttgtttgaaaggttcgttcattttgaaacaggacagcctggatcaggcctggatcacaagttttacccacacattcccacctcccctggaaactgtccctggctgcaggtaggaatcatttgttttttcagctcctcctttcccatgctttgttggaggctacttgcatttcatcggtaataactttggagcaatatgttgtttctttcctgggggcccctagagctgactgggcctcttcgtgatgctggataggaaaacttgctgttaattaaacttcacaaagccacatgccgatttcctgaccttcagtcaatacccagggagtcttgttacctacaggggggcagaaaccacatagcaagaagtgaaatctttggccttatctgtgtttctccttggaaagcctccctggccatcctgggtagttagccgagaaaacggatacaagtgtttgaaatgcatactccttgtttttggtattttttgttttcctacttcaagggaatttttgtgtgtttttttttaccttctgaagcaggaatagcacttagtccctgaatcgtttgacaagaagttacctgttgatgctaagcagataaacggtgttccaatatgctttgatttctaaatcagaaaccttagcccttttcagtaacagagtttgtagcagagctaggcctgatggtatgtacatttctgcctgtaggttaggaaggattggagccagattttaagcttgagttactctgatctcagacaaggctccgaagagcccttgttcatttcttgcggtatttcattaagtgtcagaagtatttcattagttatcagaacaaagatcacattcgccgtaagaatgctgcattgaactttctccaagtcattcataactctggttccagaagaaagatgcgatgggctatggaaaaagcctgactgcaatatgtgtgtcccagaagggggatctcagttctgcatctggaatccgctagggcttttcctccagcgcacacctagtgccagcctgcgatgccttcatatgaggatgggaggaaggaatttcccgcatgtgggggttgctatcgtttcctttgctcatcctacctgcaggagcctgcacatattgttgattcagtcatagtaatcacagccatttttgcaggacctactatgtgccacatcattgacatgtactatttgagcctcaaccagccccagtttacagaggacactgaactaaggtaaagaagtccccagcatcctgctccaggaagggacggaatgggatttgagtgcagggttccctgactctaacatccttgctcttctcattgccaccccgagcccacaatgtggacacgggtaatttacgtgaggtttaggggatacccgctgtggttgacctgtaatacacatggcctgcctgttggttctcaggataaagtgctcacatccctcaagggttttttaggtcctcacttgcttgtcaatccataagcccttttctggatgtgtagtccttttgtcttgtctctattaatagtaacaagagcaatgacagctgatgtttgtcgatggtttcctctgtagtaggttgaataattccctgccctctcccactcagtcctcaaagatagcaggccctagtcctggaggctgtaaatgctaacttatttggaaaaagggtcttttcagatgtgattaagtatcttgagatggggagagtattctggattattcaggtgagttctatgtgcaattatgaatgtccttataagagacaagcagagggagatgtaacatgcaggcacacaacagggtggctgatgtgaagatagaatagagagagacttgaagatgcagctcttgaagactggagtgatatagccacagccaaggcatgctggcggccgccagaagctggaagaggccaggaaacagatcctcccccagagcctctgaaaggagcatggccctgctgccaccttgatttcagcctagtgatgctgattttaaatttctggcctccagaactgtaaaagaatagatttctgttgttataaatcaccaagtttgtggtaccctgttacagcagctacagaaactaatgcactgtaagaggctctgagctaaacctcataggacccttatgcataaactatctttagtgtgtcttgtgtaacatgagaagaattctgtgcttacagcaacaatgtgatgagctctgggtcccagagccagtaggctgcagagcagggatttaaaccagagaacctggctttaaagcccagcttgtaacactgagttatgctcccttcctgctcccaactccattctcgcccttatgccccaggtcaggccttgccccagagccttcctttccccatttatggtttagcttccaagcacacaatatattttatcttccctcatgaatcttttttcatgcagaaacatttggttctcttgtgggccacatggatccagcagcaattaattaaaattgcccttttcctcagtgattggaccacagttcattgtgggctagtgctgaaaacgtttcctttctcaatttggggggaaacaataatttttcccattttccagtaagtcctcacttcaaatagtctatccctgtaatcctctgtgaatgggaatttggtatttaaaagctgtactgtgttgcagttgttaagctctttagaggcttgcccttattcattcagtcacatttgttaatatctgttcacacagacttagtagcttggacaggttcttcaatgtcttttagactcagtttcctcatctataaaataaagtaactttgatctttgcagtgatggttaaatgggattacacacataattcatttagcaggtatttgatacagcatagccatctacatacagaatgtattatttaaatacagttgtcccttggtgtgcagtggggattgatattgattccaggactcccctgcagataccaaaatctgaggatgtacaagtcccttttataaaatggtgtagtatttgtgtataacatacacacatcttcctatactttaaatcatccctaaattatatatgatactgatacaatgtaaatactttgtaaatagttgtactgtattgtttagggaataatgacaagaaaaaagtctatgcatgttcaatattgaggcaaccatccatttttttcacaatatttttgattcgtagttggttgaatccacagatgcagaactcatggatatggctgaccgtacactgtgctaattatttttatggataggtaaactcgagtagagatctctcctggctttaattaactgaaggtgacagacctgcatctaaataacttcctctaatgcaaggaagaaagctatgcctcttcttattatcatgattgataattatgcttgcgatgcttcatacttataataaagaaagaaatagaagtgatatagagtaagtgggtacataggcagtgatatagaaattgagagtgggagaaacatccagcatatgagagaaataccattgcttcctctacgagcctttcacataaaagatgctcaagaagtgtagttgtgttataatcattattgctgtagtattaatgtattcagcagaacttactgctgaaaatagttcttcaggttccttcaacctgccgggggtcagcctctagggcagagggcactgtttgacagtccctgggagagaggggataggatctccatttgcttagcacctgccctggtcaggcactggaccccacaggtaaactcatttggtctcctctaacccccgtagtcctggagggccacacaggttcagattacaacccatactaacaacaggcatgactcctaagagggctcctcttagttactctggagaaatgaatgcatttactgttctttcatgcaaagccgcctccgtactcctcagtcccatgtttggctacctgcctctgcaacagttcgcacatatcacattggaggctctgtgtctcttaccttcagggcagtgcagccgtcacggtaactaccatttacagagcgttcactgagggccaagccctgtgctaggcgctttccctgaatcattgagtttatctgtgcgacagccaggggaggcaggcattgttatctccattttgctgctggagacagggtgtggaatgacttgcccacaataacacaggtaattagtggctgatctggcctgtctgatggaatacctgggctctctctaccatcctatgttaccacctctgtccctgttggtctcttcttctcttcaccttcagagatatcttgcccagcacaaaatacagcaagaaaaatcatctttgctctgagctatctaatattctctcagccttagctggaagcatctctcttttaaacttccactgactgatttcttacctttgtgcgaatccaaaaagatgcctcttcctctggtcagattcatctccttgctgggaggacacactggatttcaactcccaggtgtccttgtgcagtgagtaacctgctcaactgtaggtggcatccttgcagcctctccaccattgatttctgtggcactcaaatgggttccttgaacactcactcacttgtccgtattccactcctccgggcccacactgaataaggcacctgaaggtcagttctggaaacccagatcactctgatgcacagcagcacccgtgagcactgtggttggcttgttcttagggaaacttggctgattttcaaacacaatcttagaagaagagaagccacctgatggcaatatctggggctgtgagtctaaatcatctcctggggtcgtttcccccagaaggcctgagtcttttattcttaaggttgctgctctgttttattttggcagctggggttgggggacagccccatggaactcacatcctgggaggctgacgggtgggtcactgagtatagggtcttctagaggcttggcttcctggtgcaaaaaaagccctttaacatctgagtgactctaaaaccacctttctgcttcctctgcctaggtggcttgcctcttgacttctggaagagctcctgaatccatctgtgaaaagacctctctcttttcactttgttggaacacatttgtcattccttcctgtggccataccccccataagcctgtggggtccttctttcctaaaggctcagagcaaacctgtcagctgattctcatgctggcctttaaactcgggtcttcagcacatggtggggagcagcagcagatctagtcaaacctgcagctaacgtatgtgacactgtgtgctgcacagtaggcgaccagggaagctttcgttttcatcttcttaatttttatttccctaagtggtcagagttttgcctcttatcttctgtagacaccagataatttattacccagaacagccctggcaggaatttcagtcttagaacttctaagaagacatctgcactcaacctaaaccatttgctcgcaggctctttgaacttagcacatgatatcctttctccctttggcaggtgatcctagtggaacagggtgggttttaggaaaacagggctctctttccagctcgaggctgcacactcccttcctcccagcttgccttggctcaagcggctccttggtgaacacacacgtttctggtcctcagctgctgctccctcccatttttcctccctttaatttgggctctcaggtcgctctaggtagccactggctgctgatctaattttcctagctccctttaattcccacccagatgtgtggggctgccttgacttcttgcatatggaaactcctagcctttctgtctcttatgaattaatccaaagcagtagcctttattgacccattcgttacaaatgctgagcaacgaggctctgggcccacccatatgtcacttcagcatacattcccagggtgcctctgtgtcagactcagagctagtctcagggatcatgcacacaccaataagaaacagggagcatagccctggagaatgaaacttactaatacagtgttaatgtggtaaaggggtgtgcagactgcccccgagagtactaacagtggggaaagcacatgggcgctggtgtttatgttgggctggaagtacagaagtaggtagggtagggttccaggagggagtcttgccgcacaagagccccatgtgtttgggaaatggtgagtcattagtgatggttgggaagggttgtgagcaggatacaggggaagggagacgaagaccggagttgaatctgggaagatagactgaaaccagatgatgaagggtggaatgtgacatcaaaccaaatatgccctaaaactgtcttggtttgaactttattttctaggcagaaatgagccaggtgggtctttcaaatagagagtaatgaccagggctgtgcatagaaagacaaatccagtggagagggaagtcagaagtgtgtgagattccttacttgggtacctgacagatggggatgctcttagcctactgggaatgcgcactggggtgtttgtcatcactgaaaagattggactggacatcataaagtcattgttcttcttcccacaggctatgagattcaagcatattcagactctaagaagcttccgcctcggtatgagcttgatgctggtctgtgctgatctaaaatctttctgggagtatatgacttttctgttcttgatgagacagttcagaggaatattttgtccttgagctatttctgtccctctggtctttggggcttacagtgtatttataagtgggcattttatgtccaaattgaaatgtctgcatatttaggcgttaagattactgatttggtttctctttttgactctgcttacacagcagtatgaaagggtaagaaatgacaaatgagtctgcttcaactgagcctcactgggtctactgcccaggggaaatcattgcccagagtttccttttggtcaatttggaaatatattctgtatatactgtgtacatttttcatatactgtatacattttttctttaaaaaaaacacacacgcacaaatgagagcatgtttagtgtcctcagcttagtatctttactgttttattctttttcacttaactatgtttatgagagctttctatatcagtatatacacagctgcctcattcttttaaacagcttcatagtactccaatatctgaatgcaccataattaaactagctccttattttcctgtttaaggatacttagattgtctttcagatttacaatttacaaccaccactcaggtatgcagaacacaatttatttttctataactagatgtggttcatgagcctctgcttctattgctgaaggaaaactttgccaattccaggagactcagatgctcagacacttcgtgttaagcatgatcaattcagggtttatgttcagctcagttaggactctctcctctctctcctcccctcttcccaggaggtgtgacctggatcccctggtgaggggctcctgtgcaggcttggcaaaggaagcaagctgtcggctgtgcttcaagctgttggccaccttccacccttgctgtggctgctgctgaaatctctgcatgtaccctcctggccttctgtcaccaagggccatatactctgtggaaccacaaaggggtgatccacccactctcaggtgggcccctccaccttgatgcctccctcccacatcctagtcaggtgctatgttggacactggcttccccataaagcgtgcaagtcccttctgttctcaggcccctaaacacatctgggatttctactgttccccagcccaggccactgcattctgtcctaatctctgaatactgccttttggttcctccctcatctgcctgctagtcaaactctccactcgcccaggctggagtgcaatggcacgatcttggctcactgcaacctccacctcccggttcaagcaattcttgtgcctcagcctcccaagtagctgggaccacaggcatatacccaccacgcccagctgatttttgtatttttagtagagatggggtttcaccatgttggccaggctggtcttgaactcctgacctcaggtgatccacttgctttggcctcccaaagtcctggcgagccaccacatccagcctgctagtcaaactcttaatttccttgggttcagaaaggtcattccaaggtcataacacttcttcatagtctgtagtgtaagctctacctctgcctactgttttccagactttggctcttgacggataaagctcagtttttccaatttaaagaaaccttttccctcctcatactgatctttgagtcttcccttctctggcgctatcatcctcagtctcactctagaagaactgtgtggaaagaaggaatgactgaagtgcactggccagttcctcagttcgccgtcctgctgtggtttcaggtgtcctgccagctccccagggctgcactgaggatccccacactcacatctctgtgtgctcttacaggcacttgagaaggactattcctcggtataatttctaccacctagtgttgttttaatgtctataaaaacctttttaaaagatacgtgtggtcatacgaaagtattttggcaaaaagcatttcccttgatagtcattgtgaattacatctccctcctccctctcctagcttaaagtgccaatgctttgtatcaatgccaggagaaatagaggagtatctgtccacatttcggaggctggcattgaggcagccctcagatgcagcatcctcacatttgtaaccaggaccctgtgatacttagtctccgggaaatttgccccaaaacattggcttgggagtttagccttgatatatagtaacagttcaaagtgcaaatgtggcataaaggctctctttaagccacatggacattattcattagacatagtaaaatccagtagtatcttagattttctccacagaatctagtacggggacttagattccccactattcagctttctccaacaataaataggctttcatctcatgagcttccttctcatcttccctatggaagaatttatttctgtttctgtagcaactcaacttaggtagcaagatgcaaggaatgccacctctctcttttttttttttttttttttttgagactgggtcttgctctgttgcccaggctggcgtgcagtggcacgatctcagctcactgccacctccgcctcccagttcaagcaattcttgtgcctcagcctctcccgagtagctgggaccacaggtgtgcacccatcacgcctggccaattttttgtgtttttagtagagatggggttttgccatgttggccaggctggtctggaactcctggccttaagtgattctcccacctcagcctccgaaagtgctgggattacgggtgtgagccaccatgctggctggaatgccaccgctcttaatgctataaaactcaggaccttcaaggttaagcagtgcaaggagactttccacgcgggcaggggtggtcagcctcattgcctatctgccttcgtggagttccactttactgtggggttctcgggctccactcctctggttcctcgagggcagtccccggggctgctgctctgtgggatgctgtggcccgtgtggggttcatgttagcacagctgagagaggcagggcccctcaaaggaacttgcctgagctctaagggaaaacaagatggaaataaacacggagagcctaagaaacacaaaacagcctggctccggagggcggggctctcactctgcccactcccctctgtcctggaaactgagaggaggtaggaagcccccctatagctgcaggctgctgacagctttgcctgggtggctttccagctctgacagctcttgagctcttaattcttcactccttttgaaaataaaggctgagtcttagcccctgctgggtccctctccattctgaggacctgtctcttctctaggtgtttgataccagaaatgctctcacacaatagatgagacttctgttcctacatagaaggaggtggctttgtcctcagggccataatagtttaacagtcttttaataagatataataattcatataacagaaattaaacaggcacaataatgatgaggggagatttttctccctttggcaatagtggtttgagccattcgtttgttatttcagcttttctagggtcaattaactgagcacctattatgtgctagtcattgtagtaggctatagggatataagaaataaggcatagtccctgccctgaaggagcctgcagcctggtcaactaaggcaggtgtgcaaacaataagcataatagaagattgtgctgtgacagctacatgaggcccagtggaaggacaaaagagaagggcatcagttctttgaaggagagggttggagggcggtttggaccaggaaaaacttcattgacaccaaaatgcttccgttgaatcctgaagggtgactaggtcattattttgggaaacgatgctggagaaagcagctgaggaggaggaaacagcataggtcaaaacatggagaataaagtcccttggcctactgaggaggtacaagtggtgtgggtggtccatgcagggccagggctgacaagagatgcagcaggagccaggctgtgtaggttgagtgggtaagccaaggagtttgggtggaatgcagagagaaggggtgggtggaagagccagccgtcttcaggggatggtggtacttgggagtaagacagaacagtggttctcactgtggcccacagaccaagagcatcatcatcatctgagaacttgttaaaaatgcagattctcaggccgtgccctagaccaatggaatcggagtttttgcaggtggggcttcacagtcttttgtaacaagtcttctaggtgagtctgatgcttgttcaagtttaaggactactgagatagagaatatgggaagagctagaggggcatcagttttgtggaggaaagatggtcaatccggacttgagtgtgttgacttcgaagtgacacgtggagctatcaaagtgcagtcccaggacccaccacatcagcttcatctgggagcttgttacaaatgaagcagaggcctgtgctagacccgctgaagcagaagctggattttagtgagacccccgggtgacttatgtgcacttttcaggctctagtctggaggttagctaggcacatggggttgatgctcgggagagggatcttggcaggaaacagaaaggcgggagttgtcagttccaggtgatgattgcagatgacacatttccagggtgagtgtgtagggagggagactggatggagtgactttgcttgagtcatgctgactgcttagcattatctttgtagagctgtggaagatcacacataaccagccctggatggcagccagcctgttgtaaggaaaacatgctgtttgcagccattatctcaacaactattatagcaacagcaattttcccagacgcccgttggatgaactgggcctggaacctggacttagaacccttactgtgcactgtcatgttcttctcatagagccctactttatggtggtgtgggggcggggtgggggtgttccatgtacttacgttgtcagggctggaaatgtgaacaagtggaaaaaaaaatcacacatgatgctcaataggcactcatagaagttgctcaataaaggtttgttaaatattgttgaaacaaatcattaaaaattgctttcagatttaaaaaatgcatttctatcagtaagttcaatttgactttacaacatccttgtaagtaaacatgctttcttaaaaaaaactttattgagatataacttacataccgtaaaaatcaccatttaaaaatactatgtaactcaatagtttttggtatatttacaaggttgtgtgactatcacgactatctaattgcagaacagttccatcatcctaaaaagacactccatccctttagcagtcactctcttttcccctctctccccaatccctggaaaccactctctgtctctatggatttgcctattctagacattctatagaaatggaatcatatgtgtctggcttctttcacttctttcacttagaatattttgtaggtttatctatgttacagtatatatcagcacttatggctgaataataatccactctgtgggtataccaatgttttatttctctctacatcagttgataggcatttgggttgtttctgcatttttggctattatgaataatgtagctatgaacattcatgtataagtttatatacaaatgtatgttttcatttctcttgggcatatacctaggactgcaattgctaggtcttgtggtaacactacatttagtcttttgaggagctccgagatagttttccaaagtgactacaccattttacctacccactaggaatgtatgaggttaccaatttatctttcccaacacactattatctgtcttttttgagtatagccatcctagtgaacatgaaatggtcatgctctcattttacagctaagaaaactgaaggtgcattatttgccaaagttggtagagctattaaatagccaaactagagcttttcttacataaaggcaaatacttgtatgatgcatactctgtgtgaagcattaggtcatttgctcttaagtcatttaatctttgtaactatctataacaaaggtactattattgtgtttatttgtaaatgaatacaaggccagaactgggcttggagtgcagctagggaggttcttagggtgcaacatttaagaagacattactctcaggttcctaccagcacttccacgaccctgactgttatctccttaaatattgcatcctagttgcttcactggcctcatcttaatcctggtcctgtttgaagaaactgaggcatacaaagattgggtaacttacccaaagtttccaaactagcaagtagcagagctgggattcaaaccccagaaagctggcctcagggtccatgtcgtgaaccactagcctacactgactcccacatctctgatctgcaaactgtgccttttccatttctttctcaagacataactttcagaaattagccagtgctttgacaagtggagcacctaaagtaaaatcccagagatgggttctggggagactaagccgaactactcaacagctcccctgggcgcctaccacatgattctcctgaaggagtttactggccacacagatcgcctcgccacatctgtacttatcatagctctgcataaatctccccagttccgtggaggcccccctgcaagcggccagatggactctgtcctgttggagaagaggccattcagacccgtcaggattattagctctgaccagctgtaaggaaaacaaacgttctcctggccaagccagaatgaatctgccacttgtccaaatgttctgagtcaaatacctagaaatcagatctctcataaacacacccaatttggtagctcatgctctttggtcttttagaattaactggtcatttgcattcatttcgtcacctttccaatgctgttgctctgtcattgggttttgaatggttctccaatttaggcagagcttcccacaaggcaatatgaatacaaaaatatacattggtgcttgtatattttaccccctcaggcctttgggaagatgtttacacaagtcatcagccaacagcaggttcttcttctgctccccaagaggaagctcaagtcagttttggttcatcagtgctgagtgagctccagcagggcagcctgtcccgggccagcagatcttttgtatctgcctcaaactcagaggtttttggtttgaatttcattgccatttttccttcattaaaaatggtaatttgcagtgttgaattttcacccttttgtttggaatttctattttattctatgactgattatcaaagctgtgggtctgtggaccagcagcattggcatctcccaggagcttgttggaaatgcagactctcaggctgcaccctagatgtcctagatccagaatttgcaacttaacaagatcccaggtgatgcctgtgaacactcaagtttgagaagtgctattccacatgtccatttctctgttaccttcagctagggtctccattcagtacttactttgaggctaaaattttttggtagactttcagatcttaaaaaaacacacatacgcagaaattctttcctttgcctttgcatgatgtcattcattttacctggcctgccacaagaaagaaaaaggcaaattatatccaagttttatatatatgtgtatacacacacacacacacacacacacacacacacacacacacatatatacatatatatgactaacttcttaattgcatctcttaaaacccccatcgttaacagagtcccaagtgttgccaagattaattgagaaagacctaaatgcaaaataaacactgtggcgtggtttaattccatatcagctaagaatgaaggtgcaattagtaataaagatgttaataattagttgtggtctattaaattttatgttcagtaattatgtggagagtgaagaaagaattttctcatgagggcagaaatcaatgtttcaccttgattgctattttaatgtgcttattttaatggggccatcctgtagaaacccttgggcacatttccaattttacgtaaatgtagaattaattattatggaagcatataattttagagttggagcgaccttggcggtcatttaatccagctcagtcatcttaaaagtaagtaagagttagttgacttacttaagtccttccacagagatttggaacctgcgctcctcaactctaatgccagtgaaggcgaaaccttttctgatcccttcagacagaagtgctttttcttgcctcagaatttcccaaagcaacatttattgtatggcctctaaggcccttaccccgccctgcattgtgatctagttgctttcagttgtaaggttggggtcttgaaaactatggatgattaatttttgtatttcttcatcattgctaactctgtgttttgcaaagagtagttgcacaataaatattcatgcagtggtgttctggagctggtttttacctgctcaccagagctcactgtgtcttcacattggtagcttgatatcagccatgatggaagtatttacaccataggagtgggcaaatgctacaaatcagggcttctaccctgtcctgcccacgtcccccgccccaccccacctcagggcagtgggtctttacaaaaatctaaagatctaaaccaggcttgtccaacccatggcccatgggcgtcatgtggcccaggatggctttgaatgcagcccaacacaaattcgtaaactttcttaaaacattatgagatttttttttgcaatatatttttttagctcatcaactgtcattagtgttactgtattttatgtgtgacccaagacaattcttctaaaccaatgtgaagatggccatttacccattgctttgcctgggctacttcaagagtggtgaaggagccaagtatttaacgcccttgaatattttcaggattaaagtcagtgcaagtgaggccttgggactgcactagaatttggttgcttatctaagttccattacgtagaaaagctctttgagtatgaatagtgaaggaaacagggtctgaaatatcacagttagttgaaggagcaaaaaatacatgattagaaaaaaaaagtgaacaggaaagtttcctgtggctgaaattgcaatcatatgtttgtacttctctgaaaaccttcagtggctcccagtgacctacaaaaatgcccagactctttgcataaaaattacacgctgaccatagtttactgttctaatctcatttccaaccacttgcatcatccactgttcatcctctgttgattccctctttcattctactttccaacttctgtggagcctctgttccagcctccatgatggtgccttctaaaatgcgttccccctgcttcccagttctaccatagaccctttcccaagcttccgttcctacctggtcctctctaccacggaccagagcttctgagttaacatgaaattcatccgactctgatcatctcctctcttgtctatctctctttaggagcaggacccgtggtaccattggccctggcaagtatggctatggtaaggccccatatatcttaccactgcagacagacactgcacacacgccacagaggctccggagacagaagctctcatcccgccattccaggtcccagggagcatcttctgctaggcatggctacagttcaccagcccaccaggtcccccaacatgggcctttgtaccaaagtgacagtggccctcgctctggactgcaggctgcggaggcccccatctaccagctacctttgacccatgatcaaggctaccctgcagcttcaagtctctttcacagcccagaaacaagcaacaaccacggtgtggggacccatggggcaactcagagcttctctcagcctgcccgatctacagcaatctcatgcatcggggcctatcggcagtacaagctgtgcaacaccaacgtgagtacacacaacccataccgggcctggaaacagctgcccctcgtttttctgtcatttggcactaagcatgatgaagacagcaaggatatggtgtctgggccatgttaacacaccttttaatcttcctcctttctctttgctttccatgtattctccctacatagttttctttttttttttttaaagttattgctttagtaacttatacattgcttcttgaattgcttattgacaatcgcttaatggtggtattaattattaacagctattgctgcaaaacaacctccaaattctcagtgacttatattaacaatatttattctttgctcaagtgcaatatataagtttcccagaggttctctgctattccaggtgtaaacactaggtattgtagcatgaagaagtctgagagtgaagttgtgaagagtcttctcttaggggaagagctgggacagctaaggtgatagatggcacacagaggcctctgggcagcagtaagttcctaactggtgtggaagtatgttgttattttaaggacctgtatagctgtactcatgcatatatatacaggtatacccactttggatatcagttcaataaatatttattgattttatcttcatgcatttacataatatctaccattattaaaaactcataagccaggccttgtgctcagcactttttttttttttttttttttgagatggagtctcgctctgtcacccaggctggagcacagtggcgcgatcttgtctcactgcaacctctgcctcccaggttcaagcaattttcctgcctcagcctcccgagtagctgggactacaggtgcgcaccactatacccagctaatttttctgtttttttagtagagacggggtttcactatgttggccaggatggtttcgatctcttgaccttgtgatctgcctgcctctgcctcccaaagtgctgggattacaagtgtgagccaccgcacctggcctgtgctcagcactttttctactaactccatttcatctccttaaccatgagtttgctcttctcttcattttatagttgcaaagagaggtaaaataacttgctgaagatgccacagctagtgagtagtagaaccaactatcaatgttaattgtatatggtgaccaaaggaattttttaaaatatcagtttaaagactgcgtattaaagagaagtgaatgagaggatgttaagaggttaaatttctgagccagtatatttttcattaataatttaatctgccttaatactctgttgctgggtaacaggacagctgttctatattagcttcaatttcctcattaaaaatatatttcctgctatagagtccatagaaatgacttaatttgtgatcttaataatttcattgaatgcctgggttgctttttagcttattcttccactgtcagacttcaggaatcattaattttaaaaagcagtaatttttctaaggccattgctgatcagtcaaccagtaagtcttcattgagcatcattgcttgtcttgtaacagagtaggtgtcacggagaataacagaaaagtcgtggtatctacctcctagcattgctttgaggatcaaatgagggatggtaggaaagtgctttgtaaatcaaaaagtaaagaattgtttggtttcatggtcagacatgcccttgttcctgaatatctgttgctgttcttttaaaacgaaatgaattcatttgtaatatacaacatattctcccattgagtagtgtatctcttaattttgaagaccaagcaaaccatagagagaaagtaaaagagagggcatttggcatccgtgtggagctgatgcccgcttagcattccttgcatttaacttacatttgtaaagcccgccccttttgccagacctgtgctgccaacggcagggttgttctccccatgtagaagctgtggcttccctgagtgctggggtaatggcaccactgaggagactgtattgcaaggaatcccaggaaattctcgtgaggtcatggtgtcttctggcattttggatgaaggcaaaataaagcctccaacccaagccaaagaagtacatgttgacacgggattgtataggtgtagttcccttctcttccctgtgacatgtgcacagtgtcctccccagtgcaccccactgttccaagtccacatcctgcttacccttattgagagatgtcattccttagaggttccattattgcatgtatttttttcataagcccatgtcttcttgtgacttgggccacacccccatgatctctttaaaattccctctttcagaggtccccaagaccattcctgggtttgatgatttcctaggaggactcataagacttagcatatagtcacactcacagttacgacttattacagccaaaggattgaataaacaaagcaaaatcactaaaggaaaggctcataggccgaagagcataggaaaccaggcataagctctccagaatcacagtggagccacataggacttgcttaattcctctgcaatgacttgttataacatgtaaaagttctataccagagaagtctcccctgtgcccggggtttttactgagggctggtcacataggcaccctctgcctgccacatatcaaaattccagactcctaaaaagaaatcaggtgtttagcataagctattttaggcacggtgagccactcctatcatttagggagtggtgagaactgccctgaaatccaagttcccagatgccagccatggaccagccttgcaaacaggcctttctaaggggagcagtctcagttcagctatgttgctttttttatatactccccagatggacccatatgccccagcatctcagcatcaatgacctcatgtagacatttatctgtcctccccagtgtccagcatcaagagaggacatgaatgacccaattatgtaagtattcctactgaaagaggaaaaggtatacagatgccgagctttgacacggaggaactgagtttccttgggcaagtcacttaacaccctgaggaccatctgtaaagtgggctaatgatccctaccgtgtagggttgatgtcaggttcagacaagatggagtatagaagagctggcatggcagtgacacatggaaggcatggtgctgacacattgttgggaaataaacgtgactggcatacccccctttagataggaatggagtaagatctcccctatctgaacatcttccaggttctcagtggtaactgaagaaatacgtggatgaaatgatcagacttgctcagagtcatcctcagtcccacgttagctgcgattgaggctcctttacctttacgcagtgacaaaacgagattgccaagagacccaacaattcagctgtgatttagtttcagtgtgatcacccttgggtcatggtgactttaaagtgataagagttaaattatagataaccagcttaataacagtgaattctttatgtcttccgatgtgcatgtttaatattaagacctatcttatggtgtgatctaggaattttaagcattccagcatgtctctgagattgttcaattcatgtaagatttctgaatgtagactttaaagataaggaagtattattattttgttgcctacaatgtgtacgaggaagttcaggtgacacatcctagtacagatagagaatctatggtcttttcaagcaccaatctcaaacatctgctggtgcaacactctccttcagactgtatgtgatggacgcaagactcaatctggtccaaagtctttttttttttttttttttttgagatagagtcttgctctgttgcccaggctggagtgcagtggcacgatctcaggtcactacaacctccacctccccagttcaagggttcaagccattctcccacctcaccctcccaagtagctgggattacaggtgcacaacaccatacctggctaatttttgtatttttagtagagatggggttttaccatgttggccaagctggtctccaactcctggcctcaggtgatctgcccacctctgcctcccaaagtgctgtgataacaggcatgagccactgcacccggccttggtttttttgtttgtttatttttgttgtttttttgttttttgagacagagtctcgctctgttgcccaggctggagtgcagtggcgcagtcttttaaacattctcaagagaaggcttttgcttgaagtccataagcataacattgacgttgattgcgtggggtgaggtgttaggctgtggttggagacactgagatgcgagcaggctcttgccttatgcagcttgagtccagtaagagggatagactcataaaaaggcattaacagtgcagatcatatgtgccaccgcacacgccacataggtcctttcaaatcaccacacagtggaaattaacctggcttgggtggagtttgagtgcagattatccaggcgagggaggatgttttaggaagagcaagtgacaggggtcctagaggccctttgcagtcctgtaagggctgaggagcaagaaggaggcactcaaggagctcttggtggaatcagatgtgttttcagtgagtgaaggcttcacctgcaagtttgtcttcagcagtgaaggggcaacacagggcggaagtcatgattaatccgcagccctgcactttcttgatgagggctaaaagtaataggaactcaaggaatagagtaaacagttaagtttcttattcatggaagctcattgaagcccaaggcttgatagctagagtttttgtagggattgcaacagaggaaggagaaatcaaacctcaattcctctggtgcctgaggagatgcagttgaaaaagaacaacaacccttttctggccagactcagttgggcttgattggctcatgcctgtaatcccagcactgtgagaggccctggtgggaggattgcttgaggccagaggccaggagttcaagaccagcctggggaacatagtgagaccttgtctctacaaaaaatttaagaaacagctgaggttggtggtatgtgcctctggtcccagttacccaggaggcttgaggcaggaggattgtttgagcccaggagttggaggatgcattgaactatgatcacaccactgcactccagcttggggggcagagtaatactttgtctctaaaacaacaacaacaacaaaaaatcctttctgcctttgtcttggggacttaggtgtctctcttcccactttctcttagggactccgaattcaacactttcttttaggtgctctgaatgcaacactttctccctggagaggagactgattgatactctgacctcttctggaggagggaggctgcagtgcaaggcagggacaaaattatgagtttttaagggtctttgctgccaaaggaggcgtgatcctgagtttagacagagtgcacttaacattatgagggagaaattcctggggctaaaagcagcttttagcaaacatggacatgatgagtactggtatcaatgactctccagtgaatttccctggggtaggactggcttttgacaatggatttatccatatggagttgtttctgccccagagtaagtgcaaataaggggaagatgttggccgaatctcaaatctagattggcgtgctctctgcaggcagattctaattctactccatctctagtctgatattgaatgaaagaggagctaataacttcctgactgcaattttaagcaaaaacttagtaaatgggccaggtaagaatcgagtacagttctgtaaggtgtaaagcttgccaggaaccatgaggccagttactgaatggacagaatgggggtttcaacactagtttctcttatcatgagcttatcatcagcctccttatctaggaaatatgtgcgagtatcagtgtttttgcagcatttgtctttctgtcttctcagaccacttggaatttccacagaaaattctcttactgaccttttcatacatatatatatacacacacacacgtatgtatatacacttatatgtgaatcacacacatatgtatatatatgtatacatgtatacacaccacacacacatatatatgtatacataacatgtgtgtgcatatatatacacacaaatatatacacacgagaattgttaacagttgtcatttttcatgattatagaaagttgttctcttattgacttcatatatgtatatatacacacacttttatatacacaagaattgttaacagttgtcatttttcatgattatagaaagttgttctcttattgacttcatatatatatatatatacacacacatttatatacacaagaattgttaacagttgtcatttttcatgattatagaaagttgttctcttattgacttcatatatatatacacacacacatttatatacacaagaattgttaacagttgtcatttttcatgattatagaaagttgttctcttattgacttcatatatatatacacacacacacatttatatacacaagaattgttaacagttgtcatttttcatggttataaaaagtacaaacaaagagtaagaaatatcagaacagcaaagacatgtatatccttgtctgtctctcaagatgtaatcacagccagtgatttttaacttgtagttcttacgttcattctctctataactctaaatggcacattaatacccctgcttcttgatatatcaacttaaattttctccatcaactccttattctggaagatgaagaattgaccccctttccttccactcctgctgatctacactagccacatttttattttcacttatatttttggctatatgtagtaaattaacaatttttattttcttgatttttcaacattaggaaaaatcagttaactccttcctttgcaaggttagaaatgttgtgtccaaacaactcactacattcctttccatgcattatacatttttgtttatgcatttttctcgtgttgggctataagtccctgagggaggctattatggcaaatttttctttgtatcctcattactgtcaacacctcacacatggagcgctgcaatgaatatttgcctttgaatggaattttgcaccctgcctcagcagatagcagaggggaaggaagccagtcttattaatgtggtaccggaaatagccactaagaaatgtgtgctccttgggagattaaggtggtttggttttcgtttttgtttttgcttgagtcagggtctcactgtgttgtccaggttggagtgcagcggcatgatcatagctcactacaacctcaaactcctggactcaaacaatccttctgcctcagcctacaggcatgcactaccatgctcagcttatttttattttttgtagagatgggttcttgctatgttgcccacggtggtcttgaacttctgcactcaaacatgctcccaatttagcctcccaaagtgctgggatcacaggcatgggtccaccacaccagactaaattttttaacaagtttacattttgccatgtgcttcctgattagttagggaaaaaagaattcttttttagatcttcttacagacatagagatatgtaaataatataaataggcagtcataagtaagcactcttgaaataggcctagatttgaagggatctcgaatatttaaaaatctatgattggcctgggtgaaaggctgggcttagtgtcatattaacatcctttggggctttgatgtaggtattgaatgagagggaaacacctctccctaggagaacattatgaacttccttggatgaaaaaaataaaaaaagcatttgagaattacaaaaatctcagataaaacaaaacaaaacaaaacaacaacaatgaaaaacatccaaagcctttccccaactctttggacaaactagttaattcactgactggagaatttctggaagtggtgggaggtggcaaaggtttttgtgaggttgagtttgttctgtgtaatttgagaaaggagatattaaacatatttgaaaaatgtgcaagataactggagcgaaattttggcccatggttttatttctctatagctagaaaacaagcccattttccagctgtagatgagaaaggaaggaagggcatgtttgcttagaacacatacttttcaagcaattacggcttctggaactactggattctccacagtggacatttggtgtctccacttcagcaaacatttattcagcattacagagagctggaaacattaatgtattaccacttaaaaatccccataaaaacccctggggattggggcctggaaggtggtacagggcttgttattcaattgtggtagtttagacttggagaagcaaaatgtttttcccaaggtcacacagccactttctcatggcagtgcagggacattttctagatttctttttttaaaaggtttcatgactgtggtgacattaaatacatcatatgttgctatggtagctggtcttttgattgaatccatagcagtgaaaaggataaaaaaattacatatctgacgcaggcagccttcaaggtcatgttccttggcaccgctacattggagatgatgctgtccgtctcctggggagatgacagtaattaattaccatcagtgtgatcactgatggtggctcttgagcagtgaagttgggtacaggcagttgtcatttcagattaaccagggtcactagaaatgtggctggagtttccataatactatttgtgactcatagcaaccccaggcaattgtctagatagaactttggatagggctcatattgctttataaggattcagctaatcatattaaagtacgtctttatttctcttccattaaaagtccagtggaaacatccctccctcttttgggtgggagtcatttgaagggaggttatctcccagaggcattacttggctctaaatctccagactttgttggtctcatcctgaatgagcctgatctctatctacatggcttttcccctgtctcagttttctggccttaagattacaagaatctctgcccatgaaaaggatcagctatctgcaagaaacctgcccccagggccagttcacagtgtaatgtacagacaattactgataaggtgaaggtgactcagtccatgacatcaggaaacaaccaatttaaaacctaagaaaggggtaaaaggatctgtaacctggaagttttcacttcagagagtctgttaaaatgagagatcacatcccgataatagtatgagaagtacaaacagatgtaatctataaaagagacatgaaacaggatttcccaggccctgcttggttttcatcctcactccgcagctccctgctccttgtggtggaggccagccacttcgccaggcctcgggggctgattccggctttggcctctagccctatcctgacaagacacagttatggctctcttgtctggggacccatcacaaattaactttgttgtctacacagtcacgaagggcaccatggcatagtggttactatgatggattctagatgcaaagtgtcagggttcaaatcttgatttcaccacttatgagccctatgaccttatgcagctcatttaactttttgttgccttgggttcctcatctgtacaatgggtataatagttattgtgaggattaaatgagctgaatatatgtaaatcacatagtggaatgtctaacatttaataaatgctcaataaaagttaggtatcatcatcatcatcatcatcatcatcatcagtccaggcttctgccttccttgcctgtaccacaatgctgcctcaataacccacttccacgtccgggcccaagaagccttgcatttctctggccacatccctctgccctccaggcttgcagtttgcctggcgtcatgtgagtccttgctggagtcatacacagggccatgcccatccaccaggacaccttgttaccttgttacctcctgctgggcttagctgactcctggcaactgcaggtggatctgctgatcactgtggctctaatgccatgttaagcttttctgccttagatgggaactggactacgcttagatgtaaatgacttattggtgaccaagggacagggtatcctaaatgacccacaataagttgggtggcagatgtgtatggatgtaagagcaccaggcattagtggagtattaagccgtaccctaagattataaactgcaaagatgtgcaaagttggctaagggctggtgtatttggcagggctctatacttatacattgtcacttttttttttttggagacagagtcttcctttgtcgcccaggctagagtgcagaggcgtgatctcagctcattgcaacctctgcctcacaggttcaagtgattctcctgcctcagcctcccgagtagctgaaatcacaggtgcatgccaccatgcccggctaattttttgtatttttaatagagacagggttacactatattggcaggctggtctcgaaatccagacctcaagtgatccgtctgcctcggcctcccaaagtgctaggattatagccgtgagccactgcatctggccaattgtcacttttattacataaatattacatgtttattgcagaaaaaattaaataacacaaatagactaaagattaattataaattaaaaacatctataacatcaccttccagagataacacttttaacctctctctgtgtatgtatacacacactccacacacataatctttttaacacttagtggattgtggactcctttccaagtcgtgaaacagacatttatgttgtcaagtactgagcaattctagatgattctgaatgtgcattggtttgtggtctagcctattagccattttactcattgagagaaaggggttaagcagactgttaagtctttgtagtctacagcttccagttctggtaactgccaccaggttaatgaagggtggcttctggctggagcctcactgtggagcagcttggctttacttagttgtagttatttgaggaacaggaccttcaaccacttgtgctggtctgtttctgctacgaagacctgcggcccggcagccgatctctagttctgattatggacagggtgggccttcagcgctctgggctctgcttctgtgtcactgtggagcctttggcaaggcttgccacatctccaggtctcagttccctcatctgtaaatgaaaggggttggatttgattctcttttgctctagcactctgtgattccacgttaagtcatttggagtggagtgagatggggcttgggcgtggcccttcatcgctgctgcacaggttaggatgcacaggccacaccagaatcacccaaggagcacttcaagcatatattcctgggctctcatccccactcttctgccagagtgaggcttgagaatctgcatttttaacaaactccttaaggtttctttctcgaagccgtacttggggactgctgcagggatggtggcctctccaagtcacccagctgttcacatcctacttgaactctggctcaggccaaaggcatgtgaaaagcatcttagttaactcaaaagccttcatggagacagctggtgttgctggaagcttacatgggcccagctttagggttgccagcaggttggcttccagagccctaggagacaggcttctgtggcctgtccgcctctccctgattgtcagagctcagcccaccctgcttgttcaccctgcctgttttttcctaccagtttccatcattttctgctttagggggcttcttgctccatatggttcggctcaggccacagcagggtaatgaccacgctgggcatttgtaccagcagcctccccaactgcgactgtccttaatcaagcaggagatgtttaccctcacacctgttttcagtccttcttctggtccctcatcttccgggagacctaatatttctgatacatacagtagatttctctacaaatccttgaagactttgaactatcctattagcagtttattccagagacttctacacagtactgtttaatgtttcaggggccaggctccttttccttctgattattcacacacacacacacaaacacacacacacacatacacactctcttaaacagagtatagcttgggttcaacaaagctagatcatactttatccacaatatgaattagagattctgatcttgttattttctgtctcatacttatttactttatgccacactttgctcatatttaccatttataaatgaggaagagataagccagagggagcagtatgttttccttgagtagtctagtgcatcaggatcacctggataaacttgataaaatacagatctctggatcttatcccagatttactgaataataatccttaagggagggatccagaagtttgcatttccagaaagatctctgggtgattgttttgcatgcagaaggtcggaaattcctgcttcatgtgggacagaatttagactagaatttagagaagatggggcggacaatgagagacagcctggtgggaaccaggctgcttgcatttaaatccaggccccacacctcactggctgtgtgactcctccatgcctcagtttgctctcatgaaaaatctgtaaaactacagtgtttaccttattggttgttgtgaagattaaatgagttcacatgtggaacatgtttaaagtagtgcctggcaaaggtaagggctctgaacatgtctgccgtggctactattccatgcaaggggaatggcatgaacaaagtcaaacagaagcagatggcctctttgagagaatggagtaaactgatttgtcagaagtagaaggtttagatcagtggttttcaaattatagtgtgcaaaaaaataacctagggagcttgttaaaagtttcttgcccctataacgattctgagttggtatacatgaagcctggggatctgcatttaaactttttgatgcaggttttgagcaaatgttcagaaacccagtagtttaggtagaagagggctggtatttaaagttggaaaggggcccggcgcggtggctgacgcctgtaatcccagcactttgggaggctgaggcgggtggatcacctaaggtcaggagttcaagaccagcctggccaacatggtgaaagcccatcgctacaaaaaatacaaaaattagccaggtgtggtggtgggtgcctgtaatcccagctacttgggaggctgaggcaggagaatcacttgaacctgggaggtggaggttgcagtgagccgagattgggccactgcactccagcctgggcgacaagggtgagactccatctcaaaaaaaaaaaaataaataaataaagaataaaaataaaaaataaataaagttggaaaggtatccagggtttggaaatgtatcctggagctatgaaaagtatggacactaattgcatatttaatatctgctttattaggtatgtccagaaagcagtagaagtatccgggaggtacagtgtgcatcctacaacaacaagccattcatgggccggttttatgagtgggaaccatttgcagaaggtaagaatagacccagccctgtccatagaagttactttagtctgttttccattcttgttgacttctgattgatgttggaggtattggtgtgatcctggctggggtgtcaataggggagaaagtgtgactccagggcaaagagaagcctgcatgggtctttaccaaaggtagcatagctcaggtgacgcctggaccatcttcggcatgagtcagatggatgaggcactgatggaaacaagcaacatccaaggatggcagggtgagggggacagaacagggttcaaggaatcagttggagaagaggttcaaacataaagttgtgagccgtgagtgcagatggagtttccctttccttggttcctgctacaaggggtagtatgggagcttaagagaacatgtggggttgtacagttgtatggttctcacctgtagggggcctcacatgctgattccaaagataatagtaggcaggcattgcccgtgagtacaagatccccgtcatttccagatgacagaagatccagagttggtagagcaagttgatcccactctgcatgctggagtcacttttctttgttgaaatccagatgataacatggcttgcggactgagaagttttaacattctgagatatttctacccacccctggagaaagtgggctcagaagaggtgttgggtcaagcagaatttgtgggggttctatgctcacagccaagttggctggagagggagtccagctgccttcagggcccagtggaagagctctgcccagccagcccttctcagcttcagcccgaggcagtggctggacagctaaggttggccaagacccagagtatggagcactgcacaatgtgcaggatctggagaaattgccttggaagagggattgatagtgagttgtgatgattttattgcagaatcaatgcctggggaagccaaactgtgcaaggtggttctatacttagaggcccttggggaggagggaagtggattagtatctgactgctctgaaattggatgctaaattgtttttatctgtgcagtgttctcagagactccatagcttctattagattctcagagtggtcccatgacctcaaaattgttaagaactaacttgactgaaaaattgagactatcaaattcaagcaggaaggatgtacagaggaaacatagagctagctgagtgcacatacaacgggtggggaacagggtgaagggtgagcaaaagaaggatgccaaagtgaaattttgatttgattctgtggatagagcttggttctgacctttttcatttttaagggcattatgttaaatttaaggtggtatcctgatttggatcctgaaacagaaaaagggcattgttggaaaacctagtgaaataggcataaattgtatagtttagttaatagtattgtaccagcgttaatgtcttagtttttataaattgtttgttttttgtttttgttttgtttttgaggtggagtcttgcactattgcccaggctggagtgcggtggcgtgatctcagctcactgcaacctctgcctcccaggttcaagcgattctcctgccttagcctcccgagtagctgggattacaggtgtgcaacactacgcctggctaatttttgtatttttagtagaggcagggttttgccatgatggccaggctgacctcgaactcctgatctcaagtgatccacccgcctcagcctcccaaagtactgggattacagacgtgagccaccgcacccagcctgtaaatggttttgtaacatgttaacattatgcgaagctgggtaaagaaagggtatacaggaacttttgtactatctttgtaactttcctgtaaatctaaaatgatttcaaaataaaacgtcttgaaggcattgtactcccaattagctatgtcttacatggattctggtgaagacaaagtgtaatactcacttaatatgggtgaggaagagtgcactgggttaaatactgcccccacccaccacccaaattggtattcttcctggaaccttagaatgtgaccttatttggaaatagagtcattgcagatgtaatcagttatgttgagttcatattggagtagagtgggctcttaatctggaatgacttgtgttctgataagaggagaaagttgggaggccaaggcaggtggatcacctgaggtcgggagttcaagaccagcctgaccaacatggagaaccccgtctctgctaaaaaatagaaaatcagcctggcgtggtggtgcatgcctgtaatcccagctacttgggaggctgaggcaggagaatcgcttgaacctgggaagcggaggttgtggtgagctgagatcacgccattgcactgcagcctggacaacaagagtgcaactccgtctcaaaaaaaaacaaaaaacaaaaaaaaagaagaggagaaaggacacagacatacagggagtatgccaagtgatgatgaagacagagattggagtgatgcttctacaaggtaacaacaaggactgctggcagccaccaagagctaggcagagacaaggaagcatccttgcctagagccttcaaagtgggcgtggtcctgccaacaccttgattttggactgccagcctctagaactgtgagaataaatttctcttgtttgaagtcatcaaggttatggtattttgtcatgcagctctaggaaactaatacaaagaagaaggaacaaggttctggattgattgagatctactcgctagagtagatccagaggtgagtttgctccagctgatagtagcagatgccttagagaagtgaggcatgtatccaaagtgagcaactgcctcaactggctcacagatgtaggtctgtccagcacagtggttctcagccctggttgctcttcagaatcactgaggagcctcctagagacactgatgcctagacccctccccagcgattgtgatttaattggtctgggatgcagtctgaacatcaggatttcttaaagatcccaggtgattcttatgggtagctagggtagagaacctctcatctaagaggggatgactcagcctacattgagggacagaatcatgggtatttgataaatcctgaaatacattcttgtgtcagaacaacaatgctttccagtgaacatttagagaagaagtgaccctgtcttttgtctgagctgcacccttgctttatggctggctgtggataatagctgctttattgtgattacctggggggaaagatgaattccacactacactgagcagtgtgcgttctgtaatttccccaggagcagaagctgccttgccagaccttttctgcgtggtctgaggtggccatcagccagctgttgttgtctaagaccttgaggtctggtagatgcaggtctaatattgatagccctatgcaaaccacaaagaaaactttgctaatgttttcatgtattacatgtgaatgcctgctgttgtctggcttatgtatgggtctactttttctgttatttttttcccctctgatttgtgctagactttaagacctggaagaacttattttttgaacatttgatttaactgattttttggaaaatttcaaacataggtaaaagtagggagaatagtataatagtgtgataagctcctatgtacccacttaattccattagttatcagcccatgaccaatctttttcacaaatatttccatcctctctctcccacccagattatgggaaactgcttgaattcacattacagagcattattcattggtggatatattaattggaactcttggttgtaagtgacagaaacccaaactaaatacattttgatcagaaaggtattttgttggtcatgttactgggaaatgcaagaggtggcctgggattcaaatgtggctgcattccagggaatcagtaacattaggaccctgcctttctcatctttctccatctctaggttctgtttacttctgtctcgggcaggcgagaaggcttaccatgggtttgagcttgcaatcatactgggagggactctctcacctggtcttgagggctgaattgcacccccaaaaagatttattaaaggtacccctaggccaggtgcggtggctcacgcctgtaatcccagcactttgggaggctgaggcaggttgatcacctgaggtcgggagttcgagaccagcctgaccaacgtggtgaaaccccatctctactgaaaatagaaaaaattacctgggtttggtggcacatgcctgtaatcccagctacgcaggaggctgaggcaggagaatcacttgaacccaggaggcagaggttgcggtgagccgagatggcaccattgcactccagcctacccctggtacctgtgatgtaaccttctttggaaagagggtctttgcagatctaattaagatataagtttagatgaggtcacagtagagtagaataggccctaatccattgtgactggggacccacacagagagcaccatgggaagacacagacagggggaagacagcccatgtgaaggcagaggcagagactaaagtgatgcagctatgagcctaggaacgccaaggattgccagcaacttccagaaaccaggaaaatgcgtggaaggatccttcctccagagactttggagggagagtgaccctaccaacacattgattttggatttctggcctccagaactgtgagagaatacatttctcttgtttgtgttcaacaggacgccaaccagtttgtgtgatatattacatcagtcctaggaaactaatatacctagtgactgttccaatcccagacaaactataccatggtcttgtttggatcctgttcccatccctggaacctagtttgggggatggggtacttgggttagctcaggtcatgtgaccaaccctatggtaggggacccacatcgcatgaagaggagatagggaagtggggattgagacagacaggaaaacattcttctaccaaaatcagtgcatacttctttactggaagccactgagatgttgaatcaactaattagcatcctaatgtggattaatcagctatcctttaccatgtgttactagaaaataatgcagtcttttaaaatggtcactgacattgatatttttcacatgcctagaaggagagaggaagcctatggtcactgaagttgagtttactttggctttgtttaaataattctttttgctgctaagattgttttcttgattttatccttcctcctcttaaatggctcccaggctgaccggcgggaggaagacactgctaatgcttctgcagggctttacggctggattttgcatcgggctcttggttttgtttggatgtctactgctattcacatgtgcctacttagggaaacagctgcgctcattcagtgcaatgccacatagaatagtaaaagcggagtatactctctgataaacacattaattttaccagatggttcttcttaagcctttaattgcatttcctggatttggtgacctatccttagataatgcctccaggaatttttctcatagcctgggacctattactgtaaagatggcaaaagtggaattagggtgcccgtgcatcccagttcacccaggacagtgatagtttatgcctgtcgtcccagtcccctttcactctctgtcttggacaataaatatatatgtccattacaccgagcatgggcagtttcataggaagccacttgtttaggtgctgagattggagcaaattctacctgttttcatgccaagggtaatggggctgcagcatgagactggagttttgctgggttgctataggctatagggcatcagatatcagttttaatccttaaaactgctagggggcagctttatgtttgggtagcttgagtgcactgtgtgtccctgagagctgaactaaagagtggcaactgaaaagccagaggggaggctgagtcagaaagtgaaggtcgccaactggtgacatgaacagtgattgtatctgtcagcagtggctggcttatgttacagtaacaaataacccccagatccaaatgacttaacatgacaaaagcttgcctgctgttcaccttccacgtgtaagggtgggtgtattttgcttacctggggacccaggctggtagaagctgtatctcaactcatgatttcactgaggcagggaaagggaacaagtgacctaggctcaaattctttgtttttgtttttttttttctaacttttattttaagttcagcggtacatgtgcaggatgtacaggtttattacataggcaaacgtgtcatggggggttgttatacagattatttcatcacccagttattcagcttagtaatccattagttatttttcctgaccttctccctcctcccagtctctgccctctgataggctccagtgtgtgttgttcccctgtctgtgtccatgtgttctcttcatttagctcccacttataagtgagaatatgcagtatttggttttctgttcctgaattagtttgctggggataatggcctccagctccatccgtgtccctgcaaaggacataatctcattcttttttatggctgcatagtattccatggtatatatatatatatacgacattttctttatcaagtttatcattgatgggcatttaggttgattccatgtctttactattgtgaatagtgccaatgaaagaacatacatgcatatgttcataatgcatgcatgtgtctttataatagaatgatttatattcctttgggtatgtacccagaaatgggattgctgggctgaatggtatttctgtctctaagtctttgaggaattgccacagtgtcttccacaatgggtgaactaatttacactcccaccaacagtgtataagtgttcctttttctccacaaccttgccagcatcttgttatttttgacttaatgatagccagccatacagactcaggttcttaaagcttcaattagaattgatccacattgtttctgctcacatctcattggccaaagcaagtcacaaatcacacctaacttccaagggggaagggaggtaccctcccactatgtgctcaaaggaggagaaatggaatatctgtggctggccctagtgactagcaggcaggaagctccagtgaaattccctgaatgccttcctcgttaagtccaggtgacttttattaggttgtttgcaagaatagtagatgttgctccagggaatattaaaggtgccaccacacagtctgatatccacagagccctgagccacttcagtcaagatctaccccttgcgtgcttctgactcctccaccaatccagcagtctgccccaacacagacgccatggtggggcatgatggggcagggggcgctgtcagataaaaacatagacaatattatcagaactgtaagatatgagggagggaggcttgtgactaagtgctggtggacctggaattagagtgttcgtgttttactgaagcggctttattcataggcactctcattcccgcagcccacccctgtgcatagataatccataatcctgtgaatgttcagagtggaaggggcagaccttagagaaatgagaggcggtttctatttcactgggagtggatctggaatgctccccacaagatccattctcagagctctcttttacatgccaggggatacctggcaagactaggccatgtttgctttggggatgagcatatcattgaggacaaagcccagagggcaacctctttgtgaaaacaaaatgatgattttggttttgtatatgttgagtctgaatgaatggtgggacccaacaggaggttagggatgcaaggttctgaagtttagggagatatcttagggttgtagacccatacttgcagtcatcaaccttggtgagattagtggataagaccttcaagaaaatgtagaataacaaaatggattttacaaggaccaggaaatgagctttggagtatgttacattaaggaagcaggggaaagagtctcagccattaaaggacactgagaaggtgatccaggtataggagaggcaccaaggcattatcatcccatgtatcatttcttatgttaataaagcttattgtggtttataaagttctgctaatacacacagcacaatgaatgctatggactaaatgtttatgtctgtctaaaattcataagttagagccctaacccccagcgtatttgaagatggggactctaaggaactaattaagattaaatgaggtcttaagggcagggccctgatctgataggattagtgttcttataagaggaacactaatattacctggggacccaggccgatagaagctgtatctcaactcatgctttcactgaggcagggaaaggacaccagtgttcctagtggaacactaacagtggtggctggcaagatggtcaagtagaaacggctccggtctgcagctcccagcaagatcaatgcagaaggcaggtgatttctgcatttccaactgaggtacccagcttatcacactgggactggttagacagtaggtacagcccacggaggctgagctgaagcagggtggggctctgcatcacccaggaagcacaaggggttggggaactccctccccgagtcaagggaagccgtgagagactgtgccttgaggaatggtgcactctagcccagatactacgcttttgccgtggtctttgcaacctgcagactaggagattccctcgggtgcctacaccaccagggccctgggtttcaagcacaaaactgggtggtcatttgggcagacaccaagctagctgcaggagtttttttttcgtaccccagtggcgcctggaatgccagtgagacaaaactgttcactcccctggaaagggggctgaagccagggagccaagtggtctagctcagcaggtcccacccccacggagcccaggaagctaagatccactggcttgaaattctcgctgcgcgcacagcagtctgaagtcgaccttagacgcttgagctttgtggggggggaggggcatctgccattactgaggcttgagtagttagttttcccctcacaatgtaaacaaagccgccaggaagttcaaactcggcagagcccaccgcagctcgggaaagtcactgtaaccagactgcctctctagattcctcctcactgggcagggcatctctgaaggaaaggtaacagccccattcaggggcttacagacaaaatccccatctccctgggacagaccgcctgggggaaggggcggatgtgagcgcagcttcagcagacttaaacattcctgcctgctggctctgaagagagcagcggatctcccatcacagcgctcaagctctggtaagggacagactgcctcctcaagtgggtccctgacccctgtgccttctgactgggagacacctctcagcaggggttgacagacacctcatacaggagagcgccggctggcatctagtgggggtccctctgggacaaagcttccagaggaaggaacaggaagcaatctttgctgttcttcagcctctgctggtgatacctaggcaaacaggatctggagtggacctccaacaaactccagcagacctgcagcagaggggcctgactgttagaaggaaaaccaacaaacagaaaggaatagcatcaacatcaacaaaaaggacgtccacgcaaaaaccacatatgaaggtcaccaacatcaaagaacaaaggtagataaacccacaaagatgaggaaaaatcagtgcaaaaaggctgaaaattccaaaaaccagaggcctcttttcctccaaaggatcacagctccttgccagcaagggaacaaaactgaacagagaatgagtttgatgaattgacagaagtaggcttcagaaggtgggtaataacaaactcctccaagctaaaggagcatgttctaacccaatggaaggaagccaagaaccttgaaaaaaggttagaggaattgctaactagaataaccagtttagagaagaatataagtgacctgatggagctgaaaaccacagcacaagaacttcatgaagcatatacaagtatcaatagctgaattgatcaagcagaagaaaggatgtcagagattgaagatcaacttaatgaaattacagcgtgaagacaagattagagaaaaaagaatgaaaaggaatgaacaaagcctccaagaaatatgggactatatgaaaagaccaaacctatgtttgattggtgtacctgaaagtgacgggaagaatggaaccaagttggaaaacactcttcaggatattatccaggggaacttccccaacctagcaagacaggccaacattcaaattcaggaaatacagagaacaccacaaagatactgctcgagaagagcaaccccaagacacataattgtcagattcaccaacgttgaaatgaaggaaaaaatgttaaggacagctagagaaaggtcgggttacccacaaagggaagcccatcaggctaacagcggatctttctgcagaaaccctacaagccagaagagagtggcagccaatattcaacattcttaaagaaaagaattttcaatccagaatttcatttcatttccaaactaagcttcataagtgaaggagaaataaaatcctttacagacaagcaaatgctgagagattttgtcatcaccaggcttgccttacaagagctcctgaaggaagcactaaatatggaaaggaaaaaccagtaacagccactgcaaaaacataccaaattgtaaagaacatcgatactatgaagaaaccgaatcaactaatgggcaaaataaccagctagcatcataatgacagggtcagattcacacataacaatattaatcttaaatgtaaatgggctaaatgccccaattaaaagacacagactggcaaattggatagagacaagacccatcagtgtgctgtattcaggagacccatctcatgtgctaagacacacataggctcaaaataaagggatggaggaatatttaccaagcaaatggaaagcaaaaaaggcatggattgcaatcctagtctctgataaaacagactttaaactagcaaaaatcaaaaaaggcaaagaagggcattacataatggtaaagggatcaatgcaacaagaagagctaactatcctaaatatatatgcacccaatacaggagcatccagattcataaaacaacttcttagagacctacaaagggacttagactcccacacaataatagtgggagactttaacaccccactgtcaatattagacagatcaacgagacagaaaattaacaaggatattcaggacttgaactcagctctggaacaagtggacctaatagacatctacagaactctccaccccaaattaacagaatatacattcttctcagcaccacatcggacctattttaaagttgaccacataattggaagtaaggcactcctcagcaaatacaaaagaacggaaaccataacagtctctcagaccacagtgcaatcaaaatagaactcaggattaagaaactcactcaaaaccgcacaactgcatggaaactgaacaaccttctcctgaataactactgggtaaataacgaaattaaggcagaaataaagaagttgtttgaaaccaatgagaacaaagacataacgtaccagaatctctaggacacagctaaagcagtgttgacagggaaatttatagcactaaatgcccataggagaaagcaggaaagagctaaaatcaacaccccaacactacaattaaaagagctagagaagcaagaggaaacaaattcaaaagctagcagaagacaagaaataactaagatcagagcagaactgaaggagatagagacatgaaaaacgcttcaaaaacaatcagtgaatccaggaactgttttttttttttttgaaaagattagcaaaatagatagacagctagccagactaataaagaaaaaaagagagatgaatcaaacagacacaataaaaaattataaagggtagatcactgatcccacagaaatacaaactaccatcagagaatactgtaaacacctctatgcaaataaactagaaaatctagaagaaatggataaattcctggatgaatacacccttccaagactaaaccaggaagaagtcgaatccctgaatataccaataacaaggtctgaaattgaggcagtaattaatagcctaccaaccaaaaaaagcccaggaccatacggattcacaggcaaattctaccagaggtacaaagaggagctggtaccattccttctgaaactattccaaactactcctccctaactcattttatgaggccagcatcattctgatgtcaaaacctggcagagacacaacaaaaaaagaaaatttcaggccaataaccctgatgaacattgatgcgaaaattctcaataaaatactggcaaactgaattcagcagcacatcaaaaagcttatccatcacaatcaagttaacttcatccctgggatgcaaggctggttcaacatacacaaaccaataaacgtactccatcacataaagagaaccaatgacaaaaaccacatgattatctcaacagatgcagaaaaggcccttgataaaattcaacaccccttcatgctaaaaactctcaataaactaggtattaatggaacgtatctcagaatattaagagctatttatgacaaacccatagccaatgtcatactgaatgggcaaaagctggaagcattccctttgaaaaccagcacaagacaagaatgccctctctcaccactcctgtttaacatagtactggaagttctggccagggcaattaggcaagagaaataaataaatggtattaaaataggaagagaggatgtcaaattgtctctgtttgcagatgacatgattgtatatttagaaaaccccatcgtcttaaccccaaatctccttaagctgataagcaacttcagcaaagtctcaggatacaaaatcaatgtgcaaaaatcacaagctttcttatacaccaataatagacaaatagagagccaaatcatgagtgaactcccattcacaattgctacaaagagaataaaatacctagtaatacaacttacaagcgatgtgaaggacctcttcaaggagaactacaaaccactgctcaaggaaataagagaggacacaaacaaatggaaaaacattccatgctcgtggataggaaacatcaatattgtgaaaatgaccatactgcccaaagtgatttatagattcaatgctatccccatcaagctaccactgactttcttcacagatttggaaaaaaacactttacatttcatatggaacccaaaaagagcccatatagccaagacaatcttaagcaaaaagaacaaagctggaggcatcacactacctgacttcaaactatactacaaggctacagtaaccaaaacagcatggtactggtaccaaaactgatatgtaaatgaatggaacagaacagaggcctcagaaataatgccacacttccacaaccatctgatctttgacaaacctgacaaaaacaagcactggagaaaggattccctatttaataaatggtgttgagaaacctggctagccatatgcagaaaacagaaattggacctcttacttacaccttatacaaaatttaactcaagataattattgagcacttactatattataggcacagttcaaagtgttgactcatttaatcctcacaattaccccatcaggtgggaactagtttttaccttcattttacagataaaacaaaggcctagactagttaactaacttgcccacggtcacctagctagtaagtgatagagccaggttcaaactccaaagtctggctacaggaatttctactcatatgtatatggaagccaagaaaagggtttccagaaggagaggtggtcaacactgctgaacatcagaagaggtcaagggaaataactgagaaaataagacaaggatgggctgttgggaaccctactggaagggaattagagtggtcaggtagccatctctcttttttttttttttaatggccatgtagaaggcatattaggagtgtatgctactttaaggagaagggaaaggtttgtctagaatgataaaggaatgaggatgttctgtagatgtgaggatgtagcttgtagcaagggagtacagatttaatagaatgatatctctgaacctgtgctatcctaaaagaaaagatgcaaagtgggcattttttcttcctgtagaatgtgtattattgcttctctgcaagcttttataaaaagcttcttcatcatttaataaaaattaattcattcaagagaaatgaaagtaatcgttttgccataaaaaaaaatttgcccaagaatgttcacagcaccttttttcatattagcttcaaactggtaacaacccaaatatccatcaacaggagactgaataaaaaaattgtggtacattcatacaatggagtattactcaaagtaaaaaaagaacacactactgacacatgtaaaatcctggatgaatctcaaaaactttatgttgagcaaaataaggcagatacaagagcacatactgtctgattccatttatatggtattctataataggaaaaattaggctgtggtgatagaaatcagaacagtgtttgcctatgcaggtgggaggagtattatagctggaaagggaaatgatagaaccttctggaatgatggtaatgttttatgtcatgattggcattatatacacatgggtgtatacagttatcaaaatccattgaactatacacttatgtgcattttattgtatataatataaactatatttttaaaaccttatgattctcttttcccttttctctttctttctcattgtctcactctctgcctctctctctcactctgtctctccaattcctgaaggagacttttagagctagtattaatgtcacattgtgaactattctaaggctttctagtttctctcttttattagactcaaaaatgtgtagtatcaactatacaactactaggagaaaacataggagaaacactacaagacatcagtctaggggatgatttcttgcatatgacctcaaaagcacagacaaaagcaaaaatagacaaatgagattatatcaaactaaaaagcttctgcatagcaaaagaaacaatgaatagagtgaaaagacaacccacagattgggagaaaatatttacaaatcatacgtcagatcaggggctcaaatccaaaatatgcaagaaactgaaaccacttactagcaagaaaacaactcttaaaaatgggcaaaggggctgggtgtggtggctcacacctgtaatcccagcactttgggaggctgaggcgggcagatcacgaggtcaggaattcgagaccagcctggccaacatagtgaatccctgtctctagtaaaaatacaaaaattagccaggtgtggtggcacgcacctgtagtcccagctactcgggaggccaaagccgaattgcttgaacccaggaggtggaggttacagtgagctgagaccacaccattgcactccagccaggggacaaagtgagactctgtctcaaaaaaaaaaaaaaaaaaaaaaaaaaagaaagaagtggggagggaggggcaaaggacctgaatagacatttctcaaacgaagacataaaataggccaacaggtatatgttaaaatgctcgataccactaatcagcagggaaatacaaattaaaactacaataagctatcatctcatgcctgttagaatggccattagaaaaaagatgaaagatggtaagtgttgggaggccgaggcaggcagatcacttaaggtcaggaattcaaaaccagcttggccacgtagtgaagccccgtctctagtgaaaacacacaaaaaattagccaggtgtggtagcgcgcgcctgtaatcccagctactcaggaggctgaggcaggagaatcacttgaacccgggaggcggaggtggcagtgagccaagatcatgccattgcactccagcctgggtgatagaatgagactctgtctcaaaaagaaaaaaaaagaaaaagaaaaatggtaagtgttggccaggatatggagaaaggggaacctttgtctaccgttggtgggaatgtaagttagaacagccattttggaaaacagtatggaagtttctcaaaaaaaactaaaaatagagttaccatcattctgcagtcccacttctgggtatatagccacaggaatgtaaagcagtgtgttgatgagacgtctgcactttcatgttcactgcagcgttattcacatgccaagatatggaaacaacctaagtgcctatcgacagctgaaaggatttaaaaatgtggtctgtgtacatgaaagaatacgattcagcctgaaagaagaatgaaattctgtaatttgtgacaacatgggtaaacctggagggcgttatgctatgtgaaataagccaggcacagaaagatgaatattagatgatctcacttttatgtggaatgtaaaaatttgaactcagaagaagagagtagaatggcagttaccagaggctgaggagggagggagtgggtggtgaaaagtaaaatgttggtcaaagggcacaaaattgcagtgagacaggaggaaaaagttttggtgatctattgcacagcaaggtgactataattaataataatgtatatttcaaagttgctaaaagagtagattctaaatgttctcaccacaaagaaataagtatgaggtgagggatacgttaattaaccatattttcttattccacaatgtatacacgtattgaaaccccataaatatatacaaatatttatcaatcgaaataaaatttaaaaatacacagtatcattttgagactcatttagaattatagggctttgctgggcgtaggaatcctctaataggtcagaatccgaggaagcaagccagacatctgtgttagttagctttcttattttgcaagcaacagacaccaattttggctaagtcaaacacaaaaggattttatcaggaggatatccaatagctcagagacccaacaggaagtgtggagaagtaggcttggtaaaggatggaaactgggaagccctgggcttccaggtggacagaactcacagtctcattagtgtgctgctgctgcaatggaaaattccagcaggtttctccatctaagagtcaaagtcctggtaacaagggttggattggcttagcttaggccacatcccacaccttggccagggggagctgggacaccctgagtgacagtctcgccaagactacacacagaggggagaagtaattttcaaataagaaatctagaaagaagggaaagtggatatgggatggacaaaaatgattggtgtctgtgactgaaactcatgacatgtcagggtagccacctggctcatcaactgtcatttcatcattcagctggtagggcttcctgacacctttgggggaattgttgaaattgaaatgtaacacgcaagtatcattcattcctccttcttgttgtgtttgcatttctgaagattgtacagacaagacctgtgtagatcccctctgatcccaaatgtgatgctggtgtaattcaggttgaccagtgtgtatttacacaggcgcatgggccactgcatcataagggggcatgaccttaggatgggagtgaggaatgattccctcctccctgattcctataatcctggttgctggtctagttcttctcccaccactgctgccaagtaggagtatatgtgtgaaatgtctctgggacaggcctccttctcacacccacaccatgtttctctctctagctaaagaggaaggagaatgcaggatggggcaaatggttattacctacctctgtaagtctttccactggaaaatgtaggatatgagaaaggaaagattgagggagaaaattgcctctattctagggtattctagcaggtgtaaatgattctttaaaaagctgtttctttcctggcacttgaacccatgtcattctgggtagttagtaaagaaaagcctcagggtgtatttcaacatctaatgagcagattagactaaataggaatgattttaaggacttgaaaccaagcatagagcttaaactcactgcaaaatattaaatactgagacccgatcctattgtttctctcttccaagaactcagctttctacaaagactgccttgctcagttgtcatcgtgtggctggtcggggtgtcagtattctagtgttcctactcaacagatgcaggaatagagactcacaggggtaggatggtctgccctgggtcacagaacaacagagaagaatcagagtcaccgagaagttacataagcacagcccaccaagctgagagcagcgatttgcctgagggcctgcagaagaatttctccctccatgcatccaagccatgactgattcatttcctttaaaaacaaacaaatgtgtttttacatcaagactactaagacttctccaggaaatcctgggtctctgtcttaatctcttgtagcacagttctctcactctccgagcagaggtcaccatgttgtaaattggtggggacatgtcctgaaggagtggttgggacattttgttgtaccttgcatggaccttgagatattagtatctggtgcatatcaagaggttttcagagttagatttacaactacggtgtgatcagtgaatatgcaacttatatttaaattacacattcagcccatgctttatatatttatcagacattctcaccccactgatacagtctgatttggcttggctctgtgttcccacctaaatctcatcttgaattgtagttcccataatccccacctgttatgggagggtccaggtggggataattgaatcatgggggcagttaccccttgctgctgttctcgtgatagtgagttagttctcacgggatctgttggttttataaggggcttttcctccttttgcttggtgcatcgccttactgccaccgtgtgaggagggctgtgtttgcttccccttctgcgatgattctaagttttctgaggcctccccagccatgctgaactgtgagtcaattaaacttctttcctttgtaaattacccagtctagcgtaagtttctatcagcagcatgagaacggactaatacactgtccttcccccaaagctgttaaacagctaccaaacctgccagtctccatttcttagaaatttctgtgagaacactccatgaatcagtgggagttgtttacaaaagattaaaagaaaaatcacttgtgtagctgtagtctgaggtgggaaggtgcacccctctttccttttatctgggtaaaatctgccttggtacattcttgtgatgccaccatgtttaccctggaataattatttattgcctagttaccctttggagccatgttgagcacaacatccagtgtacctcttcggatattttaatacaatcatgttgtcaccccgcatcttctttttgccagcctgctgaataattttatttccttaaactgatttctgtgctttggggcttgctgtttattatcctgactcttccctttagagtgtggttaatgagtcataacgcgcaggtctcctcacctgtgtgagctctgatgtgctgggcttggaaacaaggaatgttattgggattgattagtgatgccttgattgggcttgggaagggggaatggctacatctgtgctgcctctttgccagttctatggtttttcaatctttccaatcatggttacctaggtgccgattaatcctgctagttgctcgaaaatttgagatgagtctctattctttattaaagacgatgagcttcataaatgtttacaatatttcattatatttgactacaaatgcctgtatgcattctttaatggcagggaatgatgcaaataaatatgaacaggttatcgtacattgtctaaatgtattcacatttaaaatgtaagtaaaaaacaatatgtagcggattgtaatttttcaagagatgaccttaggatgggtgaaattgtcaggggctggcctggtttcccagaataatcctttaaattaagaattctctcattgggggcagtgtatccagaggtggaggaactgaatcaaggatagttttaaaaactggatcatctgatggctgtgtattaaataggtttaattcttttgattgtatttcctgtctgcatctgaggccgtatccactgcagaataataaaatggaggtactggcaactatttgtatttgaattcttcttcttcttttttttttttttgaaacggagtttcactcttgtcacccaggctggagtgcagtggtgcattctgggctcactgcaacctctgcctcccgggttcaagtgattctcttgtctcagcctcccgaggagctgggattacaggcgcccgccaccacgcccacctaatgtttgtatttgtagtagagacagggttttaccatgtcggctaggttggtctcaaactctcgacctcaggtggtctgctcaccttggcctcccaaagtgctgggattacaggtgtgagccgccgtgcctggcctgtatctgaattattgtttccaaacccagctgccttcagcctaaacagtggcaagcacttgtcatcatatcctgaagtcatagacataattatcacacctcttagctgcaaatctaggcttcaccatcagttaactgtttgaggcccttttacttagtaacccaaatacttggtaattgagtatatgtagggatatatttttctttaagattactacgtgtgacatacattaccctggaatagaatgctctcattcacagccatttctgtttaacgtgggagacatttctgggtttttgcttctctctgtctttcctattctgtgactgtcactgctctattggaatcacttttctcctggtggtgtccagtgatctttggatggtccactgaaggtagatacctcccagccctttctgtgctgggactaagatggcacatacagtattctgtagctccctctggccaaagcagaagctatcatcactacccactgtgtaagattcctcctgtacagcagcacccttcactgggtagtgcttagtttttaatctatattttttattctttcttttggatttccaaatataaaaataccaccactactgcctcccgccagcactccgccttgtgaggaaagcactgtgtaactttgttgacaaatgtctgcttaattatgtttaatgattcagaaataaaacagggagaagtcccacattttaatttcaaactaaagactgctagaagccaacagaatttttgtttgcttgtttttgttttgttttgctgagacagggtctcactctgtcacccaggctggagtgcagtggcatgatcatggctcattgtagccctgatctccctggggtcagtgatcctcacacctcagcctcccaagtagctgggaatacagccatgcactatacatttttgtactttttatagagacagggttttgccatgttgcccagctggtcttgaactcctaggctcaagcaatccacctgcctcaacctgccccgatacagatttttaaaatgtaggtgattaataactcacttgtagctctggagctgttcaacagaagttgcaactcaagaacgctatttagtaattaataagaaaagtttggggaaacaaagttctacattgtgctctgctgatctttttctttgaaatcttactgcagatgctgtttctctgcggaggcaaggaggaggaccttgactagtctctgatggggcaaggagtttgttcgattgtgccagtctgaaatatggcaggttagaggggtggagaaagccaagtattgcaggggtaagaaacgctaggcagacaaaccttgtcacgagtttagtgagcccagaagtcaacaaatgagtaggggcaagaaactggcagggcgaccatagatttcatatggttattggattaatttatttttgctttaaaattttatcgagtgagccataatttattgggctgagttgagttttgtccaggggattgaagtttggatttatcccaggaaacagctttcatctaaagtcatgctccagcaaattatgctgattttaaacggagcagcctattaaaaataggtcagatttcaacaggacagtggaacgtttggtttgaggaaactttgagtacatcagtaactattatgagatgttctgctgtgatcacgtggcctgcctgtcatcaggaaagggagaaaatggaggggaggactcttacattccagtcaattcacgtagcctcttgatgccaaaaattagaaaggggaagcatatcagatgtgtacagctcaaattccatttgtacttaaggttacgtaacagctcatagtgtaatagctttggcccgtgtccagtgagcctgtagatattggcggctttgcgtgcttaaaaggcccccatcaatcagtcatgatgcctggtcctacacccagttgccatgtttgtttaagccggctttggaggttgtataaatagtgttagcaacctgctctcccacccttggtgataaatggcacctttaaaaatcctttggcacattcttaggatgcgaaggagtagaactggatccattgacatctttggtggttatcagcctccttctgcatatgttcttgtggcatctccaggagggaagtgtggagggtgcctggggcatccgtaccgccctggcttcttgggcctctgcagcctctgcctgtctgaatcagctagtggagtatcctgcctcgtggaaactggcaagggctgcacaggggctcccaaatgaaactgtgactcaggactggacaagcgaattcgagttcacacagaatggaaaggtgtactttttcccctttaaaaaaaaaaaacacaaagattgctacaacatgttggcattgattcatgcagtcactttttgttctgtacaaacagtggccttggggtagcaggaagagcaatgggcaaaggacacaacctcagtgcaaaagccctagctcccttggaccacagttgcatatctagaaaattaagaaataacttcctcttgttgtgaggttccggcgagatgccatgtgtaaagcacgtgtatcagtgttggacattccactattggtgactgggtgcctgctgtatgcttatcctccaggtagagcttccaggagcaagtgggactgggcgtgtgcagatgtaggggaagggtgttccaggcagagggaaccacagaagcaaaggtgcttgggcagaaaatacaggtgttaggaaacatcggcgagtgtccttcctctggagcaaagaacttataaaggggaacagtgtaggacgaggttggcctggaagtttggggccagattatagagggcctcaaacaggaggctaaagaaactggactgccttttatgggcagtgaggagttattggggtttgtaagcaggagagtagtatgatcagagctgagcttcaggaaaattaatctggcagcaaaatcctgcaaaacctctttggaacaaaaggggtgaaaataaataatttgaaaatttggcagtcatgttttcaaatatgttctgaaatgtgtaagctataatatgtattttgaaatgataacatctttctttttctgttcctgcacagcagccaaattccttgttcattctttatttcttttcctcattccctccctccctccctctctctctcatttttcctgtgtttctgtttctttcattgtttctcctggtttcagtgtgtcttcctttctcactcacccagtccctccctcactctttgccctgttctgtctttcatggttagtggtgttttggaggtgtgtctaaaccgagccagggactgcgagttccaggacagtccttcaaaaaggtccatctgctggtttttgtgcccagcatacccgctgtgaatggactacattactgaaggctgtgaaatcacccaaatttgatcttcaactctcatcatacaaagtatcggtattttgaatttgtaggtgaatcatttgtaattcatgggggcaatgtttctacaattgaactttctggactcatcaccaaaaggttcagtcagcttctgtaacttgtgggttagcaagtggattctatagatacgccccatgtccctgcccaggcaaacttaataaatgtgttcagaccttaggtgttcatggatttaactcacaggtttgtgattctttgtgggttcccctgtgggtctgtggcacagagttgggctgaggtatgaatccgagaagtctactttgcaagacacatgttatggaaaagggtcatttatccttattgttctgcgcattcatgcatttgtaacaatgcttgttaattaaaacattgtgttgtgtctgtgaaaaacagccatcaggtgagagcaacatttagtgaaatctgaaagtagggttaacttgtagtgtgaggctatgcacaggaaaacgcatatggctctccatagaaatgtgattcaagcgaaagctgggagcctctataaacattcttgtatttgtggatctgggaattcaagaaggtttcagatgtatgcctcaggaatgtcaagagtctgctgtatatccaaatttacaaaacagataaattattgaatgactattcaggttgcaaaacgattcttcattttattaaatatttactgcacatttaccctagagaagttctttagtaaatatagtacttgatttacagaaattcagtgcgtatgactgtttctggatatatgtattgtgttaagtgggatcctttctccatagcatgaagaaattttaagataatcttttctccatttgataaatgagtttgtatatatgaaaggcacttgttcagtaattatagagttggttttttaccatgaggaattttgtatcttagatgactaattttcaaaactgataaaaaatgttcctatttgtcgtgttcagccatcagcagtttcactgtcctttggctttggctcatgtagtataaccattaaaaccctgactctgatgttcacctgctccgggactaaaggcctcagattccccattagggaaaggaggataatagtagtatccccctcaaaggtttgggagaagattaaatgaaatagttcctacacctgacacctggtatgggctcaataaatgttagctattattactatttactgttatttttctagtcccaaagatgaggtcagctaacttatgctgagtaatattttatttccaaaggagtgttttttattcaacttttcacattttgattttgttctctctgtggactattgcgcattttcccaaatgaggaatgtttggcatctcacttaaaccgtggcgtccagcagtcacaggaaatgctgccttatttggtgcttggattaaaagtgttctcagagttcactgatttatatccctgtccagctgtaccataacctggtatagttgtaagaaataaaatttaaaaaaggaagaaataggaaaaaagaagacaaggagatgtgttacttgtttgtaaatgtgaggttgatcctgtagctgtcaacagtcctgtttctaggggtagccattgcttgtccagtgctgccttggttccgacatatcctagctaagctctgctccttgactttgacggtccacataggccaacacccacagttaacccacacttactttcccaccattccactttacactctaccaagcacttcactctgaacttgctcatgtagtgacttctgctaggattcctgccagtgctgttcatttacccagattctatctaatcttcagggtccaactcaaagcttaccagatccatgaaggcatccccaactacctgactcctcactgatttcttccttattcaacttgcgtatccttttcagcctgggccctataacagagtaccctattttaattaattgtagtcacaataatacttacaaacatgcacataaagttctctagcccccagaggattttcatgtatattatttctttgacctgtgaggtgggcaggttagatttttttttttttttttttttgagacggagttttgcactgtcacccaggctggagtgcagtggcacaatctcggctcactgcagcctccacctcccgggttcaaacgattcttctgcctcagcctcccgagtagctgggactacaggcgcgtgccaccacacccggttaatgttttgtatttttagtagagacggggtttcactgtgttagccgggatggtctccatctcctgatgtcacgatccgccagcctcggcctcccaaagtgctgggattacaggcgtgagccatcgcgcccggccaggtcagatctttgtaactctgttgtatacagttgcttggtcaagctcatatggccaatgagactaagaacttgaacacaccaagtctaccagccctgttgctcacatatggttttacgtcacttatttcttgaatgttaatattaaatgttaatattatctccttaagtagtctgtagtatttttgatgttgagagagatgtcttttacttcagaacctgttaatggcgtttgaccctgaacccagctcattaaagacttggtccctaatagtagtaatgtttattgaatatttactatgtggcaggcagtgtgctgggctgctttacaagaagcatctcacacagtcctccgagcacttctgtaagacaaaggacattattaagtttaggtttagggaggtttagcaacttgctaagatcagatagatccaacagctagtaagcggctttaactcatcacaaagattggtcatcatgggaaattttttgccctatttttaaaattcatatttctacatagcttaaaagtggaaggtatcgttgacagtgggctgcattgctgggtttgggggcaaggggaagatctgctctgttgagagctcaatgcccagggatggtaaatggagactctggtgggggagggaaagagctagccctttgtcctgttgggattctttactttagaaaagagcagccttatgtatctcttgccagaatttcacattttagttggattaaattatgtcagtaccatcatattctacttaaacaagaggtacaatgccttttctcttaagtgtccttagctctagactcgaatggatgagaaccctggaaatgtggccccaagtagtacaaagaaagactagagatgtctacacattcttatgaatgcgtgtgggattttcattgtgcacagtagtgtatgcctgtttgtcttaatagaaaaatgcttttatattccttgctattgaggaaaaaagatatgatttttggatattttaaaaattgggttgataaaaagagtgctaatgctacattataataagttctgggtccaggcagcctctctctctttgttggtgttatatattgagaacagaaattcatacacataagtgttggggcattccacacagggagatattcagcatgttgccaaagaagtggttccatgctacattttcaggcataggaattacatataggaatttcggtaggtatttcttcatgctgagaagccaagttacttctataatatcatggacccaaagtgtttctgatttcagtaacgacaactgttgctctttattttgacccatgtaaataattatcttgtcttcacatgtaaataacctaactcaaagacttacagacctctggatctgagctcttcatgaaaaactctcaaaccttttcatattagctcttctttgcaatggtgggtttcagctatgaaagaaaaaagtttcctaaataagtcaatttctgaataataaaataattcattgtatccaggtctttacttttgtgttttgagaacatttgttttctcattaaaaaaaaacaattcaacagtaagtttaagaacactagtcatgacctacccagtccttccccctccccatagctagtattcgagtggataaataaagcaagctttcctaggaggcactttttattgcaatgtttctacaaactaatattcaaccactgtctgcattgactcgtttctttttttgagtgtgttgttctctactgaagctgtctgtgccttcaccagcctctgtccaggctgctattctcaattttaaccatccgctctacatcttcagagatgtaagtaccattcttactatgaatggaatggaataataatacttgattaaatattactccattaaataatttacagctaagcattttgcacactaataagccttcacaaataatattataaacagaacaagcaaagatcattaaatggactcatcactaatataaagcctcccagccaactggaaggtcctgtgactattccttcacttgtgtctgttgagtagtttaaaatgtgttgtttggtggtattattgatttttggcttggctgtctctttttgctccaaaccaggatagtttgtgtctacatgacagggcttcaccaaatgttctcatgaattgcgcttcacctcctaaagtgtttctgaaactaactccaaataaaatttcaagcaactaagtacttcactaattgttttccaatgaattgttccaaaccccaacttttctcttttattaaaaaacagccgggtgtggtggctcatgcctgtaatcccagcactttgggaggccaaggtgggtggatcactaggtcaggagattgagaccagtctggccaatatggtaaaaccctgtctctactaaaaatacaaaaattagctgggcgtagtggtgtgcacctgtagtcccagctattcaggagactgaggcagaagaattgcttgaacctgggaggcagaggttgcagtgagccgaaattgtgctactgcactccagcctgggtgacagagcgagactccgtctcaaaaaaaaaaaaaaaaaaaaaaaaaaaaaaaattctagtgatttttctttaaaaatgtgcgtagtttctttattaatatcattgcaagaattttttttttcattcagctaatactcaggtttttttctaccaattttttcaaagtgaggtttaggcgcatttatatatccacagtgataaacactttatttgatgtatttgttctacgcatcttagattgtgaccagtttactctaagttgggtttggggtcatgcttttactgttgttgttactattactgttatctgttatcaattttatttttaacttttaagttcagagatacatgtgcaggatgtgtaggtttgttacatagctaaatgtgcgtcatgggggtttgttgtacagattacttcatcacccaggtattaagcctaggatccattagttatttttcctgattctcttcctcctcccaccctctgcccttccataggcccctgtgtatggtgttcccctctatgtatccatgtgttctcataatttagctcccacttataagtgagaacatgcagtatttggttttctgttcctgtgttagtttgctaaaaatggcctgcagctccatccatgtccctgcaaagcacatgatcttgttcttttttggctgcatagtattccatggtgtgtatgtaccacattttctttagtcagtctatccttgatgggcatttgggttccatggctttgctattgtgaatagtgctgcaatgaacatatgcatgcatgtgtctttataacagaacgatttacattcctttggctatatacccagtaatgggattgctgggtcgaatggtatttctgactttaggtctttgaggaattgccacactgtcttccacaatggctgaactaatttacactcccaccaacagtgtataagcatttctttttctccacaacctcaccagcatctgttattttttgtcactttgataatagccattctgactggtgtgagttggtgtctcattgtggctttgatttacatttctctaatgatcagtgatgctgagcttttaaaaaatatgcttgttattgtcaattttatagtagggaaatttcactataacttttgctgatgtggggttattccgaattttgcctattatcgttcacatttttggtcatgtatacctcaaattttcagtctttaacaaacaacattcctatgagtaaacatattcctgtttaagaagaatgatatttgagtcaaagtcgtagtcacaaagaaattaatactaaacagtgtgactgcctggaagatatgcccgacaaaatgaaatacttaggatgtaaaagtacaggagtagacttttgggtggcttagtatggcagtgttagatgcttgtctttacagaaggaaatgggagaaagttcattgtttttatcatttcatcatgctgtgttaatacttgatatttagaaaattgtacgtgtccaagaaaaactgaaaataatcttattatcccatgatgtttttatataaacctacagatctagacttttacccattgctatatctgtaataagcattatggaataatgctgatgttcttccattctttgatatgcatgaggatatttttaaatttagatgttttatatccaaaacagttccagacactacccgcaaaaataatcaagcttcacgtggtgaagagaacgagggatatgttcctgggaaaagcccttagccagaaggcttaaaaccagatagaaactttaaaaatagccttttgtgaggcaaatgtaacttgctgaaaatcgtcttgcacagttttgaaactaggatgaaccccctgccacccaggagtccaggaccactctgtggtctgatgccaggaggatgtacttgcatatttcagatgcttcatattttgtttttgatgttctgagctggtagagttgggtgcagctcttcttggattgataaaccatgttcccagatgttgaattcaagaaggaatttttaactcttccatgtttaaaaatgatttctatggctgagagctaatacactccctcaaatcaatttgggaaatttttttgagaagaaattgagtctttttcacatttgagtaactttatacacgacgcgcaacatgccctgtaaatatagataggccacctacaaagtgcactgggtgatattttatactgcagatgttctagtttgcacctgatgaaacatgtaaaatgcttatcaaaaaaaatgaattatacagtcccacacaaccgtttgcttggtatttgctaaatttgattcggcctttagatgataaaaatgaaccagtccacagtaaacacttaatgtgaaaagagataacggcaaactggaaactttcttatcctgtcattttgatccatttttgaaagaaagcatcctgacagcaacaaggaaataccagcttggaattcatacctatttgatttggcaaatgtgaataaactattctttcagaggatccaggaagtgaaaacatgggccagtgactgaaaaaccaccttagagattatctgattaactctctcattgtacagatggggaaactgatgctcagaggtgtctaatgagcttctaggaacaagtgagggtgggggctgaaagtcaaaataaataccctgacttatcttaccattccatctcctgctggtcaaatccagctggaaaccaaagggcaagggctcctttctgggacatagaatgggacaaataatggcagagaatagatccgggaaggcagagaacaatcaacacagtgattacagaataaaaagatcctttaggaatgcagtcatctgtttattcagtaaatttccgtatcttactaatcacaacagcatccacgtacacttaaaatagtgcctatatgtatgtgtgatacttgtttacataacaagcttgctgatgtttggtgcagtgtatgggttcaggcttctctgacaacaataccaagaccttccggggatccacggtcttctgcatgggggatttctgcagaaggaaatataacactcaatggacaaatccccagctggaagaggtctctgtttattagtactgctttttgaatataaaatcaactctatcttttaggaagatagctaaatgttgctggaagttggaatgagagttttaattacgagctagacactgtatgagacatctttcctgtgctgcctcaggtcctcttgactgtaatcaactcaggagtcttggctcagtccctgtgaaaactgtcctcatgtggacaaatgccacagctcctagcctcatgtctgccaccctggggctccctgttgactctgaggggcaagactcccaggaccccatggatgctcagccatgtgcaaccaggagggtagggaggtggcactgctgggagatgggaattagtgaagttcttttgcttacccctctctgaacggactgtcctgatgctgcctttatgatggttcctcatgatcccaggctcagttgcactggacgccaagcagaggtcagttggggaacatgccccatcctgttttctctccctccttccctgccgcactctccattgctctccaccctgaataaagtagtggctctgcttcagggaacccaggctgagatagataccagggcctcccttttgggggttctcttttgaggtccagttttcaaaggaactgattgggcaactgcaaaatgagtatgtgaagacattaagtggaccaatttgtaattcgattattataattatctggatacctctttggctcaaaaggcaaatgttgatctgttttaagaacagagaatcataacgcgtagagccctaacctgccttcctagcctcacctgatgccttctcaaccctcatctagggcttattcctttcctttatgacttgccaggaacaagggaagaataggaaaagtcaaaataaataccctggcttctcttgccatttcatctcctgcttgctgctagcttccttctgacaagggagaagtaactgggattcacttttccattttcctagctggatgatccctccctgacaatccagaatgagatgatggtgcccgggcatggggggagtatccacgtgtgctgatacctcctcacctacccttccccagagtagatacacattgcccccaaagaacatttcacagttctttatttccagcagtagatggaatcgggagaagtgtattggaagttttgcttgggatccagctgccttagtctcccctactgtgtcttgttactacatagtgctggtgaccatgggcaacagtgtatgagacatgtctgtagccttaggcctggtgctggcacagcaggtcctctgttcctggctaagtagcttcaaagctggctctcctggaggttctgcgagctgcctgatgtcctttaaatatattttcccctggaaccagctagggtgggttctatttgcaacagaccaagagagcacttttaaaatccttgaaattttatgcgaagtcccaggctttcatttgtatgtcatttagattttttttttcccctctgtttgtcctgttagtgtctctttgggatctccacatctatcaacggattgcttgcattgcttttaaaaactgttgtttacaatgacattcaacacttgtaaaagttatttgctgccaagaggaaactaaatgcattgtaattaaatttatttcaggctttgattactaagaagtgcagagatacatcattcacttgtgcttaatttaaaaagtattttggtcataatacataaattagttacctttgtagtttgcttataacccataagacactcaactggataaaaagctgctggctacaaataagtaaccttgtcatcacatgctaaaggtggctaataggtttgtccctactgccaactataatcaacttatttttaacatgtatagtcacattgtaattgatgtctggaaacctggtttccttttttcctttttttttttttttttgttaacttttatttatagacacatgcatataatttaaaagtcaaatagcccaaaaagacttataatgaaaaacatattcccccaaattccatcccactccccagaggcaagtgtcttctggcatttaccttaatttttctagacaatgtgaattatccagttaggatattccttcttgacttcttgtaaggtaactggattgagcactcctatatcaaccactcccccagcttcactttggcaccctaatcacccccatgtagttacaactgaacttttaaatagttattgtttacattatgactatggaaaaaatagttcactacagttctttcatatgttatcacatatatcactttctaaacatttctatatatctgtattagtcagggttctccagagaaacaaaaccaatagtatgcatatatagaaataggttcattataaggaacaggctcacatagttagggaggctgagaagtcccaagatctacatttggcaagttggagacccaggagagtcgatgttgtgttccagtctgaaagcctgaagtcttgagacccagccaataattcagttcaagtctgaaggcaggaagagacaaattccaacacaagcaatcaggcaggaggagttccctcttacttgagggagggtcagcctttttgttctattctggccttaagctgattggatgatgcccacccaccttgaggagggccgtctgctttattcagtctactgattccaatgttaatcttgtccagaaacaccctcaaagacacacatattattaccagaataatgcttgaccaaatatctgggcaccctatgacccagtgaagttgacacataaaattaatcactgcaatatctttctgacatctatccatttttctgagtactcaaacacataacctaccatttgcattttgctttttcttggaggcctcctacccttagtcttccaccctcctactccagtctggactagttgtgttctaggctgggagcatagctagcatcctctattgtggtggcccctgtctaccacatcctgctttcttggttactgaaagcacatcctctaatagcttctcaagaaagggtgcgagggaagtattgttttagcttctgcatatctaaaatgtgttgattgcaccctagacttgacataattaaaccagttttggaaatcagtgttggaaatcatttgtttcttagagttctgaaggtattccaccattgtcttccagcattctgcttgtggtaagaccaatgccatcctgatgctctttgttttgtgtgtgattgaattttgcctctggatgcttttcaggtcttcggttgatttctggcattccggtacgttgtgatgaggtatctcggggagggcctttgaatatccattgtctcctatgcatcccttttgatgaaccctttcaaggtagaaactcatgcttgtgtagtttcttccaatatttctttgatactttccttctttgtatattctctgttctttatttctggaatgctgttttggacagcatctcaaatttccttgtctttcctattttctgtttttatttttggttctcctttctgtggtatttgctcgactgtcttctaaattctctgttgaattctttaatttttatgaccatgtaatttctaagacctttctagtttctgattatttccttcacatagcattctgttcttgtttcatggatgcactatcttaacatactttaattaacattctttaagaatataacaggatttttttttttttttttttgagacggagtcttgctctgtcgcccaggctggagcacagtggtgcgatctcagctcactgcaagctccgcctcccgggttcacaccattctcctgcctcagcctcccgagtagctgggactacaggcacccaccaccacgcccggctgattttttgtatttttagtagagacagggtttcactgtgttagccaggatggtcttgatctcctgaccttgtgatccgcccatcttggcctcccaaagtgctgggattacgggcatgagccaccgcacctggccaaatataacaggacttttgaagttctttttattttccctgcctatcccctcacctccaagttctttttgtgtttgtgttaaccctgcctttcttgtcaggggctttccccagatggctgtcagcttttagagtatatccatattggacaggtcgaaagttctacgtgcatgtgctgcagatgccctgtgccgtgcagctcagcatgcataggtggggtagttggttgatgagcttttctttaggagaacagattttgagctatctttttttgttggaaccctgcacacaactgtcattatgtagatggttttcctctcaggtggttggttttctccagagaagaacccttgaatctcctgcctgtggaggtggacgtgtggttggtgttctgggtgccccttgccctgagctctgttctccatggtgcctgtttcctgggtctgcagccccttctcagtttctctgaagagtaaacctctcccctgcttggggaggagcatgggggttacgtagtagcctggctgcataacatgggcttagtagctcagttttccatcatgaaccagagcctcatctttcatggttcctgtgcctccgagggctgggctactggggtgtctgtcagtccagatggctttgttctcaagtttcctccacagtggatatgaatgtttgcaacttacactcaattacaacgctttcctctacttttctccaagtttgctgaaatctttatttgtggatatctcctctctttttgctttgtcctcataggttaaaacgttttaaaattccctaacagtaggaaatttagtagggttttggaagggagaggaggtgtaagatggtcactcttccatgtttaactggaagtggaaagtctaggcttttgcttcaggcctgggaggtgcacatgaaacagtccctcccagtggctgcctggggggtccctgaagggtgtgagaccaccgtgaatcctggggcagggcacttgcagtacatgtgctatgtgtttgctagtattgttttagatgtttgatctcctagcctttgcttttctttgtatttttcctgctttagtccatttcccttctagctccttctgttctcatttatcttctgctgctgcttggagttacattttcagcaagtctgtaacacctctctgaaccaaaggctctcaagttcatctttctttctccaagcctacgcctgtgctgctgtcatgagtggcgagcttctgtttcttctgtcttcttgtcagtcccaagtgcccttttacagagaatgcctgtttttcactgtctagctcagttaccaggagtccctgtgaatgacacccacaggtccctcaaagaagtcagatttctcttggacctgataaagcaaacaaaatgtgacccaagcaggctgagttggacgggtcccttcttaccttcgccctctgccatgttgacattcttatctgatggcacaggctgggagttcaggatccacttagatggggtccgttcaggggataccagcgttcacatttttccttttaagaaagggtcttggcctgaatgttccccatccggacacaggctgcatgtctctgtgagtgtcaaagctgccatgaccatctcggtaacctactcttactccacaatgtctatattcactgcagggctctatgattagtccataatgtaaatgcctggcccaagacgtatggcctgagtttatccaaggcccaaacgattaccaaacattcctcttagatagaagacagatttctttcccttggcaaagatcttctactaagatatgttacaggatgttttacattctcttggtcttataataacaccacgcccaatccagtatttgatgcgtcggtggtcactcggaaggttgttattttaaaaatacttattgttctcagtctgcagttctcacagctgtaaaaaaaaaaaaaaaaaatacagtcttgtttccacctttccagagttttatggcacctgggaactgggatcaagctgggactgggtccaagattggggtgggtgagtggcgcttgcgtcagggaatgtgagtgccctgcaggctggaagggatgctctggttgtagccttaagataaacagattgggctggacatctgtggtttcagattaggcaggaaggaaatcatctcctacctggattactcaatatcttccttactggtcctgcagtgatcctgggagggtgatatgatcggctttgtttacagatggatgaaccagatgagtccctaggaagtgaagtgactggcccaggatcacgatgaactctcaaggccaagtttgaacccaggccttctgactccaagcctgtagtcctttcactggcctacagctgcttcctgagcccctttcctggttcagtcaggcaaaacaaaccagcttcctgcgagttaagggggaaaagggtttaatggggactgactcattgagattggcagtcccctttggttaatttcatcaggtcatctcctagcgttccatttccttttgtggagacacagatcagaggcaatctggctctgtatgaactcactttgtgactctgggtgaatcatttccctctctgggtttcaggttcctcattgcacagtaagtatattggaattcagtggttctcaaatctgctggaacgtcagaatcacctggggacattttctttaaaaaaaaaaagccagctctattgagtcacattttacaatcaatgagttttagtaagtttaccaagttgtgcaactatcagcataaatcagtattagaacatttttatcatgtcagtaatatccccatccactcccactccctgccctaggcaacaagtaagctatgtactttctgcccctgtagatttaccttttctggatgtttcacataaatagaatcatgcactgtgtggtctcttgcatctggcttctgttacttaatataacatacttgaggttcattaatactgtagcatgtattgatagcctattcctttctattgctcaataatatggcaattgtatgatatgtcacatgttatttatctacttatcagttgatggatatttgatccagttgatgagtcatgaatgatgctgcttagaacattcatggacacatttttgtgagggcgtatgttttcatttctcttgcgtatatacctagaagtggaattactgggtcaaatggtaactcttatgtgtaacttttcaggaaatagccaaactgtttcccaaagtgtctgtaccattttacattcccatcaacaatagataagggttaccctctggagagctttttaaaaattgtcatttctgtgccctacccacctgaggtctggcatggggcccaggaatctgcattttatgagctccccaggtaattcagatacatctggttcgtggatatgtgtttcggcccactaagaccggatgacctctgaagcctccctaaggcctgttgtctctattagtctgtgcctctcgggcaagacgcaccttcctgccaagtctctctgggtgtttgtctttggatcagagaatcagtacgcagagcagggctgagggagttggccaagcagcgtgcataactctgcgcagcacctgtcctgcattatcctccacactggccaaggctttgtgtccctggcttcatggacataaaattttatcacaggtttttatgtgttatcacattgtaaaagtgccataaaatcaagggtccagttttcagtgcatctgaaaacgtcgtattcctttaagttataatcttggttgcagtcattttggtaacttgttgagaagcctcatcccgaccctgccatttattagctataactagatttttaattgctccgagcctctgttttctcatctgcaaaatgagattaataacatcgacatcatgaagtctcttgaaaggattaaatgagataacctgtgaaatgctactgtaatggacctcagtgctcttttctttcttttggctgtttctgccccatccctgcttccattattatacatcttttcatgagcttattgcccatttatatgtcttctattgtttttaatgaggtgaaattcacatagcataatattaacccatttccttcacatccttgttatttatttttttttaattatatccatcctagtagtgggtgtgaagtggtattcattgtggttctgatttgcatttcttgaatggctaatgatgttgagcttcttttcatgtttttgtgtgcttattggccattcatatatcttatttgcagaaaaatatttattcaagtcctttgctctcctcttcttttttttgtttgtttgtttgtttgtttgtttgtttctgagacggaatctcgctctgtaacccagactggagtgcagtggcgcaatctcagctcactgcaacctctgcctcccaggttcaagtgattctcctgccccagcctcctgagtagctgggattacaggcacgtgcccccatgcctggctaatttttgtattcttagtagagacagggtttcaccatgttggtcaggctggtcttgaactcctgaccttgtgatccgcctgccttggcctcccaaagtgctgggattacagacgtgagctaccacgctcggccttttcctcctcctttttaaagacagtagggtggtctcactatgttgcccaggctggattccaccttctggacttaagcaatccttccacctcagcctctcaagtagctgggactacagctgcacacgactgcaccctgctcttttgcctatttttaaattgggttgtatgtctttttgttgttcagttttgagagtttttttgtgtgttctggatactggaaccttatcagatatataatttgcaaacattttcccattctgccatttgtcttttcactttcttgatagtcctttgatgcacaaaaatttttattttgatggtttatctgtttttttcctttcgttgctcatatttttggtgtcgtatctaagaattcattgcccaaatctaaggatgtaaagatttacccttgtgttttcttctaagagttttataattttagcacttaaatttaggtctttgattcattttgagttaatttttgtatatggtgtaaggtagggttctaacttcattttttggaggggctattcagttgtcccagcatgatttgttgaagggactatgtccctttgaatggtcttggtacctttatccaaaatcaactgatcatagatacaaggatttctctggactctcaattctatttcattaatctatatgtctgaccttacaataacaccacactgtcttcattactgtagctttgtagcacattttatatcaggaaatgtaagtcttccaactttgttcttctttttaaaggcctccttctgttattaaccagccatcccactgttattttgctactagaccggggtatcagctatgtatactgtaaaattagctatacatatctggtgtctctattctttttccaccagatgaggctttatttcttctcttctagtcccccccttagatatttccctccttctgtgagactgagactgacccctggatatgtgctgacttttttttttttttttttttttgaggcagagtcttgctctgttgctcaggctcgagtgcagtggtgcgatctcggctcactgcaatctctgcctcctgggttcaagcaattctcctgcctcagcctcctgagtagctgggactacaggcacacgccgccacacccggctaattttttgtattttagtagagacggggttttactctgttgcccaggctggtctcgaactcctgagcttgggcaatccaccggcctcggcctcccaaagtgccaggattacaggcgtgagccgtgcacacagcccagtgctgaccttttatttcaatcacctcaatggctggagaagcagaacctttgttgttgagtccctggtacaccctcagcacctgcctggtgatctcaggttctgccctgttatttcatgagtctctagtctgagtcgcctttatcttactgagttggacaggaggaacaataaccacatagcagaatgaccattaaaagaggcgggaatgaggtaacatgactgttgatggtactcatctaaatgttttaatatattttgaagttttaaaacttaagccatttgcagttttagtttaaaattcttggtttcttcatagcagcaagttaagaattgtggatgcttcgatattcaactatttacactgtttagagaagaagctgtgctaggagaaaggggagaaaggaagaccactggaggcagccactcctctgttctgggtatttcacctctgctctgaaacttgcaggctgcattgagcaaaagaaaaacaatgtgctttgtgacagcatgcgtgaatgtagaggactttatgctaagtgaaataagccaggcagaagaagacaaatactgcattatctcacttgtatgtgaaatctaaagagttcagttcatagaagcagagagtagaatggtggctataatggggaagagggagctgttagtcaaagggtacaaagtttcagttagaaggaataagttctagtgatctattgcacagcatcatgactacagttaataacatatatttcaaaattactaaaagagtagacttcaattgtccttatcactaagaaatgataagtatcttaggtgatgggtatgttaatttgcctgatttaatcattttgcaatgtatacatgtgccataacacatattgtaccccataaaattcatacatttcttatttgtcaattaaaaataacattgggctggacgtgatagctcacacttgtaatcccagcaatttgggaggcccaggcaggattgtttgaggccaggagtttcagaacagcctgggcatcataatgagaccctgtctctaccaaaaaaaaaaaaaaaaatatatatatatatatatatatatattagccatgggtggtggcaggcatctgtggtcccagtgacccaggaggctgaggtgggagaactgcttgagctcagggttttgagactgcagtaagctatgactgcgccactgactccagtgtggcaacagagcaagaccttgtctcttaaaaaaataaaataaatttaaatataaaattagttttttaaaaaagaacagtttagcaaccacaccccttcaccaagaaacaaaaaaataatgtgtttaaggggaagaaagcagaaggcattttgatgaacctctcctgtcactcaggcatacctctgtggttgtcatgaccaaaggcccccttatcagaggacttgcaaccatttacagagccctccttggaaggagttctggaaaatagtagtttctcttctggttaggttttcttaacgttcaggggctttcaaagccacatagggacagctgggaacttgagatagtttgattgctgattgtgaaggattggcttggttgatgtttttggatcaaatgctgtatttatagaagtttctcatcacttttctcactaaattcctcagcacatattctaggcagggttcagctttttaaactcttatcaatccccctcaaaattatccatgaagatgctgtagtataagagtaaaaactatagtaaaaatctagaatgtataatgtgttctttttgattgcattgtctagtttaaactctcagtgaaatgtctggcaggagaacactatatgagaactcgattaagttccagattaagaaattacaagcaagataaataaatgcattgtgctggcaagttctaatagagcatcaaagtgactttgataaacctcttcctgaggaaccaactcccagcttctgaaatcacagccaggggaatctttttgctgagattttatcgttgtccaaaggaatatgggtttaattagataattttcttttaggacacaagaatttgctaaagtaggtgttgtctggacaggtcctgttttatttaaaataatctgggcctttgctgcaggacaagggaaatttctctgccctaagattattttctaattgcctaaaatttttctttcattacaggttggagggtttttctgttgttgtttgttgttcagcagaaatagagactaaaagcaagagaaaaaaatcagctccagtttcaccactcagaaataacttccattaatattttgttctacacattatttaattttttaacaaaacctatgtatataatgttgcttaatctgtccttctgcatttaacaatatgttgtaaacagcttttaggccaacaaagacctgatttttcacataatttttcacatgatttttccgtgatttttcacggctccaagtatctcatttatatttatcataatatattttattattttattagcatattgctatttaaaacaatgtgactatctttgaacatataccgttgtgtgttggggataatcattctttccatctttgctgttctattgggtaaaaaatgagatctcttctgtaatatgtgttaatatctgcaaggcctagttcccctctagtactctgccttttccaagattctcctagctgttctgggctgtcctttctccagatgaacgtaaattgatgcttctgttttcttttgagaaataatttatttttaaaaaataattttctctgggctacctggagacctcctccggtaatatgagatttgagttacaatgcagagtttcgaagttgagtgtgtgcttagttatacttatatcctgcctggatacctcaagggagatatcctctcttctggccagtggaacttgtagggagcagaggaagcatcactcagtctttgcagtgcatgatgttagatgggatgccttttgagcgagccctttagtgtggggggctcctgggggactgaactccactgcctgatgcccacactggtccaccacagcaacttcagggccttctgattttttggtcagactaggtctgcctgtgggagcaagcttagggttggtttattttgggatctatttctagagactgaggtttgaagtagcatgctcaaacccagaaacgcattccacatgtaagaggtgagctgccaagtgtcgttgtgagtctcctttccctggcagcgttttccatccttgtttgatcagattccatgggcttggggctagacagacagcttctcatcccaggttggagagcacaccagaggtggcggaagggtaggggtaggcagagcaaggctgagacccaaatagagaagaccaggtctgataagcccaccagggaaggccaggagatcaccagaaccaaaggggctgatgcaggcactgagccagaacacacagctggaaatggctgaatcagggacacagcagagcagcagcaggtcccatcccacagggaggctctgggttgctgctcagagccggccccatttctgccttgatgcatgagatgtggccacaccagctgcaaaagaacctcctcacatccacttactttgatttttccaagtggaatggttttgttgggtgggagtgggggtggggtgctgggggcagtgagcaagggaagcaggcaatgcagatttttggatctgtatccaaacatgctcctgcccatgcttagcccagtgggtgcttctcttcctggggccagcaggaagtccgcttggctggtggggcagtggcatgtcatgatctgtcaccctgcttcagctgatagagattatcagctggagaactgaatggtacacaccttcccccttcttccaacaccatggcccccaagatgctgcacctgccgccgcctcatttagccctacaaccccctgccactcaacattatgcagagggcccaggagggtcttgcagtcatctacatacttccctgcgagttcttggtttggtccctagaaatggcagcctgcatgtggagaaggctgcatgcagcctcaggcctgcccacccgatacgaggtctgcatgtatgagttgtgtgcatcacatagctcctcaccatgctttcctacccaggaggataagctttcctacccaggaggataagctttcctacccaggaggagactcaaggcaaaacactggaaactgtgtttatacaaactccccaagtgattctggcagccagcacagaatgactgtgcacagacactcaggcatcactagctctgggcgccgcgcatttgcctgcttcatccaggacagtggctaacacttcaggtagggcccacatacactcagaataaagagctgcctggtcaggaggggggcagtcagcatgggctaagttttttacagatctctggcagacagtgttgtctgctttggctaaagagggaatgggaaggcaaatgacaaatggcctctaacgttgcaaagaataatgtgttatgtggaactcagacaagccagttctatggagaaagcagtacattgaggatgagatttctgcttgtttctttttgtttttggaggaaaagccagggctgtgggcctgacagaagttgatatttgggtcttgaatgtgttctcttccagaatcttctctttccagttttcccagcttactattgataccattcacagaagtcttgcattcagtgccctctctaggtggtacctccttataaactgggccttatgctggcatcttgggtccttggaaggatagtttcctggtgcgctggattagtcatagcctattgtagtgactctggcatggttacctcaggaacaccaccagacaaatatagaccctttaacactggctggcccttgtgtctccagacccctcccaggagttcctcacactaggaaccttgggctgctccactttgggtcacaaggacccctttgcctagcccaaagcaggcctctttggttgcttttctctggtccactctggctatgaccttcaggatcagagggcaagaagtcgagaaggacacgtctccaagatagagcactaagagctaatgggcagaactggctggagctgcttattcttggcctttttatgggtgagatgcctctagcagtgttggacatctcatcccagataccaccaggaggtgagcttgctctgggaggcatattgaaagggctgcaccatgcaaaggtcaggaactctctccactgcatgaaacatggcacaagctctggcccatctggctgtgaccagctgggcctttgctcagggctgtctgtgctgctcctcaccaggtgaggagtgaaggggaaagaagaaggagtcttgtgctcctttcagaggttggacagtgccatgacactgttcaaactgtttagtttctctggggcttctgcttggagtttaagagagacataatttattctgaagtttgccatggagagaatagcatctctattccaatgtagtcataatatatggtatcatcctgcctatttaaaaatatgtttggtagtaaaattttcagtcttattaaaattttagcccaaattcttttcctcctttcttgtttttccccaatcggaagattcggtcggtatttcccccaggggaaacacaagaacattacctaagaactttgaaattattttcagagaattcaggtgctgctggttttgaagatgcctaaaggagtttccaatgttctccaacctcgtctatggtaaaataaattccaagtaagagattccttccaacaaaaagtaaccaaaatgtgtatttgccccatcttaggtaattaaactccctaacagacttgcagatttaggcaaaaagagtggtagaatataaaagctcattaatcatcctggcatcatgagctcatattgttatgaaataaatatgcttactaaatggatccagatgccatcaaatacatgtttccaataaagactattttttgttcttgcccaggcaataaacacacgaggcttgtttataacacctcttttccgtgaatcacagtggtccatccaacacatattcttttcacctctttccctggtgaaaagtgggtacgttttctgatgaggattctggggaaaaccctaacgaggtaggagatgtttccctgtaacccagagctgatgggtgataggaaaatggaaatcacttggctaatcgtataccaacatggaagacatttgtctctattaatcttcttacccaacacatcaaagtaccaatttcaatccaagacagtaccagtccccagaggacagacttgagtctaagaggaccccctgcgatctactctgtaaggatggaatggtagaaagatgaagatatattcaattatcatcaaaccccaggctcttgatgtgggtgagctgtcttcccaagatcacccccaggagttggctcaggactggaaagcagagggggcccattggagggaggatggagttcatagtgagttgagggcagtagttaacgtggggttggagccagacacatacaagttcctatcctgattctgccacttaatagttatgaccttcaacggtattctacctctctgagtccgtttgctttattcaaaaactccaagttgctgggaggataaatgagattgttattgtaaactgcccagcacctaagatgcactaagatgtggtagctcttatcacccttcctagaaaggttattccggatggggactgatgctgtccaggagaaatggatgagtagagggaaagctgtttgttcttaatagtagaatgaaactcacatgtgtcactaaccaaggggcctgccctgctgggacaggcctccccttatagcccactccaaatctatccttctcgagttcccactcactggaatctccagccttccagattttctgggacctggagttggccagtcaccaccaccatcctatgcagctttccctttattactggaggaagtgtgaagataactttttccctcaaacgattgtaaagagcttaaaggcattaagatgagagacgggccaggcgcagtggttcatgtctgtaatcccagcactttgtgaggctgaggtgggcagatcacgaggtcaggagttcaagaccagcctggccaacatggcgaaacctcttctctactaaaaatgcaaaaatcagccgggcgtggtggtgggcacctgtaatcccagctactcgggaggctgaggcaggagaatcacttgaacgtgggaggcagaagttgcagtgagccaagattgtgccattgcactccagcctgggtgataagagcaagactcttgcctcaaaaaaaaaaaaaaaaaaaaaaaaaaaaaaagggaatggtattatatattttttgatgccttctcttatggccagtatcttactaaactattttatctcattttcatcctcataataacagaggtcacacccagatttatctttcttcaaagcctgtgctcatttcagtacactctctgcttctcagttacctttactgagaaattaaggtaaacaaagcagcaccaatgaaaaaagggtttggaaaggaagcatttgtgttttataaagtatgggtgtctagtccactagttcagcaattttctcaaccctggtgtctgttagagccatacatctctgaaatcctgcttgaaagagaattctgtggccaaataaagtcaggagtgctgcatataatcttaccatcttgacaatgcatagtgcagagtatcattttaaaggttctgagaagtcctgcagttcaaaacaaccccaaaacataaaattgcttaaccttgtgtttgccaaacatattatagacccctgtatgatatgtgaaacatgtattaatatccttgttgcacttctccttcacagagcattctttagaaataccagtttgaagtacaagcataaatttctcaaattttttaattggcctcatgtcccagtctaggagaatattcaggcaccatcccagaattttctgccttgtcctctctccaggtcttgctctgcagtcctccctcaagccatactcttggggaaaacactttccttccaggctttgggacaaatttgccttccttgttcttggggattcttcggagctctggcctgtgaaagttgctcttcttgactgacaccccaacttttctggcctgttggtggctgaacacctcctcactagccacgtgttaaggctggctcagtaaatatgcccaggtcctccatgatgggaagttaggttgtcatgtagccatagttatggcggtggctgtgtgacctctgtgtcaccgtcttcccacatgtaacttggtattatacccagtttctacatctgtgtgattgatgtgtatgttaagtacattggatgtgccagcatactgaatttttaagacctaagtgtgtcaagggccctcaagatcatcctcagccttgatgatttgctaaaagaaatcacagtacttaaaaacccattcaggccaggcacggtggctcacgcctgtaattccagcactttgggaggctgaggcaggtagatcatgaggacaggagttcaagaccagcctggccaacatggtgaaaccagtctctactaaaaatacaaaaattagccaggcatggtggggggcacctgtaatcccagctacttgggaggctgaggcagagaattgcttgaacctgggaggtggaggttgcagtgagctgagatcgcaccactgcactctccagcctgggcgacagagctagactccatctcaaaaacaaacaaaaaatgctttcatactcacacttatggtttattacagtgaaaggatacaaataaaaattagcaaaaggagaaggcatatggagccaagtccaggagaaatcaggcacaggattctagggatcccctcccagtggagttgcacagggatgtgcttaattctcccagcaacaatgtgtgatgatacatgcttccccaccagggaagcatgccagagccttggtgtccagagtttttactggggccagtcatagaagcatgcagcacctgtgtgactgacctctagtttctcccaacccaacctcctctaccctccagcaaaaacaggcattcaccctgaatactgggtggtctatgttctcagacatacaaaaacactcttatcaggacagtattccaaggacccagaggttacctcccaggagcctccaagggtcagtccttgaggcaggcctttctctggaatatgcaaggtttgagcatcgcaggcctgctgagttagctttttcttaacccttccctgcctactcgggtttaacttgtccttttaagttgctacttttcttagaatgattgaattcaagtcaaataacaggttcttcacattgattctttttcctgctagggtgcttattgaaatatggaagacaatatttgggcttggtttgaaagatcaggagagccctgtctccttccttgctttttattttgttttctttattttttactgaggtaaaattcatagaacataacatagccattttacattgtgcagttcagtggccttccatgtgttcatgtggatcagttcttccttcattttaattgccaagtaatattccatggtttggatatatcattttgtttatccattcctctgtttatggacatgggttgtttccactttttagctattatgaataatgctgctatgaatattcacgtgcaagttatcgtgtggccttgggtatatgcctgggagtggaagtgcccagccataggataactccacagttacctttttgaagaactgctaaattgttttccacagcagctgcagcattttacatttccaccagcaacgtatgagggttccaagttttccacattcttgtcaacctttgttattgtccatctttttaactctagtcatcctagtggggagtgaagtggtttcttgtgcttttgttttttggagactcacttcattgcccaggctgcagtgcagtggcactatctcggctcactgcaacttccgcctcccaggcccaagtgattctcccacttcagcctcccgagtagctgtgattacaggcgcatgccaccatacccagctaattttttgtattttcagtaaagacagggttcaccatgttggctaggctggtcttgaactcctgagctcaggcaatccgcctgtctcagcctcccaaattgctaggattacaggcataagacaccacacctggcctgttttattcttaatgactaatgttgagcatattactgaccattgtatgtcttctttggaaaaatacctattcaaatcctttacctatctataaattaggttgcctgtctttttattgttaaagtgtaagcgttctttatatattctgaatacttaccagatatataatttgcagatattgtcttccagtgtggggttgtctcttcactttcttaatagtgtccttttaagcacaaaagttttaaattttgatgaagtctaatttacccattttttctttggctgcatgtacatttgatgtcctatttgagaaaccattacctagtctgaggccataacgatttacacttaggtttctttctgagatttatagttttagatccctgacccattttgagttagtatttgtaaatggtgtgagaaagtggtccaacttcattcttttgcatgtggatatccagttgtccaaccacaatttgttgaagagacgatttttccaccattgaatgatttgggcactcttgttgaccgtatatgtatgggcttgttttctgtttctttcttaataaaaagatatacttgacagaggaaggtgtggcatgcaggccgtgttacacagagaatatgggctgcctgaaacagccccagtgctgacctctgctactttcctccctacctcatgtactcgcagatggacacccagcattgatggctctccacctgtatagcttgtcttcaccctgcaaatatttattattcatacagctcctaaaaggttggggaaggatgtcagctgacataccatagaaagctatcagttggataatgctagtattaggaggtgattttcaaaccgtggtccttggtaccctgcctcctctaatccaagtacttctgctattatgattttacctacctatctgtcttttagcatgttttcattttaggaaatcagcacagaccttatgattctcttacactgtgggactaggagagatccattagaatccagtttatcactaagttgaaaggatgcctggaacatatgtaaatgtctctgtgggggccaaggaaacttcccctttgccttctgaaggctcattgagaaatcagctcacaaaagccagattaattggagaaacatgtgtacataggtcccttcagaacgaagacctaaagatacagggaaaagtgtccatatttttaaagtatccatttttatgcttaggttcaacaaagtatggacagccatgtagaaacatggttgacaaaaaggatgtgatctaatgctaatagactgagtgggggaaactcagcagggcctgcctatctagattcttcttggcctctctaagcttgcattcattccttctgggtgacctctctggaatggaggggggttcttatgactgtcaaacaaggtaggtcagataatttctttatggccagtttttacacagaaaagcattgggaaagttagaaatatatttttaggttttatggttggctttggggaaaaggggttctggtttctatgacccacctgggagaagagggattcactttctctgtctagccttggtggagaatgggactgagagacaggggggcaggagaatgtcaaagaaaaccttttacttctgaggccttcgttttggggtgttgtttactgagccccaacatctcccccacaacgtgccagttattccctagcctgttgtatccgctcagatttagttcagtgttaagtagcagagacccaaaataaagtgacttaaacatgacagaagtggattaaaagtggctgtgctccacacagtcctcagggcctggagccttccaatttcttaacttctatcccttgggtttggtcctaattttaacattccaagaggccgtcaaagttctaaccatcgtatttcaatttcaagaggcaggatagagaataaaaagggaggacaatgagcaaaggacatagacctgctgtttgttaacatagatttccagggagttgtcataggccacctctacttatattgcattggccagaagtgcaccccagtggcaacacctagcttcaaggaaggcctagaaatgtcatcttagaaggggatagccatgagctcagctaaaaagtctattgttttggaagataatgggttttggaagacatccgacattctctggcatgggtgcaccatttgaacagcttttagaatccagcctcttccaaggcattttttgaactaattagaagagtgctgtgctccctgcccctctttgtctgatcccggggtttcatggtgcagttgctgcttcactttctaactgtgcactgatccttgccttctgcttccacatgtcctctttctagacttacagatgacaaacctagcattatatgttgatatcatgtttcccttttatccttgtgtatcatataataaaatctgttttcacctgggtaaatggcaccaccatctacccattgctcaagccaaatgcttgggagtcatcctgaagagcggcctttctctcgtcactcctcttcagtctgttagcaggtcctgtcttcttttcttcccatgacctatatctgtcctcctctttccacctccatgctgtcaccctagtgcgtaccccattgtctccagctgggcagctgcagccaccctcatacctggcctctggctttccctcctgccaacccctccccatagcccgtgctccacacagcactgaaggcagttatcttttgtgacactgtcctactgcagaccctccgtggccttcctgttgtgctttggaaaaatccagagttctctttgtttccctgccctctgttctggactgtatagtgctcccctcaaattcatgttgagtcctagcttccagtacctcagattgtaactgtatttggagataagacctttaaagaggtaattgaggccgtctgtaatcccagctactagggaggctgaggcaggagaatcgctggaaaccgggaggcagaggttgcagtaagctgagatcgtaccactgcactccagtctgggtgacagagcaagactctgtctcgaggcagggggtggagtggggagtggggggagggtaattgagttaaaatgaggctgccagggtgggtcttaacctaatctgactattgtgcttttaagaagaggagattaggacatacagagacaccagggctgcatatgcacatctgtgagctgaggagagaggcctcggaggaaacgagtcctgcaggcaccttgatcttggacttccagcctccagaactgagaaaataaatttctattatttaagccacccactctgtgatatttcattacggcagccctagaaaactcctctaacctgccaagccacacatgatcatataacctgccaagccacacatgatcagttacctctggcctcataccttcctctgccttttctcactccactctagcacgactcgggctcccactccccacttccccaccaccccacaggacctttgcacttgctctttgtgcttctgggaatgttctgacccccagatcttcctatggcttcctcctcattattcaggcctctcttctgattgtccctccctgcaagagaccttcactgtcatacctcaccactcaagtatctgaaacttttggagttggtttacttattgccctagaatgaaagctctgcgagagcagggacttcctctgtcttgttcactgccacgtcttcactcgctagaacagtgcctggcatataacggcacttaatgagtgttcattggaatgaatgagtagatgtatgataaaattaaggtttttttcctatgtgtttatttatatcagtatcatttatttattgatatcagtatggacccatggatatttattttatactttgggctacagttcacttctactttatttatttattgctcaagttattcaagccttagtcactgaatttagttggcccctggtatccctttggcacaaccccgtcattctgtgtgtgtacatgcatgtgctcacatatgtgtgtgtgtgcatgtgttcagtatttccttactctctggcactacaagatgctccaggttcatgttggacattccctgccccagttatcaaatcagccatttcttcaaggagctctggtacttttgtattttattttttgatatttttattttgggggaataacacacactggagcttgctgagggagggtcgggggagagcattaggacacacagctaatgcatgctgggcttaatacctaggtgatgggttgataggtgcagcaaaccaccatggcacacgtttacctatgtaaaattagtttcaatatatagacaatttcaaaatcttaaaaataatgctttgagggaaggagagactcttttcgtaaaagtgtttcttaggagaagcatgtcattttttactttttgattttttcatacttacccctccccagaagcagcggacctcctagctgtgtctcgcggtctccctccatctccgcaggtttgtaccgactgggggctctccgtagctttcatgccattgctggtatcattactggcatcaattgttcctgttagaatgagggcttaggtagttagaaaaaaacacagcatgggctcctactaacaaaagcagattaaagccatcttttcagttaattagttccaatgctctgatacggatgatgaggcataggaaggcttttattggaggaattcttctgtccagaggggctttgaaagcaaatgtgctgaaagtcctgcggcttttctcagtggtttgagaatgtttatcctaagaagtgtttctcagtgagttggaaaagatcattttagccatatgattatagccttttttaaaggtttaatagttacagtttactgagaaagaggttgaattatatcttgatttttttttctcttttgtttgatttaggctgaaggaacttatctcaaaacttagcctggtaatattaattttgataagttactataagaaaatattatatttttattcttttttttaattattggcggcggagtctcactctgtcacccaggctggagtgtagtggctggtctcagctcactgcaacctctgactcctgggtccaagcgattctcctgcctcagcctcccaggtagctgggattacaggtgcacactaccacgcgcagctaattattgtatatttagtggagatggggtttcaccatgttggccaggctggtcttgaactcctgacctctgatggtccatctgtctcggcctcccaaagggctgggattacaggcatgagccacccactgtgcctggccatttttattcttttaaaagagaaaagtacttgtgctttcagcctcagagaaaccatgcctacaacataatcttattatttgtatcacaaagttgtgatccaagtattgccacaccttggttcagtgtgctgtagtgcaggttagatattttggatgctaaatacacctcttgtagcaggttttaaatttctgcaacagactcaaagagaaccattactttaaaaatatttctattttaaacaaatgtaacttagtatgtcttattttcaaagacagtagaatataaacttacactgtcaagtattcttatactttcactctcttatctagtttaaaacagttttctggggataatttttctaaagattcaggctcatagttaattcaagctccagggctattttccacctggggttctctgcctcctgcccccactcccccaggatgacctctgcaatcaggaatatgttgatggcagtggtaacagggaggactattagaacactctctgccctctgggtccttgttggcatcctagaggtgccctttgtcctcccagcatggcctgggctgcctgccttcatctctcctcatctctggctgatatacctgcattcacctgtgctctgggctggctctaactgtgcaactggtgaccatccctgccttggctttcagccagtctgtatccttcttgcccaaaacctggacttttaattgtccacagacccccttcacacttttattatgacactgagccttgcatgaactggttcacctctctctaggctgtgggaaaccagggagatatttcaaagcctgcatgacactccgtcttctctactccaccatggccacctcttgttaatgtagggcacacagcgggtggtcttctcccagaattccaaatgggaaggaaagcacccaggataggaggtcagctgtgtcctctgtggtcagtcctccaggctccgcctccttgaaaccaacaaatatatttttattttcttttgaacaaagcctgattactgttactgaggtggcggcggggaggctttgtttgcagataaatctctagaccagggatttagaaaacactattttaaacttcaaggattaggaatgactcccttgttcaaagttgtatctgtccttgctgtgaaggaggatgtagatgcttcagtttcaggaggtggagagatttggggaaataggagcacaaggaataaaaatatatcagattgtatttcaccaacacaaaaaaaattgtccttctatattcttagtagtagaatctactgattaataacaaatgactatatatatagcctcatcctcaaaagtgaatgtaggatgactttcaaattagaagtcaaggtgaatgagaggtaaaatagaaattacagaggaaatcttagtaagacttttgggttcactgggtatgagcagagtaaggagttggggataacttcaaagttatccctgttagcctgtatggaaatctgcttgcaaaacaggctcttggctatgactgaagttacacaccacttgattcagctgaaacagtcatttatgtctgttgccattcctgtcctctcttctggtcttcattctcacatctccaacttctgctaaacagcccctcctttatataactcagcttgacttcaaattaagtacatctaaacctaaacccatcttttcaaaacaggtagacattgacaaaccttaacccccctgctccaaccaaggggttacattaagacgatactggtgggacatcttcagtcacctattttacaatcttgaagttatccacaaggcatgatggtgactggcccacttttgtggaattggtaggccaagcacaagtctacctttgtttagggtgagtgatacaaaattgtcactctacagagttctaggtgtcatttggctccttaaatatactacacaccaacctaggccttaggcccattgctgctagggaggggtacccatcatgctttcaggcctggcttagtggctgaaggcctagatacaactgaacctggggcaagcttcctcagttccagcagctgaccagagtggggctccctggacctgggaaaggctgggcccccaacaagcagcagggtctggctggaagatttatgttccaagcatctcagtggagttctgagaacacaaatgtaatggatcttagggccgaaatctgaggactgagcccatgttgggaaaataccaaagtattatactttgtagttatcagtgggacctaataaaccattgtcaatgctgacatttatattttcatgtgacacaaaatgagccatgggaactgcctttcaaggttgcttagaaagtggttggcagagcctgaagttttaaaaagattgggtgggatataaatgtttagacaaattagattgcctaagtgtttgctttgtataataatagtctgaataaactgctaagggagaattttcagagctggatattggtgtttaaaatagtcaacatacaagtgactaagcctccactcccttaacctctgaaacatatttgtgatggagagcattagaagtgaggagtagccataaaaggaaaaaggttgtcgtcttctgtgaacccatttctgtgtacacagggtagaatgtttttgaagatggtgtattagtccattctcaccctgctaataaagacatacccaaggctggtaatttgtaaagaaaaagaggtttaatggattcactgttccacatggctatggaggcttcacagtaatggcagaaggtgatggaggagcagaggcatgtcttacatggtggcaggcaagagagcatgtgcaggggaactccccttttataaaaccatcaaatctcatgagacttattcactatcatgagaacagcaggggaaaaacacacccccatgattcaggtaactttcactaggtccctcccatgatatatggaagttattacaattgaaggtaagatttgggtggggacagagagccaaaccatatcagatggcaaaatgtaccctttgggaagttcgttttttcacatgattccaaggaagaggctgcctgtgtagggggacagtgggatagttgaggactgggaatggtctggcttcaaatcctggatctatcacttagtattgacatttgacaaattactcagcctcttccaggtttattttccacatctgtaaacatggagaaattcataatacctaccttcatagaattctcatggcattaaatgagatacactacctaacgcagttgattagcaaatgcctggtatttggtcggggctgagtaagtatcagtgtcccttgagatcctcactgctgttttattaggtgaggaggtggtggagcttagaatttatatgcccaggaggatggtgcttcttgcccaacacccacctaccagtggcttttggggggcagtagggaagggaggaaggattcagggagcatggagttacttgttcctaatctgcttggtccgcctttgagggaagtttatgaagaacagtcccacttccttcccaggaggcatgccatgagccagagataaggcagtgaatttgggaagacagagattcaagacaactgagcctccaaagtcaccacagactaggagagaggcagcatggatggcccccagaatgaaggccgaggatgtcaggggtggagacagacagagagccagggaatggcactaggcataggatggagcatggtttgaagtggagttagtttggtgttttctacacctgggacatttgttcctttaccacactgagagatggaatcttagtgggaaggaaccactatttgtcttttactcattaagttcctagcccagcataaaggctcctggaataagtatcctaatgggaaaagctaaagcctcttggaggcactcagggtttggccacagtcattgatggttcaagagttgttaaggtgattcagaccaacacaaaccaggggcctgtagctgaggctgggactcagcccatcagcaatcagaagggccagaaccacactggatcatttcattctgggttggaaatgactggaataaagatcctaggggaagcaggagcaatgaatctaagacttagaacagaaggagcacagacacccaggttacctgaagaagagtcagatgatgccaagtgtgaacctgagaggcaggagggctggggaggcagagtacagcagtggagagaacactgagctgagagcgggagccctggccctgggtgcagtacgattctcctagcttggggtttagctttggataatttgttttatttctcagagtttcagtttcctcagtttcaaaatgaggatgatcatgccttaggtcataatgttgattaatggcagaacttgatttagaaccagatctcctggaagtaacaattacttgtgctggacattggtgcttgcaaaatacttctcttaagtgatcacatttgatgacatttgtttcaggcctgtttcaagcacaccataatcaggactgagcaccttaggacactcctggtatgtctaatcagggaaatggggaacaccacaatgttgacatcaaggattctaaagtctattattattattatactttaagttctagggtacatgtgcacaacgtgcaggtttgttacatatgtatacatgtgccatgttggtgtgctgtacccattaactcgtcatttacattaggtatttctcctaatgctatccctcccccctcccccttccccccaccccacaacaggtcccagtgagtgatgttccctgccctgtgtcgaagtgttctcactgttcaattcccacctgtcagtgagaacatgcggtgttcagttttctgtccttgtgatagtttgctcagaatgatggtttccagcttcatccatgttgctacaaaggacatgaattcatccttttttatggctgcatagtattccatggtgtatatgtgccacattttcttaatccagtctatcattgatggacatttgggttagttccaagtctttgctattgtgaatagtgctgcaataaacatacgtgtgcatgtgtctttatagcatgtgtttttctttgttctgattctgaattgccctgttggtggtgctgccctgttaaaagtcagttaggatggccctgaatgtgagttttgctaggctattaatgaccgtttatttggccaacaagtgttacaaacacgtgattaagcaaaggtaagcaaattctttattacaggagttctcagagctcttactgtactgacatgaattataaatctttaaaaggacggtatggtaactagactccagcaaaagggtcatagaaccatttttaaattggtggttgttgttagatctcttggcactaacattcttgaaaatatgcttggggaaatgctaactcagaaattaacgtttgctgaacccagagtccactgggttacccctaggtgaacttctagttcccgaagttggcctttggatgagtcatcttcccccatcaggttcaactatgtgaggatcattctgcagtcactcatgataaccatttctcagtttaatggtacaattccatattgccttacattttatataagttgtaagctcataaaacatctttgtatatttggaatgtactaaagactgcaagttaacccagactaaaacaacctcaaagttatttgcaatcttctgaacatctccatattacagcaactgcccttctcacgagcaggtccattttccttttttgatgaggatactagcttctggcaagctgaactctcctttggatcacaaactttccttctcctaaaggtcccagatgttactaagatttaaaataggtcagctcacatttttggccttttcatacaacatagcccacgttagattggtaaagagacagataacacatagaaaaaaagatccaagtagcccaagaaagcctgttcctggaacgtgatcaaactttttgctccatccatacctttcctcacaaaagctttttcaaaaatgtgggactcgcactgcttgtcccttgattttagtggaaccaagaaaccgcatcaaataacactgaatcctagaatgagaaagtcattcctttttcagttctctttcaactccagacatctttttttttcaacatcaaggaagatgttatgctagttatgtctttaacagttctcaaattgagctagtcttcaattgtgtctagctaggatttaataacatggtttcattttcttttgtatttattttactataactttttatccatggaaagtgatgtagcttttccatattccatggcaagataagattcgttttgaaaataaacgttaaaacatttaaacagagtatattgtgaagattagaactgctgtcataacagctgccctgtaaccttctaaggttgacccaaaacacatgattccccgttttatagatgtatcagctgagactagcagagatgaaatgactgcctcagtgatgtgccagttatttgactgaaataaccagagctggacctaagatcttctgcagcttcatgtactccctctgtaaaacttttgttatcaggccaggcgcggtggctcaagcctgtaatcccagcactttgggaggctgaggcaggcgaatcacctgaggtcaggagttggagaccagcctggccaacatggtaaaaccctgtctctactaaaaatacaaaaattagctgagcatggtggcaggcgcctgtaatttcagctactcaggaggctgaggcaggagaatcgcttgaacctaggagacagaggttgcagtgagccaagatggcgccattgcactccagcctgggcaacagagcgagattccgtctccaaaataacaaaaaaagctttagtatcagccttctcttttaaaacataaggttaacagaatcttttaaaattgttttcccttccctgcagcattttgaaatcatattctaagaatagatttatttaataactaagttattaaaatattaaaagcagttatgaatgtgagagtgctgaaataaatgtaattgcattcttaaaatgctgtaacatcagacaatttttttaagttaaaatatttaactgaaaaacagctgaaacaacttaagacctattaaaacaacaaatgggctaatgtgagcaatatttaaaagaatattaaaatattatagtcaattcaatatgggcaaaaaattttactttcttaagaccctgaaaagcagcaaaaacaaataaaagccagagtcaacaattgcaaatattaacaacaatcaaagaccattagaactaaagggaaaatgtagaactgagtaaaatgatcacatggacttaaaaaaaaaaaagtgggtcaaattaagttgaaaacaagcttggagtacattaaaatgcacctaataatggttttttaaaattcattgacgtttatacagtgttatggaatttagcctggaaggtatcagtgactttttaggaactttgaggaaatgaccccttggtctcctgatttgtacctgctgacttgcttgctagaaaacaggatttccatgagttgaagagtctgagaggctaagactgtaggcgggccacctagacaacactcaacccttgctggaggatatttggttattaaaaccatccagaaaaatgtgtcagaaaaaagtgaggaaatttagtccaaggaacagatcagaaaaacttgctaggcctgttaaatcttcgtgacttccttctgttttaaattttgtctatttggcctgatacggggtaatagaattctaaaaacagaaatgtattcgttgtctatgactgcataacaaattattctaaaacctagtggcttaaaaacagcaataaatatttattatcttaaaacgtttctataggtcaggaattgagaagtggcttggctgggtggttctggttcagtgtctgtcatggggttgcagtcaggttggctggtgctggaggatggacttccaaagtagctcactccctggtgctggctgtgggcaggaggccttagttctctccacatgggcctctccacaaggctgcttgagtgtcctcctgacacggtgactggccttcctcaaggcagccaatcacagaggccaggtggtggccaggcatggtggctcacacctgtaatcccagcacctaaaaggcttaggtggggggatcacttgagcccaggagttcaagaccaacctggataacatggcaaaactcagtctcaactaaaactccaaaaattagttgggtgtggtaacacacacctgtagtcccagctactcaggaggctgaggtgggaggatcacctgagcctgggaggttgaggctgcagtgagctgtgactgtgccactccactccaacctggttgttggagtgagaccctgtcttaaaaaaaaaaaaaaaaaaaaaaagatcgtagtcttctaatccttaacctcatcttgaaagttatgaagtgcttactgtcatcattctctattggttacacagactagtgcagattcagtatgtgaggagaccacccaaaagcatggatactagaaggcgccaatcgcagggggccatttcagaagctgactaccacaaccaaggattaaaggtcatgaagagaacatagaaatctcatgttcgcctgtgtccagccttgcaggaggaagtctaggaactagacacatggtagcagcttagaaaaggagaaagaaggagcttaagccagtgaggccaactgaaaagaaactgggattgttcagagagccagtgggggcaggtagaaaagcctgttccattctctcaggttccctgaaaactggttgaagagctgcaggggggtttgggttccaggtagtcatcttgagcttaaagctgtgggtgccagagcagatccttatcattaacttgagtgggtgtcccgaggtggcaagacacaagcttattgataggaagaaagataaaggatgaagcagcaaaaatcaagggctgcctatatattcctttggcagaacaccagagtaatgcaatgatctgactcttagaaacagacacagagttgtttttctcataaggaatgtatttatggtagcaactttagagaatgcagataagcaagaagaaagtataaataatctgcaaccccactattcaaagaatgctgctactattatggtttccatgttttccagtgatataaatgtatcattctgtgtgtgtgtgtattattgtgtttgtgtgcatgcattttaccaaagtcgtgttgcacctctgtaacttgcttttctcatgcggcactcatcttcagcatctgtctctgtcgtgagtgattctactacagcagtgtttcccaaccctctcttcattactgctcccataggagccttttgaataccaccatgaaatgttaataccgcaggtatactctgtatctgtttatatattggggtcctttggaaggtagcaaataattgtgatagctgttttttgtgttcttttttttttttaacctcccaacaacaaacgtttggccctttgacaacgcatgcacgatagcgccgtatacagctttatagtatttcattatatgagtgtgcaataattttttaaaaatatttttttatttcaatagcttttggagtacaagtagtttttggttacacagatgaattgtagagtggtgaagtctgagatttgagcccacccatcacctgagtagtgtacattgtacccaatgtgtactttttttcttccttgctctctcccatcctccccattttgagtctccatagttgattatatcactctgtatgcctttgtgtacacacagtgtagctcccacttataaatgaaaacatacagtatttggttttccattcctgagttacttcacttggaataatggcctccagctccatccaagttgctgcaaagacattattttgttcctcttttatggctgagtactattccgtggtgtatatataccacattttctttatccaatcattggcctatggacacttaggttagttccatagctttacaatcgtgaattgtgctgcaataaaacatacatgtgcaggtgtctttttgatataatgacttcttttcctttgggtagataccccttggtaggattgctggatggaatggtagatctacttttagttatttaagaaatctccagactgtttcccatagaggttgtactaatttacattctcaccagctgtgtataagtgttcccttttcaccacatccacgccaatacctattgttttctgactttttaatggccattcttgcaggagtaagtaggtatctcattgtggttttcatttgcattgccctgatgattagtgatgtagagcattttttcatgtttgtcggccatttgtatatcttctttaaagaaatatctattcacataatttgctctgagtgtataatttatataaccaacccttcttgctgaagatgtgggttatgtatagatttgacttgtcatgcccaatgttgcaagaaactcctcatacatgtacaggaatcatatctctcatccagaaaaatgagactgttatctgtaacctccagtatgctatcctccttttccttccattgcaagaccatcagctttctctttattcctcagttcaacagtctctgagtacttacccagtgccaaccagtcctgaagctgacactggtgatagagagatggccaagaaactgattttgtctgcatgtatgtagagctgacagcccagtggaaggaaggaggcaagtgtggggatgaaaaggatgcaaggaacctggataccagaaatgtccagctaatgttctaagggagttcaaaactgggatatgtcacagtcacagtcctccctggaattcaagtcagagtacaaggttacatgatttgtgattattgcaaacctcaatttccacatttgtgcaatggactgtcagtactgactgcttaggaattttttttcgaacctcttgtgattgaggctcagctattgaaatgccaagcccaggtcagagattagtcagaggaaatgctaaattagagcccatttgacttttatgtatgacactaattaaacaataacaaaaaaactccaagaactctagatagtttgtccaggggacacctataggttatgataacatcaaaaccagaaccaaaaaagcccaaatatttttcctgggaacttttttttcctcacccctgagtaattctaataatatgcatgtaaaatacattatgggaaatcctctaacaatttccacctctgtgataaatgttgcattcgagtagagcaagaacatctacttaataattccatataactattctgcaaagctgccaggagcagaatttagtcagttgggtatagcacgaagtagatggcgtgagagaaagaaagaaatggtttgaacccagacttggccactaatgtgacctagaacaagtgatttaaccctccaagctttggtttcctcgttcacaatgtggagataaaaaatgatacatactctacagggtagttgtgaggggtcaatgagtaaactacatgtcaagggcttaatgtcagtaacaaccagagtgttgctggtccagagtgaacactcagaaaatggtggtggtgatgatgatagtggtggtgatgataacggtgatagtggtggtggccgggcagggtggctcatgcctgtaatcccagcactttgggaggccaaggcgggtggatcgcctgaggtcaggagtttgagaacagcctggccaacacggtgaaaccccgtctctactaaaaatacaaaaatcagccaggtgtggtggcacacacctataatcccagctactcaggatgaggcaggagaattgtttgaacctgggaggtggaggttgcagtgagccgagatcacgccactgcactccagcctgggcaacagagcaagattccatctcaaaaaaaaaaaaaaaaaaaaaaaaaaaatatatatatatatatatatatatattagctgggtgtggtggcacatgcttgttatcccagttactcaagaggctgaagtgggaggatcacttgagcccaagattgaggctgcagtgagatatgattataccactgcactgaagtttggatgccagagcgagaccctgtctctaaaaagcaaacaggccgagcatggtggctcacgcctgtaatcctagcgctttgggaggccgaggtgggtgggtcacctgaggccgggagttcaagactagcctgaccaacatggtgaaaccttgtctctactaaaatacaaaaattagctaggcatgatgttgggtgcctgtaatccgagctactcgggattctgagacgggagaatcgcttgaacccaggaggcagtggttgtggtgagccgaggtcacaccactgcactccagcctgggtggctgagcgagactccatctgaaaaacaaaacaaaaaaccagctcaaacactccaatagaccacttcattccattccttcttttaattgttcatggtggccttttctcccctgtgaaatacataaattcccatagttatggaggggctcacactgtcctgccaccggcctacagtttcaaacagctcctgtcagctaaaccttagccgccttccaccaggttctggaacctcccttgggaagccttccctgactgacctgacccacctagaacttcctttcttgggactccctgaaccacacactttataaaaccaattcactaatgccttattatgttttaatatgtataatatttattttgtctatgaaagtttcattgcgtttgtcttcctaataagttaaagctctaagaagtcaagaattctgttttatttactttttgaatgccatttcctttcttttagaaacccccattcccttcttgtcaccccccacccactgtggaaaaaaaaattgtttaaagcacaatgctgaatgtatatggcattcaatgcataaagctgtatttggatttcttttttataaatcttgatttttctcttgccccttttgcttcaccctactccccatatcatgtgccttcaaatatacacaaacacaaccttttgtatttatatatagtgacctgcttgcaaaaataaatgtgttaacaatgtagggcctaggacacctgataccatttgagcctcagaatgtattaattcagccgggtctgtgcaagaatggtgatttttcaattaaacatactgtagcaatgatggcctcttttcccacaaacttactaaggtaaggaatgggacaaaagtaaagccaccttctttcctccattacaataggccgtgtcctcctttctcaaaccttggctcagaggcgaggcttgtagttcactgctgcattctgctgggagaaccatggtgaccctctgggtcatggtcccgactgggacaccgtattttcgtgcttcttgtttttattgttcctctatttctttttcttttgagtccaatcttcagtcaagccttccgtgtgaatgatagtggccacttggggatctccatctgcattttattgtatggccacgcaaaaccttttatctaattcctagaagacatcgattgctgcatagcttggtgggtgaagaatggaaaagcacaatctcactttattttgctggtggctttgccctccctttcctacaagcagtcattcaggcctaatggttctgttcctcctaattattcatttgttcattcgttcattaattcattcagtctgccattcaatatatatttatcaagcatccactatgttccaggtgcgattccaggcttcagagatagaacagtgaatcaaactgataatgcccccctctccaggagccagcattctagcgagagagaatgacttgctgaattgtttcagttggaactttttttagactctgaaccttggaaaaagtccactttccatgggcttattaaatgtgctgaatcagacagttggtgctgtttactagagatcagggttcaaccagctttagctgcatgacccagaacatttgattttatgatttacaaaataaaaagttatggccctctgcagatgtcccatctaatttgctcattgtgttccttagaggcaatgtggtattgtgaaaaaagcaagaccaagctttgcggttcaagtggcccgtgcttgctgggcctcagtttcctgatctgtagaatgaggctggataaatctaagtttctctccaactctacagtctgatggttctagtactacaagatcaagatttttttcctaaagagccatttgtcttattttagcttcaagccaagccagggcatctgagaaataccaagcctccgttgtgatgtgtcgccatgaaaatgttggctgccctctggatgcaagtctgcttgtgctgtgctgtggctcagagttaaatttagataaaaatcagttaggagctaagaatattcccagctttcctgacaggttgtatccatcattatgggaggaaaaacaaggaactggctgcctggcgacagggagcgggccaggctgagtgtgaggtcaggcctcggctggaatctcacggacttgaaaggacagagacgtttcctgagatgtctgcggcagaatgtgggaggcttcagcctgaggaaagttcaagttggagagaaaggttgccagacctttgagtgacccacactgcttataacttctagaaggttcttttagggaaacctgcttagaatgaaaccctgaaacgtcctttgctgcctccttaacaacttgcattagagagtttcttcagccaaaaggcgaatgtctgttgagtggaaaggagaggacggagtcgatgttgtcccctgtgagatgtcatgtctcaggcagtatgctggacattcccgagacgccagctctgctcaggtgacttgtgtgccctgcccttgtaagcctcgaattactcatcgtgaaattgaggtcaagccactcactcacagacagggctgtggtaacaataaaatgaagggtgcttagcacattgaaaataactcaggcagtgttccattattgctatgggctgggcgtggtggctcacgcctataatcccagcactttaggaggccaaggtgggtgaatctcttgagcccatgagtttgagaccagcctgggcaacatggtgaaacttcatctgtacaaaaaataaaaaattaggcaggcatagtggcacgtgcctgtggtcccagcaactagggaggatgaagtgggaggattgcttgagcctgggaggtcgaggctgcggtgagctgtgatagcaccattgcacaatctaaactgggccacagagcaagacctcgtctccaaaggaaaaaaaaaaaaaagaccaccatgattgttctagtattgtttattgttgtgccctcctgggccaaacgaggaggggtgggagctgccctgggtgtgcctatgaggagggccttgtggtcttgtggagtcactcagatgtgctttcaatctgagctcccccacttcctagctataggacctttgttaaattcatctttgagtctcagtccccactcctcagaaatgggtatgacatgtactttctaaagctattctaagaatggcatgcagttgtcattaattaaaacacgcagcacacggtaggtattcaacaaacatggggaattgtgtatcatcgtcagtagaggatgctctcaaattacactaactctgctaaaatccaggccaggattgtgattcgttgggaagccttggggaagttgcttcgccattctgaacttcagtttcttcttctgtaaaatggaagtaataacaatagtatcagctttctatagttactatgaggattagatgacataaggcatgtaaatccattagcagtgtctggcatgcagtaaacccctcaataactgttagcgctttccttcctgcccctctcaattcttccaggacccaggtgaagagaacagtcctatgctttgttccttctgatgtacaatactgtcatataaacccactcatttttttctcactttctctctctgcctctgctgctgctgtcaccagtccatcgctctgttggttgccaagagtaagagagcgactaggttggtaagtaatttcaaataaaacagacaccagtctacacacagagcagaggtttgagtgacatggacactaacccgtttaccgggtgccactggcgatctggccttgtcgaggaaggagggaggctgtgctaatttgctctcccacctgtgtggctcccgggtgtagacagagcgttgagctcatttctcctgcgctcctctcagtggcctttggctggcaaagctgtttgtctccccttctagttttctgctgcagccatttggacagtgttgattagttttcctgaggtgctgtttgggcgtctccccagccacctaggtacagatggagtgtgtttggcttgtgatggtgacagaggggcggctgcccttcctcgtacttcttctggcattgaagaagcagctctgaaatctccaactgggataggccaagaaaatttggatgtggatacatgaatgcctggtttcctctgaaggtagtcaggtctcaggcggccaagatcactgggaagaaatgtgactttgcatttgaagttctcatttggggagacttggagttatcagtctcagctggctccagcccagaacagattaacttttatgaaatgattgtctccaaacacacttactaaatgcaaaaacctgctgtggctccacaggcaccatggggcggggtgagctgcagagcttcactctagctgggattgctctgcagtctggcccccagagcatggtgggccgggaggaggaacccctgatttagatgctgaaaacctaggctttgctcttggcccaccactaatgagttgtaggacctagggaaatggagaaaggcatactgcttcacagggaacacctcagggcccatctccaggactttttgtggagggaatgggaggcctctgtggcattttgattcacaaatagctaatattgaattacaatgcattccttgcccccccctccccaccccgtgacattggactgcctacttgtcccttgaacttcagctttttcatctgtaatacagacatgataaaattctgtttgtcagcatcttccaggaagcagacatcaagacaggactgtacattcaaggattttattaaaagaaacaggttaggagaatggtcagatagcaatgcaagtctgatctctactgaaggaaagaagaaggggcagttgtagggaagggtcctagattgccaaggagggtccacaatgccatcagggagtcctgcagccaaactcagctgtcagaggagtcccatgtctcccaggaataggtttgtctcagtacccctgctgggttccgctattgcctctggaatcagcccatgagaagtgcagtctggtgcccacacagctacagtgatggatttcagagcacagcagctggagccgttggtcaatttcattgcctgtagttggaggtctgcgaagagcattgattctcatgggtaccacaaatacctacactgccagacggctataaggataagagatgaatgtatggtaagtcttacttaaaggatgatgtatgtgtgtacatgggtacgtgtctgtgtgtatattcttggctgtaaaatgcagaaggagtaaactagacatggaatcaggaatcctagaaggagaaaaggactctgctcctggccttcaaatttgccccttaatttaatccttcccttaacagggaagtcaggtacccaaggtcacaaagttagactgcagcatgcctcggatttgaaccccggttgaagtcttgtgatgttaacattttatggcccgattgctgtcacaggcttaagatagggaccattcaacctgacagcagacgtctctctctctcttttgccatacctagaattatgcctgatatgcagagagtactcgccaaatatttgagtgatgaattcattaactgcaagctgagccctttaaacaagcttgtccaacccgtgtcttgtgggccacatgtggctcaagacggaatgtaaatttgtaaactttcttaaaacattgagatttttttacattttttttttttttttagttcatcagctattgttagtgttagtgtattttatgtgtggccccagacaattcttattccagtgtggcccagggaagatcggacacctctgcctttaagcttggtatctggtctagctcacctagactccatttgggtattccccccttttaggcctccctaatagtgctgttcctatggggaggctgggatgcttaggtgagaaggacatcttccctttttgctgcccacgaggtgggggcataaagagccacttgtggctagaaaagcaggtgcattgcaggcattagcagctcagcccaagagtgtgagcttcctttctctggagtctctaggctgaaagggtcttgggaggggcattctgagttttggctttcagagcaggcatttatgggggaagtggggagtggcagagtcaacctaaagcccccttgttactgtccttgcagttgttaagctcactgtggtcatagagaattgcccatggagattccaaacagatgtctattctagtttcccatttctgatatgtgggcctcttagactttagctttctcaccctcaacatactctaatttggctgaacctttgttttttttcttggccaagagccttgtcattctggcatctataattttggagatttgagtggctggcaactgatagagtgcagaaaggcagtgatcttaggggacattcccatggcatcagcatgggcattttttatttttccaaaaatcggccagactgagggtacaaatggttgtgactgtcgttaaggacttattgaagtcttgcttcacactttactcaaggctatttcccactcagtaaaggcagcgtctgcatcaaacacccaatgtttaaggtagtaccaagcagacaacaaacctttttctcttacggggcttagtagatgcttattgaaaatatatgaactttcgttgacaagataatgctacagaaggttgtggcttctttcttccctttctcaacctccctctggtctttatcctcaaataacatttttgcctgtttcttttaagccaaatatgtggaattcagagatgagtaagacacaacctctgccctcaagaaactcactgcctcccagcctgttgttttagtttcgagttgagttgatgaaagtatctaaagaaacattgtttttaaggtttaggattcacatatggaggacagtgtgataagatacacccagcaaaccggaagccagagcagtatatcagcaaccataacagtcataaactgagaacttactttgttcttttctgcagaatagccaaggcatatttttgtggatcatttttcttcatgatgcataacatgaaacataagggtaatctcttctcacaaatggggaaacagagttaaaggacttcttcaaaatcctagctttgaaaccgacactcgactaccacagaaccatttctctaagaggtggacatcggcagctttctagatgaacaggtcacagaagaatttggggattcagcatgagagtgtatatgaagcctttggtacattttctgagtgcttactaaacatccaatacagtcagtagctctcatttttatttttatcattgttcatgtcattttctcattccccagctctgggggcagttggtgcatggctgtcacccaggacccatggacaatccccaagggccaaataacgctgaaattggcattgaccaaggctgcggccaaatgccagcccatcaaggcaaatgagtcagtttgccagtgtctgacccaagcctaggagaagaaacaaaccagcctccctctctctagttctttgaaagtaagcccttagcctgatatgtttgttgcaggatagacctgtggccctcatagtgctcagaactgtcagcagaacttcttcactggaagaaggaagatgcacatctttcatggaggttgtgctgtctatctgggacaaagggggaatccgttacaaaatctgcttctttttgaagctgcacattcagaaacagactatggctaagtgacacactggagcagatgggccagggctgtgctggatttgaaaaaggccctccttcctgagcagaattaatggagctcaggtctggggagggtgagcgcactcttggcaggcagctgtcttgtgtgacttgtgctgcactcatctgtgaaacatgttggatctgagaaatgagtcttgaatcctgggtcatgttagcatcagaatcatcttctgttaattacatgagacaatacatgtgaggtgcttagagcagtgcctggaacacagctcacgttcaggaaatgcaaatacttgtcagccccagcaacttcttctgcttttagttgagggctcttttcttaaatcagtattgtgggctttgagatggtatttcaaggaaacagaatttcctactctgtttaggacttgaaccaagtaccccctaacctctccccaacccctcccaacaaaaatgcacagattttatttaatttttcttttcagaatctttatcccttagaacctagacttctagaatgacaaatatatttaatatggtttcacagagtttgtctggacccctttttgaggagaattctggggctgatttcagacccagagaaaaaggatataatgattgatgagtgatgtctgtcacgggtgcgagagaagggtgggaggtatgtgtgccatgcttttaccatctctaactaaatgaacttcaaggcccaatttcctcggtgaagatgaatgcaaggcttatttccgaagatgatgccactctggagagcagctgagacctcaacagctgtttatcttcctggtcatgtttctggtttctggctgtttcttttaacaaggggtcagtaactgagggcttctccacatctgcagggagtttcctgcagaattaggatgtgtaaaataaacccacaaaatcaaagccccaaacagatgctggagattatttcacacttgaggtcatccttcttggagaagggcatgggggtgggttgtcggggaatgatgtggaaggccaaacctgaggggctggactgcagcagaacacagtcaatgaaaaaaagaatctcaatcattggggagagatcacctcggtggatggcctttcgcattgcaatccattaggaagaggaaataaagtgatggaggccatcccctgctcagccagcacatgtgaggcatgttcacacactgtctccctctccccacaaaatgctcaagcttctagaatgtttttaatcaagggatttagggcagtgtttttcaacttctagaataaaaatgttacaaccttggtctgagtggtgagggcccaaagatacagggaaggaagtggtagataacaaatacattaataccctttattatgagttcataatattttgttaaatctgaaattcagttgtcatttaaacagaagagattcaaattcaagttatagaaaagttaaaatttctaattagcaatatttaaagcaaggaattttatactttatcattttaactgttaagggaaaaaagtaatttgagtgtgattgtttttcttaaagttgaagatcagtatccagaatgtttggagttatcactggtcatgaactatattccacgtggaaccatatctgagtttgttttgaagtaccacatgttcaaatcactgaattagactttttaagagacataaagtgttatatttctgtaagaggtgctttccaaacccaaatctaaaaatttatcatttctgttccttaaagtatcattttaatttacaacttattttcccttatttggcaatttggatacagtgtctgaagcagtaaatggatttaaccccaatctaatttttctgtaagaagtaggagagagtctaagaatgacatacaaacctgtcaaacctgttaaaacgagctagactttcacactttcaccggtggaaaatgctgttccttcatgtcaactgaaggtaactttgatcacattttagtacatgccttagggtggcaaagggcagtttttgcaaggcacagtttacttgagggccttccaatccttgggctaaatcagagagagaggggagagggagtgtgtgcgtgcatgcatgtgctttgttttggagagaagtgggaggcaaggaggaaagagaaggactgtaatgatgtagtgaccgccttggtcctgggctaggcagaggaagtctgtgcatgtggatgtgtcttagttgggtacaacactgaaaacatgaagtggtcattttccaacccaagaactgtaaggggtggtagtggctgcagcagccaggccagtggtagggtctagagtggccccacctggacatacagcatgtggttgcattccagtccagggggaccgagggtagagccaggcccaatgcccttgtgggagccaggagtgaaaagtgggcagagcctgaggcagtgggaggaaacctgcccctggagggcttgatgctccttactcagtgtttcagcccaggagaaaaaccgcaaatacttgccttgtgagccaaaccctagcttaacaaggatcagctagttaacatgtgaaaagttgtcccaaatggaaactggataaacaggtctggcctgataaatagctaaaaggtttcccagtcagggatggggtgagagaggcttggacattctggcccgcaggtcattaattatgcaaattcttactgggctctgggaggttctcaagaacttgggccctgggagagagggcccctcagccaggctggaagatgaggctctgcctgaacacttgaggagggcctttgcataccccaggtgaacctagtagaggctgagcccaccggagacgttcccagcaggcttgagtaaaggttaggaaagtgatttctgcatgcaatgtgatgtaggcagaaatgggcaattcgaaggtcaaatggggctctcatttactaatgactgtgggcaactttctggtccttccagcctcagccgcttccctgtgtaaactggtggagctgataagttcctggaaggattatgaggattaactggaaaaatgtatgtaaaatgccttgttgtacctagaaaagaattgtgctcatatttttcttccctgttctatcattaaactgttcccccatcaatgccccaaaatcttatctgcttatttttctctaagaactgggttcaaaatatggtttcaaacactgaagaatcagaagtttgagctttgaatcctggagtttccctaattagctgtgtgaccttgagccaatcctacagtcttggtatcccatgaaatgggaggattctccaggtgatggcttaggtacccccaccccccgccccactctgagcttctttccgaacactcagcagtaggacaggaagatctgaaagcaaggggtctgcttcatgtagcatgataaacactctttggaccggagtctgaacacttatagatatcagggaggttcacattgctccagttcatactcgcgcgtggatcctagaattgggccatgaggtaatgccgagagtatgtgaactgttataaattaatacactgatctactctgcagtgaggttctttcggctctgatttctccttttatggtgtctttagagacaggcaggaggttaggaggtagttgacagaggagttacaaacacgtgtattcactgcatcagggctggagcttagcttttgtttttgagttagttctgttgtttgggcttggttaatctgtgcccaaacactgagattattagaaggaaaagacacccttaactggcctcttgcagcaacagacacttggtgggaggtaagagaagggggaaatgggacaagggagaaaagaccttccaactctacccaaccgagtggacctatgaaagactgaaatctccagtttaatgtagccagaactgaggtcagggtctggccattgtctggaaaccagagttggagttctggggctgtcagtgaagacctgtctgtcctaaaggtcacctctgtttctatagaaacaggtgcctgagtgaccagtgtttacgagttaaaagcaggctccttgcaggacatcacactgtgtcttgctccagccactggccatctctgcggcctcgcctcttctcaggacattttgtcctgacctcacctaccctgagatctttttgttagctttgtgttctgcccttaagatatcacttaagaactccctctgggttcttcatagcattttagcattcttagtatgttttatctccattaaactttttcagtgttctatgctgagttttttgtattttttgtctctgtctacccaaactgttacttctgcctgagcctcccttttattgatttttttaatccagaaatactcctactcatccttccaaacccccaagtttaatgactcaggaaatctttgccgaccctctcagatatttaattatcccctcccccaaccgtcacctctgtactttgcacaaatgtcccatgaagctgatcacagtgcattactttatatttttttacttgccttgtcactctctaacaatataacctcattaaaaatgagagccgtacattatctattatcgatcaggtatggggtgtagtgtttaagagatgggttgcctgcattaaaatcccagcactacctagtatggtaggaacttctctgtcataacttgagataagttcttaattgccctgtgcctcagtttcctaatctctaaaattggaataataaaagtaactacctcatagggatgttatgaggattaaatggtaaatatgtgtaaagcagataagtgctcagtaagttttaacttttttttttttgagatggagtcttactctgtcacccaggctagagtgcagtggcgcgatctccgctcactgcaacctctgcctcctgggttcaaggaattctcctgcctcagcctcccaagtagctgaaattacagtcgcgtgccaccatgcccggctaatttttgtatttttagtagagacaggctttcgtcatgttgtccaggctggtcttgaactcctgacctcaggtgatccgcccaccttgccctcccaaagagttgggagtacagacatgagccactgcacctggccaagtcttagttattcttgatgttgatccgaatttctaggcttcattattgcatttggaccttaacacttaatcagtagatgtttgcaggttggctttgtactgtgtgtctccctgactggaccgtgtgcttgctgaggcagtgtgcgggtacacctgctccttggcatatgccttggcttcacatcttgccaggatgggtctctcgtccccatttcatagatgaggaacccaaggctcagagaggttgaaggacttgctgaaggtcactttaaagaccagaatatggtagaagtcctggaactctgaatgggagcttagacccggtgcttccaaaatgccatccaccctgtagctttaaggctctggaccctgaaaccaaatccatgagggatgagctggaagagccaggccgtgtgacccattttccgctgtgctgggagcttgcgcaccctctggagcttccttgctgtgactgccttccacttcctaggctgtcttttgtaggtccatgtttgggccttaatgagcatccagagacttttttttttttttttttttgcgacacagttttactctgtcacccagcctggagtgcaatggtgcaatctctgcttgctgcaacctctgcctgctgggttcaagcaattctcctgcctcaacctcctgagtagctgagattacaggtgcccaccaccacacctggctaatatttttagtagagacagagtttcgtcatgttgaccagggtagtcttgaactcttgagctcaggtggtccacccacctctgcctcccaaagtcctaggattacaggcgtgagccaccgtgcccagccccagagattattttcataagctttccctgggagttcacttatgaaaacgggttgggagggtctacactggtccctacagttcctggggtagatgtgcaggtaatggtctccccattgtttcccagtgtcttgcatttcctctctctcccatttcttttttcttttgttgccttgccttttcttttctattgtctcttctgtcttccctctctctcccttttttttttccttttaattacatttattttaatgctgaatttactcccgtgccataagtttttgtttcttcagtttcttctgggatatctttttcttctgggcaacctcctcttctggtttaggaacaatctgttccttttccgtaaggatcatctcaatgtggcagggagagctcatgtatgggttaatccgaccatgagctctgtaggtccggcggtgcatcttaggtgctttgttcacttggatatgctcaatgaccagagaatctacatctaaacccttaagttcagcattactctctgcgtttttaagcatgtgcagcaagaattcagcactctttttgggccaccgaccttgtgtccagccccactgcttggcctgcgcacacctgccaactccaccgttgtaatgtcggaatggtacacactgtttctgtaaagtgacatctttcagatacttcgtggcttttcgtatatgcatacccttgatggcctgagcagtttcacgagtgttcttaaagtgaacacgaagattggaacctcttgatttgcctgatttcgtggggttctccgggtcaagtgaatagcgaaccattttcacagattacctcaggctgcttaggaaaagagctctctcccttttcttccttttttctcctacctccctcacaaccctcttttcttccttccttcctttcctttcatttggtttatttccacctactaggtttttattatatttcatctagaataatgaccttaatgctctaacgatttttttttctaaaagtagcttgtgttcaacataaagtattcaaacaatccaattgaaagccaagaagacagtaaaaaattactccatatcctaccacagaggattaactcttgttaacagtagatgaggatagtcacagctgtctgtaacaggagatggggaggggtagaataagtggattgatgggtggacatgcagatgcagaaactgatacatcctttgattgactgaaacgcttcttcataaaaaaaaaaggtgggggacagtaggtgttatttaataacatctactaaatcccatttatttcctggagtttaaaaataacatagctgatgaggttttaaaatacgctttgggaacctggaacagagagagtttgtgttacagagactgccacggggagtgcacagtactcacggtgcacatgatgcgtagaagaaagaaatgggggcttgtgctgggcttgcactcttggtcctctgcctgcaggcacttggagatcctgaagtcagaggacagcctgaaaacaggagagaagaaacaacaggggtgcagtctcagcatgggagtccctcccttctctgacccccaccttgagctgatcgccatgcaggttaatagctttcactccgggtttccttgccttccccctgcccacccccaacttctgcccctgccctggtgtgccctggcaggcgcagaccctgcagtggctgcacagtggcccttggggacattccgtggctacagccactttggctactctgacatgttcgtccttgttctccaggcagccgtgttggaggggatcccacctcagccatggacggtgcctgaagcggccctccccaccccacagcagctgatgggggtccttggataccaactagatgtcttctttcttgtggcaaattctcttttgaggctgtgtgtgccaggcacacccagatcctcagagacagtccacaagtgttgagcttcagaaggtctttgagttccgtttgtgctcgagtttttctgttctcttcctcccgactggcccatcttgcatatagaagggtcttaagagacagcctttgccatatgctaaaaggttccattttacccatatgccagagcctttgtgcttactgggcatgtattatcagagctgggagggaaaattatttcttctctggacaaacaaagtccacccctaaatgatctgccttgactaagccagtggctcatgcctgtaatcccaacattttgggaggcagaggtggaggctctcttaaggccagaagttcaagaccagcctgcataatatagcgagaccctatctctagtaggtaggtaggtagatagatggatatattagatataaagagagatagatggatatgttagatgaattagatagattagatagaccctgtctctactgattgattgataaataataaatagcctgccttgcccgctgtattagtttccagggtatgccatgacagatgactgtaaagttagtggtttaaaacaacaaaaattattttctaaccatctcagaggggaaaagtccaaagtcaaggtgtcatcagggttggcttcgtctggagtctctgagggtgaatcctcactttcctcttccagcttttggtggcacccagcaatcactggccttccttgacttttaggcacattgctcaagcctctgtctttgtcttcaagtgaccttctgctctgtgtgtttctgtgactgaaaatccctgtgctttctcttataaggacacctgtcactggatttagggccatcctaaatctaggataatctcatctcaggattttttttttttttttttgagatagggtgttgctctgttacccaggttggagtgcagccgcaaaatggctcactgcagcctcagcctcccaggctcagatgatcgtcctacctcagcgtcctgagcagctggaactacaggcatgcaccaccacacccagctaactttttgtattttgtgtagagactgggtctcaccgtgtcgcctgggctggtcttaaactcctgggctcaagcaatcagcccacctcaccctcccaaagtgatgggggtggggtgggggtgggggttacaggcgtgagccactgcacccagccaggattcttttttttttttttttttgagacagagtctcgctctgtcgcccaggctggagtgcagtggcgcgatctctgctcactgcaagctccgcctcccaggttcacgccattctcctgcctcagcctcccgagtagctgggactacaggtgcccgccaccacgcccgactaaattttgtttttgtatttttaatagagacggggtttcaccgtgttagtcagtatggtctcgatctcctgacctcgtgatccacccgcctcggccccccaaagtactgggattacaggcgtgagccactgtgcccagcccagccaggattcttaataacatctgtgaagattctatttccaaataaggtgatatgtgcagattccagggtcaggacttgggcatatttgggagaagggagggcaccattcagctcaccacttccaccttatggagcattgacgacctcttcaaacatgtttcacgcctcagggagcatacatgcagggggctggctgggtgcctgttccacagacctcacatcctttatcctttatgtcctccacagtactcagcactgtgccgtaagcatatctttgtttcatgccaaacatgctaatttaggaaaaataataaattgggtgaaaatttctctgggctccgggtaggggcattctttcataatcagaaaaagaaatgtagaagcaccaaattgtatcatgagcattcacaaagatttcttgtgcctacttccacggatgtacaaggtctactcaacaaatgtggcctttgcctgccagcatctttggggccgtgggaaggattttgaaaatggtgtactctccatgtctgtgtctcaggtccagatcgtgagatctgccaaggtgggagatgccctttagatatgatgacagaaaagtgagccaagaattctgagtatgtgagtggtcatgtgggagatgggtagcaagcagtgtgtgggttagagggggcgaaagagtcacagagaaaatcgggagacaaagtccaaaaggaaactgttctcagagttcttcatctttatccttgatcctttcttagtgtagcctgggtctgtgatattggctgtaattatatatgtgatttctcatttctgtatggtatgtttttgttctgtttcagtatgcaagtggcggggggttgggggggtgggtagggggcaaagggaaggattgattgtgaataaggaggagttgtatacttgtggcctgccagatagaaagggcttttcaagtgccagcagctcccatcctgggccagagggtatgtaggagggagtctgatacaggggcaaggtagggccaaaggcaccccgggctgcctgtgagaggagagtgctgacctctgtgattggccctttcttcaaacggagctggtgccgtctgaaagcaaattaagattttttttaacttaaaccaattggatttggtaataaatcacacataacgagaaatctggaggtagccagtctgagggcttgctaatttagcagctcaacaatggcagatctctggggtggcttctctgagtttttagtggcttttccctatttgcaaaataattgtgacaggtccaggcctcagctttgatgggtgaatgtctatgtcaggtggaaaggaagcacttttcctttaggcagttgttgctagagaagaacatctttctaagatgcccctaaagacattccgttagagtgccttcgccagaataagtgaacataattctttgggtgttttgttttttttttaattattttactttgaaacagtctcaaacttatatggtagttaaagccctgtacgaagagttcttttgttttcggacttacttgagagtaagttgccaatgtgatacattgccactcccccaggtttcctgtaaacaaaaaaattctcatacataaccacaaagcaaccatcagaatcaggacattcatattgatatattgctaccacccagtccccaaacattcaagtttcaccagttgtcctgagtgtcccaataatgtccttagagtggaagtatctgattcagaatcacacgctgtatttagttgtcgcatctctggtctccttcagcctggaagtatttcttattctcttgttgactttcgtgacatgatcttgacatgtttgaagaatatagaccattattaggtagcatggccctcagtttgggtttgtgcagtgtttcctcatgattagattcagtcgatgaatttttggcaggaaaataacagaagtgatggggtattcttattgtatcctgttaggtgatacagcttgtccatttgctcctttattcagccatttattggtgtcagcatggacacatggatttcccttctactcaatgggttttgacctgttaccattattatttgctttgaagctctaattgccccgtatttggctagtgagagccactttggcctggcttcagtgtcttttttgacacatctccatcactctttgagcacttcttcactttcaggtatgacacgatgtttcaagcttgtattttaccagtcctagccctggaatcagccatttttccaaggagccctcgtccattttttttggagaatagtatttacaagccaaaatctggacaataaatgtacctgttgctcttgtggtgttgctgctcctagacccttgcagtcaaacagagctgggcaatgcgtcttatgtatgtaagcacatatttattatgtgtgtatttctgtattcatctgtatattaaaaattgtcagttcacacacatctcaaattccgaataacatcataagtttcattttcattttctttttttttttttttttttttttgagacggagtctcactctgttgcccaggttggagtgcaatggtgtgatctcggctcaccgcagcctccgcctcctgggttcaagcaattctcctgcctccgcttcctgagtagctgagattacaggcgcgtgccaccacacctggctaatttttgtatttttagtagagacagggtttcaccatgctggccaggctggtctcgaactcccgacctcaggcgatctgcccgcctcggtgtcccaaagtgctgggattacaggtgtgagccaccgtgcccggctcattctcattttctctctttctgcagttgtaactctcttctctggccatgagaaatctaggttccattatcttttatatttttactgtgtactccgtcaccctgaatgtaatcaatttcacatcaccactgtccccctgccctatgtagatgcccagttagcaccatgtcaccctccctcatatgtggatgccatctccctgccactagggctctgacaccttgccctgggccactgccagatggacatctcccttgcatggctgctgaacacacacttgtaaaggcaaggagtttgactttatcaaggtctctactttctatctatatacatttattcattcaagcatttctgccttacttgactgataactttggtgtcccatcgattacccttcttttggcggggatcctcctggtcctctttagacttgcaggtacaggggctgccatggggtttttatatacctgtgcagtccaatgtgctagccagtagtcccatatcaaaatttaaaattcagtttctcacttgtgctagctgtgtttttagtgctgaatagccgcatatgactagtggctaccatgttggacagtgtagatatagaacatttccatcatcacagaaagttctcttgttctcctaacttaacattgatccttctctgacttcaacttaatttttcagtgttcagatgatcagccggaccacccaaacactcagcagtccttcatgctaactagcccgtctccatacccacataataacaatttcagtaatcttaccctctgcatactcattcccaatacccatgggtctatccctgttgccccagaccatccataatacatgatctgcaaagggaacagagtgtttgaaactgagactattttgtaaaatcttggacatgtagttgcgataatataaaatgagagtagttaaaatcttgcttttctgagcttttgaaatgcttgttttcaggtcatccctgggaatctcagttccaggttgtcttttcggctcctcaatacccaacccttttgtagagcctcctcctccagaccagtgcttttcaaactttaatgtgcggaagaaccactgaaaactgttgttagaatgcaggttctgattcagtaggtccacatgaacctgcgattctgcattttaatgaacctcaattgatgctgttgttgctgctctgaggaccatgccaacaggccccgaatgtctgccatatggaagctcagaattgtcaacactccctctgcttttcctttgtcttccctcagaacacctgctcaccatgacctgtacatccaggtgagtgttggttttcaacagagataccttgcgagtctgtgctctggcaatgccaccactccagaaaacagctcagagcttagctcttagttgtgttcagagcccgattgagctaaagaagggacaactctctgttttatagtcacacctaatctaatggctgttgtagcctttgattaaaacttatgcttcccaatacaaattgttgctccagatttggtcccaaaggatacgactgttagcaaaaaccaaatttacctgctaaaggatgagctatttaaaaggaatgtgtcacttgctgtgtaactgcattccaacaaggagttacataaatgttttgagacagcagcatctttggagtaagtgccaagcctccagaggaaccctggtaaagggaagcagtggtctcatttggatatgcaggttcttgcatttttgttatgaaatctactctcctttgaagttacctcttgtattgtaatctctatagtaatccattctgtatttcagacataaattctctttttctgggccatccttcctatctgtgttcacaagtccatgccatctgccaacattttgccacgtggagtggtaggaaaaccaggacaggagcaagctgacccagcttcaaatcccatttcaattgttagcagtgagatcataggcaatttcttaacttctctgaccttcagtattctaattaaaaacaaggctactctgagttacagggattaaagtagatatgttgtatacaaaatgtaaattggatacagaagtggccagcccagaaaagcacctaaaattgttgtttccctttcttatttttttctctttagtattaattacttctttgcttaattcattccttcttcattcacatgcgtacatttgcacaatgtagaaaacaaagatgacacgagcctgttcacttctccacatgcctgtccatctccccctgcccctatcaacatgtcttgaaggtgtggccactggccgtttgcatcacctttctgtctacgtagcacctgtcagtgacccctgaccccagagcacctgcccttagccttgagaagcctgtattttccctgctgggctcacctctgggaggtagcattcccattgtctcttcactggatggcactctcacaggttaaaagtgggccacacccagcagtagccaaagaccactgtaggaagaacaagattgctgagttagtttttgattttcttttgctttcacatgttttggagaaatgggatgaggctgcatgtgcttaggtttgagtttgggatgggataggggtccttactcttagaggcagcaggggtttgtaagggtaacagagattcagtgtgggcccagggaagggggagctgaaacacagctggtctcaggaaggaggtggagggcgaaagggaaagacggggatggtccatttcagcagaagcaaaggtttccagtccattaattttaacgtaatgcaaatcggtttatggaagtgctgacatgccgttatttaaaaagcatgagtagcatgataattaaatctccatctatattttattctagcacatttatagtgtatccttgcccagctggggagatagatttccagccttataataattatataaactgcaaattactaaaaaaaaaaaaaaaaaaaatgaacattgatgccaaaaacaaggtgggatatattaatgtaaacttcattaagttgaactcagctttgtccttgagtttgaccacatttactcactaaaaatatctcaaagttatgcttttcagcatataacaagaaaggatatggtgtctgtttaatgttcgtttttggcaccttcactttgaagcagacattcttggtggggagccctagaatttagtcattccctgccaagcagagaagtggaacaggaatgaaccctttactgggaatcaggacccctgagttctgcacctggggctgccagtgaccgcttaagtgacctcccctctggctctctggcacataaggaaccaaggtgttgcaactcctaaaagtgactattttttgacttgaatttttatttttcttcttcattgcttaaaataaaaatctcccaacatagccctttacaaaactctgaagtttagtttccttaatttgaaagaaattcagctagaaagaatggccaacaagcttgagctgtccatggaagtttaggaggatggtgcagggatgaggaggggaggtgagctgaggccttgggggagggcacatggaaaaataacagagctgggaacaaggatgtgccattaccagattcagggcgtctcctgtgtgcaagtgtatcattccaggcaaaccacgtggccacacttttgtattaagcttgttggtaactctcctaagaaaccccactggcggtggctgttttattacctttaagctgacctgatacatgagaccactcaggtccctgtgttcaaggtgcatagtcagacaagtttgtcaccacgctgtggtgggaacagctttgtaccggttggggtaccgatgacctctgcttgggaagtgctttctaaggccagctgtggtcctggggtatcaggtcaatggctggggaactgccctgaggagtagcagaagtccatctgcattctgtgggaaaacagcctctgcagcacaattgaacgttgcatggtaaatcaatcacaggccatgagcactgcaagaggttttagagatcatctggtgcaagcctgtcttttatacagcagaagcccaaacctagctagtgaggagcaggaccaatctgatacctggtgctgagctgagctttctgcatttcccaccataatacatcatatatcatgattgcaaagggaaaagaaaaatcccttctttagggaaactatacatacataaaacagacatgtactatagacccttaaccaacattgcttctgttgattgattttactctggtttttcctctcaaattatggatttcatcaggccttccaccttgctgcatctcctagccatctgctcttgagtttctcctggtacacaaactaagcaaatcttttataacttcaaaatatcaaaatgcttctcacatgtgctctttgctcacatcatctgtggcaaggcttacaagctctaggacacagcgatctccaatgtcttattgagactgtcaccagtgagtggagatggtgttcgcgtggcctctctgctgggctggtgatggttctctatggccagattggacttgaaaacaacatggaaacaagtttcctttctgcaacacttctcccaacttggtccatgcctttgctttttatctccctactcccttccaggggccatatagattcagaagtcaattaccaaataatggtaatgtgtttacccttctctgcatttaggaaacccactaccttctgtcatttggctttaccatgcacactttgcctgccctggttcttttcaacactccttgatacacttgtgtaaaagcccctctgaagaaccatgtcaaccctgtactctcacatctgtcctttttggcttccaaagtgagccttttaattaaacaaaagaaaagactgccatgtccatttatttttggcagattcgtgattccatcagagttgatgctttcctgtcctctttgtcctctttgtcttttaacatcctttcccaaccaggaacatgctgaatgttcatttggaaagactgaagcttccaggaccgtcacttctggtgtcactattacgtgcagccctcagccaggttaaggtttgatgatggatccacaaagcaaacttctggctgaagacacatggccggagtttatccaaagccctgacggttgccagccattcttcctgagaagcagacatgtttgtttcccttgccaacaactttgtatggagataaattacaggatgtttcccacggtcatggccccataaccaagtagcaggcattactgtgtatgctggagctgttatgagtggagttaaaaagtatgggtctttaaaaaccaggtaaattttactaaagcttatagacaccctaggacttagaaaggattggctgatatagttgagttcatttcaaattttaattttattgagagcctatgtggtcagttagggatacaaattttggacatacaggtcccgttctcaaagagctcagagataccaggggaaaagaaatgaataattgtaacacagtgtcctgtgtgctatgattgaggcttatccatattgcttttatgagccctgatgaaagaaaaatgaattccagccagagtattgggaggggatagaggaaagcttaacatttaagctgagtcctaatggaattgtccatagggacgggacatgggtggaaggacattctaggagaagggagcatcgtgagcaatggctcacaagcccaaacgttctgggaaatgctgcgtcatccttgagactggtccagaggttgggtaggtgggacgattgggagaggaggctataaaggctttccaaggaccttgcaggcgataactcacattcattcaacactatctcatgtaccagacacttttctgagcactctatacatgaggcttcatgtagtgatcatgcatcccagtcagactcttctgacatcaacagacattgacacatgaagcagaaggagtgcgtctacactttaagcctactttattttcattcagggatgtcactccgagaacagcagtgtgggatgaggaacataaaatctgtatgtgatacaacatctttagctggtttgggccaagtgtaattgtttgataaacaaggcatgtggataaaaattgtgtccactttttattagcaaacacttaatctgattgcaaaagaaaccatcatgtgattcagctttttcacagtttgctttactagagcaagtcagagcagatgagaaagaacacctaaactgtggtttcctttaaagtacttcaaaggtgttttctgagtctttataggataagttcttacatctgaggtccctgacccagaaggagtcattgatgagcttccagggatccaggacaccttttatattgtatacaaaatgttttctctgtgaacacattcccatgtgcagcttttctagagaaggcccatgcttttatacaattctaaacagagtctgttagcccaaagaaagaggagccaggatttgtagaatgcactgtcccgactatttcaatgccgggatgataaaatcccagcttctttgcatgggaagcatggacttaagaatcagacttggtgttcaaatgctgcctctgccatttgctgttcgtgtgacctctgagctttggttccctcctctctaagtgtgagaagtaatatgggaacagataaggttattacacgtatgagtaaagagaggagatgagattgccaggtgattgaggaaggaagacactgaagatagaaccctgaggaacatcagaattccaggggctgtctggaaaaggagccacctgggtgtggtagctcatgcccataatcccagctacccaggaggccggggtgggaggattgcttgagcccaagagttccagaccagcctaggcaacagtcagacctcatctctaaaagaggtttaaaaatttagccagatgtggtggcatttacctgtagtccctgctattgggaagctgaggcaggaggatcacttgagtctaggaggttgaggctgcagtgagccatgcgcctgccactgtactccagcctgatcgagaccttgtgtttctataaagaaaagaaaagggagctgataaaggagactgaggggagaggccagggagctccgaggaaaaccagaagggaaaagtgtccagaagagagagtgttaagcagcagggatcacagtggctttagactgatttacttaggtaaggactgagaagccatctttgttttttaattgtcaacccaggtggagacttttccaaattgtggccaagaaagtatctcatgacctaaaaagactcttcctttattaatttaacataaatttgttgaatgccctttatgtgccaaacaaagccattgaaggagcttggttcatgaggtctcacctttaaacactttgggctctaacattatttctagccctgcagttgctaataagcatagaattacacccaatcagaaaatagttaggccttctatgtggttttgggcatgccacatgacctcttcaggttaaagcgtgaagactagattatcctaaatttcctaatccagaataaatcctacatcactgtccagacaagatgtgggctgagagtggtggccaataaataccttccatatacaaaactctggttatgcttagaacatttcatcttgtatgatgtccctccagtaaacttcacactcctcttgttcttccttgaatttcctgtgcctgtacttacgtttagtgaatggacaaatctattgcatctgaggattatccctcctaaccccagggaatcctgttgttttaacatggaagcattacaaatgtttcgtaaaacaaaaataacatttgcctaatgctgaccgtgagtcaagccctatgttagagtctttcgtatccatcatgttgtttgggctgaaagtcttctttctggagatttctgtgtactgcagatcaaatcatgtttcaaataaaggttttcctggagcaaaaccacatgcaataaaagactgatataacacgcttattgcataaggtgagtgttaatcctggcctgcttacacccagctcatcaaggagctcttctttatttgaaattggcttccaaacctgatgcctttcagagcaagacatgctttcctccagctagtttaaaggctgtgtgtgtcatgtgtgtgtgcatgcatgtgcatgtgtgtgcgtgcagacacttgttccaaagagaggctccaaaagaatgtctctcagtttgttgcatttccctatctacccaggaagttgtttcttgttttcatgacaagtgtggacctgtagccctgagtattattggattgtgtgttgttcagtggtgcctagaggaaggataatgaggaaaagaggactgtcccgggtgctggtcagttaggagaggaaagaggctgcaggcttggcccctgctcagcggagaacatgttcttgagcagtcaggctgggtctgtggagagctcaattaatggatgcaaggggcccaaagagcgtgctgctggcttgactgcgtttgaatcagcaggacccagggtcagggatgaagttttttcttcacaggtaaaaaattgagtcttagagtaactcttttccaagtgttctaatttaggtttttcttattttattttattttatttttgagatggagtctcactttgttgcccaggctggagggcagtggcacaatcttggctcactgcaacctctgccgcccaggtttcagcgattctgctgcctcaacctcctgagtagctgggactacaggcgtgcgtcaccacacctggctaatttttgtatttttagtagagacagggtttcaccgtgttgcccaaactggtctcgaactcctgaccccaagggatctgcctacctcagtatcccaaagtgctgagcttacaggagtgagccaccatgcctggccctaatttactttcttctaattagtctagtgagtttcttctccagaagattctaattagtttattctcccactgagctgatggctactctctgcacacggttgcttctggggcccgaagcccttccaggagcacctagcctgaggtggccatgcagtcattccctgtctagtccccctgtgctctcacacttatgacacacttattacagtccaacatggcaggagggcattttctcttgtttattgcctgtcttcagcctcagtggaatggaagctctttgaggactgggacctactgacttctttctctgctgtatccccagagtctagaaaagatacttggtacatagtaggtgctaaatcaaaatttgttgaatgagtgaagagaagaatggagagaaggaaggaaagggagaaaaggaggggaggaaagagaaagagagagtgaaggaaggcagggagggaggaggctttagcaggggtactaactgttttattaagcaagctggggctgaggagaccaaaatcctcagggctcatgcagggtgctgccctctctcatggtggtccatctatttcctgaagccctgccttaggtcagatgggggtctttcatagctgggacctggatctgctgtcttctccctcccccgactttcttcacactcacagccccttctctacagggaattttattcctagagcaccagtagcactgtatggcaggaagacaccaaacgacagcgcacagggtgatcactgagtccagcccaaggggtagcagagagagaccatggctgcgcacatcaaacgtgtgagagatgacattggccttgtggatttggggtaagaagagcatatcaatgtcagtgctcccagcattagtaggtacacagggcatggcagctgctccacttgtgccctgtggcttgtgggccaagaaaactacttccaggcatgccctaggtgatggagagaatacaaaggaatgtccttctgcctcctgccttcttgccttgcatcctagctggccccacggcttgtgatagtctttagatttggtggccactgcatggacaaggagcctactgtaggacatctgcactgcagggactctaaactcggttatgagagggtgtcattccctgctctagaccccatcgctgaggtgttgctgagagggctgggctgggaggcctgcgtttccttggccaccactcctgtccctggtgggagctgacaggctcactctgcagtgtgtatttcagcaagtccacccagtgggactccctgcagactggcttctctaagagggcgtgggctgcagcagccaagagccatgggtgcggctgccaggtttcgagaaagtatttgaggcactggggaggctatgcagagccccacgcccttgctccctttcccctcctggctctcccgcctgcagttttaataggggcagggcctggattaagtgtcttgggcagaatccagcaaccggagtcctttctggcagaggaaggggagtgcacatcaggatcacattccagatacggggacagagattagggaaggataaaggaaagagagtgagaaaattaaatgtggcgagaaatggattttccccttctgtctgaaaataattgagttatattattttgcaaaataatctgttttgaggtttttctagtttcccttcacactaccaactgccttacttattcaaagagggggaaaaagcattcatgctggccttgtgctgcgcgattcctaccaaatacctcaaacttgggtgaggttctgaggtggctttgctgtctgtgaagactgtgggactcagctatagacatgagaactggaggctcagcctccttgggaaggggcggccagatcccattttcaggtcttagctggcttctccttcttttccagacaagtgcctgtagcacggtcttcctgaccttccccttctctgggctttgaagggcttagtcacatttggctggagagcctcaaaggtgtctctctcaccccagggtacggcatcggcctccctcccctccttccaagctgttccttaacattctgccctggcctctttttttgatggtttaattgagagttcctatgtcagggtttcccatatggcaaaacctctgtataatcagtccagggactatttagtgactgttagtaactgtattttaattgtagagtgtcataagataggacttggggcagccatccgacagaaatcccattagatagggtctccatttagaatcatttgataggactgacctgtcctcatagtgtgacagacaggaacaagtgtggggctttcaagagcttcagctctggggccagatttcataaattcatattctggctaagccacttatcaacagcatggccttggacaagactccacttcactgtgcatgggtttccccatctgtaaaatggaggcaaaaataggatttacctctggttgctgtgagaattaaatgaagtaatacacgtaaagtgcctagaatagtgcctgctcaattagtatcacttaacatcatcagcaccgctgtcatcatcatctttctttactatctgggtggcccagtgcaagtgacttagcttctctgaaccttggcttccttctgtgtaaaatggggatgatactaatgggggttgccaagaagattaagagaggaatgtgaagacactcagcttagggcctgacacccagtggaaatggcaaaaatgagttcctctgtccctccccagcacaccctgcctaagcatagcccaccctgtcagctatttaggtagaggattcattttaccatagcaaagctggctgtgtaatggcaaggatagtccttgttactaattttaatttggtacaagttaacgtaatcctcagtctaaagagtcaacaccttttcccaccctcctgtcctccccttcgcatcttctcttctgctatgaattactcagtcacaagaaccttgtacacacccaggacagtgtgaggaggcgtaggggcacagaagatgtgtaagacactctttttgtggtcaggcttaacgtgcttaaaactcttttctgacccccattgcatcattcgcatcactgtcctcttattaatcttgagttatctttgattctccctctattgatatagtaccttctatttagcaaaaacattacttacgttatctcattggttttcacagtaaccctggtaggtagaagctgtattcgtaccattttacagatgagcaaactgaggcttagtgaagttaagagccttcccaaaggtcactcagtaataagccaagctgggattgaaatctgggtatgtggctgggtgtggtggctcacgcccgtaatcccagcactttgggagggcgaggtgggtagattgcttgagttcaagagtttgagaacagcctgggcaacatgagaaaaccccaatctctaccaaaaatatgaaaaattagccaggtgtgatggtgtgcacctgtagtctcagctactcagaaggctgaggtgaaaggatcgcttgggcctgggagggagaggttgcagtgagccaagatcttgccactgcactccagcctgagatcatgccggttcactcaagcctgggtgacagagcaagaccctgtctcaaaaacaagcaaacaaaaaaaacagagaaagaaaaagagaaagatgtgaggattcatcttctgtccttcccaccttgttatcttgtgtctgctgcttcctctgtgttttagctgtctattgctgtataacagaccaccccaaaattgagtagcttaaagaacagtttattatctttcgtggttctggaggttgactgcactcagctgggagattcttgcttagtcttttctgcagctgtactcagatggtggctgaggctggattcatccgaaggcttcttggctcacttatctggcacgtggggaagagctgggggctgatggagaatctctcccttcctatgtgaggaagctcgtgttgtgttggcttcctcacaacatggtggtcttagagtagtcaaatttcctacatggcagccaactttccccagaacaagcattctaaaagatccagttggaagctgcagggtttcttatgacctagctttagaatctcagatcttcacttctagcacattttactggtcaagaaagttactaaggccaatccagattcaacacgatgggttactcggctctatctcttcatatgagaagcagcgtatgcatacagtgagggaagaaattgatggtggccatctttataggataaagacccataaatatttttgcttaaaaaaatccctcttagccattctagtctactactgccaccttagcagggtccagttcttttgcgcatcattttgggttcactacggtactcggactctctccccggcatccaatccaattgtgtattttgctagcatatgactcctcctcagatgcctttttcatccacagttcatgtattcatagatccaagaagggctttagaaattatctaatctcaccttttcactttacaagggagcatattcaaaattgtgtggttaatttttaatagagtttcaggtcagtcagcactgaaggtgccttccttgagccagaagcataaacagaaagaagaccctaaagagcctatggtttaacaggggagatggatatcttagagataattttaatggaagtttgcatatgatcccattgaagcatagtagagaggtataccatacaatttgggtttcagggaagatttcctggagaatgtgacacttgagctgaatcaccaagtatacagagaagagttatctaggcaaagaaaagtggatagagtgtcctgaaagaaaaaggagaagaggtgagcaggcaagggtggcacatgctgtctggtgtttgtagagcatggagggccctgggtatcctactgagggatctggacttgattctgtaggtaatggggagccactgaaggagaagaccatacatgtcttttaacatttattgggaaagagcttaaaagtgactattagctgacctacttctctgtgcccagattctgctgtgatcatgtcactttggatggattttaaagtgctacctcccaaaaaaggacagtcacccaaaagaaaagagaacaaaaatgcttcacatacagttcttaaaggtgcaaatacacacaactgaactgtatgaaaagatgctcagccttgttcattatgaggaaggtgtaacctaaagctattgtcacccctcagagtggcaaagataaaaaatgctaatatcacctgtgatcgttgaagatatgggcttcctcatacatttccaatggaagtgtaatttggggaacttctctgtggaaagcaatttggtaataaccatcaaaattataaatgcacttttttttgacctagcaattctaccttttacctacagctatttcactatttggaggcagaaataaatgctcatgatcatccattgtagtcttgtttgtcatcacaaaagattggaaacagtatcaatgctatgggagaaaaaacgggtcaaacaaattatatttcatccatacaaagggatatgaaatcttgaaaacagaaaatgagactttgtgtatgtgctgatctggacgagtcaccaaaataaagtgttgagtgaacaccaaaaatgtgtaaaaagaggcagacaaataaatatacatacatatttggtcaaatatgcataaaatatatctggaaggaaacataagaaatttatattattcaaaataatgagtggaactgggcgtggtggctaatgcctataatcccagcacttgggaggccaaggcaggtagatcacttgaggtcaggagtttgagaccagcctggccaacatggcgaaaccccatctctactaaaaatacaaaataattagctgggcttggtggtgcatgcctgtaatcccagctacttgggaggctgaggcagaagaatcgcttgaacctgggaggtggaggttgcagtgagccaagatggtgctactgcactccagcctggttgacacagtgagactaagtctcaaaaaaaattataatgagtggctggggtacagaagtaggaggagaatctcactctttactcctttgtaccttttgaattttgaaccatatgaatcttagttttcagaaataaaaatgagacaaaacaaaggcaagattgtagaacaaatcattaccactacaagcttctttaaatctggggtagaataaatattccatggattgcctttaattttatagtcagttgagagagaaaagcctagcctcatcttcctagattaaagactgtgaaaataaaattggaagcaaatatgacaaaatgttaaagtgagttaaggtaagcacatacatcgatcatactgctttttagtattcttgaactattttgcaataaaaaagaaaaattgcaataaataaattaatttccatgcatggtcccggtgctatgctctggagttactgccgacagtgagttccgttttcgtccgcacgcagcactcccaccctaatttcatcctccccctccctccacacatatggagatccactttatttcattgtgttttatattcttctctatgtatactcactgcttcccttcaccaaattataaatgctgtaaagcaggggtgtctaatcttggcttccctgggccacattggaagaattgtgaattagtaaaattcactaacacgaatgatagctgatgagctaaaaaaaaaaaaaaaaaaaaatcacaaaagaaatctcgtaatgttttaagaaagctcttgaatttgtgttgggccacattcaaagccatcctgggctgcatgtggcctgcgggcggcaggtggacaagcttgctgtaaagggtacagagtgtgtctaattcagaagtcagcaaacttcttctgtaaagggccagctattgactattttagactgtaggccagtctgtgtcacaactacccaactctgctgtggtcacacaaaagcagccatagatagtacataaatgaatggatatggctgcattgcaataaaaatttaaaaaaacaaagtagtaaaccagattgggcccaagggccatagtttgccaaccttggtctaattggctgttatattccctttttgctttctcaccttctcaactttccctagaagcctgctcactgctcctggtgtgcatgtgtgtacgcgtgtgtgtgtttgtgatccctgggcaggggagacctgaaaagggaaggaatgagcatactgtgtttctagaatagagtaacccaggctgatagtgtctcaggcagcagtggaaaatgttaaagaatattaagaacaaaaagcgaaatcatgactccttttcaaagacaaaatgaacatgcgtcaaagattttatttaactcattaattaatgagggaaccagtatgatgttacaactggttcaaaggagagaacggacacatatagaggtcatcaggtatgcggaaaggaatttgcttaggataattggcctcttggggaccaggcaaggtttccatttgcatctctgctgacaaaattcatttgcattactatcagttttctacagtttatagagttgtaaagtaactcagttaaagtaatgaaaggcgcagacgtataaaatgagatggtgcagaaagggttccttgaacaatgcctcattattccccacaaaagatattcagaaatcttttctttactcttttccaagttgctcctaattttatctgatagaaatagtattcattaaagttgtgttactcaaggcgatagaagatggttgaactctagacaggaggttttctgatagagcctgtgggaatacaaggtgaaaagagacgccttcaccagaagtaacctagttgagggctgaggtttggccagtggaagtggggtggggtggacaatttcagaggctgttacagaaaaggcagcatgatggcgtggaatcacatgggatgggagtcagcaaccctgggagccccagcctgctacccatcgttcttgcaacactgggcaagtctggacaagtttgctcatctgcagttgggcggtaagatgaactgcctcagaggccattgtatcaaatgagaaggcacatatttcattacttagcactttgcctggtgatagctgtttctaatacagattaatttcccaccttatctggggtactttagctagacattagctatgtgcccttgagcaagttacttcagctgtcttcacctgttcaaatgcggaaaatgatacctccctcacagagtaactaaagaaaaaactagcaggtcgtggttctagcaaatactaatttccccttaggggttcaagagggcttcatagacgaggtgacctgtgtgtcaattcctaatgggtgagtagctgttttgtacatcaacgtttccagatctcatatttcgaatcattagtacgcacatagtttagttttattttattttgtcacctactcttcaaacacttgtgttttctttttagcctttgcatagcgctgagctttaaagcgtgtcttggtaaggggcacacgttgtggtcaaagtaaatgggaaacagtatgaaattgctggaagctgattctgggggtgggttacaaatggaacttgtatgcatgtgaattaatggttttttaaagctctgttaaattgcagttgtttgagacagccctaatcacaaatgttttgacccattgcttccacctaaacaataaaatatcctaagaattctattgttttggcacctaaaactgcatctccctgagtttctcttttccagagatgatacaaaaatcatttatcagacccttggaaatgatactcacttgtagttcacgaaaatatatccactgccccccccattgtgtgtgtgtgtgtgtgtgtgtgtgtgtgtgtgtatgagagagagaaagacagaaaagaagagagagggcaagccaatgacccatgtgattgggtgtgtagtgactaaaggactttgcatgaggatttccaggtgaagcaaagaaagctgtaggtactaactttctcagcttgccttgtggttgtcagtctctacccttcctgtcactgttgctgatgtaacagtaacaaagccaccaaaatggtaacccaggcatgactccagagtaggagcctaaccccagggcacccctccactccatccttctactctgtctttctgcctgcttgagatgctctcatgtatttccttgtctcccaaaaatagccataaacagcacaatctgctgacgctttgtaaaaatacagtggggcggtgtgggggacaaggaagaggttttatgaaatgaaaggaggtctgttctgttctcttgcttccttgggaggccttatggtatgatagcatgctgaagtgggttctgtttggattggagatgaatcttgttaagtccaacccaccaactgaacaggaaactcatgggatgtagctacaagcaactttcctccctctctctctcattgtccccttaaaagtaatttagtaggagaagttatttcactgttcttggttgaaaactcaggtagtctcatgacttttttgatcactctcaagtcatcaagactcctaggaccactggaagttgccaacacagtcacagtcgcaagtcagttactaaaagtatccatctagcctgtgtagtgatcaaaacttgctttaaagttaaattaccactcccctctctaaactagaacttctctcaggtgagaagaggtggaggttccttcttgctgtcctttcacacatcctccctcctacttgtgtcccaggtttttttgttttgttttgtttttggttttgtttagatggagtctcactctgttgcccaggctggagtgcagtggcgtgatctcggctcactgcaagctctgcctcccaggttcatgccattctcctgcctcagcctccccagcagctgggactacaggcacccgcctccatgcccggctaatttttttgtatttttagtacagacggggtttcaccatgttagccaggatggtctcgatctcccgtcctcatgatccgcccgtcttggcctcccaaagtgctgggaaacagctcccggctgtccaagattttttactctgctgggtatagggagggaagaagagctgctgctgcttgatgagtaccattgtgatatctccactggattggcctggaaggtctttagaggtgactcctcctctcatgggctcttttgagagttcttctgaggctcctcctgggaacattgaactatatttcccatgacaacacatgttgcattttcctctggctgtttttcccaatggcccgcactatatgggccctctcagttggggtcagtcactttctcatggaatcctcttatgtgggatttcaaatcaatgcagtctggctctctccccagtctgccttctcttcagcctatgaaaaacactcccacattatttgctccgatcatctccaagagaacagtactcaacaggcacctgtcctttgctcataccactggacacccaatcttttagatttccaggtgggaattagacccagtaccctgtgtcccaacaattgtagggagaccaaatcgaaccctctaatggtctcagtgaagcgcccttctcatactgtgaaggagaggaccctgacccttctccttggcagagggaaatgccagcacagctctctccaaagagctcctctttcaagctccattttctcaaaacatattccatcttctgtgtgaacaagggattcaagagtcgttagtgagttttggctcatgaactttgaaatgtttgtatagcggtccttcaaaatgtagcttccactatttttagaacacaggaacaacccattgtgttataacacccagttacacaaggttgaccttgatgatgtcatcgcatttgttgaacaattacctcatgctaggctctcttttttttttttattttaaaaaaatattttattgttaaattacagagtctaaactgattaccactatgccattcttttttttattattattatacttgaagttctagggtagatgtgcacaacgtgcaggtttgttacatatgtatacatgtgccatggtggtgtgctgcgcacattaactcgtcatttacattaggtatatctcctaatgctatccctccccaccccacgacaggccccggtgtgtgatgttccccttcctgtgtccaagtgttctcattgttcaattcccacctatgagtgagaacatgcagtgtttggttttctgtccttgtgatagtttgctgagaatgatggtttccagcttcatccatgtccctacaaaggacatgaacttatccttttttgtggctgcataggattccatggtgtgtatgtgccacattttcttaatccagtctatcattgatggacatttgggttggttccaagtctttgctattgtgaacagtgctgcaataaacatatgtgggcatgtgtctttatagcagcatgattgataatgctttggctatatacacagtaatgggatggctgggtcaaatggtatttctagttttagatccttgaggaatcaccacactgtcttccacaatggttgaattagtttacagtcccaccaacagtgtaaaagtgtttctatttctccacatcctctccagcacctgttgttttctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttctttgtggattctggatattagccctttgtcagatgagtagattgcaaaaattttctcccattctgtaggttgcctgttcactctgatggttgtttcttttgctgtgcagaagctctttagttgaattagatcccatttgtcagttttggcttttgttgccattgcttttggtgttttagacatgaagtccttgcccatgcctatgtcctgaatgtaattgcctaggttttcttctagggtttttatggttttaggtctaacatttaagtcttgaatccatcttgaattaatttttgtataaggtgtaaggaagggatccagtttcagctttccacatatggctagccagttttcccagcaccatttattaaatagggaatcctttccccatttcttgtttttgtcaggtttgtcaaagatcagatggttgtaggtgtgtggtattatttctgagggctgtgttctgttccattggtctatatctctgttttggtaccagtaccatgctgttttggttactgcagccttgtagtatagtttgaagtcaggtagtgtgatgcctccagctttgttcttttggcttaggattgtcttggctatgtgcgctcttttttggttccatatgaactttaaagtagttttttccaattctgtgaagaaagtcattggtagcttgatggggatggcactgagtctataaattaccttgggcagtatggccattttcacaatattgattcttcctatccaggagcatggaatgttcttccatttgtttgtgtcctcttttattttgttgagcagtggtttgtagttctccttgaagaggtccttcacatcccttgtaagttggattcctaggtattttattctttttgaagcaattgtgaatgggagttcactcatgatttggctctctgtctgttattggtgtataagaatgcttgtgatttttgcacattgattttgtatcctaagactttgctgaagttgcttatcagcttaaggagattttgggctgtgacaatggggttttctaaatatacaatcatgtcatctgcaaacaggaacaatttgacttcctcttttcctaattcaataccctttatttctttctcctgcctgattgccctggccagaacttccaacactatgttgaataggagtggtgagagagggcatccctgtcttgtgccagttttcaaagggaaagcttccagtttttgcccattcagtctgatattggctgtgggattgtcatggatagctcttattattttgagatacgtcccatcaataccgaatttattgagagtttttagcatgaagggctgttgaattttgtcaaaggccttttctgcatctattgagataatcatgtggtttttgtcgttggttctgtttatatgctggattatgtttattgatttgtgtatgttgaaccagccttgcatcccagggatgaagcccacttgatcatggtggataagctttttgatgtgctgctggatttggtttgccagtattttattgaggatttttgcatcaatgttcatcaaggatattggtctaaaattctctttttgttgtgtctctgtcaggctttggtatcgggatgatgctggcctcataaaatgagttagggaggattccctctttttctattgattggaatagtttcagaaggaatggtaccagttcctccttgtacctctggtagaattcggctgtgaatccgtctggtcctggagttttttttggttagtaggctattacttagtgcctcaatttcagagcttgttattggtctatttagggattcaacttcttcctggtttagtcttgtgagggtgtatgtgtcgaggaatttatccatttcttctagattttctagtttttttgtgtagaggtgtttatagtgttctgtggtggtagtttgtatttctgtgggatcagcggtgatatccccctttatcatttttcattgtgtctatttgattcttctctcttttcttctttattagtattgctagtggtctatcaattttgttgatcttttcaaaaaaccagctcctggattcattgatttttgaagggttttttatgtctctatctccttcagttctgctctgatcttagttatttcttgccttctgctagcttttgaatgtgtttgctcttgcttctctagttcttttaattgtgatgttagggtgtcaattttagatctttcctcctttctcttgtgggcatttagtgctataaatttccctctacatactgctttaaatgtgtcccagagattttggtacgttgtgtctttgttctcattggtttcaaagaatatctttatttctgtcttcatttcattatgtacccagtagtcattcaggagcaggttgttcagtttccatgtagttgagcggttttgagtgagtttcttaatcctgagttctggtttgattgcactgtggtctgacagacagtttgttataatttctgttcttttacatttgctgaggagtgctttacttcaactatgtggtcaattttagaataagtgcaatgtggtgctgagaagaatgtatattctgttgatttggggtggagagttctgtagatgtctattaggtccacttggtgcagagctgagttcaattcctggatatccttgttaactttgtctcgtcgatctgtctgatgttgacagtggggtgttaaagtctcccattattattgtgtgggagtctaagtctctttgtaagtctctaaggacttgctttatgaatctggttgctcctgtattgggtgcatatatatttagggtagttagctcttcttgttgaattgatccctttaccattatgtaatggccttctttgtctcttttgatctttgtggtttaaagtctgttttatcagagactaggattgcaacccctgcctttttttgttttccatttgcttggtagatcttcctccatccctttattttgagcctatgtgtgtcttagcacatgagatgggtctcctgaatacagcacactgatgggtcttgactctttatccagtttgccagtttgtgtcttttaattgtagcatttagcccatttacatttaaggttaatattgttatgtatgaatttgatcctgtcattatgatgttagctggttattttgctcgttagttgatgcagtttcttcctagcatcgatggtctttacattttggcatgtttttgcagtggctggtgctggttgttcctttccatgtttagtgcttccttcaggagctcttttagggcaggcctggtggtgacaaaatctctcagcatttgcttgtctgtaaaggattttatttctccttggcttatgaagcttagtttggctggatatgaaattctaggttgaaaattcttttctttaagaatgttgaatatggacccccactgacttctggcttgtagagtttctgccaagagatccactgttagtctgatgggcttccctttgtgggtaaaccgacctttctctctggctgcccttaacattttttccttcctttcaactttggtgaatctgacaattatgtgtcttggagttgctcttctcgaggagtatctttgtggcattctctgtatttcctgaatttgaatgttggcctgccttgctaggttggggaagttcttctggataatatactgcagagtgttttccaacttggttccattctccccatcactttcaggtacaccagtcagatgtatatctggtcttttcacatagtcccatatttcttggaggctttgttcatttctttttactcttttttctctaaacttctcttctcgcttcatttcattcatttgatcttcagtcactgataacctttcttccagttgatcgaattggttactgaagcttgtgcattcgtcacgtagttcttgtgccatggttttcagctccatcaggtcatttaaggacttctctgcactggttattctagttagccatttgtctaatcttttttcaaggtttttagcttctttgtaatgggttcgaacttccttctttagttcagagaagtttgatcgtctgaagccttcttctctcaacttgtcaaagtcattctccatccagctttgttccgttgctggcgaggagctgctttcctttggagggggagaggcactctgatttttagaagtttcagcttttctgctctgttttttccccatctttgtggtttcatctacttttggtctttgatgatggtgacgtacagatggggttttggtgtggatgtcctttctgtttgttagttttccttctaacagtcagtaccctcagctgcaggtctgttggagtttgctggatgtccactgcagaccctgtttgcctgggtatcagcagtggaggctgcaaaacagcaaatattgctgaacagcaaatgttgctgcctgattgttcctctggaagcttcgtctcagaggggtacctggccgtgtaaggtcagtgtgcccctaccggggggtgcctcccagttaggctactcgggggtcagggacccacttgagggggcagtctgcccgttctcacatctcaaactccgtactaggagaaccactactctcttgaaagctgtcagacagggacatttaagtctgcagaggtttctgccgccttttgttcagctatgccctgcctgcagaggtggagtctacagaggcaggcaggcctccttgagctgcggtgggctccacccagttccagcttcctggctgctttgtttacctactcaagcctcagcaatggcgggcgcccctcccgcaggctaggccctctttcttgttatctcttttcaatcttgcaacaacctcctttcagagagaagaaaatcgagagattctaagactggtctaaaaatattcagatagcattagggttggggttggaaacagtttatctaaatagttcataatttcagtcttaactgcctctttaatcaaaaagttatttagaagaatgcctataactgcaagtggatggattaaaaataattcttaataatttctagttttattgctttttgggtcagaaatatagccctgaataagtctgaacttttaaaatgtagtgaattttgtattatggtctaatacacaggcagttttagtggctgtttcatgagtctttgaaaagactgttatttcctttctttattgggtgccgagttctctggctttctcctaacttgaacttacatgactcctattttagggtctaatacacaggatatcccggtggctgaaacaaagacattttggaggtgcttatgactcaaatagcaaatcatcattgaaacacattgacatacctcaaacccaactatatttttgggatcttttctggatccataagatctggtggtgaagctttccttcagcttctaaaagacagcttcgaatggtggtcaggaaactcgagttcttggccctactctgccactgacttgctcctgtccaaattgcctctccatgagctacaagggtccaggcagatgttgtcaaagtccattctgcttccaaaatctgtgactctgtgtggtgggactctggcttttcatcctgaaggtcacaggcagttcacgaaagacagtgttcccgttgagagtgagtgagtgtttcttggagaaagcattatatacacacaaatgctgcatgatggtccctgagaattaaaaatcattactttaaaaattctgaaactgcttgtctgcaatcagttgtaaagtcactaggacaacccttccctcaggatgttatgtgaacactggactgaattcaactacaaaataagtcaagagggtagacctggaatgatatgcaaaatgctggcttgtattttcttgtgtggaacagctgagcatgggctgggtgatgtttgtcctcttccaaagtgatgcaaacacatgtttctagtgctcagtactacagtccttctgccctgatgtccttgactgtggagtggtagaaactctcaaatgggggatgcagagggaagtgtacctttctttgcaaagcactcagttcattttcttcatttcaaatgtaccatgaagtcgatatcttcattatttcactcatttcccatctgtcgagcactcagtatgcatcagggtgtgctatcttctggggagacagagctggataagagagagatcagcaagtgagtatctgttacttcttatcccatctaaagtggcacatgagctaaccacatgctatatatgaataattggatgcaataagaaggggatgtggtaagaaaatgttcatctaaatatccaaatcagaaagtggtggttctaggggaaggagtgaagttctaccagttctgctgttagaaaggctgcctctacctcatcagagctctgggtctccctccagcttcttcagaggctgcattgaggaatgaatcttgagggtgagcaatggccctgaccttcagactttgaattctaggaaagaagttgcttgcaggaatgacctcagcctaatcacttgaaattaaggcagcaaaggaaaacgcccaatctctgtttataaatgtgcaaaacaatttgctagacaaggctattactcaagcaagagactattcacagatggtggcttgggctgggtagacacaaaggctaggacagcagaccattaatcaccatgcacagacgtgctgcttggtaaaagtgagcctcccagactaagaaagggtgtactgtaggggcttaatgtggaatcacctgtcctgcgggtatttagagaaatcctcacagccacagaaatccccagaagcccacagaagggatttcagacaaatccacatctcctcacactcccttttccccatttcccccacttcctaaatgtagaacaattccaggatgttgcaaatgtatgcattcacttaataaaaactgcatgtctgccagggaccgagcaccacgaggattgtgtacactaaagatgatcttttcatccaagtatgttacagtttacatggagagatgaggcagagtatgtgcatgtggacacatatgtgtgcgaaagggaaatagcccaagacagtgatgttttctccctcttcctgacaacttctctccatcttcatctcaacctcattggtgctttcctctgagcagccttttctgaccttccaagaccgagttggatgctctggttctgtgttctcatcgctgcctatgcttctcccctcccatcactttcacactgaattgtaattgcctgttcagttgtttgggtcactcttccccagccccctactgtgtcttttttgggagcagggactttgcctgtctgtgttactcctggcacaatacatgtttgttgacagattccacaagcagtattgatgatgtcctctgtgagtggagttggaaggggtcatttgaagcccaggagaaggggttccagccagccttgaaagataagttaagaacaagaggagagaggatgtggttttatctagtgcagtggttctcaaagtgcggtccctggaccaaaagcatcagcatcacctgggaacttgttaggaatgcaaattcgggcctcactcccaaatttgctttcacattccattgcattccacacctactaaatcagaggctctggaggaggaccctggcaatctgggttttaataaaccctccaggtgattatggtgaacttcaaagtttgagaacaactgacctagcacttttctactatgactctgtattatttatcactgagaccaatgtactgtcacataccgactaggccctacctgcgactttgtgattatgcataacaaatagagtttgtctcctgctacttgcagttgattaatggcgagagttcttatgcaagagattctgagaccatgactgtgcccaaggtgaaagagtgccagaattgattagtaatgtctgtcatgggtgcaggaggaggagtactcacatcctttgctcacacctcttgcatgtgctgtctctgactggagccaatcctgaatgtatgtaggacaagatgaaggcagtgctcaggtctgagggcctggctgcaggctctcttctgatcttcatgctctgaatttttaggacccagcctccttccttatgccctagtttagatgtcctgtttcttgacactgttcttaccatgattgagtctcccacaccagtcccatactcacctccttcataccaccactcttctgggtcttgattgatagtttgccctgtcactgtttggccagaccaccaacccttgttctgacttgcaacctttttctggccattctgtggttgggtcagatcatttggatctcccctgggacacacataattctgatctgccctgagaaaaacaaatctttcccccttgctcccatttgcaaactctttgcccaaaccaggccaacttatgttcacagactcctagtctctgctgtctcctcaacctgtgctagttatccaagaaagggatcccaggtgatgggaccagtataagcaaaggcatgaggtcagaatatgaaaaatatgattaggtctgtaagtagatcagtctggctgggttaagaactcatgccgagacatattggattgaaacatcagcaaacaattggtaagatcagattttgagggtctcaatcccccagctctggagcttaaacttcatgccctaggagggagctaccaaaggctctgggttggggaaggtggtgacaccttaaggagatgctgtacgaatactcacctagcaggtgtgtgcagggtgatgtgcagggagggaccaaaaggaggtggccacagttatctgggcctgatgtggcactgattgtgggaagaggaaagaaatggacgtgagaaaggaattctggagacactcccaggagggaatcaatgtggcaggatggctgatttcatgaagggggtaaaggacagagaagagtcaaggtgactggaataacatcaaacctgacacaaagagggatgcccagtggggaagaacagatgtgagaggaagttgaggacttgaaattaacactaaatgagtttgaggtgaaagcagggaatcctggtgggaatgctgagcaggtgaatggaaatccaggaccacaggcagtatgtgggctaggatcaacaggaatgtgggtgttccccatcctaggagacagcaggaaaggggagaggggaggaaggagctgtggactctgagccatgacccttggggaatgtctgcatcggggtggagaaaaaagtagaatcagggaaggaacaaccccaggggaagggaaccagggggctgtagtgacagggatgcaaagggacaagaggacattgaagagaaggtggtcgtctgcagtgttagtgctacagggaggataaggagaaagagggcgggcgtgatgaggcctgcctgtgggtttagagacaacacccagggtgcagtgggccattctgtttcagggcagctattcgggacctaagctaaccgtgtatctccagggaaactcttttgctgacaaggttgcaggtcatcctgggcctgagaactttgtgatatacagaagtcattctttaaagtcctgttctttcctgcttgtgatcacactcttgccttcttctctattcccggacatatccacaacacacacacacacacacacacacacacacacacacacacacacacaatttccttcagtgactcttctgaaagccaacctgaaaatagcagaacataaattgtcctgccattttccacctacttataggcttagttgttcaaggctagctactgagatgtcgggaagaaattatctgccttgtacagttgttcaggttgtgcactgcacagggtactgcatctaaggggatagcatttacgttgtagatatctttattttgatttttttcatattttattataactattgattctaaagattagtgatgtgtatatttattagaacaactttctggcaggtaacagtaaagtggctttttctaataatatcaatacatcatacagttttctatcgggtcaaaataaagatgctgagaaagggatgccttcactattcttgtaaaggcatgatgaaagtggcctggagagctcccaccagatgaatgaggggtggaggcttttgtgagtagatggctagccagcttctttccaggtgtggaccatcagaatgggcactggttgattcattctaattgaacaatcaattaccaaccacttgttgtgtgagaagacctctgtctaggctatgagaaagacaaggtcccatcatccttgaggaattcagaatttcaatgagaacacaggtaggaaaacaatgtaatgcagtaattgcatatataaagtaccaggggatgcttcgtcctgccagttgcactgttccactccattatgctttagtttttttagtggaataagcttaaatattagccataattaaagcatattttttaatgaatattttatggttgagagtcactgcttaataaacctaattctttcttctaggtataagaaggtaatgttgttgtcattattgttttttgttatttttttgaggcagggtctcactctgttgcccaggctgcagtacagtggtgtgctcatggctcactgcagcctggaactccggagctcaaaggatcctcctgcctcggcctcttgagtagctgggactacagttgcatgccacaatgctgggctaatctttttattttatgtagagacagggtctcactatgttgcctaggctggtcttgaactcctgggctcaaacaatcctcctctgttggcctcccaaagcgctgggattataggcatgagccaccatgcccggccagagggtaacttgttttaagccagttgttgagatcaaaagctttttaaggcttctgctccaggattaggtagcactggtgtgtgtgggtggggagggtttctttagcttttctcattttctcattgttaaagtacatcttagctgttggttacagagaacaaggaaaggtcatcctacccatcttttcagttctaaggggattctggttctcttaggtttacatggctattgttttcttatagtcagctgttgtcatatctaacttgtccttcgccagccctccattcctaagaggacagttttccttccaacctctgactccattaagtttgtagtttatgacaaattactgaagcaaatggcttcttttttttttttttttttttttttttgagatggagtcttgctctatcgcccaggctggagtgcagtggtgcgatctcggcttactgcaagctccgcctccagggttcacgccattctcctgcctcagcctcccaagtagctgggactacaggtgcccaccaccatgcccggctaattttttgtatttttagtagagacagggtttcaccgtgttagccaggatggtctcaatctcctgaccccgtgatccacccgcctcggcctcccaaagtgctgggattacaggcgtgagccaccgcgcccggccacaaatggcttctttacacatgtatgtgtttatttgctgacctttgttgttgttgttgttgtttaaaaaaaaacttcagacaaattaaatttaacagaatttaattgaatgattcacaaatggagtagcccttggaaccagaacaggttcagaaagaccagggctgctacatggctgaataatatttatggacacaaaaaggggagtgagatacagaaaacagaagtgaggtacagagaaagctggactggttaaagcttggagtttgccttatagccacctgtgattaactgaaggttgtctgctgtgaccggctgagactcagctacttattacaaaggcaaattccaaagttaggttttcatttttgtttacgtactaagttggttgcagttatgtaaggactcaagtatgcaagtacagaggctttctcaagccaaatttagttgaatttaacaattcccttcttcttttggtcagcctctgaccaaattttgagagattgatcaaaactttgggcattggtgccactctctgtcgtcatcataaaaggacttatttggtctcagtacagaactcataactcttatttggtcacagtatggaattcacaagtcacaatgtcatgtcatcagttgaataattttttatattcttgctaatctagtcaaaatgaaaccgtttgatgctcaatgaatggctgcatacaaatatttaagacttgagagggtacaacacacccaggagacgactgtgatcactatcaagagaatagtatcaaaagaccaaagtacactccttaacaagagcccatacagaccaatctaaatcaaacaaaccaaacttctggaacttgaggcagttcaataatagctgagtctaactgatcatagcccctgttttggttttgatggcaatcaagggaccctatcttgttgcaaaatagtctgactcaaagaggtatccatcttggtagtgagcctggcaacacatgtcatagcaatctggagacacagtagaagaaacacagattggaaactttgaaaagccaagcttgccacccaccacttaggatgcctccaaaccaactgttagctgcttccgtaagcatattatattatgcattcctttccctttctcttatgggaaaggaacacataatatgtttattgccgtcccattgagggtggcaatttaatgtcgtccctctgtaaatgttcaaatggcccatcaggtagtggaaatgcaccacctaaagttttgattgtcttcctaggattatgggcttgacaagccaaacattggttgtagaccattttagcaagcttagaatagtcaccacactaatatttttcattatttatatcattttgcctactgcttgatgagttacagagtgcagaacttgtaataagggaaactttaaggactcaggaagggccccagggcctccatgagtccacactttacactgactttgcatccttttaaatatcaattttgttttccaattcaggtacttagcaccatttattaaatagattgccataggtaatttaatttggatcaatcttatgaagttcattcaaattgcatatcttaacaattttagtattggctgacttaatataaaaacctgccaaagcatttccttggtgttaatatttaattaagttttgctctggcttgatgttgggctagcagttttataaagacagtcagtttcttcctaagcattctgggaattattacccttccattggaattatcttaaggttgtcagaaacctgtacttgtcagagtcctttccatcctttccatgaacctccttggacacaaagcacttttggattatcgatagttgactgtggatgacaaaagacttaacatgtccagttaaaaatctaatgagaattcattataatcagcaattgaaaagaaaatttggttatttctgtagcatagaacattttaacataactgaaattatgactgctgccgtattagatttttagtaatcccacacaatttttggaacagtcatcttaatatcatatccataaaagtaatttaaatgttaaacattatttcttatttgacaatgcttcccatatagttaacatatcaagtaagtctactcagtttaatatctctttttttaaaaggtgagagatacatcctttgcgattttccaggggccctactgagaaatcacaaagttaattcaagatcaaaaagaattaatttagatttgatttggggaagtttgtcaaaaatgtcaaaaagtttaaaacacttaaatatgaccttggttatgtatttaatcaagatgacaataaggtattttaaggacaaatacagaagtttacatagttgtaggaaaaatcttaactttttaatagagaagacccagttttctttagtaatcaaagacctaagaaagacaacatgaaggacaggaaagtgtttcggtaaaacacagaatttttattttctgggccaaatgcctaaaaggtaaagaaaaacctttcacgatttcctattaagagcagaagccaatactccaagaaaacgttcttcttttaacagagaggaccaaatgctagttttgcatcagtgtacttttgctattagcactcaattttagaaaaacaatttccttctaattttagccaacttgatcacatataaaattccttttataatacgcatcttccacaaaccttctacatcttatccatttagttttatccagtcattcttttcttccttcattccttctgaaaccacctccaaactagataagactactcttccttaacaatataacacatcctcatgcctttcttataactttcctcaccaaaaacacatcttacttttactgtttcccttattatatctagttttaattaccttatatttattagaattttaaactattaactttaatttctcatggaataaataattttgaagggagatgataccattttataatttttagaaatgtattttctcataacacaattttttatgtttcctaatagacccaaatatatttagcttctctatactgtattaaaaaatgcagaagtatatatactctaaacctatgtccagcaattaatgttccagtattttaacttacttagacatttaataagtatctattacttaatgtaacatgactttaagacattaagttactggaaaataactttgaaacaatgaattttgaaacaagtttatcccatcctaacaaggggttggggttgagtcaagggacccttccccccatcattgtttttttaaattaacctgttagattattgccctaagtgatttctagtttgcttattataatttctgtcttcctactttttgaatttctccaaattgctgtaaatagaggaaactggttttggaccctgtaattttgggggaccagcaggggtccccctcgtctgtccagcctttggtagatttggcctttgttttaacctcagaagtctgtttgacttatccccttttatcataagcatctaatgatttttttcctaaatttgcatttccaaagtgatggcttaagcaaagctaggtagaacatttatatctcaaaggcacggaactgagacttaaggcttgaataccatcatttgcccaaatcaagaaagaaggtcatactttaaggcctacttaaggcaaaatggccactgtgatattgtgatatattgcgatataaatttaaaccagtgtcttttccattttgagagtttcaaatgactggatccttcctctgttcctggtacagagaggctgacaactttacgaatgtggattttttttaattgatgtaaatttcttttacaaaaggatttcaaaatagccagctaaatgccagaaaagtgtatagtcggccctctgtatctgcttctgcatccatggattccaccaaccatggatcgaaaacattcaggaagaaaaaaacaatacaatcgtaaagagtcatacaaataaaaatacaggataacaatcatttacataacattcacattgtgttaggtattataagtaatgtagaaatgatttcaagtatacaagaggatgtacgtagtttatataatacgccgttttacataggagacttgatcatctgcagattttacatctgcaggaagtcctgaactaatcccctgtggatattgaggaatgactgtatttgagagaccaatttagttcaataggtggtctctttgcaacttagcttctgtttcttagctaaaattactaattcagggcagagctcattaacaaatagggcaaagaaactattttgtggccgggcgcggtggctcacgcctgtaatcccagcactttgggaggccgaggcgggcggatcacgatgtcaggagatcgagaccatcctgactaacaaggtgaaaccccgtctctactaaaaatacaaaaattagctgggcgtggtggcgggtgcctgtagtcccagctactcaggaggctgaggcaggagaatggcgtgaaccccggaggcggaacttgcagtgagccgagagtgcgccactgcactccagcctgggcaacggtacagagcaagactccgtctcaaaaaaaaaacaaaaacatgaaactattttgtgtgcctggattcagcatggatagcactgaaaaagatgaagccttcctttatctgaaggtatacctttataaacactttatccagcttgctttttgccttctggatgaggtaagtagctaagccaaaaggttagcagattcaatttttctttcaattagttgcttcagttttttatttgccttttgcaaatagtcttttaaaagaggcaataaaatttttgaaaccttcttagaagcatctgcacatcaataggcttcccgggtgagcctagttctggagcccacattttaaaatgcacttcttaaagtgcagtgccgttcatttggaaccatccacataacggcattgtaattttaaattatcttcagtaagactttgcctttcagggcctaatactaatacatgtaaaggtagacatgacaagaaagtggagtactcaattcttccaaagttaaggatcccatttttatgttgaatgttggccttggctctcagatccccttaaccagcttagccaatgatttttctttacctaaacatgcaagaaaaagaaatgatgaggataggacacaaaatccctgcaaatttctgaaagctggagtttgcacccccttcagtaattgccatttactgccagtttccctttgattctgtcagacatctgaggcctatagctggatccagtccagttaattattggatccaatccaatcctggatccagtccagttgctttcgtgacttccgaacccaattcagttaaaaaaaaattgctcatataaactaggagagctctagacacaacgctgtggagttcagaactcaagagaaaaactaacccatgacctccagttacaaacgagagcagtgagcactttgggctccatggatacctcacctggttgcctggtgttcctgggggtcattggagtctgactttgagtcccacttgtgacactaatctcttaaaagaaaaaccttagacaaataagagtttaatagagcaaagaacagtttgtgaatcgggtagccctcagaagcagaacaggttcagaaagactttggggctgccacatgactggacacttatggacacaaaaagggaaggattgtacagaaaacagaagtgacttatagaaacagctggctcacttagagcttggagttcgctaaagcgaataaatttgaacctggtttgaatacgtggccacctgtgattgactgaaacttggctgccctgattggctgagactcagttatctgttacaaagccaaattcctaaattagatttatggtttgtttacagagttaggttttggttacataagggcttgagtatgcaaatatggaggctttctcaaatcacgtttcgtttaatttaacaccttcataaataggatggacttaagagatcatcccaacctccttactgtacagatcaagagatgggggtccggaaagctgctgatgttcatgctgtgagtttaacaccaggaaacaacaatttatcagtagaactgtgtgttagtttaaagaaagcaatggcagaatggaggcagaactctaaggaaaaatgaggaaagtgatgcttaagtagctagcggaccaacagaaatgtcagagaagaaatcatattctctgtctcataggcaccagtatttcctgggactgtttactgagtaggtgcttagtgaagattgaataaatgccaacgtacagaaaagcaacaccagaaatcagagagtgacaaccacagccttgtttctgctgcccaaatgttaatgggttgacttccattaaaaatcaaagacaaaacaggcagctacttaatggtttgccagccaaataaagaagctcatgctgtgagcagctaagataatagttcaaaggaatgctacccaaggaggacaggtaagcaatttccagattcagccaagggttccaggactaacataaggatgtacaattataaagaaagactgatgaggacctgcccaaagcatgtggagaaggccaagagggggttaggggaggtgctgcaaataccatgacaatagagaccactgggaacctcagagaaaagggaaaaggggcatatattttcaataaaatactgacacatgtaagagaaaatggaaatgtgaattagacataaatttatagaaaaataaagctaacattatctgcctttaatgcagacatttaaatttccagcagatggagatgttaccacgtgaaagagaagtttgacaggtggactcagcttcgctttctaaaacatgatggtttgtttcttaggagtgagacaaagagaagacccctaaaataggtagactcctgagctttaaataaataatactttttaaaagaaactttaagtgttacctgagttcctaattcagagggttagctttttaaatgatgaaagcattcgccagttgtttccttgttttagaagaatttggcaaaaatcatttgttttctaagctttgtgtttggaaacagaacagaaaaggattctgttcgcctcgtaatcaacatgtatttgcattacactgcttgctactttaggaggcaaggtttccgggttttctgtttttgtttgtgctgtctttttcttttctggtctctagagattcctttgcagcctatgggcatagggtcaagttgttttcagtttgcttgtgttttgttttaggcttcttaggacttgggccggatgcttttatcacgtttgaagaatgaatagctgtgcgctggaaactacctgctaggcataactcattaacgttaaaaaaaaaaacaggctgagagactatagaaagggatctttttgactgacattgttgtctgggtgaactcaggtgttagggaaacatttacattatctgctcaggatgctgtgatttggtgattctctccaaaccaaatggtacccaagaatcggggcttacacggggtttcactgtagacagacaacgtgccttgagatttaaagggtatcatttttttataatttgttttccttccctagagtctttttcctaatatgtataaacaaaataactcaaaattcattcaaatgcattttcaggaaaaaaggaaatatgctgttttagattttagtcttagaataaattccaggtggaggatgaatgggtcagtgggtatgaattatgttgcctgatatctgtcttactttcccaaaagctgtaccagtcatatgaagatacaactttcatcccgaacttgctttatgtgctgtccttaaaaaagagagaaatctttcttgttgattgtaagtatatacaacaaaggcttagaaggaaatattatggtctggtcagggaatctcaggcatgtagctcagaatcctggtcagcacagcttaggaaaagcatcttaaagatttttttctcagcccagaacccctcttccaaactgctctaggttcaagcaaaggttaccctcccttggccaggggacctcttgctgcctgccagccagggatgtctggatcttcttttgatcttattttcccccctcaacccagagctatttaatctctcctgggagagacagaggcatttgttatttggccatcaacagttaactgcttttgtggtttacacacataaacagaagacaaatcaaaactacactcaggatatcacactttctctgtaaaacctgagactttaacaagaacttactttaccttctttcacataaatcatcccttgaattcatccagaaagaggcaatcagtttgcgtttttaacactcttgagggcttcttaaatttctgctgcatagctgcttggtttgttccctttagcctgtaggtgattcattaatttgctcaccaaacctatatggagtacccactaggtgccaggtactttatagtaggagaatgtgggtgaagtgatggaaatttatccttagtaatggggaacacagcaactttcatgcaggctttattggttttgggtcagtaatgtcatcttcatttccaaaggacggctgatttttccatctaccagaatgtgttccttactgaaaggtcttctgttgttcagctcttcctgtatgcccagctttagatgaaggggggaaaaataaaaacaagaaagccagtccctataggacagagtggtctggtaggagatcatctcagctactctaatttgctcaccaattttacttacttgtttcattcgagtattgatttgattctttggagagagtgtgtgtgtgtgtgtgtgtgtgtgtgtgtagggagggagcaggctttggatgtttgtatggactcaggcatattgagtccttttttaaaaaaattgtgataatatgataaaatatatatatataaaaaacataaaacttaccatccaatatggtttggctgtgtcgccacccaaatctcatcttgaattgtagctcccataattcccatgtgttgtaggaggtgacccggtgggagataattgagtcatgggggtggttcccccatactgttctcatggtagtgaataagtctcatgagatttgatggttttataaggggaaaccccttttgcttggttctcattctctctcttgcctgctgccatgtaagacttgcctttcaccttccgccatgattgcaaggcctccccagctgcatggaactgagtccattaaacctctttgtctttataaattacccagtctttatcagcagcgtgaaaatggattaatccaccatcttaaccatttttaagtgtacagtagtgttaagtacattcacattgttgtgcaacaaatctctagcattcttttcatcttccaaaatgaaaactccatacccattacacagaaactccccatttccctttcccttcagcccctggcaactattattctactttctgtctctgaatttgactactctaggtacctccgagcagcagaatcatatgttatttgtcattgtgtgactggcttatttcacttagcacaatcacctcaaggttcatccatgttgtagcacgtgtcagaatttcctcttttttttttttttaaggctgaatgatattccactgtatgtttatatcacattgtgtttacccactcatccactgatgggcagttgattgcttctaccttttggttactgtgaatgatgttcctatgaatgtgagcgtattcatatctcttcaagactttgttttcagttctttgaggtatatacaaagtagtggaattgttatgtggtaattctatttttaaatttttgagaaactgtcatactgctttccacatggctatactattttacattcccaccaacagtatatataagggttccaatttatccacatccttgccaacacttgctattttctgggttgtttttttttttttttttgacacagagtctcgctctgtcactcaggctggaatgcagtggcatgatcttggctcactgcaacctccacctcctgggttcaagtgattcttctgcctcagcctgtagctgggactacaggcgcccaccaccacacccagctaatttttgtatttttattagagacagcatttcaccatattggccaggctggtcttgaactcctgactttgtgatccgcccacctcagcctctcaaagtgctgggattacaggttccatttttgagggtgaaataataaatcagaatgagcaacatattctgggcaatccctgaattttcagataaatagaaacaaagcaggaaatgctcacattggcctttatatatacctactatcaaaaaccagacaggatggacccagtgaaatataggccaagggcttaagagagctcatattacactttctgtcttttgatgttatctgagtttcatggcattatctgtttttggcgaacgtccatatgactttagctggacaaggaaaccaggaaggaaataggaaaccaagatggaaagaaatatttccttcctttacccttttttacttaaagggtaaaagtattggaagattcaggattgcatagataagctgtggcaagtttgactttcctttacataagtctacagaggctaaatccaattttggatcttgtatctccctatgtctactttgtcatatagccctcctttgacgtctagccctctgaacccacagtaacaggccttgaatgtccttgatttaaactcgtgtctgcatttgtcagagctctgccctgaggagtagtttaccatattgagttacctagcaattttccttgaatcctgatctacagagtagagttggaaggggagtaggaataactgggattactgtcagaaaaaaatcacatcctttcatctcaaatatattgggctttcaaagaaaatttgtctctttttccgggctcctcaatttttaggtaattatgattggctaaatctttttttttttttttttttttttttgtacagagagggccttgttcagtcacccaggctggagtgcagtgacacgatcatagctcactgcacccttgaactcctgatgctcaagggatcctcccatctcagccacccgagtagctgagactacaggcataagccaccatgccggctaattttttttttttttttttctgagaccatgtcgcgctctgtcgcccaggctggagtgcagtggcacaatctcggctcactgcaagctccgcctcccgggttcacaccattctcctgcctcagactccagagtagctgggactacaggctcccgccaccacgcccagctaattttttgtattttttagtagagacggggtttcaccgtgttagccaggatggtcttgatctcctgacctcgtgatccgcctgcctcggcctctcaaagtgctgggattacaggcgtgagccaccgcgcctggcaactcatgccggctaattttaaaattctttttgtagagacagggtcttgctatgttgccaggctggtcttgagctgcaagcctcaagcgatcctcctgcactgggcttcccaaaggactaagattataggtgtgagccactgcacccagactggttggctaaatatatccaagagaaagtagagcatcaagcttttgctacatatttaaggtgaagtcagggaactgagtctagggaaaaagccagtgtcacacacctggctatatttatgttccgtgtcagaggaagggcgggcgaccagggttcattccaggtatctgagtctgtagtcacacgctttccattgaatctgagtatgcttgttagtgggaactttcactgaaggaaaagaatagtgagtccttcattaagacttgtgtttatcagtggctgatgattgaactgcaggagacgatggcctctcagaacacaagagactctcacaagaaggaagattaaaactaggtctctgtccagatccaataacaaaatgaaacttgcaggtggctgtttgcaagaaccatacagaggaaggaaatagaataatgagaccctcaacagcatttctagatttggctactgagcagctggagtcctgaaatgcagccaaaatgccgtggaacccatctccctactcttcttccagggatattttaacttggccatgtttctatgataattttcagagaaaattaaaagaacaggcagctcagaagggctctgacgacagcccaagatcaatttactacttaagagcaagagaatatgcaaatgaagccttgagaccactggggactactgcccacccccaacttttctgccaggggttgccacatattgataaatgtcgatatttccatgtctgcaattcttataaagcttccaaatgcagacattcccctacttccctaggcatctagtttcacgggagaagaggttaacttttattgagtgcctgtgcttttacaagcattctcttatttgattcacagacaaatctttaagataagccttgtcataccgattttgacaggtaagaaaagcaaggttcatagacttactttgtccaatgacacaagcttattaagtagaagaactcagattcaaacccaggtaaggactatgcagagatcatcctctttctcttttacttgtatgcctttcagtagattctccagtgtgctaggtagtttgtctaaaggcctaaccatcatccttcctgccacatttctttgaatataattacattttgaaggttctaatgaaccctgagggccttggctatggaaccataatgctggcagcagctagttctgcagagcatctctgtgtctcagagagcttgagaggaaagctacacctcatttaactcaatggccaccatccaaattgtcccacggtcaagaagcgggctgcttttcatgtgtcttctgtacacaccctttgttcttcctttttgtcttttcccatcctttcccttcaaataccaccaaatactgtttcagcctgaggtttcaattaggttctggcacgatgagctcatgccacactttgtgtggccacgacaagaacatccttcccagcgcttcctttgagagggagccgggactgctgaatttgcttttcttgcagccacaagggaacctccgtttctcatttgttcaaatccttgtttgtctttggggaagtgaaatgcttgcatttgattgtgattgggatggattgacgtcttttaaagtcctggggaggaatgaaagccaagcttactcagggggattatgccccctgcgttcagttccagttgaatgtggagggctgcattcgtttggtaaatagtggtggaggggcccgcccctgcctttttctctcggtggttgtgcatatttggacagaacgtgttctgcctacagagagggcctgaaatagtctctcagcaaataactgcggcctgaatgggatgaatgaatgaggctggcaagtttcttcagggtcacagtttccatcttttggtaaaaatgatcactttccatacttgccatgtaaatccaatgagccttcatgcaggaataaactcaccacgctaccagggagagaggtgagccttggttcccaggcccttgtagaatctcagggaaaaggctggagtctggttggtggaatcagccccttacccgtgtcctttgtgtctgtccctgtgtttgtgcgtgagcagatggctcctactctgtctggcttcctatttattttgttttgaaagctcctgggtgtctgggattgtatctattcatccccctctgtacagaggcatgtaaatgagattgttaattcaattgagcaattgattaagctgtttttagtgtgcttagcactgtcctaggcacagcagggaggcatgaaagaagccccagaggagtctctatctgtgaccttgagcagctccagggccttccggagcctcctattctcatccgtaaagtgagaatgtcagacagactagctgatttctataaggagtcttcctgctccaaggttctccgattgaggcaatcactaagatggaatgatatgaaatcagataaaaattaagacccattgtagttaagaatataattgagttacatagaaaaatgtgttatttggttgtatccagagtacggttgcttgtaaataatacaggatgcccagttaaatgtgaatatcagatacacaatatttttttttttttaccatatttagtagaagtatgtcccattcaatgtgtgctgcatatctgagatatttaactgagcatcctgtatttatttggcagccctaatccagagagatggtgcaaactagacacttaaaggtgggcttcccctctgggctgtcatacactctgttgtccaaacacatttgtcttttttttttttttttttttttttgagacggagttttactgtgtttcccaggctggagtgcagtcgtgcaatcttggctcactgccacctccacctcctgggttcaagcgattctcctgcctcagcctcctgagtagctgggactacaggcaagtgccaccacggccggctaatttttgtatttttagtagagacggtgtttcaccatgttagccgggatggtctagatctcttgacttggtgatccacccgcctcagcctcccaaagtgctgggattacaggcgtgagccacagtgcctgattggccttttcactcctcctcctcctgccgcagagcatgtgcataggctggtgctactgcttgggatgtcttcctccctactcctccttcacagagctaactcctactcatccttcagatttcagttcagttcagaagtcacttcctcagtaaaacctttcctgataccctggactaagtcgtttctctattgtatatgccctgggagactttgccatcacagcacttgctacaatttggcgtttatacagttgcttgcatttttgtgtatttaataaaattaatgtgagtccctctgacatctccacccgcttctactcagcactagacagatatttctgaacagatgtcagtatgaaaggcttcccaggagtcgtaggtctggagctcaatgctgaaggtgggtttgtgaaggcagattggagaaccaaggatagtctggacaggtgaatagaagaaacagagccactgaggtgggaatgcctttgctgtgtttctgtaacaatgaggagaaccattgagtagttacaggcccagttgaagagggcggtgtccttgaaacctgccttaggagtcggatgcggatattctgaggatggtgaaggaccggatggctgtgaggagaggagtaacatgatgaaacatgttgaaagtcacttgttagtgggttttattaaaccccaaaacggggagctcagtagccaagagccctctgggaggctgctaagggacatgccgtgaaggtgacagaggacatccagtctaaaagtccccactgagctccactgccccccaggtgcaaagcctgtgctaagcatggcagctcacaaggactgggcagaggcacagacaattctcactcattggtttctgcagtcaaaagttgagactggccgggtgctgtggctcacacctgtaatctcagcactttgggaggccaaggtgggcagatcgcttgaactcaggagttcgagaccagcctgggcaacatagtgataccccacctctacaaaaaatacaaaattagctgggcatgatggtgcatgcctataatcccagctactcaggaggctgaggcaggagaatcgcttgaacccgggaggcagaggctgccagtgaactgagatcacgccactgcacttcagcttgggccacagaacaagcccctgtcccccgactcccaaaaaaaagatggtgcgagctggggttccttggagttttcccctgaattcctggatgatgtcataccagaacattcttttgctgaagccatcaaaactctcttcctgctacaaccttccttttccagtgtctcccaagtctgcttctcagtgttttgaagagagacacacacacacacacacacacacacacacacacacacaaacacagactttgttgagcacatggcctgttgttcaggcgtcgggattcgctgagtggacccacgcattcaagtgccagccttttccacctgatgaacccgtgtgcttttatcgctgttgagtgctttggccgtgtaccaatagactctgaatgaaacgtgtggatgtgcacacacatatctacatatacatgtatacatacatgtagacacatgtatatacatacacacatatgccctataaatacatactctgatacacccacatatctataccatatgtacacatgcatacataatatacacatatgcatgtacacacataaaacatgtacatgcgtacatatgcacacacacacacacatacctatacgtatacatacctattttactgagatggtaatagcaggggataggaagtcaagccgtcctcccctgggtattgcctgcagaggtgctaccacttcctctgcctctgactttctctggtttccaagacctttactttatgtggcagtttgtaccagaattcccttccctgacttccttctcaaagctctcaacagcctcagttcctgacgggagaaaccccagccacatcatcttgctggaggatacgtatctattctgtgttttaacacatatatccgctcagatagttagacattttccaaagctgtaaaacaccggccatgacctcccgcttctgctgaagctgtcaagccgctttcttgacagttggccagactggcttactactggcagaacccctttccaacttactttttattaaatataacattttaagatgtaacacaacatgtcacacagcatgaagagttttgaacggcatggtgccttttcataatggcatttgttttcagtcgttttttcctgctttggatttaatgtgacatgagagaaataggaaacatttcagaaaaaggttgggtaacttggacaaggttcacttagccaaatcccatgaaactatgtgtctaggaactttctacgaacaggaagctactgctgttccctgttcaggttttaagtgtgcaggatgcaagctgtggcacttcccaggactctagacaagttttgctcattctttctgtgagaacaatggtcttgcatgacctggactgctggtttacctctgcagcctcaccaggtatcagcttgtgctttctacttcagcgatgaggaatgtctcccagcatcttgtgtgcttcgtggtcctggcctttggatatatctctgcctggaatgttcctccttcctcccctccccttcacataataaactccttctcctctttcacagctataatttcacatttatttgtgtgactagttaattcatacctgtcttccccatgaaattgtagttgcaggaggtcaaggacctggtctctttttaaaattatttatttggtacttactatactgtctggaataagatcctcaatatgtatttgctgagtaaacgaatccatgaatgaataaatgttgattgtcccataagggcagggactctgtcttagtaatttgcttatttctagatccttgcacagtgcctggcctacaataggtgctcaataaacatctggtgaatgaacaagcattgcttcatacatggcaccatgccaggcactgtccttgaccttgagagggtgagcatttgcttagggagagaatatgtactcagaggaaagaattaagagtttaatcgggcactgaaggtagcattctaagtcaaatctgaatttgaatcctggtggctctaccactctctagcagtgtgggttttagcaagttacttaacctctctgagccaaaggtttctcatctgtaaaatgggatagtaatagtgtctacttctctaagagtgatatgaactaatacatatgcagtgtctcacacagtacttggtacaatgcaagcactctagccaggttgggtgtcattataatcaatttaggaaatctctgtgcaatattttaagtgtggtgaggtcattgacaaacagtatgactctagacaagtattttcacttttctgggtgtcagttttctactgtgtagtatgaaaggattgggtggggtctttccagctgtgatggtccatgtagtgcagagatagcaagattagtaggatatcttacttattagtaggattagtggctatgacagaggaagcttccagaagtcacatctgcaaggtcaggtagaatttatttaggcagagaatagaatgtgggacacgccagcctggggaacagtgtacaaaaccatggtggtggagaaggagcacagggcatttggggaagaggtgatggtgggagggtggttctttaggagtggtgggaaaggaggagtataaagctacaacaggttcttgaagggagggtgacctgaagaaggaaggtttggggaataatatagcttgagtcagacaaatggggagagggcaggaaacttggagtcagggagatcagctaggagaatgtgtagcttctaacacaggctgatgaaggcctgagctgggatttggcagaaggagtgaaagggaggaggagaactcacaatgaataaatgacatagcttggtggtagagccaataatagggattgaaagaggtttctagaatgtttgttaccattgacagagatgcatccttgtccttgagaaaattgggttgcgctctagaaatgtgcattagtgattggcaacccagcagaagattgaaagctggcagccagggggtgcagaaagagggaacagaagcagaggttgacagccacctcccatgtccagcaccagggcagacccatgcagttctgcacaggtttcatgcagctgatgggagtaggccaggggattgggtaggagacaggggcatggtgttagaaatccagaacagaaacagaggcaactttctgggccataggagggaggcttcctttatttaactggctgccctaggggaagcagaaagtccccaggcccccatgagatccaagcaggatgggagtaggtaggtgatctggcctgcagcaggtgactttgttggggaggtatgccccagtggtgccatagctgtagcccattggcagcacagcacagcagtgggaagctctgcttggagtatctttgggttccagagtggagtagtgaggtggggggtgcagtggtaacaatgacatttcaatcacgtggacctgtttacagctgagctctaccacttaccaaccatgtggttgtgaccaagtcactaagcttgtgtgagccttaggttccttgtcctccgtaggcaaggattggctgaattaatttatataaagggtctaacatatagtaggtgctcaaaaaacactagacatataaaatttacaaaaggtaggactaagccagttacatcctaatgcctgctaaatccaaatgcagctaaaaagggaagagaagttcctgtctcctctctgttttctgcacagcatagaccatacctgacagatcaaaaggaaacttcctccttgcaaggcctcctgatggctgcagtcttcactgtctagctttcaagtataaaactaacctttcatttaagtagccaaacatcaatttttatgttagctatggcagtgcattcccagggtgtcagctagtaggctggttacaagcgaggtctcctttctctatcctagttcagaagcatcagttagagcagaggttctccaggtgtggctcccggaccagcagcactggcatcacctgggaacttgttagaaatgaaccttcttgggctccatactagacctactgcatcagaaactccagggagtggggtccatgtccatcagcctttgttttaataaaagacccccaggtaattctgatgtacgttagagtttgaaagccactgaatcagagtgttgtggaaaattagaactgtgtttaagtatgagcagtgctaagaagactattgatagaaaattgagccaatgattttttttcagggtttaaaagggatgtttttgtgtgtgatgacacctcagtaatgctgcagaaagaaaaacaaaataaaaatttaaaaagaaatttttgttcactgtttctaatccggatacccaagcctattaaaacagtcagtaaagtaagattcagtagggcacttctaaagtttctaaaggacattgcctttagaaatgccctttaaaatatgttcagtattaacttctaaagtttaaattccaagtgtgggatggaaggtttggggtattaggcaattgataagctgtgtgtttttgcatttaagctttaataatggaaagcgcccaaaaccttttctttttcagaacaggaaaagctaagacttagtctcacccctcttctgactttttcaaaacagttttctaattccagagaagagcctgagctctgagaatcattctcctcatcttattttccataactttgtcctggaaaatgcagtctgggggaaagcattttaaatagtaatcatctgagtctagtccagaatttggaatccaagggcaggcggatactttgtcataaacaggagcaataatacgtagataatgcagtcagtggaggaaaagtctggcgctgctgtggctctgactgctcctggattagttactagaccaaatgctgcaaactggtccattgctttgctttgagcaagcaccttattttatttaacccctgcatatacacttaagacattgtatccacatgtttctaattcatttacacttcactcatcagcatctgttgggtaagcaccctgtcacctccaagttttatgagctgtgtttactaggctgcaattcttgaacagggatatcgtatattccacaaaaaaagaaaaaaaaaaaaagaacttgagcctgggaagtgaggacttcagtgctcaacttggagtgaacttgtgaagtttgaatggatctgcaactaagcacagatgttccctattctccaggaacagcttcacatgtttatgcacagaatctcctcttttcgtacctgagtttttctctccactgaaatgacagtgggagaatgtgcaattgtgggaaaagcttgaacctcgtttccttccactttttgtcccctcccatccctcccaaagtctcttcttggtgactgagagcaaatgcaaacctatgcagtagcaaagctccctaaaatccaaaacctcaacactttagcaatattttgcttccctagaaggcagcattcccttttgcaagtttcttccacttaagcaaaattcctaagaatacagcaagaagttttgtagttttttgttgattttgaatagagatgggagggacctcccattattaataactgcacagaaggattttgtttctaagaacctgaattgttagtgttattttctagatttttttaaaaattggtttttattttctattccacgttatgtgtgtacatgttttatagagtcaaatagttctaaaagtttgcctcttccctaatctttcctattcctcaaccattttagctgttcttttgatttttaccttatctgtaaataatacttatattgttaattctgggtttttacatttcacatttgttctgttgaaaatgaagatcttcatgaaacaacaggtgctagagaggatgtggagaaataggaacgcttttacactgttggtgggagtgtaaactagttcaatcattgtggaaaacagtgtggcgattcctcaaggatctagaactagaaataccatttgacccagcgatcccattactgggtacatacccaaaggattataattcatgctactataaagacatatgcacacatatgcttattgcagtgctattcacaatagcaaagacttggaaccaacccaaatgtccatcaatgatagactggattaagaaaatatggcacatatacaccatggaatactatgcagccataaaaaaggatgagttcatgtcctttgcagggacatggatgaagctggaaaccatcattctgagcaaactgtctcaaggacagaaaatcaaacaccgcatgttctcactcataggtgggaattgaacaatgagaacacatggacacagggaggggaacatcacacactggggcctgtcgtggggtggggggatgggggagggatagccttaggagatatacctaatctaaatgacaagttaatgggtgcagcacaccaatacggcacatgtatacatatgtaacaaacctgttaaagtataataattaaaaaaaaaaagaaaatgaaggtcttgccctctttcattatcctctccctagacctcaccatggatacacactccccatcctgcaccctctcaatataattattgtaatttagcttagattaataaccattgcttacagtatgatgactatgtacatgcacttcacactggagccatgtgatatactcccttaggtcagatttccagagcactgatcctaaagcagagatttgtgcccagtgttccttggggcacaacacctgtgatggatgtgggaggcaggattggacagaggggaagttgggctgtgatgcagtcacaccaaggcctcagcttgtcttacaggaagctctgagcagggagagccctgaagagttaccagcaattgagacagggtgggcctttgtaccagaggaccagttgttagatggagctgtccctggagaggaggcttaaccttgagggaggcagctccctcaggcacagcgcaagctccagaaataaacacctatgagccagctcctaactgctggggggtgtgactgactggattggcaggtaggggtaggttatctgggcaccatagtgaagcatccactacatatgccgtgattatatttcctttcctgaaatctgactttccctgttgttgattaataccttttggtttttagtttgcctacttttctatatgtacttcatgctaattcaactcaagctcttctaaattgtgtacatcatctttcagtagcttcatgtctcaatatcttgaaatctcaatatctcaaaatgtattgggtattctacgcatttcgtcttgaagaattctctcctggaactctctgacctgctctagtcttttcctagtgtacagctgtcttgttgggatctcctttcttcctagtcctggccattctctttgcttcttttttggcttagatattctatctcctggatcccacacgttctactttcttgttttactcctttattgtggtagtctacatcctccaataagggtgcatgacaggtaaattgcgtgagaattgcatttctgaaaatgctttattttctcctaaggattgataatttgactagatatagaattctaattttgaaatggctatgcctcaaaaattataaggcattactcaattattgttcagccatcaaagttattgttgagaaatccaatactattttgtttctattcagggtgcttgtattatcttttctttgtcccagtgtcttgaaatttcaagtgatgtaaccttcatgagggtttatttttatctatttattgggagacacttcttcatgggtctcttgtactcttacaagtctttggagtataccaagaatgcaaggccctgaccaccctaaaattggattatttctcaggcttgtatttgcagtgagcaaccttgaggggtaagataagtctcctttcgggacaaatagtagggttgcttattgctttcaataaaagcagtagatctctcaacttcagtgttccccagctgcaatacaaaaccactgtatatgcagtatccatgggccctgcccttatgcattgcccctatgggacttgggggcaagggaaactgacacatactaatgctcatgctgcttgctcttttttatctctcactcagaaatcttctatcttctgtttgtatccatgaaacagtaacaggataacttattgattgtaagtagggaaagatcaaatcccagtcctgacaccattttcctgggcacttgatagactcctgcaatctggaaacagaaattgtcttatttatttgatgatttcctgtgaatctagaaaactaattacttcttttcctttttgtaaaatcacaactttattgaaataaaattcatatatgataaaagtcaccaacttagttgttttagtatattcacaattatataactattatcatgatatgattgcaaacattttccttatcctaagaaggaagctgatacctattagcagtcactccacattatcccctctcttcaggccctggcaaccactaatttactttctttctccatggatttgaatattctgggtatttcatgtaaatggaattatgcaatatgtggccttatatgatttgcttcttttacttagcataatgttttgaagatttatcaatgttatagcatatatccatactttaatgcttcctgttgtcaaataatattccattgtatggatataccacattttgtttgtccattcaccagttgagagacatttcagtttcccctttttagctattatgaataatgctgctgctatatctgaatgttagtgtcaccccaaaattcaaatgctggaacctaatactcaatatgatatcattaagaggtaggaccttttggaattaagtcatgagggctccaatctcattaatgggattagtaccctcatgaaagagacttgagtaagctcccttgcctcttctgatatgcgaggataacagcaacaaggtgccatgaagcaggcagagccttcaccagacactgaatcttttggcaccttgatgttggacttcccagcctctggaacttagaaataaatttctgttgtcttctctttctttcttttctttcttttctttcctttcttttctttctttcttttctttgcttttcttttttgacagagtctctctctgtcacccaggctggagtgcagtggcatgatctcagctcactacaacctctgcctcccgggttcaagcagttctcctgcctcagcctcctgagttgctgggattacagatgtgcgcaaccatgcctggctaatttttgtatttttagtagagatgaggtttcaccatgttggctaggatggtctcaaactcctgacctcaagcaatccacccaccttggcctcccaaagtgctggaattacaggcgtgagccaccatgcccagccttttctgttgtttataaatgacataatctaagatgttttgttatagcagcccaaacaaactaagctgttatgaatagttatgtacacatttttatattaatgtaggttttcatttcttgtgagtataaacctaaaagcagaattgttgggtcatgtggtagctctatgtttaacattttgaggaactgccatatattttagagtcccactagcatggtagatatgcaaagttatcccactgtcatttgttgcaaacagtattttttccctaatgaattgtcttggcacctctgtcaaaaatcaattgtccataaatgtaagggtttatatctagactcttaagttctattccattgatctatgtgtttagccttatgaaaataccacacttactgttgattcgtagtaagttttaaaatcaggaaatatgaatcctccagctgtttttctttggtcccttgcatttttgtgtgaattttaggattaccttcagaaaaataagagggcatttggtagtttgtattgaatctgtagatcaatatgggggagtttgccatcttaacaatgttaaatcttcagatccaagaaaatgtgatatctttccatttgtttagatcttccttaatttatttcaacaatattttgaggttttcaatgaataaatcttctttaattaaacttgttcttaagtatttttattctttttaatgctgttgtaaattgaattctttttcaaattcattttcagagtactcattgatagtaaatagaaatacaattaagaggtagggtctcactatgttgcccatgctggtctcgaactcctggcctcaagtgatcctcctgccttggactcccaaagttacaggttacacgcatgagcaccgtccctggccctcaaagtattttctaattttcctgtgttttttttttcttgattatttaggagtatgttgtttaatttccattatttaaaaagttaccaaatttttttctgctatttttaatttcattcaattgtggtcagagaacatacttttcattattttgatattttaaaatttattaaagtttattttatagcctaacatttattccctcttggagatgtttcatgtgcacttgagaagaatgtgtattctgctactgttgggaggagtattctatagctagctgagtctaattgccttatagtattgttcaagtatttgctatctttattgatcttctatagatgtctcagtctaattggtttatagtgttgttcaagtattctatttccttattgatctgctgtagatatctaagactaattggtttatagtgttattcaagtatttccatattgatcttctgtctcattgctccatttattattgaaagtgggatatcaaagtttgaaactaccgttgtattattgtctatttcttctttcagttctctcaggtttgtttggtgtgtgtgtgtgtgtgtgtgtgtgtgtgtgtgtgtgtgtgtgtgtgtgtgtttgaaatggagtcttgctctgtcacccaggctggagtgcagtggcatgatctcgactcactgcaacctccgcctcccgagttcaagcaattctcttgcctcagcctcccaagtagctgggattacaggcacatgccaccaagcccggctaatttttgtatttttttttaataaagatagggttttgccatgttggccaggctggtctcgaactcctgatctcaggtgatcagcccaccttggccttctaaagtgttgggattacatgcatgagccactgtacccagcctgtcagtttttactttatgtattttggggcttggttgttatgtcttcctgatggattgactcttttattattataaaatgtacttttctctagtaacaatttttgtcttaaagtctactttgtccaaaatattagtagagctactctagctgccttttgcttttatggaagagttgattttcagaggcactgataaccattctggaaagcagaacctctaactacttcttacaactcttagagatagttgtcccggttttaggtctgctttctcccccatttccaaagttaccttttggagactccgtaatgctgcgtagctttgctgcttttattgctgcttaggatcagctttcttgggtcggctaagtcattacaatgagtccttctgctttccggtttcctaaattttgtaaccgttaactccttttctattttctttttcttttgagtttattactttttaaaaactcttcactattatatcaatggcttttccaaggaaacaaaattcaagagtgatttaaatctttaacttgtattcgagtgtaaacttttagcttttagttgctttactcttagtaacctaaattttcttgtatagtcaccagcatttttttttttcatggtcagagggcttttaaatatcagggctccaaataccgggtaatatcctaaatttagagtacctatatttggggttgtattatcttttaaattcaggcgtgggatctgaatatctttgattcaaaataagagtcagctgcttccaagtcggctcactgattgattttccttagagcaatgattcccaaacttgaccatgtcctagacctcatccccagagtttctgatccaggatgtctggggtgaggcccaagaatttgcattttcagcaagtacgcaggtgatgctggtgctgccagtcccaggaccacagtaggaaccactgctttagtgtgtggacaggatgctaggtgaaatgttccttttggaggcagggaggacattcaggaaacagatgaggacaaagaaggagagaaacagaagtttgtgcccacttcctcttgctcccagcttgtggcaacccttgtgttttcccactttccctgcaccaacaaaacctgacaaaatctgcttagagaagagtctcctggcatcagaattgtactttacttaaaggcaaaaaaaaaaagaataaagtgaatatccatgcaaaaccttaatttgaaacccttcaaaggttgttgttgttgtttttgaaatgggatcttgctcttgctctgtcatccaggctggagtgcagtcgtacagtcacaactcattgcagcctcaaactcctgggctcaaaggatcctctcacctcagcctcctgagtagctgggactacaggcgtgcaccctcacgcccacctaatttttaatttttttgtagagacagggtctcattatgttgcccaggctggtcttggactcccgggctcaagcaatcctcctgcttcagcctccaatagtgttggcataacagacatgagccactgtgcccggcccaaatgcattcttatgaggaattttaaaggaggtgggggctgggggcagaggcttatgcctgtaatcctagcactttgggaggccgaggcagaaggatcacttgagaccaggagtttgagaccaccctgggcaacatggcaaaaccccatctctacaaaaaatacaacaattagctgggtgtggtggtgcatacctgtagtcccagctactcgggaggctgagatgggatgacggcttgagcctgggaggtcaaggttgcagtgagccaagaacgcaccactgcactccagcctgagtgatagaacaagaccctatctcacacagacacaagggttgggggcagtgggtaggaagtctatgcagggtctagagaagtcattacataattttatgagaagaactagggtgttctctaaggcaacaggatgccaggtagttttgttaagaagtcccttgtcctcaggtttatttatctcctagctgcagatcggagaaggtggacccagtgtccccagtgtctactggtgggaggagcccagagttaaggccattcctctgggttcctttcttgtggccattcggagattctgctgtaattgtctcacgtttagcttttttttttccccccccctcagaatgttcttctgcagtatggttgcaaatattgaggaataaaattctggccccaaaagatagtatctcaaaagatacagatagttgggaggaagccaagagaagtgaggacccaaaacccttgcccagatgaggctgcctttcacaaacacttggattacttacaatgcaatgcacctggatagttctagcgcttcagaaagtgaggagctggggagagagggaatggggtcttggtagatgaaatgagaaagcaagttgtaggagatgaattttgcctccaacttgtcacttcctttcttaagcctgttttttaatctatcaaatgatgatttcgtttgaaataaatcccagaggtgattccatcttggtattcttttattttttcccccaaatcacctcttacatcttttgggcagccaaggaaagaaaccaggtctcttgacttctaagatagagctcagagtatctagacgatgcagtcttcctgaaccatgtggtcccagaggctccatgtgatttcctgttagaggttttcagtggctttggaatagaaggcagtttattgctgtgacagtcaggcagccacactggggaaatatgctgtatcatgtagtgtaggaaaaagtcagtattacccagtcaggtaatctgatttttagacagcctgttctaggctgtctatggctgagcacagcattagtcttgtctccaaaacagtttttttttttttgttttttttacatacagtgtgtacttatcttgtctgtttcttttggatatagaaatatatcttgcctgaaatttattttcattcttattttggaagcaactaaattgttctgagatgttccttgtagcagtaattaatttagcatttactgagcaccctctgtgtgccaggcttggtgtgaagtgatagaaatgtacagaaagactctgaggtagggaaatatatctagcaggaggaggggagagaaagacaagggggagaaaaggccgatattcatttatccatcccttgtttcattcctcagagatttgtttagcatttactatgcgccaagctctgtgctgggttcctgggatacaaaagtgaataagacagagacatcctgtattctcgcaaaaccacactgcaatacagcatggttaaccctgaaatagaggaggccacatcaacctgagagggggcagaagtagaggtgggatccagatccatggagggcttcctgaggaggtgacctggaaatgcaagcgaagtacaaatgcaggccagccaagtgagggaaggaacagttaagcaacggctagagagagggagtgcttagttgtgtgtagactgtgtatttaggaatgggatttaaggaagaacaggaggaaatgaggctataaaggtaggcgaggttccgctcttgaaagaggttttatcccttgcttaggactttgaacttcaacctagagtgacagagaagccacttaaatacctcataatggaggaattattacaggaagctgcggccatttaaaaaggcatacagatgatataactgcgtagatattaagtttaaaaagcagaatatggccaggtgtggtggctcatgcctgtaatcccagcactttgggaggccgaggtgggcgaatcacttgaggtcaggagttcaagactggcctggccaacatggtgaaaccctgtcactactaaaaaatacacacacacacacacacaaaattagctggctgtgttggcagttacctgtaatcccagctacttgggaggctgaggcaggagaatcacttgaacccgggaggcggaggttgctgtgagccaagattgcaccactgcgctccagcctgggttacagagtgagacttgtaaacataaaaattatgtgctcactgtgattgctgatatatgaaatatatttaggttggtgcaaaagtaattgtgcagttacttttgcaccaacgtaattaattatgacaatggcaaagcgtgggaggatgtctaaaagtagaatctgttatttgcatggcgagtctttgagaattcctttataatattcactcagcactgtatcactactatatgcaaatagatcaagatacaatcccttccctctatcatcaaatatggggagagctgataactttaatgcacttttaaaaagtgtgtgattatgaaatgtctagaataggcagatcaatagagacagaaagtagattggtggttgccaagatctagggggagtgaggaattgaaatgacagctcacaggcacagggcttctttttgagctgatggaaatgttctggaattatataatggttgcggttggacacacaaccttatgaatatacgaagacttattgaactgtatagttggttaaaatgcttaattttgtgttatacaaatttttctcaataaaaattataggaagaaaaaaggtgctgattccacagagatgatattgcttataccttatctttattttattttatttcattttactttggtagtaaaaggcaatcgcaaatgtgagttgaactgccaggcaatgggctaccgcttctatgtacggcaagctgagaaagtcatcgatggcaccccctgtgaccagaacggcacggccatctgtgtgtctgggcagtgcaaggtaagtgcccccgaactggggtgaattcttaaggtgtttgatctgtgactgctgactccattgttttccagggagagactaggctgctagctccccccagcccacgtcagggccactcaaccatgcgctctgggaggagtgggctgagatggggctgcttggtcagccctgactgtgcttttgatctttgggcgtcaccaggtcccactctagcattcccattattaagtgatttatgttgacaccacatgcttcacaagggacacagcaatctttgcgagttggatctggagctccttctttgcctgtgaaacggaggttatggaaagggcactgctggtttaatcaagaattggttggcgtcatgagggtggcattttaagggaatggcatattttatcttgcctctccccagaaggggcaggcttccaaaggaaagttgtttcatgccttttatagcagaagttgtactttaaacaggaagttttcaacctccttaggcttctgaagtctgttccaggaacaccccgcctggcgttctgcaaacattctgggcttcagagaatccttgtgggatgctcagtgttgacagaaagcaccatttggttaaaaataggcatcttagatgaaatggcacaaattccgtagctacattaatttgcgcttggacttctaccctcctttcatctacgtatgtattcatggagctaagatttagcaggtaaatgactctggagcccaaacgaagagtctctcttaattagcactctatagctagctggcagaccgattttaatcacaggaagagctctttggctatgacacctggaagttcctattatagtttgaatataacttgctacagtgtttaatattagggatattgaggtgttatttgtgagcacaacctacccccccaccaacaacattttgaatgaggaggtttcagataggatgcaaaataacataaagcaggattgatattctcagatttttaaaaagtatatttttaattattatgagtacataatggatgtatatatttatgaggtatatgtgatattttgatacagacatacagtgtgtaatgatcaaatctgggtaactggggtatccgtcacctcaagtttttagcatttctttgtattaggaacattccagtgctactcttttattttattttattttactttatttatttttttgagatggagtttcactcttgttgcccaggctggagtgcagtggcacaatctcagctcactgcaacctctgcctcctaggttcaagggattctcctgcctcaacctcctgagtagctgggattacaggctcacgccaccatgcccaactaattttttgtatttttaatacagacggggtttcaccatgttggccaggctggtcttgaacccctgacctcaagtgatccacctgccttggcctcctaaagtgttgggtttacaggcgtgagccaccgcacccagcttctactcttttagttttcttaaaatatacaataaattattattagctatagtcaccctattgtgctaccaaacacttgatcttattcattctaactgtatttttttgcccattaaccatcctcactttataatcccatccctactaccctttccagtctctggcaaccggcatttcactctcagtcttcaggagttcaattttggtttttttagctcccacatgtgagtgaaaacgtgatatttgtctttgtatgcctggcttatttcagttgacagaatgtccttcagttctatccatgctattgcaaatgacaggattttgttctcacattttgaatgcaagttaagaaaggaacaaggtgtcacttgatatctgatgtgtatgaagtatctttggaagagcaaaccctgaaagaattaggatgcggtacagaagaggcaggaaacatcatgggaaacatcatagcctccagttttctgctcctttggaaaaaccactggttttcacacatcctctctgagcttcagtgtcctcagaaaatacttaagggcattctctgagagttttgtgatctccagctttaatgttccctgcttctaaatgttactgaactaaaatgatgggcctgatagcaatctagctttatctttcagattccaaagcaactgtttcatttcctgaatacaggtgcacactgttgaggaatggtgaatgtaatggtagagtataatggttacaaacctgccctccgaagtcggattgcctgggttcaagtcatgcctcttccacagatttactgtgtgattttgcaaaagttacttaagctctctgtgcttctgtacatcatctaaagaatgaggaggatggtacctacgtcctgtgttgcggtgaagagtcatgaccgtataacagggtttggcattcagtaagcatactggcatttattagtatcactgcatatacctacatatataccattgtacttggattttctatgcaaaagtgtttgcctttttttgtcgattatagatttgtcagatgcacatgctcttttgggtcagtgctctcacgctatagtgtgaaacactgggggattgcagattctgattcagtagggcctggggaagggcctgggaatccgcttttctaacaaacttccatgtgatattgatgctgctggtccctggatcatattttgagtagcaaggttttaagggacattgattaaaatatagttaacaaagagccagaaatataaatatatggtggtaagatgactcggaaggaatatgaaatgtggtctcttcactgggagagcacgttttcttagtatttcattaaatgtctattagctgatgatataaaagaaaagcaaacacttataaggacatgggtatggattcttactaattgatgaaaaacattcaaactttacggcaacacagtttgcagataataattgctaaaagcctgaaacagacattttccaggatgtgagtatattaatagggttctgatgttactaggactactggatactactttgcatttgttctctgcatttgcctgaaattccctcattgaagttgttggaaccactgacggcttcagtttaaataatcagaagtacatttgcttcccaggctgaacttctgtttactttgcagctttcaaagggtaaagtgtccttttctaaatatttgattggatgcccagaattcaaattgatttctctacttctctgacttgtggctgagaaagctgtcacttgcagacagttttccctaagatgtgcgtctgcatctgaaatagtgacacaaagcctctcctggccacatagagttgaaagaaatagccaggcttgcaagaaaagttaatgaaaggtgacaagccttacataataatatgaactgagtctacaaaagggtcctcatgagaggagggcactgtcctcacatcaagccaagtaaaggccgcaggcccacccattgctggcttgaatgctctgtttcagctcaagttaaagcctatgtttatccagttctggagctcctctgtggtttatttattttttaaaaattcttaatttgtcatttttgtgggcacataatatatatttatagagtacatgagataatttgatacaggcaaacaatatataataatcacatcagagtaaatggggtatccatcccctcaagcatttatcctttgtgttacaaatgatccagttatactgagttattttaaaatgtacaattacattattattgactgtagtcaccctgttgtgctatcaaatactagatattatttattctttctatttttttgtacccattaactatgctcacctcccctttaacccccaactacccttcccagcctctggtaaccatcattatcctctctatctccatgagttcaattgttttaatttttggcttccacaaataagtgagaacatgccaagtttgtctttttgtttgtttgtttttttaagacggagtcttactctgttgcccaggttgaagtgcagtgctgcaatcttggttcactgcagcccccgcctcccaggttcaagccattctcctgtctcagcctcctgagtagctgggattacagacatgtgccaacacacctggctaatttttgtatttttagtagagacagggtttcgttgtgttggccaggctggtctcgaactcctgacctcaggtaatccagctgccttggcctcccaaagtgctgggattacaggtgtgagccacctcgcctggcccgaagtttgtctttttgtgcctggtttatttcacttaacataatgacctccagttccatctatgctgttgcaaatgacaggatctcattcttctttgtgtctaaatagtactttattttgtatatgtaccacattttctttatacattcatctgttaatggacactcaagttgatgcaaatcttggcttttgtgaatagtgttgcagatatctcttcgatacactgatttcttttctttggggtatatgcctaccagtgagactgctggatcacagggtagctctattcttacttttttgaggaacctccaaactgttctctatagtggttgtactaacttacattcccacctacagtgtaagaggattacttttactctacatcctcaccatcatttgttattgcctcacttttagtaagttattcactcatattagaactggggtgagacaatatctcattgtagtttggatttgcatttctctaatgatcagtgatgttgagtaggtttctatatacctcttttccatttgtatgtcttcttttaagaaatgtttattgaaatcgcttgcccattttatttattttattttgtttcattttattttattttattttgttttgttttgttttgttttgttttgttttgttttattttattttattttattttattttcgagatggagtctcactctattgcccaggctggagtgcagtggtgcaatcttggctcactgcaagctccacctcctgggttcacaccattctcctgcctcagcctcccaagtagctgggactacaggcgcccgccaccacacccagctaatttttttgtatttttaatagagtcggggtttcaccatgttagccaggatggtcttgatctcctgacctcatgatccgcctgcctcagcctcccaaagtgctgggattacaggcatgagccactgcacctggccctgcccattttaaaatcagattattagatatttttcctatagagttgtttgagctactatatattttggttattaatcccttgtcagatgggtagtttgcaaatattttctcccattctgtgggttgtctcttcactttgttgattattttctttgctgtgcagaaactttttaacttgatgtggtctgatttgtccatttttgctttggttgcctgtgtttgtggggtattactcaagaaatctctgcccagtcctatgtcccagagagttcccccaatgttttcttgtagtagtttcatagtttgaggtcttagatttaagtgtttaatccattttggtttgatttttgcatatggtgagagataggagtttagtttcattcttctgcatatggatttccagttttcccagcaccattttttttgaggagactgtcctttttccaatgtatgctcttgacccctttaatgaaaatgagttcactgtagatgtgtggatttatttctaggttctctattctgttccattggtctatatgtctctttttatgccagtaccatgctgttttggttactattgctctgtagtgtgatttgaaatcaagtaatgtaattcctccagttttcttccttttgctcaggattgctttggctcttcttaatcttttgtgattccatataaattttaaaattgtgtttttctatttccgtgaagaatttcattggtattttgataaggattacattaaatctgtaattcgctttggttttatggacattttagcaatattaattcttccaatccaggaacacagaatatctttctattcctttgtgtcctcttcaacttctttcatccatgttttatagttttcattgtagagatcttttacttctttggttaattcctaggtattttattttatttgtagctatagtaaatgggattagttttttgatttctttttcagattgtttactattggcatatagaaataatgtatatttgctgttcccatatagaaatgttactgttttttgtatgtcgattttgtattttgcaactttactgaatttatcaattctaatcatttttggtggagtctttagtgttttccaaatataaaattttatcatctgcaaacaagggtaatttggcttcgtcctttccaatttggatgccctttatttctttctcttgtctgattattctagctaggacttccagtactacattgaataacagtagtgaaagtgagcatccttgtcttgttccagatcttagaggaaaggcttttggtttttctctattcagtatgaaactggctgtgggtctgtcatatatgacttaattatgttaaggcatgttccttctatacccaactttttgagggtttttatcatgaagggatgttgaattttatcaaatgcttttattgacatcaattgaaaggtcatatggtttttgtccttcattctgttgctatgatatatcacattaattgatttgcctatgttgaatcatccttgcatccctgggataaatcccacttggtcctgatgaatgatatttttattgtgttgttgaatttagtttgctagtttttttctgaaggatttttacatcatgcatttggaagtattccctcctcctttatttttttagaatagtttgaataggattggtgtattaaatcttctttaaatgtatggtaaaattcagcagtgaggctattgggtcccaatcttctttagtgggagactttttattactgtttctatctcattacttgttaattggtctgttcaagtattggatttcttcatggtttaatcttgataggttgtatgtatctaggaatgttattcatttattctacattttccggtttattgacatatagttgcttatagtagtcactgttgatcctttgaatttctgtggtatcagttgttatgtctccttttttagctctgattttatttatttgagtcttctctctttcttagtctgggtaaaggtttgtccattttatcttttcaaaaaccaacttatcattttattgaccttttgtattgttttcttcatttcaatttcatttatttctgctctgatctttattatttcttttcttttcttttctttttctttttctttttttttagacagtgttgccctgttgctgaggctagagtacaggggcatgatcacagctcactgcagccttgacctccaggatcaagcagttcccccagctcagcctcctgggtagctggaataacaggtgcacgccaccacatctgactaatttttaaatttttgtagagatgggatctcgctatgatgcctaggctggtcttgaactcctaggctcaagcacttctcctgccttggcctcccaaagtgctgggatataggcatgagcaccatgcctggtctattatttatcttttactaattttggggttttttcttgtatttctagttctttaagatgcatcaatcggttgtttgtttgaagtttttctacttttttgatgtaggtgcttataagtataaacatccctcttagtactgctttcagtgtatcccatagattttggtatgctgtgtttccatgatcatttgtttccagaaattttgcagttttcttcttaatttcttcattgacccactaatcattcaggagcaaattgtttaatttccatgagtttgtatagtttccaaaattcctcttgttattattttctggttttattccattgtggtcagaggacacacttgatgttatttccatgtttttgaatgttttaggacttgtttggtggcctaacatatggtctatccttaagaatgatgcatgtgctgaggaaaaggatgtgtattctgcagctgttggatgaaatgttctgtaaatatctattagatccatttggtctgcagtatagattaagtttgatgtttctttgctgattttctgtctggatgatctgtccaatgctgaaagtgtggtgttgaagtgtccagctgttaatgtattggcatctgtctcttttttttagttttagtactatttgctttatatatctgggtactccagtgttgggtgcatatatatttacagttgttaaatcctcttgctgaattgactcttttatcaaataatgacattctttgtctctttttatagtttttgcgttgaaatttagtttgtctaagtatagctactcctgttcatttttggtttccgtttgcatagaatatctttgttcatccctttattttcagtctatgtgtgtctttatatgtgaagtgtgtttcttgtaggaaacagatgtatgggtcttttttttttaatccattcagccactctatgtcttttgatttgtgagttttgtccatttccattcaatgttattattgatagttaatgacttatttctgccatttgttattcgttttctgattgttttgtagtcttctcttctttccttccttcctgtcttccttttagtgagggtgattttctctggtagtatgttttaatttcttgagttttgctttttgtatatctgttctatgttttttggtttggttaccatgaggcttgcaaataatacagttcattattttaaactgattatcacttaacatttattgcaattaacaaacaaaataacaagcaaagagaaaccaataaaatttcacacttcatctccttgctttttaacattttgttgtttctatttatatcttattgtactgtctgtgtcttgaacagttgttgtagttattatttttgataggttcatcttttagtctttctacttaaggtaagagtggtggccaggtgcagtggctcacacctgtaatcctagcactttgggatcacttgtggtcagttcaagaccagcctggtcaacatggtgaaaccccatctctactaaaaatataaaaattacttggttgtggtgacatgcacctataattctagctactcaggcatgaaaactgcctgagttcaggaggcagaagttgtagtgagccaagatggtaccactgcactccagcctgggtgatggagtgagactccgtctcaaaaaaaaaaaaaaaaaaaaaaaaaaaaaaggagtagtttacacaccacaattagtgtataatattctgtgtttttctgtgtacttactattaccagtgagttttgtaccttcaactgatttcttattgctcattaacatcattttctttctagtctctttctactccctttagtatttcttgtaggatagggcttgtgttgataaaatcccttagcttttgtttgtctgggtaagtctttatttctccatcatatttgaagggtgttttcgccagatatactattctatggtaaaagtgtcattcctttagcactttaaatatgtgatgccactctctcctggcctgtaaggtttccactgaaatatctgctgccagatgtaatggcgcttcattgtatgttatttatttcttttctcttgctgcttttaggagcctttcttttgctttgacctttgagagtttgattattaaatgtcttgattagtgtcatttgggttatattgtacttggtcttttatacccttcttgtacttaaatattgatatttttcccaggtttggggagttctctgttattatccctttgaataaacattctaccccatctgtcctgtacttactctggaaggccaacaactcttagatttgcacttcggaggctgttttctagattttgtaggcatgccttattcctttttactttttttcttttgtctcctcttgtgtattttcaaataacttgtcttcaggcttactgattcttctttctgcctgatcagttctgctattaagagactctgatgtattcttcagtatgtcagttaactttttcagctctagaaattctgcttgattctttgttaaatgtatctgatagatttctgaattccttctctgtgttgtcctgaattctgctgagtttcctcaagacagctattttgaatttcctgactgaaaggttacatatctcttgttttttcaggattggtccctgatgccttatttagtttgtttggtgaggtcatgttttcctggatggtcttgatgcttgtggatgttcactggggtcttgatagttcagagttaggtatttattgtagtcttcacagtctgggtttgcttgtacacagtctgggtttgtttgtactcgtccttctttagaaggctttctggatatttgcagggacttgggtgttgtgatctaagtctttggtcactgcagacgtatttgcattaggggacaccttaagcccagtaatgctgtggctcttgcagactcatagaggtgccaccttggtggtcttaatataagttccagaaggattccctggattaccaggtagagactgttgttgtctccccttactttctcctacaagaatggagtctctctctgtgataagctgcctggaatcagggaaggggtgacatgagcacccctgtggccaccaccactgggactgcgctgggtcagacctgaaggcagcacaacactgggtcttgcccaaggcctgccatagccactgcctggctactgcttacattcactcaaggccctagagcctacaatcagtaggtggcaaagccagccaggcttgtgtccttccctttagggtggcaaattccttccagccctgggctggtccagaaataccattcgggagccagggcctggagtcagaaacctaggaatcaactgttgctctattctactgcagcttagctggcacccaagccagaagacaaagttcttcccactcttccttcccctttctgcaagcagaggagtctgtccccgtggccaccacctccacaggcccatggagagcactgccaggctgtcgctgatgttcactcgaggaccaactggtctgtagtcagcttgtggtgaatgctgccagacctgggacccaccctttagagcagttggctcccctctggcccagggcaggtgcagaaatcctgtccaagtcccaaggcctaaaattagggactccaagagcccacttggtactgtactccactatggccaaactggtatctaagctacaagacaaagtcccctttactcttccctctgcttttctcaagcagaaggagtttctgtccatagccaccacagctgggagtgcgctcagtcacagcttgaagctagcagatctcagagtcttacccaaggcccatgacatgtactacctggttactgctgctgattattcagggcccaaaggctctttagtcagcaggtgatgaatcctgccaggactgggtccttcccttcaaggcagcaggttcccttctggcccagggtatgtctagaaatgtcttctgggaactacggcctggaatgggggcctcaggacttacctgctgccctatcctgtggtggatgagacaaagacctgtttcctcttccctctcctttcctcaagtggaaggaaggagtttctcccatagaggcaagctgcactgcctggggttggaggaggcggagtgtaaacactcctttgaccaacctggctggtgtctcactaggtttcgtgccccccaagtccactagctccaagcctaacatagcaccagaacattcccagcgattacacggcttgtggcctagactgcctttcaggtacatttaggaccccagagtacattagcccaccgtggcaagccttgccataactcaagttccaaccactgggatggatgagtgccctttgaactaggcctagtctcaatgctccctccatggcaacagctgggttctgcctggtgttgctttccactgtgacagggcagcactgagttccaatacaaagtcccacatcactgtgctctccctcccaaaagcgctccgactctctgcaccccatggctgctgctggggaataggagaggattggtgtcagtgattcaagactgtctttcctaccctctttagtgcccctttcagtgatcctaagttaaaaccaggttatgtgatcgcccacctgatttttggctcatatgaaggtgctttttttaataaatggttgttaaatttggcgttcctgtgtggaggatgatgatgaaggctactattcagccatcttgctctgcttctcctctgcactttagacccgagagctgaaataaggacaagaagaatgtgatgtcctaggtctaccttggggagggttggggaacagagaaaattggggttgatgtctactcccttggtgcagggtgatactccattttttgacagggactggaaggagtctaaatgtcggcttcgggctaattactgcatattgaaaggcctcgaagggaaagggcaagtagagctctcattctgtcatctccaaaaacgagaggatgtattggaagcctgcagagattctccctccctcaccccaacccctttctccagacatcaaaaacgaatatctggccagtcttcagagaggtctcagagacactctggccctccccagtcattactgtcatttatgcaagcgaaatatcacttaggtctaattaacagagagcacgattataatttctattattaaacatcacattaaccacgctatgatttagttttacttgatctcagctttaaactctgtttttaagtgttccaaaattttatagtttgggggtgtatgtattatttttgctcccaacttaataaaaatagatgaaactttgccttgaaggtatagcaggcatttgaaagaacagggtcatgtggataaggcactaggaaaaaagaaaccaaaactagctccctggagaccaacctttcagaaatctcaggcttccagactttaatgatcctgagtcagaatgaccccaaggcctactcccatccccccgaaaaaagtgtttggttgagaacgaacagaacttgagtaggtgccttgcaaaaaaaaatagctgctttgaaatcataggggaggaaggtgttgaagctgatgcaagccagcaaggagccatttctgagagtttaccatgtgctgtgtcctttacacaaaagtgattttgttcatttatctttacagtgacacagtcagagaggtattattaatccccattttacagagggctatcctgaagatgaagttaattgtacacagtaaatgctacatagggtttattattaatatcggctttttaggctgaattgttaatcagaatagaaagagttgtttatatgtgttgggaaaaaaattttctaagtcttttccctcttctgagtttatttttctcacctcctctttccaaatgaccatcttttcaaaacacaaatcaggatgaacctctcttttgactaaattccacctgcagctccacagcgcctatggaataaagtcccaacccttcatcgtctgccccctgtcaggcctcctggctgccagtgccagccagatgggaatgtgtcagtccctaacactgcaggcctactggttggtgctttcatgggaatgtatgtgctgtcccgtcagtctggagtgccttgctgtgtccagtcttgctttagcaaaaagcctaccatttgaatgggtgtttgaaataaatgtgtaaatgaaagaaggtacttggtactcaatatgttgaatttcagcaaatgaagttaatcttgaactcatcacagagttttctcatttgggacctgggataggcagttgagtgcagatgaaacaaggagatgaagcccccttggccaaatacccagaacacaaggccttgaaggtcagggagaattcttggcaccctcccaagcccctgtcagcctcatcttgttttttggttgcttactctgaatttctcgagtccttgcagagctgatggcagaggaacctaagaaagtgtgagtgcatgctcccatggtgccttctggtgaagggaaagaagccgccttctggctcccgaactcctcccttatatcctctgcacaacctctggtcagtcatcgccccactgtagggcgtttcctgcggctctgccatccactcacactcagtgtgggctttgacacctcttcccccagctgggacaccacttggcttccatcgggacacattggcagacagtttcatatttattcaataaattaaagcaaggtaactgtttccaaatgttgagggataagctgtaaaccaatgtgttgccctgatggggaaggatgacataatgaatgtgtgcatttgtaagtatagctgtgtgtgtgtgtgtgtgtgtgtgtgtgtgtgtgtgtgtgttcaggtgctgaatgtccatttccctcctttatatatacactattgtgctctgctgaaccacacaagtagaccctgctcatttttctgcccttttgccctacgttgcttttttactggcttcactttgtgggctttgcttagagtttatatttttagtccaatgaaaccaagagaataattggattgggtaaattgttcttctcttttccaagatatttgcatgatttcacccttgaaagagggtagatagcttctaatttgcccaaattccaacttaatgtgactctttgtggactctctctcttataaacaccccaagcaaactctaatctaaaagtactttctgcttgtgactattaaaaatttatcatattatgttatagttattttgacatgtgtcttagctcctaaaggagagattgagtattatatgtatctgtatcctcagtgcttaacagattaaaattattcagtaaatgttttttaaatatatacaagaatggaacaaaagaacgaggtagaaattggttatgaaacctcctttcctagaaataatcatgaataggattaactaagaagtaaactttcggggcacttgatctgttcttaggacctcttgaaaccttaaactgaaacctaacataaaactgatgaaatttattttgttacatgtagtttagaaaaattatctattatttttcttattttaatcattagaacaactacccaacataaaaaccctgtttagatttctttatatatattaaataattattaatcaacctaaattatacacataattattaacaaataatcataactgctcactgccatacactgggcaaggcactgggcaaggcactgggatgaaacagtggaaaagatgaacacagtttctactcaaattgagcttaaaacctagtgggaaaagtaatacaaagtcagttaataagcaaaagaactgatgaatgctatgaagcattcagatgcattcaacaaatattatgatgaatgctgttgatgaacgctgtgaagttaactgggtagtgaaaaatggtggggggcacacattaaatggaatgttaggtgaaggtctccagggagggcaggagtccagaaaacaggtgaaggcaatgttactggcctcccagaccttggagattggagaaagtgtatgccaagcctctagcccaggacccagcacatacgagatactcaggatagaagttgaggtgaccattttgtgcttgcaccctgctctctgccctgagttaatctggtctacttctggtggtgccattcttagttcctccaaggtatgcacacttctttctgaacacatgctggcttcagtaatgggaaaccctccattaagtcattccccaggcccaaaagacttccctggaaattggataatatagtgggtcaagaagaggctttggtcaatcaggatgtccaacattaaaacagataagagagaggttgttcaggtaaaattggggtgggatgtccagagcatccaacctggtcctcttacccaagagacagaagagaggttaggatcccctcccctagctttatgaaagaataggtagcattcccccaaagggaacttgaagtgttcagtctaaattggcaggggtggtgactgacacttgtaactgagaaatgaggggaaacttcagcagagaaaagtcctctgggccagatagtccacttctaccccaacccaccaccatccctgaccctaagcacagtctagaagcactgtctaagtaggatctgttatggtatatatacagagctatgcaatactcattgtatgcaaagtcacttctacaggtactgttccacaaggcacataataaaactttagaaaactgtgctgtatggggaaactccatgctgtctctgttcagactaatagggccaaggaagcagtagccccctttccttttggcccctgtgcacatccttgcagaatcagctcatattattcaccagttatattgacataggctcagactttttaattattattacgattttttaacataggctgcttagcctaatgatgactcaagtaggacctggacatctgagtgaagatgtgaaggaaacattcgtcacctgaacaccatatttggacatctcatttaaattcctggcaaaattcaggtcaaaccaagtagttagaagcaccactaatgtaatagaaaagacttagaaaaataggttaaaatgggtttttgaggacaaaagtgtcagatgaaaacacttgaattctttgtttcatatttttaatagatactacatttatatgactcaaacatcaaaactactcagttccccagggccccaacaggaaataaccagtggttgataatttcttttttaatgcagatatttttctacatctacaagccaattcatattatcttccccctctttttgacacatacaggagcgttttacagacactgctcttcccttgcttgtcttccttagcatgtgttagagagctttctgtttcaatatctagagaacatgctcattcattttacatttgtatggtatcgcacactaggaacaaccatcatttatctaactgtgatgtacatgttggttgtttccagtcttttaccattaccagtcatgctgctgtaggggccaagcttcccacttcctcctctgaaggttcactgacaaaaggcaggttaaaaggagaaaaggcatacgacatttattgtaaaatgcgtgacacaggaaaatcggaggagaatctgacagcccagtagctcaatgggatacagatgtttatatacccttctccatagaggaaagagatgggaatatgtggcaatttgaggatagtaaacgattgttagggggaaattaatggacttggaaaatacacagtggcctgggacaaagtctgttgggcccacagagcagacaatgggtggtaaatgattctctttgaaatactgaataggaccagaatagaagacagtggtttgtgacaaaagtctgtccaggtgtattgacagacttgaatctttcttcctcaatatgagttaagttaatgaaaactaagggaaggggcagaggtagttattttctttggtgggtcttgactttgggcaaataagagagcttcaaagaacagcttcatcctttcctttgggagagatggagggttgagaagcaggagcagggagatcagaaagaccatgaggttgcttctttagcacatcaaagtgccacattttgggatattcgtttctgagctcagagtttcctggacatttcacatgttaacagatgagctagtgactgtggagaggaaaatagagttagtagctgaatggtaaaagatcccattaaaccagtctctcattcctgagaataggccaacccaactaaacagtagtttctcattttaagagatggtattgtagatgggctctcaaaattagacctctatccatgacacaggcaaacagatctttaataagagatatttttatggaaacagatgaaaaacaaacattaatgtctgaggtggtctataaactagtttcttttagagtcatgggggcagtcagctgagagggccagtggcaatgtgatagattttcctggattttagtttgtgtgtaagtttgttcaaatataagctgttgtggtgatttttttttttcaaagccaagtttactagcttcagcttgtagggccttaggaaaaaagaaattttaatttttagtgattccaagtcagaagggtaggagaaaaactcaaaaacaatgaacagggctagaatctaacaacagatgcaccattgttttcttctgaaatgtaacttttctctctttagccttccatttctaccaaagatactcataatgagactaatttgtttgtaaaataagttagttttattaacttggcctgattacttgcataaagtacaattagaataatgatttattatataggcacttttcaagttggctttgctgaaaatttttataaggaatctcagattagacttttaaaagcctctcaaggctgtaagctaaatcaaagatttgacttgccctcagactacgtctgtaataactacacaaattgagtgaatttctctctttttgagcctggccgacatggtgaaatggtgtctctactaaaaatactaaaattagctgggcgtggtggtgcccgcctctaatcccagctactcgggaggctgaggcacaagaatcacttgaacccgggaggtggaggttgcagtgagccgagatcgcatctctgcactccagcctggatggcagagcaagactctgtctcaagaaaaaaaaaaaaaaaaaaaaaaaagagagttacattctttacctaccacggggcagccataagaaatgtgtatgtaaggtactaggccagtttttcccagggcttctattggcttcataatgtcagcctccgttctgtaaagctgtctggtcatagatgaaaatatgacattccagtcaaggccttggtaaaataaccagtgtttccaattgtgttctgttacaagaagaacagattcttactgagcttatgcaaataactacattaccataaaataagaatattcatgaatttcaacattttggagggataaggtagagagaaaggcaaatgtttcaattttgttcacaaaactatacccaattgctgtaaactttaagaggaataaaaggaagctccttaactttggaaaacaaaacaaaaagaatcagtaatgttcaaacctaaagccataaaatatcataatccttaatcagttgatgcccatgtaattcttattctgctggttgagttcacagttttatgagtccagctttttccattggaattattaaaatttttatacagtccaactggataatctcaaagtcattagcagaggtctatatttcagggtagctgtcagaagctttttatttttttcatgaaccttcttgaagacagaacacttgcaaatgtctttcaggagaagcatcagagtaaaacaatttactgtggacaacaagacttaaaatggccatggttaaaaatcttatgagagttcacaataatgatgcaatcgacaaggtgttctgtgaaagatctgtatgtaaaaagcagttctcaaatgccaaaggagccaagaaaccaaaaaatgaggcagataaatccagtttgttggtatatgatgatttattaggggaacttacagacagaaacgtggtcttgggtggctgcaagacaggtcgatatctacactgttacttcccagacccaaggcttgtataccataggggaaaggtatacatgctccagcaagacaattcaaggcaaccctccagaacaccaagaatgttatatgtgtcatagcctataatttatgtgataacatcaaggttgctttgatctaaaatcgggatttgtagtgagcacatattcttacactaaggacaataaattaagaagaaatcaggaggcattcacagaaatagggtcattcagaagtcaatggtggattaacatccaagatggagtcattttgtctccacacaaagagatctggttatttttgtggcatacaagatttaacattacgattatgactggtaacataaaccaagacatatcagatttctaggactcgcgtactattttggaacacatattacacatttatacaaatataactcaaggaaaactaaacaccattttgtatttgccaatgcttcccatgtgattttaacatactgagtatgcctaatacgtctctctggaccttccaaaggcccttctggaatgttcaaaagtagttcaaggttgaaaagacttaatttagaatttgaaatttgattttgaagtcttttaaaaatgttcaaaagacttgatcaaaagtagaatcacaggtcattgtgaaacaatcatttgtttaaccaaagtgataatttagagatttcaaaaagctaaaacctttactctttgatagacgggagactcagttttccaaataatcaaaagacacagtaaaaacagcatgaagcatatataatctgttcctttccctcccttcttttttttttttttttgcagtttactcaaaaagtgaacaaaatctttttttgtcaatatttgtaaatcttgcttgcaagagacaaccaaaatttatttttgcatcagtatcaatgctaaagctaattttaatgaaatcttataaataaacctatcctgtatagtcagctttgaccacatatgatacaatttttataaacttttataacctcttaaagttttattttattctttttcaactttttatatttattcagttttatctataccatctttttatttcttcatttgggaacaacttttaaataacctctaaagtagacaaaataatctttttaaacaaaaaccacatccttatgcctttttaataatcttcctcaccaaaaacatttcctaccctccctgtacgtgttgtatacagaattatttcctttatttctggtagttttgattacatattctaattatacttttaactcttagtaaccttaattttcagtgaaaaacctgaaaagtaagcaacttaattgctgtgtaccaaaacattttataaatatatattttataatttttagaaacagccttttctgtagaacagttttttaatgtggaagacggcatatttactagtaagtttattctttctttgtgaaataaaaagccaaaagtatgtaagcttaaacttatgtttaataattaatgttttagtattttaatttatttagatatgacacagacatttcatgctaatctattatttaacataacatgactttaagattttaaattactgaaaagatttttttgaactgacacatttgtctataaatgtttatcccattcatatttacctaatttacttgttcttaacaattacatcttaattgcttatggggaacaaaactagccatttaagttaactttttttctttgtttttttttttttggtttgtttgtttgttttgcaaaagcaaaaccagtctatccttgtactagccagtgtcatattaactaaggcctctgagatactggacatagacaccctccccagtgtgtcccctgagtcatcctgggtcgcaggtactcattgggcacacaggtggctatgaagggcagggcctgtctgttctggattcacatactaggtacagagcccaggacaaaggaaacagctgtgaagatgatgccaggaggatccaacccttcccaacatggccaggagacagagttgggccaggaatgatggggccatgttaggctgggccctgccctgtagctgatggcccaggtgctgcacacacacatatccccaggcctcaccatggccacctttctacacctcaaaatccagaggctcaaaaccaaaggcataagctcacagcaagatgtatacagaactttggggaaccccattagccggcccttagagctttagctcacagacaaaacaaacaagcatcaaaaattattacaaaagcaatagttttattacactaaaacatcaagcagagacagcataagtctgtctgacagacctaggcaaaatgtcctaattaaattctgaagccatttttatgttattttaccaacaattttaaagctagctttatttaccaaaggcttattaatgtcaacctgaacctaaaaaagcatttgggcttatttacttgatttatgagtatttacgtatttctaaatcggtaccatctaaacaacatacaaacacatgtatacacatatgcatacatgtaaacatagcatgtaacacacattatgtacacagaagccaaagagatgaagcagatcagtgcaaaagagcagagctttagacctgagaggaacctgcccacgagttttggagtgttatgaggaagacagggaatcccaaaacaaaaagaggtcagtggtcccttttttttttttttttttttttttttttaatttctgaaggggtttaaggattgatagaagtctcctctagatctcttcatgtagtattgaaggtggcaaaaggaagtaggggcaaaagtagttggaagaatgagttgtagaggagatagtttagcgtggagggatgaagttttccaaaaggcctgtgaagttttagttaccaggggtttgagaaaagggaatctagctgactaaaaagttcttatgggagaacaatatccaaaagagaacggagaagcttaaaaaaagtgcagtctgaatgtcagcttttaatgaagctgatttctaaccatttctaaccacagacctttctttttgaaacaatcctttacaatttcttattattagatttcaatggggacaaacagcacatattctgggtttttaattttttaaaaaactaaaagcatctatcaggtgattctgaatgcaaatcaataagccttttatgacttaaccaagaatgtatgattcatctctaaagaggtgcaaagaaacagtcctcccaagacccggagccacccgctaagacagttagaagaaaaaagaaacttaaagatgagctgcacaacagtagctgttcatgggagggaaaaggatcaatgacaaatgtgtgctccaaaaagtcaagagtcaaacaaatataaattcaaaacaagtaattaaaacaaatccttataaatgtttcattttttttttcttcttagttaaaggatttatatctccaagggactggttctctgactgggaaaccaaccccagacagagcagagaaagttcagaatcctagtcactaaactacaggccagagtgtcttttttgcaaattcctcaaaggctccaaagcagacagtttacatgtacaaaggattttaacattgttttagatctgatttctgccttttaaaaatcttgccaagggagtttttaggctatctttcttttgtttcttttcataggtaccaataagatagttgtttaagactatagctctctaaagagtagtcttttaaatttagagaatttctttatctcataagtgactcaagccaaaaaggcttttttcatggaaagtccctgaggtaactttccgggtttagaatacgacaggcaaaattggcatctttttttaaatgggtgcgaaagatgcagccttcatgatcctccccaaaatttactcccagaaataagctaagatagcagatctctgttgccacaggcggttaaggatggtgtagctggtctccctatgagcacatggacacgtggccacatgggggtgcctctagtcacagacctgccaacctgtgacgcctgtgacacagggcaggcacttcagggattagactttcccagcactaaccaggcaacaaagatggaagcaacagaagcccttcatggatagaactccttttaggacagactccactgacagcttggcacatttggggagaaaaagagagtgctgcttaaaatttgacatggctcaggattcccagtgcttttagactagctactggacgtgacctgaaaatcacacccccagaggcagagaccaagggagaatgctccctcttggttacaagtcaactctgaagggcataaagcaagacgaaaggagaccctcatccggttttcatttcagggacccacagcacagtttgtcttaaatagatgcgggtctgatgagaaccataaaactcaccagtctgtggagatcagctcagacaatgggcttataggggttttaggcctatgttctatcctacttctaccctgtgatacccttatttatgacaaaacaaaacaggaagacaaagacgaaggaaaaaacaaagactatttctggaaagagaaggattagataatatgaatattcataataaaaatacaccagagctgctatactcaatgctagtcaaacaagtgcttttctcccattaatcttaaatttggaaaggaaaatgagacagttatttttaccacctacttaaccagatttcacaaagagtgaccaagagtgactgataagaatttctcccctttggctggcatatcaggtctggggttccctcgaatctggcttccagaagagcagagtggtttcggttatcctgttcacagcacctcatctgtagggaccaagggaaagcttccccctttactttctggaggtttgtgaatatcaacaaaagacagattaataagaaaaaaaagcatacaaaatttattctaacatgcatagcacgggggaattgcaggagaatgaatgcccagcaacccaatggaaatgtttatacaccctttttcataaggcaattggagatgagggaaatgtggcaatttgagggatagtaacatttttacggggaaatgaatggacttggagaacacgcagtgacctgggacaaagtctcttgggcccacagagcagacaatggctggtaaatgattctttttgaaatactgaatgggactgtgttcatttgtttttgcactgctataaagaagacacctgaggctgggtaatttataaagaaaagaggtttatttggctcatggttctgcaggctgtacaggaagcatggtgttggcatctgctcagcttctggtaaggcctcaagaagcttacaattatggtggaaggtgaagtgggagcaggcacatcacatagcaagagcagcagcgagagagaaaagggggagactcttttaagcaatcagatctcacatgaactgagaactcatcaccaaggatatggtgctaagccattcatgagcgatccactcccatggtccaaacacttgccactaggctctacctccaacactggggatcacgtttccaaatgcaatttggaggggacacacatccaaaccatatcaggcaccaaaatagaagacgatggtttgtgacagaagtctgcccaggcattgacagcttgagtctttcttcctgcgatatgagttaatgaaaactcaaggaaaggaccagaggtaattgttttcttctttggcaggtgtggactttaggaagataagggaactccagagaacagctttgggagagacagaacattgagaggctaaagggaggtggaggtagggtaaggtcagagagaccttgaggtgcttacttcagtccagcatgttaaagtgctatattttcgggtattggtttctgagccccagcactgcagttaatatactggtacatgggtccctttacatgtttgcaataactgttggataaattcttaaaagggagccaagaattcatatgtatttgtgattttgatagctagtgggtggcaaattgccctccgaagtggttgaaacaactaacacatccatcagcaatgtatgagagtggtttgctatccactttttggctatttgccagtctgataaggggaaagtggtatctcctgtagtattattagttttcatttgcatttatctaattttgagtgagctcaagcatcttttcacatgcttcagaactgaaccttcagggactgggctaggatgaagtgagtgcagtgccttgggtgaagaatttaaggaggcatttactaagttctccaggtctccttcacttacgtgccctaagcacctcccctacccaccctggtcccagctctgtgcagtgccctcctcgccctcgccctcaccctcgcccaggaaccacttacattccttttgtgtgatctgtcttttaataatctttgcacatttttctattgggttgctgatctttttcttaacttgtaggagctttttatgcattaaagagattattgtgtaaattgcagggtttattttttttttaacttatgcctttgcttatgaaattttgtttatttttgccatgcagaagtttcacattttttaaatggcaaatttagcaattttctcttttgtgattctggattttatgtcatagaaagacctacagtttgaagttattaagaaatcatcctgttttctttcagcaatttatggttctgtgtttttacatttttaccttttacattaattcatttggaatttatcctagtgtatcgtgtgaggtatgggttcaattttactttttttcagatggctacccaattatggataattacccaattacctaaaccataattgaatagtccaccttgcccccactattttgaggctccctctttattacttgtgtatatttttggctttgtattcaattctatgaatctctgtcttttcatatacaaatattagaacatacatttcgaaaaagaagcagaacacacaggtgtttgaagtgatgaaaggtaagtttgctttgctcggggctaatgcatttatggacttcaaatggaaacctttctttgttcatcacttggaaaagccacctgtatttaggtaccttaacaagacttcctgtttacaatatatttttacttgattgaaaaatgaatattctatgactttttggagcagaatggcaggagttacaatcatgaaaagcattccaaatgacaagaccacggtaggccagatcaagatctcatggacagttgagggaaagtattaaaaaatagagaactggaaaatttattgaaaaatgcagaatatgcttttggcagctgtttgcttttaggacaaactagatttgacatggaaaaacaaatcactgctcccataggcggctcttgaggaaccgtcttctgccattcagtaaataggcggtatctttcacaagttttgttttattgcatatggatcatagcaattttttaaagtttatcaatccatcttctaatggcttgaaatttactatttttttctacttactcttcttgtgttctattttcacaattcccagcaaaatgctagtaattatagtgcttaagaatatgctggagaggatgtggagaaataggaacacttttacactgttggtgggagtgtaaattagttcaaccattgtggaagacagtgtgatgattcatcaaggatctagaactagaaataccatttcacccagccatcctattactgagtatataccctaaggattataaatcattctataaagacacatgcacatctatgtttattgcagcactactcacaatagcaaagacttggaaccaacccaaatgtccatcagtgatagactggttaaagaaaatgtggcacgtatacactatggaatactatgcagctgtaaaaaagaatgagttcatgtcctttgcagggacatggacgaagctggaaaccatcattctcagcaaactaacacaggaacagaaaaccagacaccacatgttctcactcataagtgggagttgaacaatgagaacacatggacacaggaaggggaacatcacatactggggcctgttggtgggtgtggggggctaggagagggatagcattaggagaaacacctaatgtaggtgacgggttgatgggtgcagcaaaccaccatggcatgtgtatacctatgtaacaaaactgcatgttctgcacatgtaccccagaacttaaagtataataataataaaaaaagaatattctgaacctagtttcctaaccaaatcttgagtgctgccagccaaaaagattttttttttccatcccacctccacattcacccaaatggactaaggaagggagatcagtgacagccatgattgtcatttaaatggactgaatatgatcatgcatgaacaaagattttggattccaacatttgctttccaaatactaatctcatttcctcaaaactgcttaacaaaacctcaatataagctttgtctcccttgtgagagctatgatgaacttcttgtggatgaaggatttttatatcctttgagtttcaagtcagtttctaaaggcctaatttaaatacttcacacatacaatatgaaatttcaaatatatgatataaataaaatacaatgcatggtgtttcagtaatgtttggtgtactcatgctattatttcttgtttagggaaagataaactctttctatttttggatagatatataatccccctcagaatgaggctagagaccatccaatattttttaaatgaaagtctatgccttattgccgtgttcctgcttttatagatcatatagcacaagtaaacgtgagacttgtaatactgcttgatgatgactttttcttgaactggttgatcgtgacatctagtgttcagtactaaaattacatatctttctcaaaagcagctcatagggaaaccagcataaattactgtttaattcagggctggcaatgcaccaaaaaggccaaaatacaaaaatggaagtggagtcattggggcaataactggggacagtttgaattagaagggtaattgctccttgatgataacatcaagaactgtaaattacacttgggagcaattatgtatggacatgcaaagtgaactgctcttcagactcagttctgaatctgtttttttgttgttgtttagttcagtccttctttggctcttctcagaccaggagtgtgtataaattcactagtcagattatcttaagcaagtcataaaatttctcagagacacagtcctcttatctataaatttgagatactgagtccacatcataaaattctgggggaattaaatgagatgtttcatgtataatgatctgggttcagtgcagggtgcattgtgaataataaatagcagtgctggtgatgggtaatggtgatggtgatgcggggatgtgtctgggaagtcatttgcatggatcttgatgtctgggggtagcaaagacaggcagtgaccaggtgcagaaattgtccaggatattgtaactggatattgggatcagtgggcaacagggttcgggagagagggatggaagaaagcctcagtgtccttggagagtttcacctgtagaatttttttttttttttttttttgagatggagtcttgctcttttgcccaggctggagtgcagtggtgcaaaatctgccccctggggtttttttttttttaagcaatactcctgcctcagcctcaggagtagctgggactacaggtgtgcgccaccacaccagctaatttttgtatttttagtagagacggggtttcactatgttggccaggctggtctcgaactgctgacctcgtaatctgcccgccttggcctcacaaagtgctggcattacaggcgtgagccaccatgtccagcctcacctgtagaactttaagaagatatagtaacatgcagtaggacttactaccctgcctctcaggagctggatctcctttattaagttcctaacttttctgagcctcattttccactttagtaaagcggggatgagagcagtactgaccccgcaggtttgtgaggattcaatgagacggtgcataaaagagccctagacaatgcctggcacagcttagtaagcatgcagtagctaaatggtagcccttgttgctatcttttttgttttgttttgttttgtttttttgagacagagtcttgctctgtcaccaggctggagtgaagtggcgccatcttggcacacggcaatctccgcctcccgggttcaagcgatccccctgcctaagcctcctgagtagtggggactacaggcatgcaccaccatacccagctaatttttttgtattttagcagagatggggtttcactgtgttggccatgatggtctccatctcctgacctcgtgatccacccacctcagcctcccaaagtgctgggattacagacatgagccaccgcacccagccccttgttgctatccaaaggaaggagatgaggccgagtgcagtggctcccacctgtaatcccagcactttgggaggccaagccaggcagatcacctgaggtcaggagttcaagaccagcctggccaacatggtgaaaccctgtctctactaaaaatacaaaaattagctgggcgtggtggcacatacctgtaatcccagctacttgggaggctgaggcagaagaatcgcttgaacccgggaggcagaggttgcagcgagccgagaccacaccactacactccagcctgggcaacagagcaaaactccatctcaaaaaaaaaaaatatatatatatatatatatatgtgtgtgtgtgtgtgtgtatatatatatgtatgtgtgtgtatatgtgtgtgtgtgtgtgtatatatatatatatatatatatatatatatatatatatatatgaagggaggagatgaaagcagaagtttcaaaacaggacaaacaaaactcagacacatgactctgcttcctctttgctttggtataggctgttccctctgcctggaaatctttttcttcccttatgtacccacataggtcacctttggtagagcaatctctgattctggcaggcatcgttgctccttttactgtgtttccagtccccatagtcccttgtgcttgacaccttcttgttcttgctagactgtttatgcatcgaaccctccgataaaccatgagccccttgagggcagacccaggaagattaggtacttaagaaatgttgaaagaattatgaatacactaaaaatacaagagaaagggggagaaagaggggagcagagagacagtgaaacaagtgtggcaaaatgttcactgaatctaggtgaagggtacatgaatgttggttgaactattcttgcaactttttctttaggtgtgaaatctttccaaatacaaagttggaggaggaaaaatgttaaggatttttctttttacattcaaagcattcctttttagggagattggcctaggctctccccttctctggcctccctgggttgctctggttgctcataaatgctgtttgtgaccgaaaggtgaagctatcctttctctctgcaggtctttttacccaacttggcttctatcgactgatgtccaacctgtaattaaaagaaaaacagatccctctctctctctatgtatatatgagcaccccacctgatgttgtttggaagctacagtgtatttctgaatttagagtaaggagggagaacatcgaattttgcaaagaggaagcattgaaacagccctttgaaaatacatgttaagttcagaggcaaaacaaaacaaaaaacacagcaaacctgtatgttgtcccttccaggtccccctgctgggcatttgcagaaccgcagcatcccagatcactcgttaaaaaatttccacgttgcgctttttgaaaagcataaaaggtgcatgttcaaagctgtatcctgaccccattccctctacaacatacattgcttcagctgttaagctctatattgaatgaaagcacaatgggaaaatagaatttcaaaactaaagcaaaggtgcataacaaatactcttcaaatgcttctgttttatgttatctcatttcattttaagaaaggccctgaggcaaatcctagaagtaaagacagccacactgctaaagcataggtgctgcttctcagtggaaaatctgtctgtctcatggttatccaaggctgaggtggtcctttctgatctaatagaccttttgtctgcatttaaaaaaaagttcctaagaactagaacttccccacaatgaatggcctattccttgttataacaccttccctgttaaaacggtgcaagtgcttaataaatgcatgatgaatggtgggttgctgggtggacaggcacgcagagaggtatttgggttgagtgtggacaaactggtaagctggagaaactggtgccaaaaagggatgtttacactaagtgcagatttggacaggatcactgctagatcccttccatctaagatattgcaaatcacaaattctgaagaactcagtggagaattctaaagcatggggtccacctgaagagtcccagactgatgccgtctcttctacagccactggtgtcattgttaatcttgtccagtcacatgtcaatgtaactcttagtcagaagacagaaatataccaagagaatccatgtgtcgtctgtagcccatgcctctctcctgagcaccagactcatctgctaattcactgctttccatttctacccacacatctcacagcacctcacgctgcacgtgactaaacctgagctcattatattttcttcctcccttgtgcacgctcttgggtttctgattttggtgagtgacacctccactcaatgagtccccatgacagaccagctggatgccttcttcattcccacctctccatgatcattggtgacccagttctatttattcttgaagtctcagaagagcttcatttcacatcatcttctttggaccattgcagtggtctactaactagtcttccttccttttcttattctttttcaggtgagctttcattttaccgtcagagggattctaaaatataaattattcccctgcctctgtgcccactctacctctccccattgtccacagataaaagtccaaattccttagcatggcattcagtatgttccatgatctagcccctgcctacctctccattcttaaagcaaacattccaaccataccaaaccacgtacagctctctgaataggccatgcctctgggctctgtccctacttgtttttctatggggaataccttttcctatctgtacacatggcaaatagctgttcacctggcaagacacagcttcggtgtcatttcttctatagtgctgttactcttggtccccagagagggtggcttcctctccctgtcgtgccccaaatagacctcttttaagacacccatcattctttattgccctttttgatttacgtatctacctccccacagatgcacagaaaaatcctaaactaggaacaaaccttgtcttactcatctttgatcctccactatctagcacagtgagtcagcgcataatacttactcaaaagatgtttgttcaaatgaacaaatccatctattatttaaccagtcatgagatcaccatgggagcaacactgttcatctggagctgctgatatcataccatatgttcattcttcaccaggtgttacctggatatcccctcatctcacaacctcagagtgcagatgtgtcacatttacagaagcaccagcaaagtcaatgttctgttccccgtcatcttgattgacaggaggttctctgttttctcagatgatccttcccatcatttccaaattgtgatctaaagtagacagctgagtacccaagtctgaaattcaaagcattggttaggaccactgttttggctgactggaaagaggtgatgatttatcttcatggctaatggctcagaaagttcttttcaaggttgtagaattcaaatgttatccatgacgggatatgaaatccttacgatgtgctttgctttttttgtacatcaaagcattaagcatgggacaaattttgctgagcttaattgtggagatgagtccatgttttacaccatttagcaaaatgcagttgcaagatcgctctgcctaattgtctaacagggacttcaaaccttgagataattaagactgaatttatttccttcaactctcccaaaagaaaataactttggatactttcttctgtatctccatgaacaacatctaactaatcacccaggccagaaatataaatgtcaatatcaattccgctttccatcccctgactctatcccatagtgaaactgtcccaaggaaactacctccttagtagttctctctactttgttctttgttcttcttcccgccatcacttcctttctttaaaccttcatcattagttgtgtagataagtatagcaaccactttaatggtcttcctttatttagcattgccctttcttatacagaattgccagtgtcgtcttgtaaaataggaatcaaaatgtgtcactctcctgtaaaacttccagtaattcctccacggtctttaggtctctgtttagttctacagtgttgttttatcacactactatcttaccttatacgttggtcttgaatacctctagttttccaaacaagtcatcttttgtcatttttctcagtgctttagtatattctgctgcttctgcctagaatgccttacatagcaggatatttttggctgcaggtaacagaaaatccaatgcaaaggcttaaacactaagagtttaagcacataaagatgggtgtctggtggttctagggctgattaatggcagcaattcggtagtgtcatcaaggacaagtttctcttcattttttctctctgccaaactctgtgtggcctcctcagggtcacttccctccagttttcaggatgtctgccacagatctgagcatctcgggaagacatgaagtccagcaggaggaggagcctattctttcttgtgcatgctctttaagagtcagggacatgtttctagaagccctcaaagaaaaacttgtcttttgtcttagtagtgaaaactgagtctcatgctcatctgtagcctgtcactggcacagggatttaaagaagtcaggggagtgggccgggggagacaaggacacaggaatgaaaacgaaggcactgttagcatggaggaagggggaagtgcccagtgggtttgcaaacaacagtgtcctctgttgccctcttccctccattttttttgttttttttttttttttttttggagacagaatctcactctgtcgccaggctggagtgcagtgatgcgatcacggctcactgcaatctccacctcttgggttcaaggaattctcctgcctcagcctccctagtagctgggactacaggcatgtgccacctcgcccagctaatttttgtatttttagtagagacagggtttcaccatgttggacaggattgtcttgatctcttgacctcgtgatccgccaccttggcttcccaccttggcttcccaaagtgcaaggattacaggcatgagccaccacgcccagccctttcctcctctttgccaggctaattgttgaatactcagctaatgagtcaccctcggagagacttctctgaccacctctcttccttttgatgccttctgacaagttaatacagctatagaatttatcctaccagaccacaagtgcctcgaggtaggactgtcttttagtatctgtcatagttactggcacatagctacaggcatatgtgctaatatttgttgaatataaaaataaaagacaaaacctgagttgtgtcaattagcgatgacattctccttgccacagaaaccctagagtggtttaaccaaaagagatactgtttttctcatggaacaactccagaggaagaggtcctgggctaataaacatgcacttacaattcatcacaggcttgggagccttctagagtcttgttctgctctccttggcatgtcactgcatgttctcatgaacacatcctggctcttccacctcctgagtccatgttccaggcaaaaagaaggactaaaggtacaggttacttgtcaattgaatctgtggcttttcctctggtaaacagtagctttctcggcagctctgcttacttgacttctggttatatcccatgagccaggcacagatctggttttacgggacaatgccaaaacaaacattgtcagggttctgttagggtcacaagaagatttactctatttcttgttctgtctgcctgcttgaaacaatagcagccattaaaagttgttatgtggaagtcttgtattatatactagaaatgggccttgtaagaatgacttgtatcatattgtccacatcctcattgagaatattaagaagacaatgttgagaagactgacgcccagagaaatgtcatttgcccaaggcaaaatcaaatattttggtggcagagactgcttaggaaacaaccggtccttatctcaagtctaactcccttaacatttgggggcatttcataatttgatcttgaggtaatagatattagatgtattaacttctttttccagccttacataacaaagtcttcagaaacagaaaccgtatttgcgtggtttgctgtaagtaatgcctagtatggagtcatgtaatgattcttttaaatttaaatttaaattattgatttttgtggatacatagtaggtatattatggggtacatgagatgttttgatacagacatgcaacgtgaagcaagcacatcatggagaatggggtatccatccctgagtcctgtaatgatcttaatgcagtccttcctgctttctctgcagggacttttaggaagatgtaggaaggaatgatttgtccactgtggctgcagttacctccattaactctagatggcactcatgcattgattgggaaaccagtcactgataatattaactgcctggtagaaactgacaaattcttcagtcagggtggtgaaaagttaaatataggtggctcccaggcatggctgggtgaatagattggtcaaaggagaagtggtgaaaactggggactggctgtaaacacatttcatgagtacatacaaacccccttgccttctgttcattctccctcacagcagccaaagtgggcaaaccagaaaatggactggccagccttaccagtgtgcctgtctgaccagcgggcgacctggtcactgccccagagggtcaagggaaacctattctccttggccacattccttgagatggtgatcacagaggacactcagttgccacatcaggactttgatattcagatggaaaaggcttatatgttgatttgagttagtaattagggcttttaaactgctcttgtcgacataaacacatacactattattcagtacttctggtttaaaactcttgttccactgaacacattatttgggggtacattgatactgtttctatgtggcatttcagacactggtgaagaacatgagctttggagtcagacttgggttgctgtctgggttccatcacctactaactattgtgtggtcttgggcaggttaattaacctctctgcgcctcagaaaatatggaggtgataataaaacctacttcacagagtcattgtgaagatggagataattctgtgtagtacttacagtgcctgctactctgtaagtactaaaaatacaatcagctgttatttttattaccatgtaatctaaagacatgaaagtcacacaggacaatgatgataatcggttgtccccatcctgtgtagacattttatagtcactttagcctgggttgtaaagtgttgggagcaaaatgagaagtaaaatttaacagttcaagtgaaaatagcgtttgagaagtaagtagatttaattgggagaaaattgatttatacccaatatgcaggcccaactactagaaaatgaaaagcagtcatcttaataccaattgttatccacctagttccttgggtagcttttaccacaaattcatgatagaatttgtagacaggaacaaaaaactacttaggattaaaagtaggaaaagaaactacttcccatattaaggtcctatgacaatgcaaagaggtggattgggactctggcctagggcagctgtccagggtggacacggatggccataggagttgtgatgtgcaaacgaaggaacaagggaaggagggattgtgtgggacaaatatataaatccagcagtgtgtgtttgaaaactcaaggatggcagacctgttgcttctttcactaacccgctgcgccttgagtcattgtagttagtgaattgggtggctgcgtgtccatatgcctcatttgactggcatagctgcctggaggaagcttaggcctggaaaaaagtggagactcatgctctgggtgcctggtgattgtaggcccaggtgagaataatgcaggcaattgaagatttttttttttcttgctctaattttcacctgagagctatgcccactcagagagggttgggggagagtagaacaggaaagaaacagaagacactttgggtttgggctcagaagattcagctcacatccagcttctatcacttacaagttgtgtgctcattcacaagttgctgctgctctccaggtttcagttttctcatctgcaaaatggaaataataattcttatagcatccaaggttatgtaacaagtataaattagtgacaaattggagtctgtggaggtgtaactttgctcataactcagctcaaattgttcacaagcccccatttcacttggtagtgtaggggagggaaatgtggcttgcccctcacccttctaggttccttggctgggctatgaattaaattgacataagacagattaacaggaggaaagccacatttaattatataagtacacacgggagccccacaaaatatgagactcaaagaagggtcagatgactgaagcctatattgcatcctgagctacagaaaggaatagtggggctaggagccgggcgtggcggcatactcctgtaatctcagcactttgggaggccagagcggatggattgcttgaggtcaggagtttgagaccagcctggtcaacatggcgaaacaccgtctccactaaaaatgcagagattggccagacatggtggcacacacctataatcccagctactcaggaggctgaagtgggagaatcacttaaacccgggaggcagaggttgcagtgagccaaggtcacaacactgcactccagcctgggcaacagagcaagactccctctcaaagaaaaaaaagggaggcttctaggggtggtagcgacacaagttatgggagggtgagtcagggaactgtatggtgaataaagtaaccttgttaggcagataaaaagtctgttgagtaatacaagttgcttctgagcagcccttgggagcggaggtgattgtctggactgggatcaacctccaagctccactcctgtgatcccagttaatcttcccatgttgagaagattcccagggagcagattcatgacaattgagtttgttttgcaggatccgtctttaggcggataaggaaggctttccctgcctgcatctgctgctccccaagtgccttcacttctaagtaatcagcacaccaaagtggcatattttggggtggcatttcctgaactccttcagtggacatgatttgcattaacacttggtagacagaggcatgggggctgggagaggggtgatattttattttctagtcagttaaagctagtcctttctggtttagatgtcacttctggactaggcctgttttggaaaactgccctctctcccagagttcctccctccttctccaggtcccttctcttcccctttctcagtctgttctcctgggtaggtcagggtggaggaggaagcatacacagcgttttggtcctgaggaaagagggtgtgctccccattgttcttctctgctggttcgtgctgaccagtggagctgcacttcgcattgcctggtctctgggacctatgtcctcgctgcatctgctccagtcacagggaggcgactcttggtttgtttggcagcacactgttgagggttggtggactccagccttccctcaggaccctccttactagctcaagctcaagctccaccatggtcttcatgagtgctgctgatgctcacaggctcccctgcatccctgccaggctcccagctctggccatccacctcatgcctaaccacctcctgtagccacatactggctttgtggctgctgtgccagctcctttctctgctggacttgccacagcgctgcatctcctctcctgcagctgtcctgtgttgctggggtcactctgcaaggtgatctcccagctcccattttcccatttgggaaggaggacccaagtccctgtggctttgggttcccaaaactctctgtagttttctattcccacccccaggtgtttctaccctgggctgggtatgggggaggctgcatgaggtgaaggaaaaagttccacactggaaactttagtccctccgtgccagtctcccctcctccctcagctctcaaagggattaacccttgtcatggctgaaattgtggctcccctccaccaaaaaaaaaaaaaaaaaaaaattcatatgttaaagccctaaccccaaggtgatggtatttggagatggggcctttaggaggtaaatttattatttattatttatatttttttgagacggagttttgctcttgtcgctcaggctggagtgcagtagcgcgatctctgctcactacagcctccacctcctgggttcaagtgattctcatgcctcagcctcccacgtagctgggattacaggtgccgccaccacacccagctgatttttgtatttttagtagagacggggtttcaccttgttggccaggctgatcttgaactcctgatctcaggtgatctgcctgccttggcctcccaaagtcctgggattacaggcatgagccactgcacctggccaggaggcagttaaatttagatgaggtcatgaggatagggcccctgtgatgaaattggtgctcttataagaaaagacaccagaaagtttatctctgtctctgctcataaccactgaggaaaggccatgtgaggacacagcgagaaggtggctatctgcaagccagaaagagagcctcacgagagcccaacccttctggaccttgatctgggacttccagcctctaggactgtgagaaaatcagcttctgtgatttagccacccaatctatggtattcttttatggaaacctgagcagactaagaccaccctttcccctgtggcaagacattgcctcatgccgtagctctcctcttctctacaatgtagcttacaggccaagccctttcagaattcaaaacttaaactctttgatctgaagtacccagttcttacaagttcaaagtgttttgctgtcagacccttctgtctgaaatgggcttcaggaactgatctgtcatctcctttgtccttggatgcctcactgtgagggccatggagcaacacggtgtcacctgccacaaacgaataatacattggataataattggaaatcatatttggtgacaggagcagatgtgaaattatttagtactatacctgtaaacaattggtacttggcgacttagattttgacattgagtaacagctgtgaatttcagtgtccaaaaaacaaagttgaattacactacaacaatggttgtccgctggttggtggctttgttccctggaggtattgtatccagacactgagggatgtgggtatgtgcggttttaaagattttctgatgagaatttaatgaataggtacatgtaaaaaatggattgtgatggtcattgccttcttgtgttgtgaccatcataaccgcctgctggcagcttccacagatgagacactccaggcatctcttccaggcatgggagcattgcaaatgaacctggtttccatggtgggggcatgctctttagagtgaaagaattgcatggaaaataactcaaatgtacatttaaaaccactctttcagctgggcacagtgtctcacacctgtaatccctgcactttgggaggccaaggcagatggatcacttgaggtcaggagtttgagaccagcctggtcaacatggcaaaacccaacctctactaaaaatacaaaaattagccaggtgtggtggtgcatgcctgtaattccagctacttgggaggctgaggcaggagaatcgcttgaacccaggaggtggaggttgcagtgagcagagatagcaccactgcactccagcctaggtgatagagtgagactccatctcaaacaaaacaaaaacaaaaagaaaccccactctttcctctcttgcacctctaggaaagaatttttttctttttaaaggtaataaaccttaatacttaagttaaacaaggcattttctgtatgttgatgtaactggatagctttgaaaagaagggtgggatcatccctggcctgggtcttggagtctggccaccaaagaaagaggtggcctggcccctctcccagctgtggggctccagggccaaggagcccgaggccccgcgtgtgacacctcgctcttaagatactctaatttatagttaacgccttttaagcaaacaagagggagaaaaagaatctggttcatattatggcaacttgcaatgaagggaagtctggaagttcaaagaaaaaatgtcccaggaaaagcacagcccgttaaaattcattctaagtggtcagaaaggtaattgaaaagaaggctttctcagtgcagtgttggcaggctagtttccctccctttgcaatctcagctctccaaacatctctccctgacactaaggtcattccaaagaggaacaaaattaacaagaattcattactaagacatgctaaattgactgaatcaataaaatccccaaagcccagttgaagagatcaagatgggaggaataaacactctctccttccaaagccagaagcctgtgggacccctgctacagctttgattttcaacatgaatcttctctgatttgactagaggctccctctcccttcctatgcccacctttgtcacccacaaatggctgcatcacctgctgatcacgtggggctggattttctaccatgagaaaattcctgcctggtttctctgggccaaggcatcttttgtggctgtgtgtatttgttggaggtctgcagagcaggagaaatgagggctagaaaagagcagaactttgctttccctccttctgcctgatgtagaagtcttgagccccttgaggctagaaggttttcatacttgatgcagcagcggcaccacaatgatgaaatcagaagggcttagggtgtcaggttgcatggaaggtgatattacagggcttgtcatgtagtcgtgtttactgagaagcctataattttcgctttgactgtatattgatttggaggctttggtagggtgtgtgattggagagtgttctttatctccatcagccacccccttggccttgctgcttcatggataagacaggccactcccttaatgagtagccatcattccatgctccagggcagcttgtctcttgaggtgggtccatatgccattagacccatccccagcattagggattcattccttctacctaaggagttgggctgtaataaaatgctgttctctgtagcatgacaccaggcctagtgtgaaagtgaatttgtggatgtaatccgttccagatgaaccccaatttggctgagaggtagcaggcagaaattagaagcactgaggaggggggtagaaatttgacacaagtagatgctgaaagagaagtgggaggtgtcaaagacaaaattgctctcttcacctctggtggccctagattaaagcaaggagtgcaattttttgtgcttttcccatcaattctgataggtccttttgtttcccttgagcaacagaggccattgatcctgccccgttgaggtcagtttcctctctttctgagcctgtccgaaagtcaggggtcaagctcagccttgtttgacccactgacctttctgagggggccaccttttgtaagcaaagtcaggctttgactaccttaactgggatcccctcttacgaatggcaaagttattttgcggtgtttgctttgggtataaggaaagaacttttctcttcctctcttttcctcttgtggtttacttttggattacttaaataaatagcttgaaaatgtcccgttaagcatccaaagagtgctaatgcagcacaccatgtttatttatatgctttccaccctgtgtactcccttcacctcacagtttaaggcaaagtaatgcatttctttttcctaatttctttcacttctggaaagaatttttgccaggagcaaaaggagctgccttcaaattttggtcagatggtgaagatgcttaaatgatcatctttgttgaaaaagaaaaaaagcattgtttcatgattcatggtgatgatgaaggcactgtgctaagcatattacctgatcatctcaagcaatcatctcaaaacatacttgttaggtgggttttgttaccatccccatttcacagatgggaaaactgaggtacatagcagtttgcctgcagtcttatacttggtgggtggctgagtcaggaatcagacctcagcagtggaacttctgagtctgggagccccaccttgaggctgcactgcttccttttcaacaagcccctattctagaaattgaaagagtgttagggtagaatggggaggcaaaacttctgctgtggattaaaacatgtaaattctctccattttcacctcttttcatagcagcagccaagaaattttcccttcaaaaatccatcttgaggcattcccttctttaacaaaccagtgttatttcagctcaagatgattaaatgagggttctggggaagtacaagagtcccttcaaggaaatatcttagggccatggatggccttccctccagaagctacagtttctaggctgacttgtgaactttgtctcattgagagaactttgtctcattgagagaacttgtgaactttgtctcatgaacatccattaaacaaggataaagtccccagggtatgcagaattctgtccaataaagaagccaagatgtgcgaggcgcagtggctcacacctgcaatcccagcaatttgggaggctgaggcaggcagatcgctctgagctcaggagttcaagaccagcctgggcaacatggtgaaaccctatctccacaaaaaatgtaaaaattagccgggcattggtggcgtgctcctgtagtgccagctttggaaggctaggctggaaaattgcttgagcccaggaagcagaggttgcagtgagctgagatcacgccactgcactccagcctgggtggcagagtgagatctcgcctcaaaaaaaaaaaaaaaaaaaaaaagccaagatggtaatgcaagtgtttccaaccttgcccattctggctggggctaagaaatggattcatcacctgaaatgccgtccagtctccttgctgtggacaacagggtcctttcaaggtctggctccttcccagagctccagcctcccacctaccattcccactcagcacagacaccccagccttgttcttggtcttgccaagcctatgtctgcctcaggggcttgacacttgctggaacacttgaccctggggcctttaccaggctcactcattcacttcttcgatgcttctgttcagagggtcatcttctgaccagcctgtctccaagacttgtccctccaccaccactgtactctaccccctcacactgcctgatttttcccggatccgttattcttacctgaggtcttagcatgtctttggttatatgtttatggcctgtcttcctctccagaatgtgggccccaggagtgaagagtcttagtccatcttcctcaccgttggatttccagcgccatgacaatgcctagcatatatgtggggaatgaacaaatgaagtcaggggatctgtgatattagcagttaccagaatcctttcccagaggattcctgggcttttctagacctgggatacattattaaaagtgaaacaatccggtgaaaatataatcttattataatctatatgcattgcatatttacatttatatgtatatgcattggtttaattctttaatgaccatggattaattgttataattgttgctagtatttctctttcacagataataaaactgaagttcagagaaatttggtgacttgccaaaaatcagatgaacttagaacaaggattttgtgatataaatacacgtggaaatatgattcatacatctattgttacactgtggaaagagcctgggatttggagccaaaggttctattttgtcttagtttgtattttattatatttataacaatattatcaaaggcaacatacttccctttctaaactttagtgtgcttatctctagaattaggataataaatgtaaaaaaacaacagtactgcagtaggactatgataaggtgtataaagtacttggtagagtccagcatacctggtaagaactcaataaatgttcactgacttccaaacacctgtttcctcgcaagtaaaaatactatgcctgcttctgggggttgttattaagctcaaaacaagtaaggtaccaaaagtacttcatgaatgataaagcataaatgttaactgatcatgtaattgtcacacatcaagactctagatagcctaggactttctaaaagggaaataaaggtgaggaaaatattgtattcatccttagatgttattggagaaagcatggaagacatttacgttactgaaagagggccattcttattctgtgagatctctgcaactttaggttatagtctttcacacagaatttttaaaaacaaaaacttatttaccctttaaaaaccttgactctgtgattcattttcagtcgtgcccactgtggatggccagtcacaagttctttactttgctagatgctcagatggaactttctctgcttgactatgttttatttataattaacacttggattgaaaatatttgggaattatattttagggacctgaaaggtatactttacacagctttctcatgaattcctaacttcaccctttgaatcttgagtagtatcagccttttctttttcattttctttttttcttttttttttttttttttgacagagtctccctctgttgctcaggctggagtgcagtggtgcaatcttggctcactgcaacctccacctctcaggttcaagcgattctcttgcctcagcctcctgagtagctgggactacaggcatgtgccaccatgcccaactatctctctctctctgtctctctgtctctctctctctctctgtctctctgtctctctgtctctctctctctctctctctctctgtctctctctctctctctcgtcaacatgctcctgagctggtcacccagcaaaaaggcccagaactgtctctggcatgggttttgctcaccttgcttagtttaaggtagaatgaaatatttcttctgcaagttttcttcaaatagttgtatctcttgcataaagtagaatatttgaagcaggtcttggtatttttcaggctactttttaatttgaaaaatacaaaaagaaacacatacattcccaaagtaaaaatgacccagaaccctcatattaaaatatatacaaacttaggaatgaatatatataaactaaaaagttacatataataactaaccttacttaagaataacatttttattttgtaaaggattggctcattgtgtgctgctttgaactagagagtagagagtgggttaatacgttctagggagatgaggtattaggcagataagctttatacatttaattttttggattgtgttctctcttaaagactatatattcagtctcacacagcccggatctacttctcttatgccacactcaaccataccttttgcagccccaaagttaccagcggtctctacctctgggcctgtctctgattttctacttctggccacactaatgtctatcctataataggtgtcaagacccctttttcatgtttctctggagctgtcccctttttatccacttgatttctgtggcccacgataccagtggtaattctttttcttgagcacattctgaaaagattccctaagggaatggctaagaggttgaaagctaggtcaatgttctgagccgactcactaatagaagaaattaatcacttaccagcattcataaaaatataggtagataagcaaggtggagaagaaatacaagttgcctggttttttttttttttttttttttgaaagcatgccattggtcccagataaccccaggagtagattgaatggtatattaaaaggcacttaagtatcatgcctgtcctccccaaattaatggatcagtgtacattccaccttgaatttattatgcctttgcctgccagtagggctggatggcatgtggacatatttgcacattctagcttggtttatgttacctccagtcctgaactcacatcagaagctgacggtaatgcccttgactctgtgggagctgatttatcctgggccatttaaagtcaacagatacttttagaatctgggttttggcctttctctcgacgggctggtagctgtctcttcagtgaaaatagtaaaagactgccttgggacaattatgaacattacctgtttgcgtacaagatagctacgtttcgtatttaatgccaaggtcactttaccttgctggtgtctggcattgcctaatcattcattgcagtcctggaaagacaaaacttgtatcttctgtatggtttcctgtgtccccggtttatacatattggttcttcttgttggccccctactatttaagcactacagagaaaaactgagttttactcatggtagctctatgttaacccccccatattcattaactattgctgcataacaaattattcccaaaggtagcaataacatttatcatatttattatcaaataataaacatttatcaccccacaaagtttctgtgactctagaattcaggagcagcttaactgggtggttctggcttagggcctcccatgaggttgttgtcaagatgttagttgggtctgcagtcatctgaaggcttaactggggctggaagatttgtttgcaagatgtctcactcatgtgcctagttaattggtactgactgttggtaggaggcctcagatccctgccacatgcacctctatagagctgttcgagtgtcttcacaatatggcactgacttccccaggtgatctaagaaagtgcgaggtagaagccccaatatattttatgacctagtcccagaagtcataccctgtcatctctgcaatcttattggttacaaggtcagtgttattcagtgtgtgagggacttatagaagggcatgaacaccagttgccatctcagagctgggtcagcacaccctcgatggcccttcagcactttcagtctcctctagtagaaaatttccatagtgttatttcaaataaagaagcaaatagatcctgttgggatttatagggtccattagtattaaatatggctaccaaacagtgtcaaaatatatgtagtcctttaaaagcattattcctttccaaacgtacttaatatgatttttgttaagaaacaaaaatacagtccagaaaagtcaatattagagtccacttttgatcataatttccaagtaggattttcttccactatgatgaagacatatgggcactgtcaggtttttttttttttttcttctctagtgtctgcattgagaaaagttaaacaaatagatcaaaactgaacctctttttacaaagttaccattcatttgttgccatcctggagtgcaggccaggttcttttgttagctgctgctttgaaatatgtggccaagattggctggcatgaagctttgtatgttggcgagccaactcccatgagttggaagctccttcagagctgaagaaacaagaccagaagcatcttagaatcatctctcttataaccttacagttggaagaaatctaacaggtcttccaggcctaactttcttttttctttttcatattgtcttttaaaaaatataactcttcactaaacttagttctgatcattttctttttgagacagggtctcactctgtcaccccggctggagtgcagtgatgtgatcatggctgtctgcagccttgaactcccaggctcaagtgatcctcacctcagcctctcaagtagctgagattacaagcaagcaccagcacatctggctaattttttttcttgtagagatgaggtctccttgtgttgcccaggctggtctcaaactcctgggctcaagtgatcctcctgcaccacccaaaatgttgggattgcaggcatgagccaccatgcccagcccaggcctaactctcaatgaatgcagacatacattctgaaacacttaagacatgaaagatgatcatcccacttctactttaatatattcagtgataaaacacatgccaccactacccttgattttcaaacagttctcattttctactggagccaagttgtatctctgcatatcttctgaccattgacccttaatttttattctctctggagtaaaaccaaatgtgaaatttcttcaaatatttgaaaacccatctcatgtgggtctccttagtttcttccaggctaaacattccatgtttgttcagccttctctttaaagtacagtctccaaactaactatcttagtttcaaagtccatctgaaaatgtggtatccattcatttgtgtgacaagtatttgttgaatgttgtctgttggcaaggtactgtgccagtccggatgtcttaacaggacagagttgagtgagattgtttcttccagttgatttggatgttatgtttctattgatatgaccaaagatctcattagcttttttgcagccatgtgaaactattggattatttttagctgtgatcaactaaaattatcagttttgttgaagggaattgttgtcagttgaggatgtcccaatcctatattcatgtcgttggttttttgaacctaaatgaaagacttcacattcacctccatccaattccttctcgctggtccagctcatttttccagcccattgaagtcattctgatatttgctaactcttaatcttgacttcatcatattagttatttctcccagcgttgtgtcatctgcagttttgatgagcattccgtctatctttgtatccaagtcacatatggtaatgaggagtagaacaggacccgtgacagagccatttggcagacccaggtcacctccctgcccccttccagcagctatctttgagaacatgtttcagccaactatcagtcgcccaaattataccgtcatctggtccgcatttctccttcttgtccacaagaatttcctgaaagactttgctaaatgcctgattaatcaatacattctgggtctctgacatttacagttgtcagttctaggaacctgcttcttgctccagaggaagaaaggaaatggggcaagctgggaactgttttgtcctctgctcaattttcctaaccacataactcctgggtcagcctagggaacttctaggttcacaaagatctatctattgaccgacctcttgtcctcaccctttaggaccagggattacctgatttcttacaagtgttattatcctgattagactccaatctcttaactcctcctcagctgtctctctagctatgctgagttcattcaccttcatcttttagcctcatttgtctactctgtaccatccttctaccatcaggatcatgtctttacataattcaaatcaaactattcaattacctgtcatatgttcctgtgcaagatatgtttattccatgcgagtgctttttgatgcaccctgcacaaacccccaaactcccccaatatgaatctataacaggctcttctggttagttctgctttatcttgggaagtccttcaagctcatgtctttccccaccatcctagttgtccagccttctgcattaggacctctgacttagccatttgttttggctccatgccatgcttgtttatcccattttggtttagacagtccactctggctcagtccttttttcccatcaggatgtgacttccatcggaccaatcaccatgggtaggatatacattgcttccctctccaccccagaaccttcatggcagagtgtacccttcacctatcagattagaaaggcggtgggtggccatatagatgagaagactgggttccagttcccaagttgctggtaatccagtactgtgtattgcttgttaatttagagaaggtatactctttttttctccctgactggtaacaatgagtttcagctatcattcttggtgatgccagtgaaaagatgctcaccatcaagggtcacagttcaaggtagccgtgttacccacagtctgtgtcttggtttgcagctcctttaagctatatggagcatacccaattttcttgccctgagtttttcatgggaaagatagggctttggtacttttacctgcaacacactcattgtccctcagtatcatctttctcactcatcatctcacctagacactttcccttctaaagtttaagtacaaaccccctaatcagaaattcctctgccataattttcccagttttgggagatggacactgttttcagagaagtcccagaatccttatgtataagccctccttgggtagccagctaccaacttcccatttgttccacagtcttccaaaactatgaccttccattagagtaagacatgaaaacactaccccctcccccttaagtcctcaattccctacttaggaaaatgaatatatgcacttttaatataagtttatattcccccgtgagtaagtaagaaatgcacattttaaaccttccaaattgagtcaaatttgtcttgtgtatgacctttacctgagttatttttttcttggtgagcgagtgactcaaggtggaactcaacctccccatgcttgcccttaatgctaggaaatcttagcttttagccactgaaattctttagtgaataaacctgtttctactcatttttaaatgtattaatctgttcttgcatttcactttgaagaaaacaaggtttttattaatggaaacaaggtctcccacaggatgttcagtgtgattgactcagtcattacataatagtcataaacaaatgagctccctttgaactcagcagttcaggctcctactgcatcttggctgtgattccgtagtttgacacttatgctgcagttaattagggtggctgtgagaggtagacaggggcagagaaaaggcaggatttaaaagctgttcctgctaccttttgggggtttcaactcctttctacattataaagctaattgatagatttatgctttattttctccctggcctccctccttggcttcagatttaatgagcccaaaggaaagaggatcattatttaaaatctgggtgatgtgcatttaaatttaagatttatatttgtgcagactttttatccctgcaacccaagttacctacatatcaagcaaacctcgtctgttgcattgtcggtattcatctcccctgttgggaaaggtttaatctcatgggttatttcccaaaacctgctttgttgctctctcatttgtaaagcatgcaatatcagctggagagaggaaggcactggaaagaatgctttggtcactttacatcagttttaaagtagtggcaaataagagaatgcctattcagggcatttattggcacttccatggggggtaggtcctgaagtttcctgtggcaggtgagtgaaaggcctgggaagaaggccaaggatgaaattgatgtggagaagaggatctggctgacttttccttgagaattctaagggatatttcttcttccttatcctccttttctccccttctttcacttagacatggggaatagaaagagaaatagaggccgggcgcagtggctcacacctgtaatcccagcactttgggaggctgaggtgggtggatcacgaggtcaggagatcaagaccatcctggctaacatggtgaaaccctgtctctactaaaaatacaaaaaaaaattagctgggcgtggtagctgtagtcccagctactcgggaggctgaggcaggagaatggtgtgaacccaggaggcagagcttgcagtgagctgagattgcaccactgcactccagcctgggagactgaacaagactccatctcaaaaaaaaaaaaaaggaaaatagaggccccaggagaagctgtaacagagaaaaagggtcagacatggttatgctgaagaccacccacctgagccccagcatcccccagctccaggcccgatccagagaggacatgctccaagacatcatgtcctttatctgctggtgccagggcagaaccctcaggagccttccttgagtcttcattcttcctcatccctctagggtttgctccaccttctggatctccctcaaatgctcctcttctttccatcccttggtagaagcctccatcaccttttgcccagattgtggcagtggcttggtaatgaccctccctgcttccagctggcttttctctcatccgatttctgaattggagccagggctgtctttctaggaggcaatgctaatctcaaagtcttctgatgaaacctggaggaactctattcacatcaccccttagtcacacagtcctcccctcatgccccatccagcccctttctagctacactggactgggcctgagccctgttgagtctggggcaaatgcctcaagggcctctggcctcagctaaaaggtagcttccgcaagggagcctccctatccagacctctaatccggtgtcccctgtgaggcattgccctcgcgtttgtaactcacatccccggaagtcttattcaattcaaatggaaaggcctaggagatccaaaccatttcccgtggcttccagggacttccagagcttgctttttctgcctctccacttctacaacctcacgtgctgcctttgtgtctctccccaaatctattttccacaaaagtccacatggcatgagttaacttgtcatgaattgactaactttactaaagattaggatgatcatgagaggtgtggaaggaggaatatctcatccatcctcggttcacggctgagcactccataacaaaagacagattgacaagagaagtgcaaatttatttaatataagttttatgtgacactggagccttcataaggaaatgaatacctgaagaaatgattaaatctgtgtatttttatgccaggtttgatgaagagtggacagtcatggagaaatatgatagagcaaaagagtgcaatctaatggtgataaactgggggaatctcagcaagcaaggcctgtttgttcagattcttttcttgtccctgtgtcttcagagataaggatgcttctcttctctgagtatagggaggtcacctccatatgagggtcatatgacctgcttcaaggaagggtcagaaaatccttcctgggtgtgatgacttgcttcagggaagaagagcaggagaaaggtgatatggtttggctgtgtccccacccaaatctcatctgaagtgtagcttccataattcccatgtgtcatgggagggacctggtggggaggtaattgaatcataggggcgggtctttctcatgctgttcccatgatattgaataagtctcaggagatatgatggtttttttttttttctttttttgagacggagttttgctcttgtcgcccagctgcagtgcagtggcatgatctcggctcactgcaacctccatctcccaggttcaagcaattctcctgcctcagcctcccaagtaactgggattacaggcgcctgtcaccaagcctggctaatttttgtatttttagtggaaacgaggtttcatcatgttggccaggctggtctcgaactgctgacctcaggtgatccacccgcctcagcctcccaaaatgctgggattacaggcatgagccactgcgcccagccaatctgatggttttataaaggggagctcccatgcacacgctctctcttgcctgctgccatgtaagatgtgtcttgcttccccttcgccttccaccatgattgtgaggcctcctcggccatgtgtaactgtgagtcagttaagcctctttcctttataaattacccagtctcgggtaggtctttattagcagcatgagaacagaatcatacaggtctggagaccttcctgcacatgctctctcagatccctttttccttaaaatatttaatatgctcatatgctaaaagtcccatatttttggatagcatgtccaaaacaccaccagaggtgactttaacaagcaattggcaataggtgccttcaagggctcagccctcacttcactcccttgttcctatttcctattaacattagttttagctataagagaaaaataatatgtaaatataataaaacattacttttagctataatagaaaaaataatagcagtgatctaaaggagtttatttctgcctcacgttaggtaagtctgagaataaacagtccagggctgttgtggtctccacattactggaccctcttctgtcttactctttcatgcttagcttctatttttaagattatctcatcatctaaagtgactgctgcagctccagccattacatatacattccagccagcaaaaagggcatatgccctccctttaagaatatcccaaaagttgcacactacttctgctcccatcctatttgccagaacttagtcacatgaccacacctagttacaaagtagactgggaaatgtagtctttattctgggcaggtatttgcgtgtctgaaacctggtggttctcttactgtggaagaaagggagaataaatattggaagacaactagcagactctgtcacacctgtgacaataaacatccatcccttttcttgccttgcttaatttgacatgtgattaggctccctccaggcctcacatttgacctaagatattgtttgggtgttcttctcaaacacctgcagctcacttccaaagagaattctgcttgataaacttttctccatcttctaaaccgtgctaacttcatgtgttgcactgcccaggccctatgtggttgtcatggctttgtcctcagtgggcatcctcagattgcacacaggactggtttccacacacacatcccaagttgtagttgacttaacattacattttcagattttccagctctcagaatgcagctgcaggttcacaagtcagcaacccatggagaacagtgagacagcaatgcgagaatgtccgtggcctagctcccctgcctcacagtcccacggacacttgctgggggctggcttcaaggctgagaagctgccaaccaacttcttctgagagcccccttccggcgaagtgaggcacaggtggtatttatctactaagcagcacccacatgaatacatttagccggatatgtgttcaacttaggctcaacacatctgcatcaaatatatctttggaagactgccctatttcggcaagaaggcaggaatttcagtctggtgatctccctccccatgatctccaccatgctggtctcgctgttgtatcctttcttagtgtctcctgtggcacctgacatatagcaggccttctatcaatattcgtttaacgaatagaaaaatgaacaacatgtgctaaatgatatacaaagaccattgagccaatctagtgggagaacaacatacagttataatagagaggaattcatacaatataaatatgtacagtgtcaaatgagcacagaggagatgtccaagctggattttaacatataaataggagttcactagccatatggaggtagagatgaaggcagaggagccgatttatgcaaaggtgtaaaggcatgaaacaatctcacatgttcaggcaataagtataagaggttccctaccttaagaactttgtagtttataaagtagtttgttttttgtttttgtttttttaaatcttttcattttttttctagaagtgattcataattactactaatttataaggagtcagagctttgctttgggataattatttgcattcaagggttgtggaaaaaacctgatagtttgttggagttctacctattccctacctgagggaaccaataaaattgagaatttttgtttctttcctagaggttgactacttggagccatgtgaatgctgcacagtctcaatataaaggtcttttaaaacccaagtgataaccactgctagaaaataataacagcaattgccagcattgctatggcagagtactgttgtaagcattttatgtctattaattcatttaattttcctaatggtctcattaggaggtactagtattatcaccgtttcataggtgaggaaactgacagagatgtagtgatttgatcaagatcacaaagctaataaatggctgagtgaggattttattattttttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtcttgatctcctgacctcatgatccacccgcctcggcctcccaaagtgctgggattacaggcgtgagccaccgcgcccggcctgagtgaggattttaaactcatatatagtttgaaagttttgcagtatgtttaaagttatcaggctatttctttttgttgttgtttgtttgtttgagcttgtctgctaagcagagacaaaaacaaaaagaacttgctggttttgggataaccccttggccttgatgcctgtcggttcctgcacattcctgtgctgtgggcctcaggactttgctgctctcctcccatccagtcccaggctaccccttctgtgacccatccccactcatgacactcaaccagcttcccttggatgtgagcacatgggccctctgcatgctaaggttcagaattaatcactagggcaagcaggtggaggtgtccaaaaatcagactcatggaggggagggacaggtgacagagtttccagaatgtctgtgcctttacaggaggccctgactctctggggtggtaaatgtgcttaatactttctgtttcatctctcccacacccctcttactcacctaggccagccctgaggtgtcatgctgggtcttaaggatacagtgtgcccctctgaggccctccagccaccacttcctgctgtcctcttttgccttgccctcacccactttatgtcactcagtcagatgtttgtcttttgcaatgtgaaaggcgaagtatgatcaagtgatcaggagcaaggatgcactgctcagacatgcctggctccacttcctggcccagcctcatactagatatgtagcctgaggcaagtccctgacacttttcattcctgtttccttatctatcaagtgggggtcataaaaccttccttactgggtggccgggaggattcaggtaagatcatccatagtgctcaatcaacactggctatgagagacaggctgtgtaggggtttcagagcgtgggatctggagtcagaccatgggtttgaatcccaacttggccacatccaaccatgtgagcttaagtacattggtgtttttgtttttgttctgagagaggatcttgctctgtcacccaggctacagtgcagtggcacaatcatggctcactacagcctcaacctcctgggctcaaacaatccctccaccttagcctcccgagtagctggaaccacaggcatgcaccaccatgcctggctaaatttttaaagctttttgtagagacagggcctccctatgtttcccaggctggtctcaaactcctgggttcaagtgaccctcctgcctcagcctcctaaagtgctggaattacaggcatgagccactgcgcctggcctagtaagttttttatcctcctctgtaaaatggagttaataacagtatctacatgatggggttgttgtcaagatttcatgcttataaacttaagagtcaaatatttaaatgctaactagtatgtattaggccttcaatacatattaaccactactgtttatcattattatcatcaacagttaattcattctagagtaactctactgcctatctgtgaaaggcccatctgagcagggatcctttccaacaagacttggactgtccctgcaagcctttaattgtgctctcactcatattgcccattagaactccccccagttgaagatttctttgctcttcttagagaacagaggcttggcttctctaacgggcagagttccacagcagacaaactagaaaaagtctcctgaggaatttttcttcattccaagatgaatgttccagaaacatcccctctcctgatgcgtcttggaagtcctgctcgctgacctgcatggaaatgggatcttgattttaagagaggttgatttcacaggaggctgacttgtgtgttattctcataaagcacatgtcatcttaattgaaactgtgtgagtggtaaactttgcattgtaaatttagaaaaactcccatgggaaggaaatgtagcctttgaaacactggaggaggcagtgtgagttgttttatgtaactctggcacggagaatacctgatttgtgcaggcagacttgttgcagatgctgttaatggtgagatctgttttgaatagtgcattttcaggtgcttttaaaaaaaattcttaatgttaccaagtctttttgactgtattactgtatttggcttttttttttttttttttgagacaaagtctcactctgtggcccaggctggagtacaatggtgtgatcctggctcaccgcaacctctgccttgcaggcgcaagcaaatcctcctgcctcagcctcccaagtggctggggctacaggcacacactaccacacctggctaatttttacattttttgtagagatagggttttgttatgttgcccagcctggtctccaactcctgggctcaaacaatccacccgcctcagccctctaaagtgctgggattacaggtgtgagccaccgtgcctggcccagctttgagaatcataaactgtttttaggtcattcaatattattttaaaagctatagccttttctccaggccataccccagctggaaccctgagcacggaattacttggagttgtcgctgtttctgagccttcaaatctaccaggcaacctattggtaaatgactgttcaccatagtaatggtaacagcctgaacactaatgcctaacatgctcatatcattgtaaggaatgtagtctaccactggtgcccccaatcctatacagagaaaagagtcagggaacattcccttcccattgccactgctcctatgggatggggctggggtatcaaggaccctgacccctgttttggggtgctgttgaaaaaagggacattgaagcttggagtagtttgaatggagctagcaaagtccccatgcatgctgtgcgatgcatacagatgtgcaggccaccatcagtggaaggttctcaccagtggaagtgaccagcatagtcagtatcacctgggcacattcttacttaccagcccaggtcctaccttaggccaattaaattggaatttagggcagggcctatatggtggttttcaaagcatcccgggatctcactgtgctggacactgctgggcagtctcttgatactgactcctcatgtggatcgcaggtcaggtatacctggaaccctatgacctcatccatggtcaggccttatccattcagggaatcccagtgtcctagtctgctccccagaggcagaggcagtcactgttcatagcctcttgtgcctttacagggacattctgcattatttgcacacaaatgggaacattacagcacatattgtttggcatcttgctattttattttatttttttttttgagatggagtctcactctgtcacccaggctgaagtgcagtggcgtgatctcggctcactgcaacctctgccgcctgggttcaagcgattcccctgcctcagcctccctagtagctgggattacaggcgcctgcccctgtgcctggctaatttttgtagtttttttagtagaggcggagtttcaccatcttggccaggctggtcttgaactcctgacctcatgatccacccaccgtggcctcccaaagtgctgggattacaggcttaagccaccgcgcctggccttctactttatttttgcttgcaagtacagagttctccatggtttcatgcaaccagtccaccgttgtaccagctgttttcttctcacttctccagatctgtcagccatcctttcatcctatgctctctgtctgcagaaggctgctgtatgtgaattgcatcatcaaatctttcctcctagattccctctgggttcagccccacatgagacaggaggagggaggagagtgaggttggggtatttattcccttggctctctccttgcaaggacatcttaggttgctttctctacttgaccatctccttctggattctagcaatctctctcttcccttgactcactgggcctggagtatcccctccattctctctagttctggcttacttcactatgcagatgattttcaaagtgcggttgcaggaccagcaaaatcagtatcacctgggaacttgttaggaatggacatttccaggcccaccccagaccgactactgattcagacaccctgagggtagagtccagcagtctgtggtttaccaagtcctccagatgattctgatgcaaactcaagtttgagactccctgcattatgccttcctcttatgccctaacctataactttactaataatccctttacgaagccagcctcagatagtcgttaagttgaatgtgccatctgtctcctcttgaaagcctgtctcatgaacctttgtttatagatctctgcacatatgtgtgagtttattagaggaataaattcctttaaatagcatttttgtggaaaaggaacatgcatttcaaattttcatagatattgccaaattgttccccattttgttgtcccaattttctatttataaaaatggcttgtggttgtttaacatacctcttcaatgactattgattcaccagacagtggtggtgtattagggtcatccttctcagatttggtggcgtaaatctggggatcttgttaaaatgcagatcctgatttaggaggtctgggatagagcctgagagtctgcatttttaacaggttctcaggtaattctgctgctgctggtccaaggaccacactctaagtagcaggtgttagggagtaagcataaagaaatggcggccaggcgtggtggctcatgcctttagtcttagtgctttgggagcttgaggcgggaagtttgtctgaggccaggagttcgagaccagcctgggcaacataatgagactctgtctctacaaaatcgttttttaaaaattagctgggcatagtggtgtgcacctctagtcctagccacttggaaagctgaggcaagaggattgcttgagcccagaagttcaaggttttagtaagctaggatcatgccactgcaactctagcctgggtgacaaagtgagaccctgtctattaaaaaaaaaattctttattttttaaaagaagtggctaagagatgggctttgggctcatatccccactcagccattcactaactgtgtctttaggcaagtttattaatcttctcgagcctcaccttctttgtctacaaaatggggattaaatcatagtgttttgtgatgaccaaataaagtaacataggtatgtaaagtatttagcaaagggcctgatccatcatggtcattccaagaagtatagctgggataattgtttgccccatctcctatctattccaatggttattttctccaccggctgtatattccttttttttgaggcagagtctcgtgctatcacccaggctgaggtgcagtggcacaatcttggctcactgcagcctccgcctcccaggttcaagcgattctcctgcctcagcctccagagtagttgggattactagtagcgggaggcacctgctaccatgcttggctaatttttgtatttttagtagagacagggtttcaccatgttggccaggctggtctcgaactcgtgacctcaagtgatccacccacctcggcctcccaaagtgctgggattacaggtgtgagccaccatgcctggccaaccccttgtatatccctgatactcagctgcccttagctcccttcagacaatttccagtgttccagattggcagctgctgtagaatgtcctgtttgtcttcaaggcaacaaggcaacctctaggtccaaatctatagctaaagctaatactattttcttttagcacctcaagaagagagctcacagcggaatcattaccaaactctctgctgagcagttgttcaagaaacagtgcagcccaggtctctctccccatctctacccagcatcagcatccctcagactcttcaagaaacttttggaacgtttacttttggaaaagtgagccttcaggagccccagctgcctcatcagttatctgggccgacataggtttccaatccttttctatagggtgagcatgagtgaacgcgcactggcatcctcccatcctggggcagggagaacttctcatttcctcccagcaatgtgcaaactcaggtttcatgcttaggcaaattaagtcccccaaatagcactgttcaccaaggtaaacatacagataatttgcagtacagttcctgatttacaaaagaacatttcagaaaccagagctacaacatcaaggcattgaaacgaggcaaaagctccacacgccctccttcagacgtgcacggagccagccagggccaaatgtgtgagggtgtgacgccactggttcctatcagacggggtcttcttctgtttaatgtgaaatcaaatgagaacataaacagactgctagtaaagctccgagcatatgtgtgcaaaaccgtgtttagaatggttcgaagttgcccagaggagtccagaggtagaggaagtggatgtgctgccccgcaggccctgggtattgaattcattttccccaccctgaagacagctcttgtgcctggaagatgaaaggacgggcggacagcaagagacatttgaaagttactggagtgggattaggagtatggaggccacattgggagcattatgctgcatgttatggaaaaagaaataaaagctgctgcttccttttcttcttgagcaactcttctatctgtaggtcctcagcccctcctgttctcacctccttagctgggtcagctcttctcccattgtttcagcctccaccttcatgctgaccattctccagtcttcaccaccagtgcagcccagatcttcctcccgtctcctgccctgcatcagcatccctcacaccgtcactttattcaccctcttcaccatgctgaacctgcttctccttctgtgattcccacacccaagtaaatcttcacttgaatacagggttctgcagcttaaaaaatcataacaaactatctcactgcttgctttcaaatctggcacgatgtagcagagctgtgtgcccaaatccaacaattctggtccccaaggatggggaggtggtgtgctcaagccccaaggcttggaggctgctgcaagaagcagacctgtgcaactgcttgctgccttggcacaatgttttccttaaagatgttgctcattacattccataacagcatcttaatgagaacctatgggagaaatttcccctggggtcggctgcgtaggattagatattttcatcctgagcaagtgaggccgttttggttctgtgaatgccatgtcatattatagcttacatcagaaagcccagacctgcctctaggaagtatataagcaggtataaaaatagatgttgtatgctaactccattcctgactttcttgtgtcttcgtctacttattttaatttattttatttggtattattacatatatttatgtaaatcttctttaaagtaggacataacttatgcagaattatatcccctattctcatattttagtaaataaacacatgcatacagtatctgtgaggatctatttattaagcagaaaaatgcaactttttatagacaacccgatttggtggactccacccaaaagatgaacaaaatcaaagtcacaacagcacctgtagtaacctgttataaaatagtgcagcattgtgaagagagatttagaccttgaatgtcagtaggaggcaagtagaaagaatttcaatggtaggtagcagccaaaattcagatcacttctatgtggcctaaaacacagttatgccaagagtaattatgggatgtgcaataataaaatattggggactgtatttctgataaagggaagactctggcaaccaaatgaggggaccacaaaggacgagaatcatatgagccttttccagacactgggcaaagtgttctgagaggttattcctcttgggcttccctaatgggccattagaaaagggactgtttgctggttaacagagatgaaagtttctgtcatttttctgcaagtgaacaggtctttaatatttcctgaaaccacaggtctgctttgtatcctttaactgaaacaactataatccttaacaccagagagctgtgggcccccagtagtgcagtggcagtcgaggggaacagaaacacctgcaggaaaattaggcagagtgtattttttttttttttttttttggcaagccatgtctgggatctgtaaatgctgatcacttgttcactggtggcttttctttactttctttcttctgccttttttttttttttttttttttgtcaggtgttttcaatgactcccctacctgagtaaggtactagatggacatattttgcaccgattcccattaggcttaaataacattctccatctccatttgttcatgttatttgtcatgttcacaacttctgtttctgatgccaagccttagttcttttaattgggtaacctttctctttctctgacactagtgaaattacttttactagagtctgcagtttcctaatcattgcttctggatttggggttttatggaaggatcaaggacaaatgaagagtgagaggcaggaaagaaggttaactttagttttgggaaactgagcactaattcacagatatgcatctcggagtctgaaacagagacttttcattagtcgatggaataaacagacaaatttggggaagaaacaggctgggctgttttttatatgttgatggggatttggtttaaattttgaagcatacttcagcttttagttgccagattttaaaagtacgtacccttcactctttaggagaaggtttgaaaaaaaactgtgtttcctgttgaaggccagtgatacctggcagcttacagttagaaaactctataactttattattttcatttgcacttaaaactgctatgagttttttaatgcaaaaaatagtgattgagaaagaaaaaagtgaacatatttatattcttccccctcagagagaaacactgttaacattttgtgtatttcggtccaggttcttttctgtgtgtgtaagcacacatatgtgtttatattgtataaaataagagattcatgctggacatacattgtttgtaacttccttcctttccttcctttctttctttcctgagctagggtctcgctctgtcacccaggctagagtgcagtggtgggatctcagctcactgcaacctccgctgcctgggctcaagcgatcctcccacccaagcctcccaagtagctgggaccacaggcacatgccaggatgcctggctaatttttgttattttttgtagagacaaagtcttactatgttgcccacgttggtctcgaactcctgagctcaagcgatctactcaccttggcctcccaaagtgctgggattacaggcatgtgccaccatgccccgccactttttttgttaatgttttagacatatcccatgtatatataaatatagatcattgtcattaataataatgacggtttaatactatgtgatgtgttgcaatttattaaattccctattttttgaaatttaagttgtatatctgttaactcttgccataatattgctgcgtaacaactacaaaaataaggcagatagaaataagcacttccttcttgctcgtgagttttcagcatggctgaggtggtattggtacataatgaggtggagcgggctctgctccctgagcctcttacacccttcctgggatcttctcatcgcgttgccagctagagttgacaaaagtgcaggagtgcaaagcccaatcacataaatgtttttcaagccttgcattgcatcttagtcacaaatattccattggccaaagtaagtcacgtggcccagcctaaagtcagggggcagggagtgcactggacctgtgaagaggagcgcagtggatagtaaaatattttcaaacactcatcaactctaccatagtctatcttcatttttcattgtaaacacatccatgaacaccccatgcatgcagtttacatacctgattgactttttttatagattcatagaactgaaatttggtccaatgtcaaatagtatacaaagttttaatttttatgcctgtgaccagaccacccttgttagacttgtttaaaaacagagcagtttgttagattgttttggggtagggaaaaaggaggatgctcactaagccaacaacaaacaaataaaaacctgcatttgattggaagaaaaaaagctctaaaaagtgaaaaattctcacattaaatgtaacatttagactctgtgataaaagaagcctcgattagttctcaaagatccaggataaggtaatctgatgtttttggaatactatattattaggcttctatggaaagtactaatagctacttctttgtttctaagtatgcttataaaatcagagtcattccttcatatatatttatgtatataaaactttgagaatttctgggatgatgaagtttttaaaaatagacataaaagtttgaaaatacaagtagattgatgctttcactgaaccacaaggatttttctaagtagctaagtccttcactgaattccagcaggcagtggtagtggagaagtaatttcttagatacacgtagcccagatggagaagagaagaccttctttctcaactctcatttttctcttccttttagccagtccttcctttttgcccctcttcatgctctagcctctttccccttttcatttgttcattaagcctgtaattacctaaaaagaaataagaaaaagaaggacaagatgtgtacgtatatgctcatagttggatagaacaaccatttcattatttctattggctagagtattattttctcaccttattaagtgatcaatccttctgtagacatttatgagaacaccatggtttctgataaatacatgttttgagtgaattccctctaagtaaatattgaaaaggcagggattctttatgtgtttccagtcattgcttgaaaactcagccttttggctttaaacaccagaataattgctcagagccataagtgcccttcccaaagtccagcaacaacatgtggagccaacttagaaaacatggggtaaaaaaataatccctgctccttctggccatagtctgatcagtgtgtttggtttcaagtaacagtaacaacttatagcagcttaaaccaagagggatttactttcctatcataacaagaagtctgaaggtagacagtaactacagttgattcagtggcttaacactggtatcatctctactgattctcccatggtctcaagagggctcctgtggctccagccatcatatttgagttcaaggcagacagaaagatggaaaggactgtactgtaactttttttttttttgagacggagtcttgctctgttgcccaggctggagtgcagtggcacgatctcggctcactgcaagctccgcctcctgggttcacgccattctcctgcctcagcctcccgagtagctgggactacaggcacctgccaccacacccagctaattttttgtatttttagtagagatggtgtttcactgtgttagccaggatggtcttgatatcctgacctcgtgatctgcctgcctcggcctcccaaagtgctgggattataggcatgagccaccgtgcccagccaacttttttttttgagagggagttttgctcttattgcccaggctggagtacagtgactcgatcttggctcactgcaacctccacctcccaagttcaagcgattctcttgcctcagcctcccaagtagctgagactacaggtggccgcctccacacacggctaatattttgtggttttagtagagatggggtttcaccatgttggccaggctggtctcaaactcctgtcctcaggtgatccacccacctcggcctcccagagtgctgggattacaggcatgagccaccacgcctggcctgtactgtaacttttaataggaaagcaaacctttctcataactgccaccctcccccacagcagagttcaacttatatctcattggccagaaccattgccatgcccatcccagctatgaaggagactaggaaagtgagtatttttttaaagacaaaaaaaataaggaggttgagaataggtattaagattgctaataaacagtatcttttacagtaaggaatacaaaatattaaagagctatctttaatatttaataaaagcaccatccagggacatagagaaacatgaaagagagaagatgcataggccaagttgggctgactacaggctcgagtccctcagactgattacgcagtcacagtctccaatacctcaattcttcttgagtaccttcataaactcccctcaatcttcatacgtgtgaatatatgtaaatgtgtggcttgcatcttatttgaattttaatctatgttggtttcataataggtcaaagattataagtttctcctatcaaggcttgtttggtttttgtttggacattttatttcagggagaatgatgttctaaaacttgatcaagtggagtgagaggtggcgctgtctcatgagaagagcatttgactggttggcaatttacttaggaaagtaacttgaacttccacagccttcgttctttttttaatttattatttattattttattttatttttacattttaagttctggggtacatatgcaggatgtgcaggtttgttacataggtaaatgtgtgccgtggtggtggtttgctgcacctgtcaacccatcacctaggtattaagcccagcatgcattagccatttatcctgatgctctccccgaccccaccctcccccgacagaccccagtgtgtgttgttcccctccctctgcccatgtgttctcattgttcagctcccacttgtaagtgagaacatgcggtgtttggttttctgttcctgcattagtttgctgaagataatggcctccagctccatgtgtgtccctgtaaaggacacgatctcgttcctttttatgtagccttgattcttcctctagggaagggagacaccattcattctgcctatttcacagggtgtgaacaagtgagaaaatactctataaagaggaaacggcctttcaaatatatctcagaatggtatatatttcacattggacccattaactagcttctctgtgaacctagactttctcaggatttgaaactcagatggagatactgccgtctggaacggaaacttttggaatatttttctatgaaattcctgatgctctgaccatcgggaaacttccctctgctgattttactgactccaccagcatagttgactcatgaggaacctccagagagaatggttctacttttctaaattagcttttagaagggcccacatgctgctgttttcatgagtaagatctgaagaagaaactggccctgggtctcttcttacattgttttttcgattagataggtgctattattattccaaacttaaatttgaagaaaccaaggttcagaaagattttgtgttttacacagaagcctggcttttaaaccaaacctgtcctgtcctgaggcagagctcgaatcagctgtcaaaggtagcgttatcaacctaagctcctcttcttcctcatcatcctttcagcatacctgtgatctcatacagccctctttaaaaggaggtttgaacttgggaaggttcaaagtcgggggctgaactctgaaaagtcaaaattctttgaggttgttagaactgtgagtttattaacccccatttgcaggtgtggaaacagaggaaactcagagacgtgaagtgacctgtccgtggccatctggagtttgtgatgaagtgaacccttgtgatggagtacgacctggggccaaagtttcccctccaaatcatttagaggcattgggacttaaaagaggtcaaggacttctgacctaataaaaaatgcattctggttgagtttgcttaagacgtcccatcatctcagaggcagacatctggtccagtcctctcttctacccctgactattgctgaccagctaggtgatctacaaacatttaaaccattttgtgtcttcaaatacgttgtttctccgccctttccccagctcctctagaggctagtgtttccagatttggaagaaagagggctgggctgactaagggtgtttaatcagtaaccactaccgccactcctgctatcctcattaatgctgatggctttttctaggccccactggctccacatctgtatatgtatttctgttctgccattattcgtctgacctggtcatctgcatggtatggagccttagatgagggaccttaagaaatgagttctaggccaagctctgcccctagtggccatctccctctccacctctgggcctcagatctccatccctaggctgagaaggttgaactagaaaccccctaaagaatttttctgtgatttattttcctttctgggtagaattacagttcaccatcattgactatttttggctcagaattattgtggttcagtggtagaagaggaacttattacaaattcaactttgaaatgttttgagatcattaagagaaaactgagctaaccattgcctccagagcatttgatgttaccagccttgctgggcagaaggaggcctaaggaaaatggaaattggagacagaagtgcctggagattctagactctttctcttgccctctacagaccacttgtccagggcccacagctcttaagaaaaaaaaaaagagagagaataaaactgtttcctacattatttaacagtacctctcattgaatgacaaatatttactggtaaatattttagtgttattcctataaaattagtggccgtgtatatcaacagtgcatagctttctttttgtggtcatacttagttattactacagcccagtgacaagtttgtttttcaagctgtggaaataattagaacgtcaaataccacttcatgattaaaaactttctaaccaggaatagctccccctttgcagtaattacttgtggcaaatatccttttttagaaaataaatgctgaacaaattgaagtcagatcattttttcctctcctgctaaaataattgcatgagtaagaggtgatttcagtttagggacatgtggagttttatatattgcaggatataacattcagtcttgagcacccttacacaccctcccctctatctcaaaatatctctttctcggagtcagagttgaagtggtatccatcttccttcaaaatcaaaccttcctcgatcctcttctgcctcattggagatattaagtcctgaatttttttccttaacagctgtagtttctccccctttgctagtttgggattccacttccagttccacttgtgggaccttgggaaagtgaaattttccgaggcccagctaaaaagtgggaatgatgattttaccccacagggtacttgttatgtgaattaaatgagaaagttacattttaggatactccctggtatataatcagctatccgtaaatgcccattctctcacttacgtgtggcataagtggcatacatggcttaccattttggttatgcatgcagttatcgctcacatcttactgaaactttcattggaactagttgtctacctccctaatgccaagtttcttttctgtttttttttttttttttttttttttatttcccactcctctgtccacctctatatacattttagaaatagttttaaaagcttccttcagattggccccttatctgcagctcccgggtgtgaatttctttgttgtgaatgctggctcatggtgaggtaattctcccacgctttgcaattttggagtgtgagctagtgcagcagggtccttttcctggagctaaccccctggctcaagaggagtacctatgagaatattttgaatttgccttttcggggtcctgcaaaaccaggatttatgttaactaagcttttgaagacaccacctattgagtatctgcccaccagttcagaaagcttttagctttattctgagaaaatctctcagatgtagctccctttcagccagggaagtagttgaccacagtctcagttgtgaactttattaaaactgcattaaaatcctagccttgcagggcttattgggttctcacaccactgtaagacattcagctgtatgccagtgcaacatgcttctgaccttgcatttcctcgtcatttctgacaccttgggatttccctttcttattctgaatttagcgatgtgggatttgtgtacatgtgtattctatccaacttatctctctgtttggagatggaaggtgggatttttgcatcagttcccactgttgtaagcaggcaagaaattgtgttgttttccttaagcactggaatgaatggcttttgctaacagctgcagactagttttcagctccattactctgtggaaactgttttctggaaagtcaacagtgaccacttccttgctaaatccaattgccttttctaagtctcgggatatataaaagattttatgagcatcttgatagctgtaacctgcaagaaactgtcaaccagtgtataagggccaaagcaacatggtatagaaaaaaatcttctttgacttatgtttgcagttccccttatggccagcttagaatctttcatgtagatatttgtctagctccaaagtaagatcatgttaaatggtatataattcaagaatgttgttcaaatgtttgttgaggaccttcagaaatatttttaaatttttctaagtgactttaacattttaaaaattgacttatattttatctttttaaaatgctattgtaaatagaatcttttcttccaatatatcttgaatctggttattgtttataaatatgaaagttattggcttctctataattttatatactttatcttcataaattcttttttatttctgtggttttaatttttttcctctttgggtgtttgatgtatgtaaccatatcacctgcaagtaatgataattttattcctcctcatcaaattttttacacatactttcttttttcttattcagttatgtaggctgctgcttctagcacaaaagtaagagtgaaatccttgtcctgctcctgagtttactgaagatgcttcttgtatttctctcttcagcaggatgcaagctcttgggcagcggtagatttattgttatcatatgaagggaacattctaatatatttgaatatttctaacaagaatagatgttgaattatgctttttcttcttaaacttatttatatggtgaattatattaatatatctcctaatattaaactgtatctctggcatacatgccacctgattaggatgcatcgttcttctaatgtcctgaattctgttttagtaagttatttagaatttttgcataagaattcataagacggtttcatttttgaaatctttgttgcatgatgttattgctcacgtcagaaaacttagacgtttccattctatcctgtgctctagaatagtttaaataagtttgagatttcctgttctgtaaagtttggtggaaatcttaatctcatacttcttagaagatgaggctctttagcaactttcttcttttttttccttccatggagattagcctgtttagattttctctttcttctggagtcagtttaagtaaattgtattttttttcaaaaattgtccattcttttaggtttttaaatgtatttgtcttgagtttagctaaatagtcttttatgattcttttcatttacttaggttttgtagttatttcctcataacatttcttagtttgtgtatttactattccccgcccctttcccgattaagttagctagcagattatgtattttgcccctgcaaaagcttttagttctgtttattctactattagcgagttattccagctcaccaatatctgatgttatttttattaattccttatgcttctcttcagtttatttcttttctcttttctaccttcaaatacccaaatttgctgtcatctgagatttgcagttaagtgtgttcagagggtcccgccagtccctttgccatagcttctcccatcacctttctgttggctgaggtacgtcttctagaaatttccccagaaaagctcataggaacaatattctcagagttcctgaatattaaaaattattctcctgtgaagaagtatgactatgtagccaaaaaatagggaaagaaaatatgatagaggtgtggagtgttacagaattgggtcaataagttagttgcagctagttgttagaatcatattctttttctggattttggtggtgggtgtaaaatatatcatgcattaccatttctttgctcattttaagtaagtgctctcattgtagctaattttgtatttaaaatgtatttaaaatgttgtcttattcatctttaaaaggttcttaccccccaaattgcataaatctcaggccgacaacccccaggagctatccccagctgctgcccagctcaccatcttctgtggggactcctctgcaggcgatggatatgccttagtccctcagaggtgcccctcacactccagaagtgcattatttttagggctttatgaaatctgctgcctctagactctcccctactccgcttctccacatttcctcctctatacctctggagaaaatttgttttcattttgtaacccttaaaaaaaatttgatgtttgtctcctggttttgccagaaatagaagatggtgggttttttcttttgttctcatttttgggttatttccacatgaaagacgggagaatgctgacttatgcaataattttcacatcagaagtccgctgctgtcattttaaacatttttttttttctattttgaaaataaaacacatacccattatagaaaatttggatcctgagaagtattaaaaaagaaaattaaaaccaccatcactgttaaaatctttgtgtatttctttctaatcttttttccatgcttacatattttctttcctttgaaagattgagatcactctaaacctacagttttgtgtcctgatttttttttccacatgagcattttcccatttcactaaaaaagttgtaatgtttacataaaatattttaccatttccatattgctaggcattcaggtgattctacttttaaaaattataggccaggtgtggtggctcacacctctaatcccagcactttggaggccgaggcaggtggatcacctgaggtcaggagttcgagaccagtctggccaacacagtgaagtctcatctctactaaaaatacaaaaattaggccgggcgtggtggctcacacctgtaatcccagcactttgggacgccaaggcaggcagatcacaaggtcaggagatcgagaccatcctggctaacacggtgaaaccccgtctctactaaaaatacgaaaaattagccaggcctggtggcgggtgcctgtagtcccacctactcgggaggctgaggcaggagaatggcgtgaacccaggaggcagagcttgcagtgagctgagatcgcgccactgcactccagcctgggtgacagagcaagactccgtctcaaaaaaaaaaaaaaaaaaaaacattagccaggcatggtggtgcatgcctgtaatcccagctacttgggaggctgagacagaattgcttgaacccaggaggcggatgttgcagtgagccaaggtcgcaccactgcactccagcctgggtaacagagcaggactctgtctcaaaaaaataaattaattaattataagttgtactatacaggttggcaaactacggtcaatgggccaaatccagtctactgctacctgtttcggaaataaagttttattagaatataaccgtgcccatttgtttctgtattgtctttggttccttgctacaatggcagagttgaataatggcaatagatgccaggtggcctgccaagcctgaaatatatattacctggccccttaatagaaagggtttccaaactctgttgtactaacacaacataaaagtgaacatgtttgcatgttcatttttgtgtgcatgtatggtattttctcaatataaagcccaagaaatggaattactttggtcaaagggatgtaaacatctttatggcacttgtcaagttgtccaccagaaaagctgattgactgttccactactaaaatgtgaaaacatgcccttttcctccacacccttgacaacactgggtatgatcatatttttaatgttttaaatttggaaagttaaagaagggtatctgctatggtttgagtgttgatcccttttgaatctcatgttgaaatgtttttccccgttgttacagtatttagagggtgggatatccaactacggtatttgagaggtggtacctctgggagataattaggattagctcaggtcatgagggtggggcattaatggttttataagagagagacctaagctagcacgctcagccccctcaccacatgataccttgcactgccttggaacttggcagagagtctgcatcagcaggaaggcccttgccagatgtagctcctcaactttggacttcccagcctctagagctgtaagaaataaatttatggcccagcatggtggctcacgcctgtaatcccaacactttagggggcccattgggagaattaattgaacccaggagtttgaggccagcctaggcaaatagggagactccatctgaaaaaaaaaattgttttttaattagccaggtattgtacacctgtggttccagctacttgggaggctgaggtgggaggattgcttaggcctgggaggttgagacttcagtgagctgtgattgtgccactgcattccagcctggttgacagagtgaggccccgtctcaaaaaagaaaaaaaagaaaagaaataaatttattttatttataaactacccagcctcagatattctgatatagcagtacaaatggactaagacagtatcttatttttgcttgcctgcctttgatgacaagtcaggtggaatatttcttcttcattatcacttttatttcctgtttgaaatgcctgttcatgtcatttgcatgtttttctgtgggcatgttagctgttttctcggtggtctgtgagatgtatttatatattatggatgttttacacttgatgttttgacattttcttttctcaaaacaacagcatacatgtagtccatagtggatgggacaccattagtctaaggtagtatggctgttcctcgtcttaggttttgtttattttatttattttattttttattttcgagatggagtcttgctctgtcacccaggctggagtacagtggcacagtctcagctcactgcaacttttgccttctgggttcaagtgattctcctgtctcagcctcccaagcagctgggaccacaggtgcgcaccaccatgcccatctatttttgttgttgttgttgttgtttttgtatttttaatagagggggggagtttcaccaagttggccagcctggtcttgaacccctaacctcaagtgatccacccacctcggcctcccaaagtgctgggattacttaggttttgttttgaagggaagccccatgaagcatatttgtaagagaaagcaaaaccgctgaggacctggcttcaccaactccatgagcctgaaagaaggaagcttctagaaaagaaacatggcagtaaaggaagcctctttccctttgtgtcccaggtccagagttagcccagggtctttttcaaagtgcagaagctccctattgtttctaaagaagcccctaaatcaattccatgctcatggaacctagtagcaggaatcgatttgcttgtggtgagaattattactgaagcatgccacatttaaaccctttgccctccatgaaatgtctttttttttttttagaaccatataatgaactgttgaaaaagggttaatcactgtaatgaggaaagtagcccctcaaaaaaccactctacccatcaaactttccaaataaaatttgtgaattcaggtaggtttcttggcttagaggagtcgacaagaagatacttcagagccatatggttgttctccaaaataaataaacctgcttgagatatccagagtaaaaatggtttgggaagactttagtaaggttggtataaaagcatgaatgctaagccagcttgcccctcgtcagatttcatgggctctggggtaatgtgagaatggcggatttttttgtgacagagctggagaagttaacactgaattgtgagaccacctgcggcgtcttctgagctttggctgccaagccagtgctctgtctaactctcactcttatatttctttgatttttaaaaataatttttatcctttcctctgagtttggacaggagccatctcaaacttaatgataacctctatttatgtagcaccccacaggtacaaagagctcctttcatgtgatctttatcatctgtgtggaaaatgtagctattatccccatttgatagctgaataaactgaggctccgggaagcttaatgtgttgctgtgggccatatgactagtctatatcaacattagtgtttgaatgtggggcgttagctttactctgagacctccatagacctcagtgtgaacacttcacactcactgtgaagagtgtgattagattgccccagaattgctggcatgaactttctctgtctttaggacagctctgtcatccagaggacaaaggtttattgggctcacactatttcttgccactccgctagacacttcatacccggtctgtcaaatcagccacggctgccttccttgtgagggaagggctattgccatcatcatagctggggcaagaagggctcagagtggtcaccttgcccaaaagcacagcacagctaatcagaggttgcgctgcatgtgaaccctgtcctgggtggccccaggactggcctttagagcactaatgagcgcatggttgtccctagcagccttggctctgaccttcctagtttacagcgtcgctttcaggtggcacctgtggatgggacacccaggtataatctaactttaatttgattgaagattgtgagggccaatttttcaaggaaattaggcataccaacaaggagagtcttttcaatttacacctgaacctttgtaagtgaaaaaatttaggaagaactatttttccatttgcacttattgtttgtatttgcaaactgagcatctgcggggaggaacattatttggttaaattataataaaataggtgaatactaactttttttaaaaaaaggacggagctcatctctgtccccatcttttcttttctaaccccccttccaagttgggaaaccttgtgctctaaatgtctcagtgatcccaagtcattgtcagcctctgtgtctcaacaaaagcaagcacaaaatgtaagtagctccccaataggacactggcttttaattaaatacttttaaaagctttcaagcaactgaagtctgtattatatacaatgtttcctatttacttttccatactctgaccccccacccccaccgccaccacacgatggaccccaagagaaataccttctggattcttgcccattagtgaatttgatatttttcttttaagttctgtttcagatcaggaagaagggtggctttataaaccattaccaaatcaaagccccatcagaggaggacagaagcctccatacattgggatgaattattttcggctcttgattttatgccagtgctagtgaaatttcacagctggttattaaaagatcccagggtcagggttatgtgctatttatgtcacaagaagcaggagaaataaaataccctaaagatatgaaaacattttgtaaatcgacatatttttggcatctgtttctctttcagggcctaagaagtgatttaggtgctctgatgaggtgctggtaggaaaggtctccactgactcccagcttaatggtccacgcacctcccaaagtattgatacagctgacctggctcaggcccagtgacgggtgagaggagggaggctgaggaaatgtgggcaatttattgcttttcagaaagcggggagaagagatggtgccagtgacctaagtcacagtttcctcgaaaggtagaaattgctaacaattcaagttgacaactgccaatagcaacccaaccccgtttttctcaccataaatttgaattgttgggttacttttgagaatgttgaaatggagctctcctctcctactgcttggagcagttccaaccctgccctcaaatgtaaagacccaggcaccaaagtccctttaaccagagaagaaagcccgcaagtagacagtggcccctctcagagcagagtctgccccaggaaaggaatggactttgagcatcttattgtgattaactgattgtccccaatattcattccctccctctcatcacttcaccctgccaataccactctaaactgaaataggatactaaaagtatagtttctctttgttagaaacatgacacgggaaagaatggaacattcttccctgtgctcgggacatccaataccagacaagtcaaataggacctgctcaaattctgctgggtcatgacagctgtagactgtagacactgtaaaggattaaaatgagtgtcaatattattatctttgtaacatagaagaatttggacttagaaacctcccatgtgggctgtagaggagaaagtctaaaaacgcttaatcccaggtaaaaactgttttacaaacacatgcccctgtccccagaaactctcccaagcaccctgtccttttgtttttagtaactccatgaggcttcacctcaggaaaagaccatgcgtctcatttaagcccatggtagagtcactagagggactggttacaacttcaggctttggcagcgttcaggacagggccttcccctgcttacattctggaggggcagtcacagttcatgccaatctcttgcctacacagtaaaccaccagcataggcactcatctgcctggtagcagaagcttctcccatagaggaagggatagatttagctaaataccatcctttggtttcttaagttacagatcagtttggaacgtcgcttgttctaggtgaatctgagatgttctttgagctgaactgagataatttaaggatatgtaattgtacctgtcacttacctgaactacagcttttgcatgctaatgtttcttcatggtacaacaaaattaatgtttcatattaaaaattgatttagttgtacaatagaaagcagttgggatgaattattatgttactgagattgagaatgggcttcataaacagaagattccaagataatcatggcctatagtcccaaaggtggttttcttttttctttcacttgaaagaagtctgcgtatgggcagtgaggatcttaagttcctcagtctttttgttctatcactcccagcatgcagctttcatccaggttgcctccaggcccaaggtggctgctggagctcctatcaacagaaccacattccaggcagcaaggtaaagaaagaggagaaaggcaaaaagtacgttactccctgttccccatttaaggacctttcccagaaacttaccccatagcttctactgacatttcactggacacctctagatacgggaaagggtggaaactatagccatctaaccaggcacaatgatgcttggaataaaactagggttctgtccttagggagaaggggagaatgagtctgaggaagtgactcagtctctaccataagcaatactaaagaaaggaaaagactctgacatggctcctcccttctttccagctaaaaatggaaagaaggtagcagccatgccacagggttggtagcagctaaaaatgagatcaaccgctccaggagcatttgctggaagctttgggctctgagcagggtgatgaattaattaccagccagagagaaggaaatacatgaacactgggcatgctgcagacctcaccatccaagaaatggaacaccagcactgccattgcattccaaccaccaaagagtattttgccaaaggaaagatgttgtgcagtttctgaaattgttgcacccaaaatgaaacctttctgcgatgataataccattatacaggcgaatgttttccaaaatgctgtgttaataagagaaggggaatatggctatgtgtctgaaaggtatatatgtggccgggcacggtggcttatgcctataatcccagcactccgggaggctgacacaggcagatcacttgaggtcaggagttcgagaccagcctggccaatgtggcaataccccatctctattaaaaatacaaaaattagttgggtgtgatggtgtgtgcctgaagtcccagctacttgggaagctgaggcaggagaatcgcttgagcctggaaggcagaggctgcagtgagccaacgtcgcactacagcataccagcctgggtgatagagcgagactccatctcaaaaacaaaaaaaaaggcatatatgtgagtgaaataatatatatacacatacatataaataatatataaatttttaaaataaatttattttgtagtgcctacttctttgttcaaggagtcctgtctacagagataaagtttaatcttttaagaacgactttccctgtggaaaagcattacttgccaagctagcgtcaccgtgttgtataggtccccagaccactgtagtctctgttagaatttttttttcctgtttatcaacataaagttttcagtcattgaatataaccactgggctgtaaagatttctcataatgtattttaactgttattgtttagaaaaataaatgggcttgatgccctgaattaaaatattgttttgggatcattatcttcatatcatttacagatagaatggctggtatatgctaataggattttcaaagtgtggaattaaatatgtttgagttaaaatgacaaggggagggtgggttataagtgattctcataatgatttaggcgcttatcctaactggggtggcatgaagccagcatgcgttggtgatagaaatcgaatactcactcgaatttaatgattaagtaatttttaaccaacagaaacactgctgttggattatattcctcaaaacaatattaaattttgtaacactttctaatcagaaagaatccatgggaataatccatatagtattgtaatttatcatgctttaagaggggaacaactcatgcctcttgagaaagctgattatttctcgcctaattaaatgctaacattttagggtccattgcaagttgaaacccacaaaaccttcctgctgtgtaaagtgcctgaaatgtgttttaaaatattttgcattttttcaccccagttgtgcttgggtgttgataatgtctggctgatagtagttgggaaacagtgctttattgtctttctgttttttaaatacaaatcccatggctgcctctcctaatattcttcctccttgcagagtcccatcttctgtctgtctggaatcataccttcctccactcccatgcccactctccatccaggcttcaccactggctcctagacattgcagtattcatccttgctgccctctctgcctctggtttctgccttttgcatggatcctgcacacggcaaccaagttaatcttttttttgttttgtttttcctgaaacagtgtctcactttgtcacccaggctggacagcagtggcatgatcatggctcacagcagcctcaccctcctgggctcaaacaatcctcctacctcagcctcccaagtagctgggaccacaggcacacaccaccacattgtactttttttttttttttttgtattttttgtagagatggggttttgccatgttgcccaggctggtcttgaactcctgaactcaagcagtccacctgccttgacctcctaaagtgctgggattacaggtgtgagccgccacacccggcacaggtcaatgttacaaggtcatctaatccccaagctcaagaaccctcattagtattgaattgatgacaaatcaattctaagtgctgtagcttggcattgatcagatgggtcctacctttcctaccttttctctcattatttccaaagacaaacccttcactctggtctaattgatgcaactcctggtacccagttgctgtcctttcattgcagttttgcttaatgctctcctctctgccagcagcacctccttctaagttcaatccttcctccacggccaaggaggaagcctctctcttcttgccctgactacccaaggagcagcagtctctcaaacacttgagtttttgaagcacatattttccctagcacatttttgccatgccacataggataccatgtactatattttccatacacttatcttctaagcaatttgaggaccatgtttaggtatcttaggtgtttggcacaattgttttttttttattatggtaaaaaaaaaaaaacataaaattgaccatcttaacaatttttaagtgtatagtacaatagtgttaattactgtatatgcacattgcaatgtaaaagatctctagaactttttcatcttacaaaactgaaactctgttcccattgaacaactccttgtttcttccttctctcagccccaggaactaccattctactctccgtttctaacagtttggctactttaaatgcctcatataactggaaccatacagtatttgtcttttggtgactcccatattttacttagcacaatgcccttgagctttatccatttgtagcatatgatgggatttcgtcctttttttaaggatgaataatattccattgtatgaatatgccactttatccattcatctacagttgggttcacattttagctattgtgagtcatgtagcagtgaacatgggtgtgcaaatatctcttcaaggtcttgttttcagttcttttggatagatacccagaagtggaattgtcagatactatgataattcaatttttaatttttgaggaaccaccttactgtttaccattgcagctgcaccattttacattcccactaacagtgtacatgggttccaatttctccacattctcaccaacgcttgttattatctatttttttttatggtagctgccataccagatgtgaggtgatatttcattgtggttttgatttgtatttccttgataattaattttgaacaccttttcatgcacctattggccatttgtatatggtctttgaagaaatgtctgttcacgtcctgtgcccatttttaaattagatttgttgttgttgttgagttgtaagagtgtttcgtatattctggatattaatctctcctcagatatatcgtttgcaaatattttcccccattccataggttgtctttttcctttgttgattgttgccgtggctgagcagaagtttttaagtttgatataatatcatttgtctatttttgtttttattgcctgtgttgttggtgtcatatccaagacatcattgccaaatctaatgtcacgaaggttttccagtaaagtttcttctaagagttttctagtttcagataatatgtttaggtctttaatccgttttcagttaatttttgtacatagtgtaaggtaagagtctaacttcattcttttgcatatagaaatccagttttcccaataccacgtgttggagagactgttctttccccattgtgtaaccttggcacccttgtggaagatcatttgaccacatatgtgagaatttattcttgggttctctcttctgttgcattggtctccatgtctgttttatgccagtaccacattgttctgattactgtagctttgtaatatgttttgaatccaggaagtgtgaggcctccagctttgttcttctttctcaagatcgttttgtctattcagggtccttggtggttccatatgaattttagaattgtttttgctatttctgcaaagccataccattgggattttgataaagattacactgactttgtagattgctttgggtagcatggatattctaacaatattaagtgttctaatccatgaacatgatatgtctttccgtccagcgcaattctttatatataacaataagattgttgttggtgatgagtgtgaaaaaaaatccaccaaagctgtgtgtgtttttcttttagagaaggcagaaagaggcaaaacaattcacacatattcggcactttcagtgtatcacagatccatatatgattattttcagtataaacttgtaagtgttgggattcttattttgcaaagaaagaaattgagactcacatttaataacttcaattatcaaaggtcattcaactagtacatggcagaagctgggtatacctcaagtgggtttatctgatttccaaggctgtgttctgttcattctcaatctcccctccctttctgttctcctctatgctggtattttccaattctgccaacatgagctgtttactgcctacatgccagggctaggtaatgccaaggtcatttggagaagcatttcgacatagcaaggctgagttgatggaataatccagtgtcctctgacttaattaactaaaccttgtatcttttgaacagctaatgtttgaaggcagatttgaatttaaaaatgcaaataactcttcccacttttggataaaatattgtgttccttttcatctgtgatccatcatgacctctcaattgttttctaccataaaagctcacaaagcagcacacccattgttttctttcattcccccaccctaattttgattttgatgtgtcattgagtcatcttttgacttctctttcccatctctgcctcctctatttagtgcatgttacataatttctgctgccaaagagggaacaaatcatgcagagaacacacctatttaactatgtttaagatctgcccaggaatgtggaacatgtttaaatataaaactgagaatgaggcctttgacattgattgattttagaaataaagtagaactaatccacaatactgatctcatagagaaatattttcataaaattccagaacatttgtgggaactggaccttaattagagccccattgtacagggataaatagcatggtggttagagttgatatagttactgaaaggaatggagtgtaatcagggcaagcccgtgcatctaggtattggatctggttagagatgcttgtatataatatagggtcagcccagaaagcacttaaaaatgcctctcaacacttatcatgtgctatggaaatgaactaggagtgctaaagttaatcaaaattagggtggggaagtgaatgaaaataatgggtatgtttctttgcaaacttttatggtagaaaacaatttagaggttatcatggatcacagatgaaaaggaacacaatattttatccaaaagcaaatactaagcatgttttaacaatttaaaaatctgctgaaaatctttcaattttaaatgaactgagtgcagtagtaacatatcaagtcttatgcttcacaagttagagaaatgaaggaactttgaggtggctgggagcaaagatgattaaagcattggaacataaaagacgcaaaacagttgacttgaaaaataacatatcagatcataatatattctatgtatggaatacatactgaatagaagcagaagatcttctacagaagatcatctcaggctgctgtacctctttagggagaataaagttaggaaatgtcttaagtgagagttggagagagaaatcattttataaatgaggtctttctgacaaatggccaaaataagaactataatactaaatatgctgttacttcagcccttgtatgtgccaggtgccgcatcagagtttgtcatcttactcggggaatttgcagcagactgaacttagatacggttgcattatatagtgtaagttgaatgaacttaaatacagttcagcacagcacagcataccaattctgtgggtgccatcaatcaggaaagtttgagaagcactcagttaggttcctgtgatagtgactgaaggacaattttagatggatggcagagaagccctctctgaggacacatttgagctgtgattgacatgaagccttgtgaagatctattggaaagaccattccaggcagcgggaacagcacgtgcaaagacattgggaatgatcctggcatgtttgaggactagaaagaggaccagcattgatgatgcatggaaaaatgctgggagggtggttgggaagaaggtcagaggggtaggtaggcatcagagcacagctctgtaggccacagcaaggatgaaagggttttattcctcagggagcatttccatcctggctcaagtccacaccacactttcccattgtccccagcaccccacgcccaaagcctcatgacctcaccttagcatagagctgttccaccttgggattcccagcccaccctttaggagtctgtctggtccacaagtgaaaaaacaaaacaagtgtcccgtcactgcagcatgctgagaaagccttgactagcagaattgtatcagcctggctgggacccagtttgaggccaccctgccttccacatactcagggagccaccacagcccctaggctgttgtgcatcttcagcaaaggggggcctgggctatacctctctacagacctcccaacacctcttcccaggaatgtcactctccagggttgttggcctaatgtattggctctagggccaatatgcattgagacagtcatagtaaagtcaaaagaggcactgaatccactcctggagccaatcctcctaactttttcaaaagatgaaaatcatacacaaaacaggaaaatggaatctttgtctgtgctgtaatttcctcactaaattgaccatgaagaatcagtttatactggcactcttcacgcagatagtctgtgggactcagttactcagtgcattatgattttaggggagcatagcatggtcctagcttggggaggaaagggagaggtggaaaaaaatggaaagtgaaggcttttcaaacagcacagcaaatcatactttgagatttggcaaggcctctgagacaggcccttgttttgtgatgatcaagtcatgcagaatttcacttttctttatcttgatgacttgagggctgggactccaaatcaccagcaggtcgtgaagggttgctcaaggtctggcctatgatagggctctgaatatatgttgaagaaatccatgagggaatgaatgaatgtgtgcatgtgggattaaggaagctgagataattaaaggtgaaaatagtcaccactgttgattttatggagaagaattgatgaacaattacaggacctctttatgaagtcaggtgaccttagaagaaaccatttcagaagcgtaaagactaaagtcacacattcatctcagaaacaaagtattacaaataattagagaaggtggagaaaagaagaaaatggagccagtggttaaagccacaaatacaaggagtttgagaatacttcattatttggattaattttattaacctttttattttggagtaacttaagatatttacagaaaagttgcaaagatagtagagagagttcctgtaccccttagccagtttcagtgtcccctagtgttaacgtcttgtattactagggtacatttatgaaaattaagaaaccaaccttggtacgttactattaactaaattctagactttctttggttttcagcagtttttccattgccatcctttttctattccaggagctaacccaggacccaacattaacatgtagtcatcatgtctccttagtctcttctggcctgtcctaatttctcagtcttccctgtgtttcatgcccttgacagttttgaagagcatggtcaggtgtgttgtagagtgtccctcaaaatgagtttttcagatgtttttctttgttagactggggctatgggtttgagggaagaatactatgcaggtaaagtgtcctcatcccatcatttcaagggcacatgatagccacatgacatcaacatgacagtattgggatattcatcttgatgaatcttgagcacagtccttgcctttacctcaacagattcccttccttatgctcacctccccatccttgcaggattacactaggtagtacagagattcttctctaagatgcccagaacactgcatcttcacatcttcactgataccttttcccacaattattctcttttgctttagtaccaacaatctctttctgtacagaggttcgttgagtatctgtttaaacattgtccaagagagtgaatgaaacagacatgtactttaaaaagacttttgtagagtttggggaagaaaattgaagagctgaaatgcaaaattagatatagaaaaggaacaagatggggttttaaaacaatggcagccaaaagtagacagccaaatcaaacaggggcaaaatttgtgattaaaatagcaaatgtaaaaatggaaaagcagcggtcaaaagcaaaagtttaaaaatcaagtttccaactttaaaataaaatcttgcaaaagtagaggaaatttaagtggttcaagtttgtatgggaacagaaacatagatggaaaaataagcttcaaataggtaaggcaaatggtaatgaaatgccaaataatacagttatctgatcttgcaacaggaaagtcctgtaatttggaaagtgtcagaagctcttggcgatacccatgcgattaatagtatcagcttaggcttaatgaagtctaagaatactagaaagtgggctggttctctttgtataagcagaagatccagttctttgttttgtttcaagaagcaaacaatgaaggaatttgaaaaactacaagaaaacctttaaaacttttgagtaattttgtaaagtggtaaaatggtgttttatttattttgaggggaaagaatgcacgaacatgttttctaaatgtggttcatgcccacatgtcatactgaatgttttctttcaaaaagaattgatcgtgcaccttctgtgttcaggcatggtgtcaggagtggtccttgcccgtaaggagtttatggtctgctgagtttatggccatgttgttccttaactcccatctgtggttttgctgatctagatcttaggaatcaaatatcttttgcctccaggtttgtgttttttggtttttttccttctgtaatttaggttgtgcaccatgatgtttagaacaatgcattacccgtcaggatgagtgatctgtttcagcctctccctccaaactgcccagggttaagtattggattgtactgactctctcactcttccttccccatgtactgtcaagaggagcttgccatcagcatggcacagagacagtaaatttgtctccagagactgactctaccccgtaaggcccatgccaaccaaggccaggttgtttgcaggtggcctgctttgtcgaacctttagtcccctccagcacaagtgccccacactgacatcccatcagatacaagaatgtcaacacaaggttatagaaatccatgtaattcacacaaaacaacacgttaaactttcaacttgcgtaaaggatcagatgatcccattgtatcccacaattccatttccaccacttacggcggcctgaagagcaggttgtctttcctggtctgaactggcccaaggctactgccatggcaggacccttctgccagctccatggggtttgtgtttcaggctcagctgccctgtgaggtgcagcctgttctgttacaacttgtgttacaacgttgcttagttcacaaataactggtaaaaggtagaatgttatcagtgtgccatgcaagttagtttggttcatctgtaagttttcctaggcagggggaagtggaatagtgggagcagaattgaaaacttcaacaggacaaacacatacacacacactcacacacaacccaaaactctcagtagggtgttgcataggcaggagcctttttagatgtgtattaggcaaatttaaaatgagacatgagcacatgcctcgggctgcccccaggggaggtcgctgaagctccaggactgcagttggttgtgcttcctcctgtacacctgtaatggctaccccgctggctcagagctctgcctcaccgccctgccccagcacctgcaagccagtgtgccacttttttgatgttgtatgtttttaatattccctgagacagactccagagttctgagtttcttacttggggtgtcaaattatattccaggaaccaatttgggttttcctggcttctggttaaaaagctggacagattttgagttgtttgctcttatttctctcataaactgcactattttgtagaacacaagatttttcaggaagtatactgaaaggcctgtacttagttgtgtgtttttctttcagccacactcagatcttccccttctggtatgttctcagctggagacactgctccccgcattgtcccaaagtttgaaaggtgggggctgaggagagaaggggagtagtcaggcagtttctagcagttacctccccacattgccacctagaacctcatctgcctccctctacaccccaagctccaggaaggcaaagaccaaatctttggactccatatcctttgtgcctggagaaaagcttggacttggtgttggaatgttactttgagttgtctttgacaggtatcagaaagccacatgccctccccatggaagcaggaccagaattagactgcaggactttagagacaaaccccatgaagctccaaggggttcattctaactcaactgagcaaattaaccacttctccagttagatcttctaataacttttgttgggtttttctcctgcagttagggaatagcaaagtcttcactaccaaaaaataaaataaaaagtacaatgatgcagtaatgtcatttgaaaataatagtgaaggaaaaagaagtatgtgattgagaaagatgcttatgtgagttatgaacattgctaagggggcgggaggaccacttaatgattcagtgaaatgggaactgtctagacaagtaattcatatagctcatgttgaagccagcccttcaggagtttgcaccagagcccaacctcagctctacctactggagtctcagggctttgttttgccctgggttaagccacatcacagttggctgccaactttgaacaatgagtagcttaccataagaagcccaggcctaagggaattcatcttctccctcatgccagttatagtaacgggcagggaaacctgagtccagctgccaacagtcattaaatgcagaggacttcttccccaggttcagatggtcatggttaccttggccagatcctccctacccagttttgccctgctgtccctcccaaatccccagaggcaagggccaaagtcaccgcactgaaaatcagaggctgtgcctttcattaccagctctgcaaagggcctgcggcagggggtggggtggtggggtgttgtgggaggtcattgaacctgtatgcttctcagttcctcatctgcaaagtaaagggggtgagctaaagcatttcagttttcttctgagtagagaagtgagatacattttcagtgtagaatttgtaaaacacagaaaactatcatgtatatgtagtgtatttttaggtattataaatatgttggatcctgctgcttctcttaacattatatgaagcacttctccatgcattacaaaaattctgtgtaagttttaatagctacctaaaattttacaactgcttgctttgaaaaatgccttccaggtcaaacattttagaattctttgagcgtgatgcaaaaagaaaaataaaaggatggattttttttttttttcaaaaaaggaagcatttctgagagagagggaggaggcaggtggaatctttggataccgagttgtaggaactggggggataatttaatcatgttattattggaagcagtcctccatgggtttactcatactcctacatgtcatgttaggtatgaccagaatatgaggacatgatcccctttacctgacccatttttcaggactgtgttttcagtaagcaacatttagaaatgagggaaggcctacctccagaatgaagaacaggcttgtttattgcttgctgtgaatgcagtgcattcccaagctcagtattcatccactgcattgcaaacacactgcatgtggaatatgtctggacctctctgcattgcccctgtggacttggagacaaggggaaccgactgcaaacactgatatccatgctacttgctgtgccatgagtaataaagtcctttgtctcattatccaagattctctgctagtatccatgaaaccatgatagattaactcattagcttgtaagtaagtggagtaaaatcaacccccaggccaagtaatgattacatgttagttatacaatggtagatgagcagcaagggcatttcgacttcaagaagcaaagcatctaacttaattttacacagctagtggcagagctagaaatcaaacctgggtctgttggactccaaatcccacatattttattggctgctttcaccatactgtatcttgcaggcagtaggaaccatttgatatgaaattaataaagaacctcaaatggactcttcattttaaaaagtggtggatcctaggtaggtgttaagtctgaagctactttccccaggaaagtttgccatctgttacctatttggagaatttctctaccaagctacccaactggtttatttagattgaatgatgaaaacatttaaatctggttgttgtagtgtttcattggctttaaaaagaattttttttctccagcaggctctagtgcataactattgtcgatatttttaaaaatgaaatgaatacagtaggaatcattctaatatccatattggcagaagttagaagcttttcatgctggaacgaagaggaggtaatgaataaccctagagctgtgtgtcgctgctctactggggcaagatacattttattaaaaacagaactttgcccattggtagaaagttgttgcattgatagaacacccaatgcgcttgccactagcgctcagcacagtgtctagtgtctggtaaacactcagtaattggtagattttattatgacttggtactcggtaaatgttttcccagtgaatgacagctgtttgttcatccttcacttattttgtatttattgagtgcctactgaaaggacaaatctatactaggcactgaggctacagctgcaaacaaggcaaaagtgcctgccctcatggagcttatctttcagaggggagattgataataaatgcacggacatagaatatcagtgaccatagctgctctgaagaaaagttgaataggagaaacaggctggagagaaagatggtgtgagtgggctcttctagattctgtgatcagggaggtccttgcttggttaggacgtctacagagtgacctgaatacagcatgggagcaaacagcagggagatgtggcaatgctgctgcctggattagggcaaagcatgagatggacctgaagacaaaccaggttttcttcgtagcccagcctcatgttctgttacggaccacggtctctctacagaccttaactcacctgtagtctggggataaacctcatgcttaacaacagcaggtagagtctttggcattgtgaaggataattaaaagtctcattatttacctcagattgccatcaaagaagtagaatcattctttttgcttgaatgtgacagtattgctatatgctaggctcttatataagaggatgggtgagctcacgtttggcggtgtggtcgagtgatgttttgtgtgagaggatggatgacctcacgtttggcggtgtggtcgagtgatgttttgtatgagaggatggctgagcttatgtttggtgatgtgataaagagatgttttgctgtaagggtcaaggggagaagtctgagtacagagcaagataaagaaaatgtggcttctgtcttcagcagagccaatcaaatggaaagggcaccaaataatgggaaacagagagaacaaagaggaagggggaagagagttggactgtttgtggcctgtgtgtggaactggtaaccaagttggtcttgagggacgttttaacagacatttggtattggactgaggcagagtttggggatgtctccaccagcttctctttctcagatttggtttaggggcctgaagaaggaataatagattctctcccctgctacagctgaagtggggaataaaggtgggaggattcagagacttttcaaaggccaaggtgttcactctgaattgaacaccacagatttttgttgttgtttttccttcctcccaggaaaaaggaaaaagatttactttcactacaaatatttaaggatctgttgagttcattttcacaaaagaattaaaacgtgggaaaaccaaatttcccccctcccactgcttttgttttggcttttgcttaattttgtaacattaattctttgatccttccaaccacaaatcatttaagtgactttgattaagtaatcacttaacttcccaaattctttgtatcatgattgtatttcttgtcatattttatacaattataatgaggttttacaaagcaggttcagatgccagcgcacctgggctcctcctggcgcactgcgatttaaagcaagttatttcacctctcagggcttagctttagcatcgataagaaaagcttggtatttaatacacatcccccacagagacggtgtcgggaattttattcagttagtgtttataaaggatctttattggcaaccctagggagggtgatatacatgaatattttaatatgcaatgaacaatctgctgtttgggccatctaggcaatgttatgtaatgacctattattttggcttcatatcccctacagagacctttctctggcttctctggagaccgagttttgttgttatcccagcagctaagaaatcagggggtaaccgcccaggctgaacacatggcaaattctatgcctaatgtgttcttctttggtgtggaggttccgatgatgtctgcacaggcctgggcagcaacttccaatgttttgagggttaatgcaaatctgtgaaatacgaaacctccagtgtagctcacaggttttctcaaaaatgctagcaaattacccttaattttgctcactgtacagctttattaggagtactggttgactcccactgagatttatgcattgctgcattgcaaaggttgaaccacttcagcccggcagcgttttcctgtgacccctgcgtttacaataactattaaagacgacagtaaaacatatataatggacatggttcaaatatttcccactgcttctgaaatgattatttctccacaagagcaaaagaccagtgaaatctgggcttaaggcgaggcagcaacaaaaaccacgggtttttaagtttaagctaatatttaacataggataaggactactggtaaatattgatttatcttctctcctattcccctgggggcttaatctcgccgctcagaacattaaacaattgtttatttttccaccagtattataaaaacaatactagaattcttttccttttttttcttttttttaagaaataaaaagtatccagtatcccagcaggacagagcaactgcgtaagtgttgagtgaaacatccatacgagagtagggcttgtggtagctctgttttttacagggacttgcttctttgcctggtcaggacacagatttttagctgcaataatacttgaaggagttcttttaactctagaaaatgaaaacatacatcttggtgcaggaagctcaaaacccagtgttttacgaataaggaaatcaacagagatcagagcaaagaaattgatccaaaatttaagcaagggctcaggaatgataatcatgacacagctgatgagtagtgttgaagaagatgcagaatcagaggaatctcatgggagaccagacatccacacaccacttctagaggctttccaagatggcgtgagccgagagcttcctgtcatctctgtacttaggaaatgtgccatccttgcattgcccttagcctcagttttactgttccttgtacatagcgggattgttacttccatcaagcaaagcagtccttaagtttcatagactgttacagcattgtctaattggctcctcaccctgtttcagataggttaggaaagtatctttaaaaccactttatatgtcaaaggacttgtatttagaatatggaaagaactcaataagactaacaacttaataaaatgggcaaaaggcttaaattgacatttagcaaaaaagatatatgaagggccaataattacatgaaggtggtcaacatcataaatcatcaggaaaatgcaaacgaaaacctccttgcagaaccactaatgctactttattctcaataccaaggtgaggatgagagactgaaacactcacacattgctgatgggcgtgtaaaatggtacaaccactttggacaactgacccagcaatgaaattgctgggtatttactcaggagaaatcaaaatacagacacagaggacttgaacatgaatattattagcagctctattcgtagtagctcaaaactggaaacaacgcaaacatctatcaataggtaaatagataagttgtggcttctgcatgcaatagatatactcagcaacaaaaaacaaactattgattcaacaccatggatgagtctcagaaacattatgttgatcaaaagaagccaaacacacaagaattgatctgtaacattccatttatatgcagctctaggagaggtggaactatgatgatgaaagtcagaaagtagttgcctccatttagggaaattgacttacttgtttacttgctttatttagggaaattgacttacttgcttaagtaaatgggtgagccagtgcttgaactcaggccaacagatctcagggctagggccccactggctacatcacactctctcagcatagaaggaaggtgaggaagaacgaggcacagcagctggggagcagaaggaaggcaggtaaggtatcaggagaaaggaaaggcagaagtcactgaggtcacatttctgtcctgggcataaggctcataatggcacctgtgatggaaagaggcccttccatcgtggccacctgcagaagtaattaggagggcttgacagatgtgggagagagaagcatcatcatccaactggtggagcctgccagtagagaaggtattaaagttattctcttgttggtatccaaatgggatttttatcatcatagtcccacctctcctagagctgcatataaatggaatgttacaaatcaattcttgtgtgtttggcctcttttgatcaacataatgtttctgagatccatccatggtattgaatcagtttgttttttgttgctgagtaaacaataaacttgttttattcgtaagatcttttaaaaattcttcatgacataattaatacatatacactgcagaaagaaaatatacataaaagaagaaaaaataaaacctcctatggtcttattatcccgtgataatctctgatctttgtttttgtttttcagtaaataaaaacattttaaacaaaaatgggatcatatactatacgtgctgttttataatatgccttttaaacaacatatcagtgaacatttctctctatcagagggtataatttctattggatacataacatcctatgggtggatatatccaaattttgtttaaccaaacctctgctactacatatttaaattgtttccagtttttagttactacctactaccccctacaagagaacatcttgaacataacacatttgctcactttttttcagtatttcctcaaggaaaactctagaagtggaaattctaggtcaaatggtttggacatccttaaggaatttaatacatattgtcaattattgtttttgaaatggttttagcaatttacattctcaccagcagtgaatgaatgtgttattctgtgtcaccttaacaggtggactataactttcgtccctgtgctaagtactacctcttttcattgaagcacctgtcaggattagaaattaacctttgatgttgtctagctccatctcccaagcaatggctgaattcccttttggattctgctagtttgaaatgaaaaccatttctttaaaaatgttaatttgaaaacatgattgatgtttgagtgtagtagaaaaattggaggagccagaaacagaagtgatcctggggtcagagtacctgggtttcagggctggccgcgtccttgtctgtagttgtgtaatcaccagcaagttgctgacgtaccctgcctgggtctctgtgtccccatgtctaagacaaggggattgaggggggctcaatctctacattgtctttagttatgacattcaataaatcttcggctatttaaagcattcctttcaagggctgggcttgtaaattaagcgtggcaggcctttgaaatgcagcttgtgtgggaaaggaaacaaacccagcagctagtttgctgctggatcagaattcgatgttctttgtgaagtaataaattgtgtcttggctcctggattgttccaggttgcctcgggtttcacggaagtggctttttcaggaatggttcccattgccggaaagtgggtgttaatttgtgccttggctatttttcagggcacattctggcaaaatcctggcatctttttcagaggatcagcagatgtaatgacctgggggttgctccccttgcaagaggacacatgctctatgttaataccccaaatcaagcctatagtcagaggcctaggttttataatagagcacttatcctgggcatgccaagggtttttgaccaagtggaaacactttgggacatgtaccacaggaaacaggacagcggaatgcttagtaatggttagcatttctaaataaagtatctgctctccactgaaatggggtacaggtggtgtcctggaagaggagaggaagctaatggaagtgaagaaagaataaaatagaataacatctgtgtttggtgctccacagcttgcagcctacattaacatactttatttactctacacaatgtccccaggatatcatcattgccattttgtcccaatttaccaccgagcaaatgcaagggttggagtgttggtcgtgagtggcccaatcacctctgcaacaacctcacggcttggcttaaaataccgtaaatccctgcttccttggcagatcttcatagtctcatacctcctttctcttctatgacaattgaaaaattacttttttcttactctttgagtccatagtcataaattcaagtcatttgccaatcttcagtataatgcaattggaaaacattgtctagtctagtatttcccagactttaatttttaaaattattttcaacttttattttagttatttgcacactgtcttcacaatttatgccacatctgtgtgccacctgtaccattatttacattatttgttttcagacaaattacaatttcacttttttcttgctctaagaactctagtaactgaaatcattagtttgatgtaccagttatagttttctaatgtatgctatcacatagctgttaaaatcttgtgttcattttttgtagtacataatatatctcacttctccctttgatatacacactatactctgaggaattaatttaaatgaaataaaatttcaaaattcagtttcttggttgagttagctgcattttaagtgtccagttgacacatgtagcttaacggctgccatattgggcagggcagactagaacattctgtcatcccaggaagttctatcagacagactcttcctaaggtttgtccagggcacttaaagcagcagacatttcactgctttcattagcctaagctagactaacatacaagattatcaaaagaaaggtgaattaatttaagaactgctaccaaaaatgtcagataatagtttctttcattgaccactgtccaagtaagcagcaagacaagtcaaagcatctgatttgataatggatcacttcagtctgctctaaaccagctctctctcagggctgtctcttcttccatccccgccactcccattctccccttctctccttcccagtccatgtctctcttcagtgtgtgtctgtgttttcgctttcatgcttcttcttcctcttgcttcacctgtgtgtcctaacctcactttcattctagccctcagtcctttctctccctttctgcctattttaccttcccaaccttctgaatctccctcattcaaaatttaagtatatttggattttgttttgtaaattcttcttcaagtacaataatttcaggccaaaggacattctcatttgtaatgtgaataagggatacctcctagcagaattccacaagatgtgataagtctcactggcatctcagctctgtgttaatgcacataaaacgactgtttcctgctcaaacctctgcctgtctctcactgatgtaaaaccataacaaactaattgctttactctactcctcatccaaagtctcctttaaagaacaagagaatttttgaccatgcttctcttcaggcccatggaaaaaggtccaaaccttgctctgtggcattggttacacttcttgagcagactaaaagccaggcattgccttgaaggcctgatgccacttctatttaatcagaactccttccagagccataaggttactggaggtcccccagagggaggaaagtgctgtgtagacatatttatgcttcatctgttggccatgaatgtcaaggaggagaactgactagactgccttctctttgttttaattatccagagattccaaaaggaaaggaaaggccaagtggacccaagagccctcagaagtgcaagatgctctggggaacatatgtgcattgctcaattccatgaaatagacccttccttaggagtacaaaattgaaagtttcccttacttcttgcggggaaacctgtttacctccccccacctccccaccccttccaaatgtactcagttaggctgtggaaaatttaattcctcttgctaatttatataagaagttatgataccttggaaatttttatctgtcagctttaaaacgttaaatatgggatccactattctcaggaaaatgatgtgatgatctgctgtctttctcagacaaagggaggcatttttccaagagtggaagtccctacctgcgtgggaatgatagagacatcctctgactgggttttgtactgctccagactctgaaaaagagaaagagatccaagtttaagtgactttaatcttagtaaagttttaaggtttatgttatcctctggataataataactataatgatgttttgagtgcttggaatttgtggagcagtgtgttaggtgctgctgctgtaaacacaatctcattaatcctcatgacaaccctgatgaggtgactctcccccaccaccatattctaattggaggaatttgagtctcagagaggcgaataatttctcaaaggcaacacagtcaataaattgtcagagctcggattcaaacccaggacagagctttgtggtctttagatccattgttctgtgttggtttattcagcaaatgtttattggtggttactgtggccaggcactgttgctcagggattccacaatgaacaataaaggcaacactcctgatcttatggagcatatgccctggagaggaaagacagaagaacaggaagttaaaaaataatataacatttttaaacaattaataatctggcatgataatttcagatgttggcaatgccataagaacaatagatggagtaaagcaatagtgaatatggggctgctttatgttgggagctctcagaaggattttctgggatgacttttgaactcagacctgagtgatatgaaggatccagaatccagtgttgggggcagaggaaacagcaagcgcaaaggccctggggtgattgagtgccatgtctttcaggagcagcaagaaggccagttttgctgtgtagccggtgggggtgagtgacaatataaggtcagagatatagacaggctttggattttgctccaagtgtaatgggacaccacagggttctaagcagaaacggtatatgatctgaattgtttttttctttttctttttttgagacggagtctctcactctgtcacccaagctggagtgcagtggtgtgatctcggctcactgcagcctctgcctcccgagttcaagcaattctcctgcctcagcctcccaagtagctgggattacaggtgcccaccaccacacctagctaatttttgtatttttaatagagacagtgtttcaccgtgttggccaggttggtctcaaactcctgacctcaagtgatccaaccgccttggcctcccaaagtgctgggatgacaggcatgaaccactgtgcctagcctgaattaagtgttgaaagataactctggtttctatgtatggaacagagtgtacagtagcaagacaggaagtgggaaaaatggttagaagaacatgaacatcagaagggctggaggtttttgaaggaggaggatagtgctttggaaacagcaaagggggagagtgggcaagaaatgactgtttatcctacctccaggccctgggtgtgaggagtgatcctcaggggccagccaggtccagggagtaggcaaaaaggaagggagccttcagaaaagaagatgtagctctaggggagtttgctgcagcggcagtggtggcaaatcacaggatagctagtttttattgaacatgtactgtctgtctagcaggattctaagtgcttttcctgcaataacttgtttagtcctcttggtaatcctaaactgtagatactattattagccccatatcacataggaaactgacagggagttaagaaacttgtagcaagtaagcaatatggctgggatggcattactaatttcagaagtcagagtggaaagttggaggggttgtcagagagggttggagcgtgctctcactaagggaggggtcgactggtctagagatgagacccagatggcaaacgtgacctgggaggttttgatggaggtaaagcttgctccatgatgccatttgccctgaatgacactagaggaagtttccccatcagttcagactggaagcatggagcctaggagtgactgctctttcttgaagcttcccgtggggtggggcccagggcctcctcactgggattgctttcttaggcagcttgtggggcaagaagagtttcgtctaaacaaggcagtgtcttgaccccttttatcccactgcctttgagttgggagaatgttcatatttacacatttctgggatgttttactgcagttctcgtttggagataataatagataacattcatcattcattaagcacttacaatgtgtcaggttctatgctgagcacttgacatatagtattccttcaataaacacagtagtcttatgacatggctactattcttgctcccctttttctgatggactaactgagctctagacaggttacgtcatttgcccaaagtgctatatagtgagtggtggacctgagatttaaaccttacaacctgacaccagaggttatagcctcactctgctgcaagtgaagaagatatgtttgctaggtttggggcaatgctgcccaggaagtctttgtaaatcccaaaagaatgagtgattgtagcaacacaaagtttgaagggaaaccttgagagtgagtggctagcatcttccttccgtgaccatactgatgttgaaatgttggtagatcaactaccagcatcagagacgaacctgaaggtaatggactcaggaggggaagacaagggtgagaaaggggaaattgttgtaaatagagaaaaggaaattattggtttacttaacttgtcttccactacgtgatctaaaagtaacagtactcagataatactttctctctcttttaattccagtaaatgaacacctaaaaaactgcttacttccccactctccctgcaaacaagaaaaatggtgggattatggatacttttctattaagatgttttagttttctattattttaaaagaaaaatatgtggggtatttttaaaagaaattgtttaaataaatgaaataagattctttaggcatcatatttaattgaattcatttcatccctttaaaaaatatattttctttgacattcatctattcctatccaaaaacatgggtggatgatcggatctcagttttcttaggctccgtgatcctggcagagttactttttaatcacttgtctatgtttctccaacttgaaaatacctagacttccaaggcaactgaactgctgtggaagagccatgaacttctctgccaaatggccgtgagtaagaagatggcctcttggattgctctcagtccctcatttgtgttctaaaagaattcattaacctgtagatcagtttggggttttttttgactcacctggtggatcagattttgctgtccctaaatgttcctctgagctccttggagaaaaaagttacgagtaatagacatgtgtttatcattttacaaatgcatattgagtgcctactgcgtttcagactccagatgccaaaatgagtaagctgggatccttcttcctaagggctggttgtttgaagaaattattagaaaaattggtggtgaggggcaaatacagccacctgtgtggtgagccagtctgtgtccctttgtgtaaaaaattccttgaaagttagagccctaatgtcttgaatgtactaatataaaatattcatcatcagttcactgttacaatttttcacccttttacacctgatgtgaactttgggctttgcacctcatgaaggcacatacctactctttaagatggagtgatgttacccagagggaccacctacctggaaaatggcaaagcctggccttgaacttctaattcctacttcagggcactttcttctgtctaaaataaaaccctgctcattatctgtgtactttatttacctttccaaatgttactattattattaatattattattataaccaagttatttagattagccaacatattttactgaggtgacatggtagaagcaaactcaaaactgtcctttgggctgcctccccagtccagggcatgcacagttgtggacagatcatagaagacagcttctctctgaaggtatggggttaggagtggggatgagggaggtccaggacaataagagaaacatgcaactgctgattgagtgtttggaaaaatgaaaagtattgctcactgattgaaagagatgtagtcagaatttcatgcttaagtgcgaccaattctggatgtcatggttgtcacctaatatgtgcccaataaacacatgttgactgaatgaataaatgtggggtgaagaaatacaaagcaaggagagcaagccaacccagaatcttccttgactttctgtgtgcctcctggaatagatgatttaacacctctgtgtctctaggtagaactgaaaggtgtcagtggcagagtttatggatatctaccttgagatgctatttagaggagtaggttttgtatacctggaaggtgaaaaggaagatctagtaagttcaaaagagggagactttggagccaacaacttaatgggacttcagtctgaaccacggcaaaggggcagccaagcctgtctggatgcctcccttgcacaacatcaacacacatgtgcccaccacagtgagggtcctgcttggttatctggcatgttatgggaacagaggagtcaacactttggagtaagtcagtgttagctcgtgttgcttcatttttagagatgagtaaaaagatgtgataactgcagtagcttcctataactgctgtaaccaattactacaaactcagtggcttgaaacaacagaaatcaattctctcatagtgctggaaacctgaaatcaagaatcaaggccagcagggctgtgctgcctcctgaggctccaagggagactcaatcctggcctcttccagcttctgtggactccaggcattccttgcccactggctgcatccctccaatctctggctccatcaccacacggccttcttttctctctgtgtttctcttctgtgtgtctctccataaggacacatgccattggatttagggcccacctggacaatccaggatgacctcattatgagatccttagtcacatctgcaaagaccctttttccaaataaggccagattccagggattgggacatgagtatatcttttgggagaccacgcttcaacctactgcaatgatgctgatgtattaggaagatggtttgacagggggagtgtgatagcaagggtagggtgcagacactgggctcactggctgctgtggccttagtccaggactggggaaataaggaacgaccacagcaggagccatgggaataaagaggaggaaatggaagcaggagatatttcatggaagaatttgccagaacttggtgataaattttggtgtggtcagtaagagaaagagaaaatcctaatttgacaccaaggcatatttccccaaaatatgtgctacagaatgctggatcttgggatatcagtagctattgtgtgaggggaaaatggttctatacataaagacatttgggggacactggattaaacagcattgaacaggtgtctatcctgcaggatttctgtaagcctttaacatccccacgtatatcataagtgtctaaagaaggtttctagaggacagtctttcccatacttacttgaccataggcctgctttatctagattatcttgaagaacaagtggtccacacacctctgaaaaatactgctcgatggcatccaccctctgagaaaagataatataagtgacgttcagaaagatggaatgaagaaaactggaatcggacagtctgatgagggccaggcttgtttccaagacccctgccagccttaaagatagccacagggactgacaccagtaactggcagctggcagaagccatttgcaggtttgcacagtgacgctctgactttaatagtccgtgcaactgtcctgtggtttggtttcttatttctctggtaccttcttgacagtagaagctgttgctttagagcagttgcagcaagtatgtttcacccagtgtgccaactctgctgcattggatggctgactctcatgctgccttgagaaggatgctaagctgcaggaggctgcgcaggaaagagtgctgtaaatgacttgtaatgtctgccatgagcacaggaggaagatggagatgagctaagagcccttcttggtttatgcctcttttttttttttttttttttttttttttgagacgagtctctatctgtcacccaggctggagtgcagtggtgcagtctcagctcactgcaaactccgcctcctgggttcatgccattctcctacctcagcctcccaggtagctgggactacaggtgcccaccaccacgcccggctaatttttttttttttttttttttgtattttttagtagagacggggtttcaccgtattagccaggatgatctcgatctcctgaccttgtgatccgcctgcctcggcctcccaaagtgctgggattacaagcgtgagccaccatgcccggcctcttgctttatacttcaaagaacttccttgcccatgctccctccctcccttgtccatgcctcaaaaggggccaaccaagatcagcagttatgcatcttggatgcagtcttcctggactcttcaatcttgagctctcacctagaaggaaaatggtggtatcaatgagagaaatgtagccatcaatttcacaatgaataataaaaatagctaatatttactgagcacttattatgcatcaggctccctgctaagtgttctacatgtaatgtctcatttaattctcatggcagcctcaagggataggtaccatcaatcatctaattgtacagatgaggaacatgaggcacatagagattaaattactagcccaggaacacacagctaatatgtgctacaaccaggatttaactttaagcatcctaatgttaaaaccgacactcataaccactgaactgcagatttaattatagacatgttggatttgaaacattggtaagacttgcaagtggaaatatgcaggaggcagaggaagatacagaactggacaaggtcaggcatgggcacagagccagggagtgggggtggttgaaaggtgcccacagatgcgtttattcaaactatgagttgagagtcagttatacagatgtacaatgtacagagaaatctgcgcaaatgttttatgtattagggagatgttttcccaagtaatgagttagaaataactgacttttgttatggtccatggacagaacattccaactgtgaggaaacaggacgcagatgaagaagtctgtgtcctaaatcatgctgaaaagtcagaatctgttgggatttttggagatacattctttgcatctcatctcatctcaatggtctcacaagtgcaatagaaaatcatggtccttggtgagagctggtgagagctttgccttagcatccccagctacagactcaccacctttcccattccctgtagaacctgaacccctcaaggacagggaatgggtctcattcatccaggagcttctaacacccgacacacgcagacactcagtaaacagtaagtgaattagtagaaccaaggaaataagaaccgaccctattcggttacatctgctcctggatatattatcaaatttagagtgttttcactgacccatcactatttcattgtaaatggctgaattttccccctgtaggctggggacaatgccacaataaattactgcctacttgaaccgagtttcattttgttctgattgattgccggtttcaaggaccgtctaaaatctcagtttatggactttacttcctggtggttcccagagagaaatgagcctggattccagagaatgcaaatttcttcaaacttgcagccggcttccagactccctgcaaaggtctcttaagcctctaaatatttcctctcttaaatcacacatcactggcacaggcagaatattttccagttacttctttcttgttaggagagagtcgcttagaggtctaccaagtagacagaaatgcagtcgttttggcagttttattgtgctgtctttaggtttcgtttagtgattctttttttaagttgtgtttggttttttattcctgaaagaaactatttcaggaatagttgcactggaatattccaggaatagtcgctgcattagaaacacgatgttgactctctcttggcatgtttatgggtgggatgaactgcatatgtgaaatgaagcttaatctctcacttgtgcaaatgtcgagactttgatttgacacttttccaattaggtgatgtgaatccctagggctagtgtggtagcttattgtgtagcaatggcacacaggtattctgccaaattttgatgtgtatctaaaatttgtatttgattcaacctagaatagattctcttatagtgtctgttggacagtatgctgaactgagcaagttatggagtgtggcacagaatgaggcacaatttatggtgccatagctaagaggcacagtgtcatgtcaagttagtatgtatgaaaaatgaccattgccttggtctgaatcttccccaaaattcatgttgaaacttaatcaccattgcagtcgtattaagacgtgggtcctttaggaggtgattaggtcatgaagactcctccctcataaatgggattaatgccttataaaatagccttcacccggggttcagccttttttgcccttctgcctttcaccatgtaaggacacagcaacaaggcgccaccttgaaagtagagacggggccctcaccagacaccaaagctgctggagccttgatcttgaacttccagcctccagaactgggagaaataaatttctattatttatagattactcgttctcaagtattttgatgtaacagaaaactgactaagacagccatttattgaaacacacaaactcttctctgatgaatacaaaaaggcttgtggtcagggcaataaataattctcaaatggagggcaacaaaagtgaaaaatgtgacaacagaaggaagtttttataacttcccaacactttctttttcataatgtattccccattaatgcccttcaaatgtatagccaaaaatttgagtgtttgaaagtgcaaaaaggttgcaaaccactgatccattcccgacatcatcagttaggttctgacacacatacacacacacagcactttagttaatgttttttcttttggattttctttaaattttgctgcttttcttcattgatgttactcagattttgttgattttttttccccatgtttatcctcttttttttttttttttttttttgagacagggtctcactttgttgcccaggctggagtgcagtggcacaatcatggctcactgcagctttagcctcccaggttcaagtgatcctcccaccttagcctcctgagtaggtaggactaaaggtgcacaccaccacactcagctaatctttgtattttttgtagagacagtgtcttgccatgttgcccaggctggtggtctcaaactcctgggctcaagcaatcttcctgtctcagccttccaagatgctgggattacagttgtgagccaccgcaccaatcaatttaaactcttcatgtcttgcctgatatatcctaggtataagcctaagaaaattgccttaagtaagactgaacagtgccttggactctcttgctctcagacaaatacccaactttccagagtgtttattattgaaaaccacaaaagttgaaaatgggagacagctaacttggaaactctccctcatccctccatctctgccattgtcagagtcagtgataagaatgagaggtaaatgctcttgcccatgtatcgtacttttgcagtggatggggtccttgactctctgagagtcatggcccttaagaacatctggagcagccactgaggactttgtcagcaacttctcattccaggcaacaacccacagtggcagccagcagccctcagctccgtgggaagcagtatgggggaagtacgtggacttggatagcactcaaaccaaagtgtaactcattactactgcaacctttagtagagttgtccacttctgtgagcttggtctcctcatctggaaaatggaaataaaatttctcccccgtggttattaaaattaaataagatgtctgtcaggcatccttatagaggaggcactgtataaaggttcttttccttgcctccctgcatcccataatgtaaacacaacctccctcactggctaccttttgttactgacactggaatatctgaaaatcaactgatagagatgatgagacatgcttctttcacagattcatcagatttcctgactggccttagatgaagcaggagcagagggggaaatcttgatctgtggcaggtgtttaggtttcatggatggtaaagagtaagtctgagctatccatgatcaatttattactaatacacatcacactttcatataacttagataacagctatgaactcacttctttggaagatcctgactgctatggcaaagactctttcgttgtctgccaaacctgagtctctttcctcctgggtccatagctaggccgtatttcccagccttcttgaagttggatgtagccaatggaagatgggccagtcctggtgattctccactttttcccctctccatctgccaggtggatatcagtgtccagtgcaaccttggaaaccatgtattgaggggcatagagcctctggcagcctgggtccttaagtggttgtgtggagctttaccctccctgcccaccatctgagttttaccctagcaagaaataagctcttcatgttaagccatggaggagttgtcaaggttcatctgttatagcagctagctttgccttaacgaataaacttgatgaaacaggaggtgagttttttaaactttccccttttatgatagcactgacattcttctgaacattttctatgttgttactgtgggaaaacaaatgtcataattacttatctattcaaaatatgctgtgtatattgatcataagaaagatggaatgaggttctctgtcagcaggaagtctatttgactttttacctaacagtctcaattgaaagctggggttagtgattaactacacttattgtgttttcaatcagattaaacactcatggtgccaggtgctaggttgagaaggggaagcttagtaaagacagaagaaataaaagtaattttttttctaaatagtcagaaatccagaaattagacaatcatcaaagatttgtctaacgtatcctatatacttttatgttttcttgaacaaaatgtactgaaaatagttttaccttttccagccttcagcttcatcaactgtaaaatgaaggatacttaatctacaggatttgagaattaaatggggatcatagctacctcccagcctaatgcctgacgtaataaatattaaaaccctaccctttcttaatgacctggtttgttgggatatgctcgggagttatgcttatgaacatgaattatcacattggagacttgtaaattatctgtggctgcttatcccaacatggaatggtgctaggtggcagtgcttctgttatggtaactacttctacaatttttattgatttcttcttgccactttttgcttgtagttgcagccttcaaaactatcttcttctaatcctttttattgggggaagaaaatgaaacacccctgttagaaattattattggaaaatgaacgagttctgtatgcaagctggaagacactccagccaagaagactaccagccgaatggcagttacagcagctcaggggccagcacactcagtgccaagattggggctggttccagcaagttgaggttagcagcagtcagaactccccagttcagtatggtgctgccacacttcttgccagctcagctcctgtggctgggagaaagcggggaggaaggaggtaaagatcagagattgaagcaggacaggatatccagggtcagatgtaactttagtgattcttcattgaggaggccaagcagtggtttttgggtgtgagtttttatgacacactacttatttggggctaaatatgacatgcccacgtatttaaaagccccaatcattcattatccagcacaaagatggtaatatacacatctatttaatatggtatcagctgacatctcagtgatttgaggaactttagaaaggatctgtcctccaaaatatctcctcatccagtttgccttgattaaggaatctcaccctgaagagatgtatcccttagggtcagtggagtgtttgctctctttcactcatatggtcaccagaaaacatgggttgatacctactgtgtaccaagcccccgaaaaaaaaaatctttgcctctgccttcaggaatcttactgtctacttgaagagattattacatgagaaatctgtgctgtggatgaggaagggggtctagaaagtgaagtacaggggcttagagagaaattaaatggggggcgggggcattgacggggataggggcaggggtgctaacttagattttgagtcagaatgcctctctggaagaatgtgcttctatcagagacctgaaggagtggtccttggccaggcaaaagaagggatgagtttagagccataggaaaaaatgagtgaacatttgaggcaggaaggagctaggagctagagggagaccagagggtcataaggaaggggctggggagtgtgggatggggctagatcctgctgggcttctgggcctggctaaggacttcttaaattcagacctaaggacttcctcattcatcctacaggcaataggaaacgcctgaagtaataaaagaatgacctgtttccgctcttgttttaaaatatcattctactcaagatgtggaaattgtgttggaaatagacaaggtagaagcccagagatcagttaggaagtgactgaaaaaaatcccgggaggtgcaaggccttgaacttgtggacacatgaaaatggatagaagtgggtgaattcaagacacatttcaaaaatgcagtcagtaagattcttctactgcattgtggttaagcacctcggctgtggagacagacgccctgggtttgaatccctgctttgctgcagacttgtcatgtgatcatgagcaagtcacttaacttttccaagccttgacctgacctgtccactgggcatgttatttaaaacagagaatacactcgtggtctcttaacacagtgcctagtggcacagatcaagcactcattaaatgttgttcttttgttgaaatgcagggagaggtaacactacaattcagttatcacttaattagctctttgttctgagttagtctccccgatattttccagctgccaaataagagaagcagaaactgggcagaagacgcctgaattctgggtggaggaagaccagggctgcattagaatcccttgtgaacttgaaaaccatcagtgtgtccccctcttcatgttcctcttctccagctcacccataaccccagtcttaagcttttactgcaaggtcagtttttccagttttttcccgtactttctccaagtcctcagaaatttctgtaagtcctgcagcctaaaatacagtccaagccatgctgaggagtaagtaaggttacactgttgtgttaatctgccatgagcagacatgcaacggtggtcactgggacctttggtgcttattctatagccttggcctagagggaagagagacatgacccagaagggtaacagccgtcagcaatgccaacactaaactcttagcactgactgaaacaacaaagggtgagagagagagagagagagagtgtgtgtgtgtgtgtgtgtgtgtgtgtgtgtgtgtgtgtgtgtgtgtgatggagtctcactctgtcaccaggctggattacagtggtgccatctcagctcactgcaacctctgcctcctgggttcaagtgattctcctaccccagcctcctgagtagctaggattacaggcacatgctgccatgcccagcaattttttttttttgtatttttagtagagacgaggtttcaccatgttggccaggatggtctcaatctcttgacctcgcaatctgcccgccttggcctctcaaactgctgggattacaggtgtgagccaccacatccagccagggtggaattacttaatgtagaatttatcttgccacatatttgttaaactctttcaccagagtgtttggtgctggctgtttataatatagatgtttgacaaatctcttaaaacatgcaaagccattttctttctttcttttttcagaaagtaataatcatctctgttctattcgaagcagaaaattatatttaattaagtaaaaataagattagagaaggagtgtgttgaagacccttggaagaaaaccaatgagttggttggctctgtcattttcccactggtaatattttttcagctccactggtgggagttgtaaagttttccatttaggcagagagtgaacacctttggtcatggaaagaaagccagtccttttgagatattcacttgccatgtgtgtgccttctgaagtatgagttgtatttgctgagcaattgagtcttccctgggtttctgggatcaggtgcctgcagtttgataaaataacctctagatggagcttttgcaccttttggttgagctgggttgcccgtggggcaaatccccggtaatctgagcaggatcaaaataaacttcgttactccttcttattacgtaagtattgtgtgtttgtggtgggaacactaggaaatatagatttgcaagtgggagaaaataaaaatcaccgtgcagaggtaaccagcattaccatgctggagaatagccttctgatcactttttctgtgtgtaatgaaaatggtttcatcctcgaaatccccttttgtaactttttttcacttagtaaattgtcacatcaatacagcatacaccaatcagtgtcactaaatattacaacaccttagttttataattaaagagtatctcagaacatacagtaagatgtatttaactcagaccttgtgattaaatgtttacattatttaagatttttcaccattatgaacaataccaagatgaaaactcttttttagacaaattttggctcatgtccacgattctcagagatggaactggtgttcgttgaaaatgtatgcattatgaagtccgctgatattgcctgcttagagcaggactcccacctgactagtaggagaaaatttaatcacaagggtccttaaaggtggaagaagaccaaggcagatgagggaaggttgtgagaagaactcaacctgccattgctagctttgaagatgaaggggagacctactgatcgggtaggagatgtgctctaagtaggcattattggcaggcttagtaatgcatatattttgaactaaaataaccccaatatcattaggggttattggaaatccaaagtctcaggccccatcccagacctactgatttaaaatcatgttaagatacgaagtgatttgtatacactttcagagacagggtcttggtctgttgccctggctggagtacatcagcgcgatcccagctcaccacagcctcctgaatagctgggactgcaggtgcacacaacacacttggctagcttttcaattttgttgtagagacagagtctcactatgttgcccgtgctggtctctaactcctgggctcaagcaatcctcccacctcagcctcccaaagtgctaggattataggcatgagccacagtgcctggccaaagcccaactcttaaagcacctgtattcatttgcagtctcaaccctgtgtcagactacctgtttccctagactcttgccagtaatgggcatttatccttcataaaaattattttccagatgaacgtagcaacgtgttatttgattttgtgtatctttggttactattaatgttaaattggttttcgtattagagtctcatattgcatttgtgtatcttcatttgtgaactgcctattcatggtcattcccatttttatcatttcactatttttccaaatgagaataatttttgttttgttactatatttttctgctcactgtaaaaacaattagaaaataacaaaattaaaagaatgtgatactcaccttttatgtttgctcaaaataaaattatattaaggatggcattttatggcctactttttaaacagcatattaagatacaatttatggccaggcacgatgtcctgtaatcccagcactttggtaggccaaggcgggcggatcacctgagttcaggagttcgagaccaacctggccaacatggtgaaaccctgtctctactaaacaacaaaaattagccaggtgtggtggtgggtgtgtgtgtttgaggtatgagaaccacttgaacccgggaggcaggggttgcagtgagccaagattgttccctgaactccatcctgggtgacagagcgagactccgtctcaaaaaaaacaaacagaaaaaaacaggtataatttatacatcatccaattcactgatttcatttttttagtatatttatattcacagggttgtgcaactctcaccatagtataactttagaacattttcatcactcccaaaagtaatcctatacccattagcagtcactccctatttccgctcaccctcctcgggcctgtgaaacaactaatctactctctgtctccatacatttgcctatactggacatttcatataaatggaatcatttaacgaatggtcttttgtgaccgacttccttcacttaatatatcttttcaaggatcatccattttgtagcatgtatcgatacttcgttgctttgtattgccaaactatattctgtagtgcggatataccacattttatatatatctgttcattaggtgatggatatttgagttacgtccatttcgggggttgggctatcatgaataatgctgctacgaacatgtggacatatgttgtcatttctcttaggtatatatctaaaattggaattactggatcatgtggtaattctacatttaactttttgatacagctgcagacttttccaaggcagccgcaccattttacctgaccactagtagtatgtaagatttccagcttatccacacccttgccaacatttgttatcacctgtgtatttgattagtggttttgatttgcatttccctaatgactcttgatgttgagcatctttttctgtgcttattgaccatttgtatgttttttcctggagaaatgtctattcaaaccttttgcccatttttaattgagttttcattttattattaaagtataagaatacttcataggttctgatacaagtctcttatcagacatgatttgtacattttttctcccattctgtggattgccttttcaccaacttgatggtatcattagcagcaccagggtcttgaattttgataaagtcccatttatttatttttcctttttcacttgtgcttttggtgttacacctataaaaccatcacctaacccaagctcatgaagttgctcctgtgtttccttctaagagttttaaaatcttagctcttatagtcaggtctatatattagtgtcctatggcttttacaacaaattaacaaatttggtggcatcagataacaaatttattatcttacagttccagagatcagaagtccaaaatgggtctcactagactgccatcaaggtgttggcaaaaccgcaggccttgtggaggctttaggaaaggatccctacttctggctctttccagcttctggaggctgccacattccttggttcccaggtccccttcatcttcaaagcctgcaatggcaggttgagttcctttcacaaccttccctcctctgcctggcccttccacatttaaggaaccttgtgattaattgtgcctaccttgataatctaaaataatctctgtattttaaagtcatcagagtagccatgttaattccatctgccaccttgttttccctttgctatgtaatgtaacatattcacaaatttcagggattaggacgtggacatcttggtggagacattattctgcctaccatgatctatgatttatttgtttaatggacaagtaaaaattgtatatatttatggtgtgccacatgatgttttgggtttatgtacacattgtgactgagtaaatcaagctaattcacttatgtattataagaacacttaaaatctctcttagcagtttccaagtatataatatattattattaattatagtgaccatgatgtagaatctttgatgtgttttgagttaatttgtgtgtgtatgtgggaggaagtaggggtctatcctcattcttttgcgtgtagatatccacttatcctggcaccatttgtggaaaagactattcttcccttattgatgtagcctacttttgtcttaaaatgtaacatcaaaatgttgttagtatcagcagtcaatggcatggtcactctaaaggattggataggagttcactttttggatataccatagtgtatctaggacctcccctacggttagacattgagtccaacctttcacagttaacattgtctttaagggttttgtgtttttaaaaatatattgtggacctgagccctttcccactataaatgttgtcaattatctttgaaatcattcacttctttccaccatcccagtttaagctcttagcccttttcatctggactacagccataatcttctaactggtcttccagcttccattcttgcctccctctaatcccttcgccatacaacagaagtagcctttgcaaaatgcaaatctggtcctataactgctgcccttgcccttaaagtagattctcattaagagaaagaaaaaatctctgcaacatggcccctccctttgtcctcagcccatctgatactgggctggctcccccttggttgcttctattcagccatacccccttcctctcaagtcatcaggaaggcaagtattgctcctctcacaagccaatctctctaatgaggacaatctccctatattaccatatatctttcctttgtaattcttttcacattgcaattctaaatgtatttgttgggtttcattaatgttggcatcctgcaccagacaaaaagttccgtaatgataagaattgagtctgtttttcctggttcaagcagatgataagtactgatattttcagtaaatggacaagtgaaatacattctctactgtgtatttggctttaaaaaaatttttttttatttttttatttttatttttgagacagagtctcactctggcccaggctggagtgcaatcacaatcacgtgttctcgactcactgcaactgcctcctaggttgaagtgattttcacacctcaccctcccaagtagctgggtttacaggtacatgccaccatgcccagctaatttttgtatttttagtagggatgaggtttcaccatgttcaggctggtcttgaactcctgacctcaactgatccacctacctcggccttccaaagtgctgggattacagacatgagccaccgtgcccagcctatttgtcttttaattctgtttatgatattttcaacttacagaattttaaaatatatatacaaatatataaatattttcttttgtgtttttgtcttcattatagctctgcttaaaaatccttccccacattaagaatatagaaatatagacacatttccttttacagttttcatacttccgttgtttgcataaaacctataatccacctgcaatttattttgtcattgatataaattagagaaataactttactcctcaagtggctggccacattcccaaccctttgccttcctttccttgatgatttgaagtgactcattgattgcacacgaaatccctctacatgtttagtcaggtaaatgatctgtctcttctgtcgctggttgtttttgccactgttttcattattacggcttcgtgctatgttttagtatctgacagttaccttttgtaagaaaataagatttcataaaataatactttgtgcaatttgaattaaggttttctagacagataattattgcttgaagcagtggttcccaaaccagcaggcatccacagggcttgttataacacaaatcaatgggcttaacccccagagttcctaattcataagtctgggatgaggcctgatagttgcattttaaaacaagttccctgatgatgctgatccagggaccatagttgagaacctctgccttagagcaaatacttgaaacaaagaatacagtcaacatgagaatggttccaatgcattgtctgaactagctcccctgtgtgctgtaagagttaggatgggcctgtatggtttttttgagcatctccctgattgtgtctctggcccttctcctggccccactttaaatccctgagcccagttgagccaagtaacataaccctcctttcagtgaacctgcaaggtgctcagcctaactgcatggctgccctgatagttacaagtgctgatccagccaggctttggcccctttcagatagaaatcagagaagggtaaggatgcagtgacttgctttgttgtagattctcatgattgtccttatctttgaagagaagggagagcaatcaccagaaatgcagcagagaactcttctttgctttcctcatttcccacctctgtggctctttaatggcttcttggttttgtacaaagggagagttaattactaacacctgcttctgcttctcctttcctgcatggccagctccctgactgatagccagctgctttcttgacaagagactttttccacctattccacacaatgtcagcatatgtaaagaaataaacatagtttgaacactttagccataccatatggacctctgtggagaaacctgcatcttccttcttccttcataaagaatacacattctttgcaggaggtaaaatagccttagaggtgacatctgctatggtttactcttctttattagtaagaggtagtgcacaattatattttacatgggatgtgtggttttaggcatcatatgttcattttccgtattttttgatactctcgtttgtaccactaacattttctctttttaggtcacccaaaagttaggttgaaattatttgaatttccttgaggaatataccttctgggaatttctcctctgcgttttctgttttctggtatctaagatgaaccattagaagacctcccgtcataagcagattagagtttgctataaagccctcctttgcatccgttctcttgtttggcattcattgaatcaggctatctgtgtgctgactcttggggccacagagaaaaagatgcatctcttgttatggagggctcactctgtattgatgaagacaacacattaattaacaattacaacacatcatgataaatattacactggagataatcagaggatatctggagacagaagccagggcagtgccctcagcttgacagggagcctgatgagatataactcctagaaaaagtgacatttaagggaatcattgggagcaaggaggacttgtgcatggcttcatttctcttcttaactattattacaaccattatttcattttatttacttttttttttttttttttttgagatggagtctagctctgtcgcccaggttggagtgcagtggtgtgatcttggctcactgcaacctctgcctcctgggttcaagcgattctcctgcctcagcctcccgagtaactgggattataggcatgcaccaccacgcccggctaatttttatatttttagtagagacggggtttcaccatgttggtcaggctggtctcgaactcctgacctcatgatccacctgcctcaggctcccaaagtgctgggattacaggcctgagccactgcacctggccgccttttttttttttttaaacgagtctctgtcacccaggctggagtgcagtggcaggatcttggctcactgcaacctctaactcctgggttcaagtgattctcttgtctcagcctcccgagtagatgggattacaagcacgtgccaccacactcagctaatttttgtatttttagtagagatggggtttcaccatgttggtcaggctggtctcgaactcctgacctcatgatccacctgcctcaggctcccaaagtgctgggattacaggcatgagccactgcacctggcctcctttttttttttttttttaaacgagtctctgtcacccaggctggagtgcagtggcaggatcttggctcactgcaacctctaactcctgggttcaagtgattctcctgtctcagcctcccgagtagatgggattacaagcacgtgccaccacactcagctaatgttcgtaattttagtagagatggggtttcaccatgttggccaggctggtctcgaactcctgacctcaagtgatccacccacctcagcctcccaaagtgctgcgattaccagcgtgagccactgcgcccagcctcattttatttactttttgaatagcaatacattcacatgtttgacagttcaataagtatgaaagggtatatagaaatgctgtccaccagtgtggctatttttctaatagccacattttaaaaagtaaaatgaaacaagtgaaattaattttaatactatatttttttaacccaacatattcaaaatattatttcaacatcaacccaacataaaaatatatgaatgagatattttacattcttttgcttataccaagttttcaaattgtatgaagtgcattttacacttacaggatattacaatttggaatagccgcatttccagtgctcagtatttgtgcatggctaagtggctgcagtatgagacagcacagatgtataataataaattttcctcgcatttctgtcctgaagcaactcagtttccctccctagaggtaaccattgttggtagtctccagtgtgttcttccacagatagcacatagacaagcaattataaacatgcatatgcaaataataggatggtaatcacacctctgagcatcttacttttttcactcaataaatcttggatatgtttcatatcattacataggaagcaaactcaattttttgttgttgttgcttcagggtacctcattttatggatgtcacaaattattcaattagtctctattgatgggcatttaggtggtttccaatatttggtgcttatgaacaatttgggctaagtttttagagacaaaaagcaacaggagctagctcagtgaggatgggggaatgacctttctagagaaagggagtaccaggaaagaaggtatggagcacaaggacacatggtatttgagataatttcttgtggcttaagatggctggagaatgaagtgtgtgtgaacacaagacaggaggaggaggctggaagggcaggaagagaacgtattgcaaacagtcttgtaattgtcatatgaagggatttggacttcatcccaaaggacactcatcaaaagattttaaggagcagaggagtaaaaataaatgtttgaattaataaatatatggaggaggcgggacaaatcatccatactgctgaattctggttaaatgcagaaggcatgagagaaacagaaaatcaccattagaacactgcagtaataattactgcaggcaagatctacagatgagtattaaaattagcagagaaaacaggacatttgcatagcctcaaagtatctcctctaaaatatttatgaatttgtgatggttttaacatatgttggaatattctttgatactccccctccaggaaggagatcttaattctatgggatttactgattcatttctaatgaataggctatggaaaaggaaaaatactatctttacagtggagaaacctggcagataccacctgaaccacatggtcaaggttaacatcatcagtggtaagtcatattgaaatagaatacccctgacgaatgtgataagaagggcattttgcttctatagtattcttcgtaaaaactcattaacccctgtctaatcatgaaaaaaacgttagaaaaaaacaaattgggccgggcacagtgtctcacgcctgtaatcccagcactttgggaggccgaggtaggcggatcatgaggtcaggagatggagaccatcctggctaagatggtgaaaccccatctctactaaagatacaaaagattagctgggtatggtggcgggcacttgtagtcccagctactcgggacgctgaggcaggagaatggcgtgaacccgggaggcggagcttgcagtgagccgagattgtgccactgcactccagcctgggcaacagagcaagactctgtctcaaaaaaaaaaacaaaaaaacaaaaaaaacaaattgaaggataatctaaaaagtacctaagcagtagtcctgaagagcatcaaggtcatgaaaaacaaagaaaggctgagaaatggtcacagaccaggagagaccacagaaatgtgatgactaaatgtaattgtggtctcctggattgggtcctggaatagaaaaagtacattttggagaaaaactggggaaatgtgagtctgtagtttagttaatattattgtgccaatgttaacatcttagttttcataaatgtatcatagttatgtaagatgttaacattgtgaagagatgccatgatattctgtgctgtctttgcaatttttctgtaaacctaaagttatttcaaaagaaaaaagttagaaaaaaatcaggagagtgacatgattggagtcacattttagaagatcccagtggctgcactgggaaagaggcctggaaggagaagagaacagaacaagaaggttgctacataaagtcaagaagagatgatggagggctggatgggagcagggcagcaggaatgtggggccatagacctgttggggagctctctagaaggaaactcaatcagacccaatgatggtttggatgaaaaagcgagggagtgggaagaccctgttgtcagcccctgggaattatatggataatgatgtcatttactgagatggaggaaacaggaggaagaacaggtttcagggaaacactagctcagttttagacctgttgaatttggagtacatttgaggaatgcaagtatccattaggcaactgggtatatcgacctacaggtcaggagggagacctggctacagatggttgtagagaatcacagatgtgggccgggtgtggtggctcatacctgtaatcccagcactttggcaggccaaggcaggtggatcacctgaggttgggagttcgagacctgcctgaccaacatggagaaaccctgtctctactaaaaaatacaaaattagccaggcatggtggtgcaagcctgtaatcccagctactcgggaggctgaggcaggagaattgtttgaacacaggaggcagaggttgcaatgagctgaggttgcaccattgcactccagcctgggcaacaagaatgaaactccatctcaaaaaataaaaataaaaaaagagtcatggatgtgtaaagcattggggccattggaaggataggatggcccaacaagggcagatagagaggagacagggcctagaatataggaatttaggagctaggcccagggtgtgtcaaggagtccagagcaatggtaacaaggcagtgctgtcattaagagtcaggctctggacaaaggcttttagggtcagaatgccgactgccacctaccgctgtgtgacatggagcaaattatttaataagactgttgtcatggttacatgaaactattttaaaagtttttaaaataattttagtaatactgggctcatagtgctcaacgaatgttggctgattagaggcaaaggaaatctagagccatagccctggaagctatggaaagagagtggttcaaacaggaggacatacgtttcacacccattaagatggttattgtcaaaaaagtggaaaataataagtgttgtcaaggaggtagagaaattgaaccttcatgcattgctggtgagaatgcaaaatggtgtcaccactatggagaacagtttggtagcttctcaaaaagttaaacatagaattaccgtatgattcagtgattctactcctagatatatatctaaaagaattgaaagcagggattcaaacagatacttgtacagccatggtcatagaagcattatgcgtaacagccaaatggtagaaacaatccaagtgtccattaacagatggatgaatgaacaaaatgtggtatatccatacaatggatattgcttaaccttaaaaaggaatgaagttttgatacctgttacagagtggatgaaccttgggaacatgctctgtgaaataagtcagacacaaaaggacaaatactgtagtgtatgattccacttatatgaagtacctagaccaggaaaactcatggagacagacagtagcatagaggttgccaggggcttggaggaggggaaatggagaggtagtgttcagtgaatacagagtttctgtttgggataatggaaaagttctagaaatgaatagtggtgatggctgcacaacattgtgaatgtacttaacgccactcaattgtatacttagtaatggccaaaatgataaatttatgttgtctatatgttaccacaatattaaaaggaggacatggttacagagaagtaaatgagttcttagtgattctcttttgaattttgtgacacaggggccattggtgacctttccagagcccttgcagtagagcagacaggtcaaaagattgcagtggattgaagggtgattgagaagtgtctagaccaggggctggcaaactactgtcaaatctggccgcctgtctgtttttacaaataaagttttattggaacacagctacacccattcatgtgtgtgttgtctgtggtttcctttgtgctataatggcggcgttgagtagttgctacttgagcccacgtggtctgtaaaacctaaaatatttaccatctggccttttacagaaagtttcccaacccctggctagacaacactcctggtctttcaagaactttggctttcttaaataattcctgcatttctcatgaggttactcggtagataactttgcccctttagttaggtagcagaacagaaccaaagctgaacagtaacaatgactaagaaggaggaagaggaaaaattcattcctttctttccttaactggagatattatcctcactatacctttttttctcttacagccctgtaaaaaggaatgaaagttcttccctccctgtcccccaccaaaaaactccccactggtaaatggtcatgtgactggtgataataaactttctgagatggctacgaactgcagttaggtttaaagtttcctcattaatgcaggaaaatgctcataacctgaggcttttcaagtgtttattaatttactttctggggctggctgctgatacttatttcagatcaaagagaaagcctgtgtctttagtagttactgtgtgccaggaactatgccacattttgtgcctaggtgagctcattgatagtcatcataaccataggatggcatttccctatttcacaggaggggagactagggctcaccagggttaaatactcacccagagacacacatgaagagtttgaagtacaactggagtttaacccacacctgcctaattccaggacctcagggtgtttccactgcaccgtgcagtcatcctatcctctgtggccaccaagagcctcagaatagcaccttgagcccactctaggcagaatacagtacttgatgggttctaatccattttaaaccatggtctctgctatttcaggataacaggtgaccatgtaaagtgtatctcaagtgcattgtaggctttaggaagacccttttcccagcctgctccccatgctcccaagccccactttgatggtctatgtgagtctactcagaggtagctcttatttctttaaaaccatcctgcatttcagtgtactctgacagcactgtctgacacttgggattcacttgttcccatgttaccacctatttttacattttctgcaataattcctcaagctcttggttaggcatagtgacccagggatgcagcaagagggggatataatggcttccacagttcccatccgtttgtgtctatacaactggtgcacaaacacacatcacccttgtgacttctgtccctgttgaggctgcccttgataatgcagcttttaactgcctagatttctgcaaccatcaaatcagatctaaaagggaactcagaagtcattcacccaacctttgtataagtgagaaaaataaactgcagcccagagcggactggcaacttgtccaggcaaacacagcttgtcagtcccagatcctggactaggaaggccctggctctccccgttcccagcccggagctcatcctgctgcaattcactgcctcctccctgcctcagtggacgaggtaggggctgtccccctgcatgtggcgtgcttaccttggaacccttttcatgaatgagaccagatgcagaactccacattgatcatttctgtccctcccctttctgctttctgttaaaggcagccccccagctcccagctggctcctgtcccctcccccagccgggagaagttattacatgaagagatcagcttaccagttttcttcagaacagaggctgagctcgaagcgccgggcagtacagtgagggagagccgagggaaccagcgcggtgcctagcggaactccagggctggaatcccgagacacaagtgcatctgctagctgttagcacttggcagacggagttctcctctagggtagttctaactttgggtaataatgtttgtcagctacctgatattaacattgctccacgttcaaacagcagtgttagcaagacctgggggagaggtaagccaaataaaatatcttgtcagaagttgtattttttttcagcattatatttcctcttctatctaccaagagggatcagggaatggaattttatggggtgcaaagagtaatgctttatattacttttgtaggcttctcttgccttttcttatatgaagacttcttttcttcttgaagaattttatactttctaaaatgtcattttgaagctgtctgtgcagttgccacactgggaagttgctctggccttggtgacagatgcctgtagcacgcacgcttctcctgctgtagcagaaaaaaaaaaagatgtgccatgtcagatttcgttagggactgttaccttttgagaatttttctccagtgctgcagagagaatgtacatgctaggggaattgcttttcttccctgcttttgcaacacttctctctttttttttttctttgatgtgcttagaaaaatctgtgcttaactttctatcatagatttgaagagggagaatgatatacaacagggctaggagtgtacccagatgtaccttagcagggagacatattttaagttcatgaggatgatttattattactggtttagttcatgtgattgttgggtacagtttttttttttttttaacatcagtgatacctcctggagtcagtttttgatgcaggcaaagagattgggatagatgatcattgagtccagagagggaagcaccttggtgtatccaccctcacctgcaaacaagcctgcaacgtatttccctcatccactcctttccctccttaccctgatgcctgagtaacgaaaggacagcctttctcctgcatccatcttcgtctttgaaaagccaaatgaaaagtgtatctcctaaaaaggccatgaggccacttcacagctttgccttttgttagccttgtcagggaccaagcaggctctgaaagcctaatgtaattactttcccttgtctaagaagagtggaagtgggagtgctcccaagcccacggctgcaaggctagctgtggtttcagcaggcttgttgctctgttcaaaacagacatgcagctcagagacatgcagcaacgggtcacttgttgtaggcttttcacttattagttactcatgtcctctgctctgtagacattttctgggcctgtggggggattgagcccttgaatgggagcaggaggaactgaatgggtgagtgatgctggaagctgaaagcagaccattgccctctagttgtagttgaagttcgcaatttccctgttgatttttttcgtgtgtagagtgaatgacaaatgggctggcctcactcagcctggagcatttaagcaggcgagaggagagctcatatggaaaatatttctatcaccgctgcatgcacatatggtctggggagacccccgaactgagcaaatcacagtgctccagcagcccctcagtggtgtgccaattattcttattaacagcaagcaaagggcaggctttagttacctgcacacagctgactcgtggggaaggccacgccggaatctgtgtgcccctagccttgtgtcacatgcagagtggcaaatggctctgcttcacctgacaatcagcaaagcagatgaaaaatgaaagggattatacaggctcacccaaatcttggtgcttttcagacagtgctcagcgtttgagagaggaaggcagaggttttgtcttatgagttaaaagtatgtgtgcttaacatgaatagctagaaaacccgatcagaggtagtgagatgcctgccctcctgcccctttgttccactctgctttgctaagtaaagatcctcttgggcctcttcctcttttctttcttgctttccctctttcccctagtgtgtgcatgtgtgtgcatgcgtgtgtgagtgcgtgtgtgtttctgtgctgttggctccagaacgcctgagctcctaggaaattatacaattaggattcctttttccttcttggaaatgaaatgatgaggaaggagcatgagtatgagtagcccccacctcttaaaaagaatgtagtttatatagagctttgaagaatgtggcatttatttataacagcctcttttttattgtcgtgttacttgcaaaacttacccataaacatgtggcgtcgtcactaagtcaccaggattttccttttctctgccagctggttttcttgcaggttttaattatcttccctttggatgttcctaaaaacacatgaggagaaggaagaatgggtaagaaagcgtcatacacctgggggcgcttggagggctgtgttctccacgtggggctggaagccaagcggcacactctgggaagcagtttacagtcagttttctagggtgtgaggtcctttcagataagcaggacctggcaggtggggagaggagggctgtgatgcaaagcaagccttgtttggcgtcctgtggctggcactgtcagtgctggtgactgtggtccaaggacagaacaacctggtatggtgtcagtgcatgggttggaggacagacacagaaaagaactgtgccttctttaattttcccattgccagagcattaaactcagaacagtgagatcatgagaatcccttttgtcttagtcaaggttagggtggcagtcgtgtacacttgtacagatggggcgtatccccgaaaagactgtaaaggacttttaaagtcaagctggacttttgaggcatttgtcagcgtggggagcgtgccaacgtgcagcttctttgcaggatgcagcagaatggcggggaaggggaggtgggaatgggaggcttgcattttctttcttgaacttggacttaccttctcagataagaccaatgagacattgttatatgtagggacagggagggagatgcaactagaaatctgctacattccatatttggaataatatgataaattctgcaaagtgtggtcaaaaagatgttctttaattttcttatttttgagacagagtcttgctctgtcgcccagactggagtgcagtggcacaatctcggctcactgcaagctccgcctcccgggttcacgccattttcccacttcagcctcccaagtagctgggactacaggtgcctgccgccacgcccggctaattttgtttttgtattttcagtagtgatggggtttcactgtgttagccaggatggtctcaatctcctgacctcgtgatccgcccacctcagcctcccaaagtgctgggattacaggcgtggatgttctttaattttgacggtacagtatggcaaaacctatcaaaatgaaaaataaatatcttagctgctgatgggtacagacaaggtttcttttcatggtgatgaaagtgtcttggaattaggtagtggtgatggttgcacaattttgtgactatcctaaaaactactgaaccatatcctttaaaagagcaattttatggcatgtaaattatatcacagttttttacattaaaaataaataaatgtcttttggatccagattttccatttctaagactttttatcatataggtctactctgagtgtgtaaaatgttctatgagccacctgtcataattaggtcctttccatcctactgtcctagtgataaggcatgctgtgcatttattcagaaagaatgaggtagctctagatgtgtaatgaaatgactaccaggatatgcttttaggtaggaaaagcaaattgaatgtgcataaaatgctcccattgtgtaaaatgtgttatcgactataatcaccattgcaaatgctaccaagtgtattaaccctgtgctgaaaaaagaaaggtgaaaagaccagatctttgtatttgatgagcttatactctaaaaggggcacagaatacaaacagtgaatgatcatgcaataagggtctctcattaattgcaagagcaatgggaagctacctaagaaagcaaagaaagattccacaaatgatgacatatttgaactgaggcttgaagggctgtgtgttgggggtcttcaagataacccctaagattcaattatctgtcgtgattcagtgacttagcatacattggcaatcacagctatgatttattacagtgaaagtatacgaagaaaatcaacaaaaggaaaaggttcctggggtaaagtctgggggaaacgagatggaagctcccgaggtttttttttcccagggaaggcacgcaggacccacttacttcccctagcaatgggttatgacaacacatgggaaatgttgccagctaggaagcttgttagaggcctagagcccagcatctttactggggctgaccacatgcacaccctctgcctgccagctaacaaaattccagactcccacaaggaaagcaggtgttcagcataaaccatattgtctatacagtagaggcgcagcaagcaagccacccttaccagttctgggaatgatgggaaccctccccaaatccaagttaccagatgccagcctagggccagccttgtaagcagatcttttcaaggagagcagtcaggtctgcaatcttaactcttttctgatggataagtaagcactttaagtgggaaaagagggggagcattccaggcagagggaaaacatctatagagccccagaaataagaaaggacatggcatgttctggaaacaatgcatagttcagatcacagaagcatccattgtgaggggatgtggcgggaaatttgtcagtcagctcgatcctgagaactggagtttttctctgggcctatgaaagttctcaaaattctagatctacagtcttaagattatctttttatgacgtgtcatttaggtcatcattgcaggacattttcttcttcataaattatttcctaaggagtaaatcaaattaaataatgaatgtaggactgctttgtaagcagtgacaccctttatttaaaaaactagttgtcactcttcattcctagagtgttatttgtggcaaatagaaatgaagggtcaatgtaatgaccttaatgactatttcgtggtacacaattctccctggctttgcctttctttttctagtatctaaaatagccagtcagctatgtggaactcacttgctaatgcaagacccaagtttgagctttgggtcaatcacttgggtgaaaactcaccatatgacttttctcatttaaatgtttttgttgttgttgttgagacagagtctcaccctgtcacccaggttggagagtagtggtgcgatctcagctcactgaaacctctgcctcccaggttcaagagattcttcggcttcagcctcccgagtagctgggattacaggtgcccgccaccatgctggctaatttttgtatttttagtagagatggggtttcactctggtctccaactcctgacctcaagtgatccgccctccttggcctcccaaagtgctggaattataggcatgagccaccgcaccagcctagcaatttttttacattataaaaactattgtaaaaacaaattcaagcaaacaaatacagagaataaaagttaaaggttcttctttaccctcattctctcccctatccttcttccctgccaagatgaaatcgttgttaacaatttagcatctgtccttctagaaccattcttgtacatttataaacgtaagggtatgtgcctatgtgagtgtctgtgggtttatgtgcatatgtgtatgtgtatgcctatgacttgcaatggcagagtttttccttcttttctgatacctgtgcttcttgtttctacctcatgtctaactgcatttgctagaacttccagaatacagtactgaataagataaatgaatgtgaacgttcctgtcttctactagacttttttttttttttttgagatggagttttgctcttgttgcccaggctggagtgcaatggcgtgatctcggctcactgcaacctccacctcccgggttcaagcgattctcctgcctcagcctcctgagtagctggaattacaggttttgtgccaccacacccagttaatttttgtattttcaggagagactgggtttcaccatgttggccaggctggtctcgagctcctgacctcaggtgatccacccgccttgaactctcaaaatgctgggatgagccactgcgcccagctcttccagacttaaatgggaatgtttctaatatttcatcactaagtatgatacctgtcacagatttaggtagatacattttatccagttacaagtttatttctaagtttttatcaggagtgattgctgaattttatcaaatattgtttgcctttatcaaaatgctcatatgagttgtttccattaatctacttacatagtgaatatattatggatttcttaatgtcggactgtctttgcattcttggaattaactatcttaatcatgatttcttcattaaatttgctactgtatttgatttataaatattttaaattttttcttctttttaaataagtgttattggctctcggctgtattttattgtgctagaccagggttttgatagttttgtaaaatcaattctgaagtctttcatctttttgtatgctttgaaacagttttgttttgttttttcgtttgttttttgtttggtttggttttttttttttcagatggagtctcgctctgtcgcccaggctggagtgcagtggcacgatctcagctcactgcaagctccgcctcctgggttcacgccattctcctgcctcagcctcccgagtagctgggactacaggtgcccaccgccatgcccggctaatttttttttttgtatttttttagtagagatgggtttcaccgtgttaaccaggatggtctccatctcctgacctcgtgatctgcccgcctcggcctcccaaagtgctgagattacaggcgtgagacaccatgccccggttttttttgtttgagacaagatctcactctgtcacccaggctggaagtgcagtgccccaatcacgtctcactgcagcctcaacctcccaggctcaagtaatcctcctgcctcagccttccaagtagctaggactacaggcatgcgccgccatgcctggctaattttttactttttgtagagacagggtctcactgtgttactgtgttgcccagactcgtcttgagctcctggacccaagtgatcctcccacctcagactccccaactactaagattacaggtgtgagccaccacacccagcctctgaaacagtttaaacaaccaaaaagttaccttttttttttttttgaaggtttattgaactcaaccgtaacaccatccagctctttagtggagtgatggtatttgagtatctttttaaccatttattttatttcttaaaaaggcataatactgaatatatgtaggagaacatatgtaatatataagcaattatgaagtagtataataaagcaaacacgtatgaactcaccacacaactaaagaaatcaaaattcccagtactatgcaccactccccactcatgtcctcctcgcttctctccttgaaagacaaccatcaccctgaattttatggttttcacttcattgcttttatttataatataatcacaggtgtatgtgtgtctaaagaatatgctatttgggccaggtgcagtggctcatgcctctgatcccagcactttgagaggtgcttgctagaacttccagaatgcagtactgaattggcgggtcatggagaatgtgtttgtttaactctacagttaatgtcagattgctttccacagcagttgtattagttttcatttccactagtagaatgtaaaagttctcaatgatttatctcctttccagtattaggcattatcagacaggttaatttttactgatatataagatataaaatggtatcagtgtatgctaatggacatttctctgatcattaactattgatattgtataatgtttatgtgtatacatatcattcacgtttcctcttctgtgaaatgcctgtttgtatttattttctggttttaaatttagttctttgctttttcactactgatttaagagtgctttgtgtatcttgaatatgaaccctctgctttttattccatgtaatattttctccactttatgacttgtaaagtgtctttagctaaacagaagtccttgattttagtgtatttgaatgtatccattttatttctttgtgttaacactctctttttcttgtttaggaaattattgatcccaaggttatagacatagtctcctatattgctttctaaaattattgaggttttgcacttcacagttaagtttttatacacttagagttaaattttctgtatggggtaaataagggatctaatttcatttttcattaagggatctaattttcttttttccccatattggcaatgagttactacaggaacatttattgaatagtctttccctttcaacaaatttccagggccatttcttttcagtaccaagtttccatatatatgtctatctttttctggcctctgtatttgctccattggacatttctatgtctgtacaagtaacatgctgtcttaattactatggccttataataatctgtgtagggcaaatcagttcgcattattctttgggagtgtcttagttattcttagacatttgctcttccttatgaaatttgaaattatcacatcaattttccttgaaaaatcatttaagaatttttatcagtattgtattgagtctatagatcaatatgagaacactaaaatcattctgacattgagccattctatccatgaacatagtgtataagctttacatttaattaagtcttctttgacattttctaataaagttttacaattttctacacaaaggtcttatacatctttattttatatttaatcctaggttccttatttttattataaattatgtgtatgtttttctaattaattttttattttggttgctaatgcttagaagtccaaatgatcatctggccatggtggctcatgtttgtaatgctggtagcactttgggatgctgaggcaggcagatcacgtgagcccaggagttcgagaccagccctgggtgaaacccgtctctacaaaaaaaataataataattgaaaaatagaaaaaatgttagctaggcatggtggtgtgtgcctatattcccagctactgaagaggctagggtgggaggattacctaaacacagggaggctgacgctgcagtgagccatgatcataccgcttcactccagcctgggtggcagagtaagaccctgtcttaaaaaaaaaaaaaaagtacaactgatgttatatcaaaacagctttctaaactcttattaatttaaatcagttttatgtaggaacttttgtaatttctagtacataattatgtaatctgtgaataatggccattttggcttttttccttttccaaattcttgtatatctaatttcttttttaatggccattttgagtttgtttcttttccaatttttataatttttatttcttaacctttgcaatggctagaacctccagcaaaatgttgaatgggggcagtattattttgttcctgatttgctcaagagaacacttctgacattctgccattgaaaatcaagtttgctgtaagtttatgcttgtattagctcaataaaccctcttctattcccagtgtactaagagatttattttttaaatcatgaacatgtgttgaattttatctgacacattttctctattaagatgatcatttggttttacttttttaatctgtcagtgtgataaattacagaaacagattttataatgttaaactatccttgcattccatggataaatccaacttggttatgatatatttctatttttattaaattaattttataacatgactatttttaagagggttctttaaaaaaatatatatttgagagtgcctgtaaacttttctttcttatggtttactttcctgttttgctataaggctataccagtcttataaattcatttcagaagtactgccttgttttctaatgtctggaggattttctataatataaaattattgtaatttattcctagaaagtcacctaaaaaactggctaagcctgatgtgtttttcccccacagggaaattttaaaccaccagttatttttatttaataattataggagtattaaggctttctatttattcttggaaaatgtttaaaagttaaatatgtctaggaatttgtccatttcatctacgttttccagtttattaacataaatgtgttcattataccttctaattatctacagcatctgcagatctccaggtgctgcagagcccttttttgtttcctaatattgttcaattgtgccttttattttattaaccattctttccagaatactgtaaattttactaatcttcataaaaaaatcaacttttggctttgttcttcctcttcattgaagctttgttttctattccattcaattctgctctttccgcgggtttatttatgtcatcatttttttctttaactttagtaacttttaaaatttatgtgggccgcatgtggtggctcacacctgtaatcccagcactttgggaggtcgaggtgggcagatcacttgaggtcaggagttcaagaccagactggccaacatggtaaaaccccatctctactaaaaatacaaaaattaaccaggcatggtggctggcatctgtagtcccagctacttgggaggctgaggcaggggaatcgcttgaacccaggaggtggaggttgcagtgagctgcgactgcaccattgcactccagcctgggtgacagaatgagactctgtttcagaaaaaaatatatgtgtgtgtatgttcagctcatttatttttagcctttaatctgttctaatgtattaaagatggcaattttttcttgtagtgttacttatgttgcatctcttaagttttgatatacagtatttttattattagtcagttttaaggtttttttgttttgttttaagacagagtctcactctgttgcagtggcaggatcacagctcatacagcctcaacctcctgggctgaagtgatccttccacctcagcttccccagtagctgggaccacagatgcatgccaccacatctggctaattttttaaaattttttgtagagatggggtctttctatgttgaccaagctgatcttggacttctgggctcaagcaatccttccaccttggcctcccaaagtgctgggattacacacgtgagccactgcccctggcctcagttttaaatatttttaaaatttttcattatgatattttctctgacccaagcactatttaattatatttttaagtatggagggtttcggtgtttttttaaatttgaaattaatttctaacttgattatattgtggtctgagaatgtggtatgtgcgatgctgatttttctgagatttgttgagacttgctttatggcttagtatgtgagcagcctctgtaaacacgccaagtgtgcttgagaaaaatgttggttttgatgaacattcttgataattggttcggagacttttatatttctattaaatcaaggttgtagattaggttgttcaagtcttctgtgtcttttctaatgtgcgctgcctcatctgtcagtattcgaagaagacatgttgaaacctccctccagcatctttgttggcctgtggaggggtggggcatggctgacctcagcattcttcaggcaatcctttccttgatgttagtggccactctagcttttgctcactgtacctgtggtttctgagtttagaattttttcatctctgcaatagtctgttttggtggtttcttctgctgtggtttcttgccaacataaactttctaatatccagaaattcctcagaatgttttatctggtaatcatatcctttcttgttttatagttgtcattacaacttgtgtgttttctgcgatttgaatggaattttgcaaaggaaagaggaaaacaaatacctttgctcaatctgccatcttgaccctacataagacacatttttatccttcttttcctcctttttttttttgcaataaatgtttattgggcaagtaatttttctagacctctgcttctctaccttcttcccataaaatgggaagaagaataatattcatcgcaatgacatataaggaacattaataagataatgttcatgaaagtgctttgcaaactgtaaagatttattcaaatgcaaaggatggcctttagttccttactttaactcactctccttttgtgtagccggtgttataaagcagctcagctacattagagaaaagtgattaattgtggttagcatatcgtgagaggctcaaacaaaattttattgttacttcttgagaaaatttattgccaagaaactattgaataccttaagagaaagtcacatatttaataaatgaaaatattatttagtctaaaaactaatgctacaatgagtatcttttttcctccctattgtcttatactatacttttgacatgcatactcaattaggcatttctcctttaaaaataacattttacttaaaaaaccttattttctgattcagcatattcaataaatttatttactttagcttagaaagttaatatgaagcaacagaaagaatgctgaaatttcaagcaaggcatttttaagggacaaaatgagtaattgatgtaaaagacagagtggtttatatcagaatgtattgaattctgcctgactacaatatttttcatattcctacattgcaccaaggcaaaataaacaattctgaattaaattcaacaaccatgtattgagtgctattttttgtgtcaagttttgtgctaagtgctgtggaattcataaagaggtgagacccaatctgccctctaaagacaggaaacaacaaataggttagtgagggctaagatataaattactctaataaacatatcacactcttttgtgagatcaggaacagcctatggagaaagtagcatttgagatgggattgaagaatgcttaggggtttcgtaggcagatattagaggaatgcattccaagtcatttttgtaaatgttctgtggaagcttgtaaagatgtactttccatttgtgttataaatatagttgtatataatacgtgtgcaattttccatgtaattgtatcatttcttttctctgtgtgggtatgctcttatatttcttaggttctactagaagtaactaaaattaagtgacttcctaagtatgttccagccttaacattatctgaatgtaggagtgaccactaaactacaaacacatatcataaaccccttgaatagagttgatgtcttttgtatagtgggagaaagtccatgagctttcaaacacacaggcctgagcttgactctctggttcttgcttaggcaggctacaagtaagttcactaagcatcattctctttatcttttttttttttttttttttttgagatggagtctcgctgtgtcgcccagcctggagtgcagtggcacaatctcggctcactgcaagctccgcctcccgggttcacgccattctcctgcctcagcctcccgagtagctgggactacaggcgcctgccaccacacccggctcattttttgcatttttagtagagacggagtttcaccgtgttagccaggatggtcttgatctcctgacctcgtgatccacctgcctcagcctcccaaagtgctgggattacaggcgtgagccaccgcactcggctctctttatctttaaaatgggaggatcatgtcaatatcgtagagttttagtgaagattaaggaggtgatttccgtaaagtgtttggtatgagaatatgctcaatgaatggcagctatcaccattattaaaaaattgatctctcaagcctaatggagaaagattctttatatagactaagggaattgtgaaatctgtgagtgggtatttgtccaactgaagtagaatgcaaagtgagaagaatgagagggaattaatatggagttgggggtgagggcatcacccatgagaataaaaagacaaacatgggatcctagagaggggaggtatacagtcaggaatccggagtgtagctccaaattccttaaccaaatctgatgacccacaggctccgattggagagaaaggagaagaaaatatgtaggatgctttaaaatggaatgacagagtgagcagttgagaaagaagaaagagcaaaaaccaggatttccaaagctacaagtgtccataccctcccaggtggagaaggaagggctgggaagtcactgggattttctcagcaaagggtggacccaggactccttttaaaataaacacacacacacacacacacacacacacacacacacacacacacacacacacacacaaacactcactcactctctctcttctctagagccagaaagtgatgttaagcaccaaattccagtgtcttgaatcattatttaataaggaacctcagagataatctagtctaacctactgattttacatatgaggataatgaattttttggaggttatgtggcttgcccaggaccacacagttgtttaacccagacctggagggtgaatggtctagaaacaaaataatcttcacacacccagttgtggcttctgagacctttaggcaagggaaagcttgggggtacttggaagagagtatttgtggttttaaatcagatacagtttaaaccaggtacattaaatgtgttcaaagctatttgtaagatacctcagctgtatagtttgttctgtcagtatgcttgcgctatagagatggttagttttgtacatcaaccatctgagtgtgttggaaggtggtaggaagggaagggaaggggtgaaaccatgcctcctcattaatcaacttatcatattatgattcatcaacatattatttgcagagagcctaccatgtgccaggcattattcaaagtggttcgcatatatgccgataagccagacagacaaatatcctgacctcacgttctgacactcttgctcctggaagtgtagcagaaaagcaggaacctgagaactgccagggcctaaatgtaatgttatatccgtttcacagttcctgcttcatgcctattctaagtcccacctcttccagaacacctaagcctaccacctttggtccttttttttttttttcttttctgaaacggagtttggctcttgttgcccaagctggagtacaatggcgcaatctcagctcactgcaacctccacctcctgggttcaagcaattctcctgcctcagccttctgagtagctgggattgcaggcatgtgccaccatgctcggctaattttttgtatttttagtagaaacggggtttcgccatgttagccagctggtctccaactcctaacctcaggtgatccacccgcctcggcctcccaaaatgcatctctggtctttaaatgccctttgctgtatattctataacatcaagtctcagatctggtttgacctcagttggcctcttaatagttttcccctatgaacattctggtctcccagtaagcctgtaagcagctgagactgggaaaccatctcttatatcccacatcgtcctatggtgcacagcgttggacacatgatgcgtgagtacagcgcatgtttagtgaacctttacatcaccacactggagcagaaaagctgtatcatgactgatgaggacccccatcagaggcaagaggcatggtggagtcttgctggaggacccactagcaaaaccactctggaaatctcggatagtaaagactctgttagtaccctgaaggccgcttacttggaaccgtatcttctaaatgctctgaaaacctatccaaaggcaattaaaatcacaaatatcattgaaaacatctaagaactacgtgtaagcacttcgggatagtcaggtaaaggcggccctctaattatgaagcattttgataattaatagaattctaagccaaagcttaaatccggatacacatcataatggttaagccaaataacacttaatcattttaccttttattattgataaagacaacacactgaagtagacagacagtaaagaaaaagtccacatctttttattgggtccaaataacctgattgtaaatacttagcctctgattttcatgtttcagaatttgtatgttaatgaccttagtagatgtggctttgtccagcctcaaaaagggttgctctccagccagggccccttttttccagttactgctcccatctcctttaagtatattcaactggtgagtgaactctttatcccgtgtgacaaatgcgtattgaggccctaacatgccccagacctcagatgtgctgctcatacatttgaggtagccctgacttgttttgggggtgtgggggtgggcttttccatcagttgtcttggttgatgtgccagtcagccaattccaaattgcactgagttttcttcattttacttttgtatattaaaaactaaatagttttttgcagcatcgtagaatagattagaaaccaagacttctgtttcacaatttataaaattggacaaatgtattgtcagtgattctgcaatgtttctgcccatttttccctcttcaggaagttgtagaggtaagatgccctattcctgctatgcttatgttgggcattataccagaaactgaagattcaaaggtgggtccccactcctagaagcccttcaaggggcagaggttcccagagaggaccataatccagtgtgaaaactgttgtactgtgtgtggatcaagtgtcatgagaacccacgtaacagcatggctgattctgctgaggaaagtcagggaatgtttcacagcagagaggacattcaggttagggcatgttgcctaagtaggagtttctcagttgaagaagattggaggtggaaggggagggaggtaaacttctcaggcagagggaaaagcaggtgcaaaggcaggaagtctgtagaagttcagattccattacccaaaacccttgagactcagatgtgtttcagaatttggattcttttggatattccacatattgtacattatgcgtaatacaatatatattgtatattataacatataatacaatatatagtatattataacatataatacaatatatagtataacatataatacaatatatattgtatattataacatataatacaatatatagtataacatataatacaatatatattgtatattataacatataatacaatatatattgtatattataacatataatactatatattgtatattataacatataatacaatatattgtatattatataacatccccagcaggttctagtcaaatacatgaatatatccaggacaaaaaggttaaatagtcatactaaatgggataaggaagactatcaatagtatcacatcaattaagtcatgttttgtggccaaatgagtttgaacaccaaacttacaaagagaacaaaaaacaacaaccaaaagaacaccttaggtttttaagccttttgaatcttggaatcttgaatacaaggactgtggctgcaggtccagcagatttctagagctaactctcattaagctgactgaggtcacatgctcatccctgacccagtggagataaatgtgctgattgccaggctgaagtcctgggcacaccctagaatggcaggatgctcagcctgccaggatcacaaagtgacctcagagtgctgtttgcaggaaaatggacacttagtaggtaaaaatcataagcgataattatatatgcatcacagatgtacccacataatattgactgtgtaatgcagcccagagcagaaccaggattcagaccatcatctctcctattccagagcccacatcagattaggctgctcacacatcagtggaaaacagtctgccccatgtaacccactgctcaattatgtgatacagacaattagaacttagcaaagtacataataagttgctaattgcatggagtacagtgcacccattcgttgaaatgatttagagaagtaaaagactttagcaggctggaaggatgtgttagaagtgatggtagagaccttatccctctgatttctgctccagggactctctttttttaagtttaattgcaaacaaacactgaacttgaggagggaaggattaacaggcagattttcctgggccctgaatgaacctctgaaaccacaggacataaattacagaggaatggaaacaagggggaagcatcgtctaatttattgacaagggaagaaaagcaagggaatcattaagggttagaggctctaagccagcttctgaggtgcttagaacaaagtatgatgatggcagacagaagtaagtctctatgacctcatgaaggacttgtttctctgctttcccagaggctcctagaattgaaaccaactaaagacctgaaagggcactccaagtgcatctggcccaacgctccctgattttagttacaggaaatccgaggcccaaggaggggaaaaatttgataaggttacagcttaaagaaaaataatgactaaaccatttcttttctttctttcttttttctttttctttttttctttttttttttttgctgaaattcggtagtgaattcaagttctcttaaggcacagttattctataacaatgcgtggtttggaggttgtgtgttttctctttacagggatttaataaaataaaaatgcaaactacttttgaaatagctataagtaaaaatacccagaagtctgtggtcagaggcaatgtccatgtatttccttaattcaggatcagcccacagatttcaacaccagtacttactgagcatctactttgtggtcaggtgttagatactctcctttaatctccaccagagccctctgtgacaggggttgtgggggtagacagataactagcttgctgaatataacttgttaaagggtggggcttggagtcctcagccatgttgagtgataccgtgctgccccgagagtttctgtgctgtagatcctggtctcttggactgttttccccataattccccatccctacctttcctaccctgcaagattgtgttggatataacttgctcactaggccttcaaaggccgggtcattttcccccctggtttataaattggcctcttatcccagggccccccctctttccccctgctccccgctccccctgccattcccacttggtcatcaccttgagagatctccagacattggcatttctttccatggggcacctccctgtcttttcaccctgagtacttaactgggattctttgaaaaacacatcagcagagagtactgtcatttttttttttccctaaacacttaaactcacataggtgtggaagtttatgccaaggaatcttggaaccagaagggagcaagggaccaaccctctctcgttagagatttggaaactgcaggacagatagagtaattggcccaacttcgcatagcaacgctaaaagttaatttatgaagtggacccctcactcagagcagtgcccggatagctgtggcattcataatgtggaactgccctcgactgtactggcggaccctataagaggcagcacgttgcaatcatggtgtttcctggaagcattttaagacccctgttcactagatcccagagaggtctttgctttagtttgggttcccccagacacagctgagccaaggacctgagtgccagtggttcctttggcaggtggttctactggtgaaaacaccagcagaggacagaggaagtgagataggaagggaagcggcctgatacaggggtgtgatcaagccagtagccactgtgggcaccagagctgaatcctgctggagacatctaggagtcagtgaagcacacacctcagaattacccagcaatgaagcaaggaagcaggcatatttgtccaccagctcctttttcattgttagttgagtaccgctataggagcattacctctttagcacttccaacttgctcctggacaagaacaaagacacccccccacacacacacacacacacatgaaagagagtcacagtgtttctagcaaactgccttcaggagctgagagaggaaggaatgtagcagtgcatgggcagaggatccacaagaggaagcgccatcagcggtcaaaaccagggaagccagaacagctggagagagaaagagagagagagtgtgtgtgtgtgtgtgtttgtaggtgtgtgtgggtgtgtgtgtctgtcttccccatgaatcccatcatgcttgcttcttgattttgtccatttggaagctcagaaccaatttacaccccacctctagctgttggataagaccttaagggaatgtcatctcttcacccaccttaccctttatttctcttatttatttcccttctgcctctctttctttgtatacttattattatcctgtttgtgcctttgaaagtccccttaagttcctttcttggtataggatgagtataaataaatacaaaagccaattacacaccaaaaagatacaaacttgggactagtcacaagcatctgccacactgctagctcttctctagttttacctcagaaatattttttttaacgaggactccctggtcttcacatgaaggccctgactgcatgggaaaaccacagaattcttgcccatacatcaaccttgcattgagaactgcaaataaagcaaaatgcatgttttcttcaaagtggccacagagacagatgcccatcatccccacaatgctacaaaataggatgcagcacatgggtgacatgatgagaggtccttgaaggccaagtaggatcccgggattctattttgctgaatcaggattcaggatcccatgattctgttttgctgaatcaggattcaggacctttttcaaaacaagtaaaacagaaaaataaagtgcaagtaccaacagaagcagcctccagaacttttaattgttatactcttacctctttttctctttttttttttttgttttttgtttttctttttttaattatactttaagttctagggtacatgtgcacaacgtgctagtttgtcacatatgtatacatgtgccatgttggtgcgctgcacccattaactcgtcatttacattagatatatctcctcatgctatccctcccccttcccccgaccccacaacaggtcccggtgtgtgatgttccccttcctgtgtccaagtgttctcattgttcagttcccacctatgagtgagaacacgcagtgtttggttttttgtccttgctatagtttgctgatctttctctcttttttaagaacaatctttaaaatgtttcctcctatgcatgatttttgttaacttttttactgcttgtctatagagtatatgacaaattttctttaatcagcatgtattactttaaaatggggagaaaatgaaaaagtgttgtctcatctgaatatgtttttaccataacatcccccaaaatgccttcttttctaaaaatagatgttttgctagaagcatccagggtaaaatgtggcctgccactcagaaatctaaagttttagttgttttctttgctggtcaggagccctgaagcagcggagattctgccctctgatattcatggatgtgagtgctgacccacacggaggctttctttgctatttgatttcatgtttcaagggaaatgttaagtcagatgtcactgttaaagggaaagagggaggaaaagaagaaagagagagagagagggagggaggacaggagaaagaaaccatataaatctagagtccagtcttgtttgtttctttatttggcccagtgatcaataatgtattgactaaacatctttcaaaagttatttatttataatgccttcattctaaaaagaatttaaaataatgtttacaaatgtagtgaatagaatttacaagaaaacaaataagggaggaaaatggagcaaagaggaaactgggtagaaaaaataggacatgagtaagactggtgtctaaactccgtgcctttacatctaactagagatgtgtcaaaaattttactgtgagctccctagcagccaaagcaaagaaagaaacaattgaatgtgtaactcataggtaaaaataagtgaaaggctgggtgcggtagcttaggcctgtaatccctgcactttgggagaccaagtcgggcagatcacttgaggtcaggagttgaagactagcctgaccaacatggtgaaaccctatctctactaaaaatacaaaagttagctgaacgtggtggtgtgtgcctgtaattctagctactcaggaggctgaggcaggagaatcacttgaacccaggaggcagaggttgcagtgagctgtgatcgcgccactgcattccagcctgggcgacaaagttagactctatttcaaaaaaataaaataaaataagctgatttatttatttattgagttaagtaagttggggcaataaaataaagcggataaaatatattagccctttgactcaagaagtcaataccactttttatgagaacaattaataacacctaacatcagtgaacacttcttatatgccaagcactaacctaaccaatgtaattatgacataagaacaccatgcatcaggtaaagccagttatattttaaaagtagaatttggggtttacaaatggctttctcgtttgtgttgttacttaattgctcacaacaaccctatgagagatattggtcaggaaaatatttttatatgaggaaagtaagatcacatttctaatcattgttgcacccggaatataaatccagattactcagatatactttttttttctttttttttttgagatggagtcttgttatctcacccaggctaaagtacagtggcgccatctaggctcactgcaacctctgcctcctgggttcaagcgattctcctgcctcagcctcccaagtagttgggactccaggtgcacaccaccacgcctggctaactttttgtatttttagtagagacggagtttcaccatcagatacacattttacactacttcataatctgggagcaaaaccctggtgatgggaatatggacatttggctttaggatcttaagctgagtttgttcaggtgagttgtctactcctgggcctgccattaagtggctgtgtggtgttgggcgagtccttcttctccctagagtggcagtgtcttcaactggaaaataagaaggttgatgacttgtctgggaagattcattccagctgtgacagcctgttcatctctgggtgtctgtggctccaggcagtttcccagactacactccagggtgttcccagtcattttcacattagcagttgctctgtggtacagacgtggctgcgcctctgtggatcattgaaccttcaccattgccccagcctgcttggggctagggtgtgtgggctgtgaattaaaggctgtgagacgtcagaactccctatgagcctgaggtgtcctatggggcatttccaccgtgtcggcggaacatgtttcattgttccttccttgatactttgtcttccatagattttttgaagggattcaaagtggaaagcaccagaagttggaactagacctgctgaagaactcacttttttttttttccttttaaaacttctcttgagcccaaaaatcacatggacacatcttgaattcttacaagttagccgggtctcagtgaaagggcttccctgaggggtagaatgccgcatgctcgtttcctatgcctagataaataaaccctggcccaggctttaggctccaggtttgtttctggcatccctttgcctgaaagtttctgtgttgaataaaacagaaatgtttagcaaatcccaagaaattccttatttaatggaaaaaagagatccctgggcttatatttcaaaatgtgatttccatgttcccactgcattaaggcaaggtcgcctcaccaaatccccagatgtctggtatgcttttcgaaaaatgcctgtatttagcccctagaacacattttgagtacctattgtggacaggattctcctctgagccctgcaggagatagagcagccaaatgagatggaaacccttccttcaaatttagttgtaatggttgcattagaatctataggaagtctcacctttacctacagacaagctttattcccccacgctgatcttttaaactgtacaatattgcatctctgtgtggccatctgtcctccttcatgacaatgggagattcagctgctggggttggccacaaacagcttatcttattagctaacctaccatgtatgagctgccttggcaatatccctattaattatattttctttcttcagcatcttagaagagtggggtttttcatttgcttcatgtctctgccaatcctaacctctctctcctaaaatgtttatttatcttttgttataaaagtagttgatgtttattgttgacagaaagagagagagaaacagggatggatattgcagagaaaaaattttaaaaagctatttataataaaataaaatcctaccacaacaagcttattgttgtttatattttggatttacaaaatctttagctatttatcctcaacccttgccaattatgtgaatttccagttgggtgagagtagctatattaaatagtgagcagttttcctgtatcattaaatagtcttcaaaaccttgattgttcatagctgaataacatttaatactatgggtgaagcaattattttaattgtttcctttgtgctgggattgtagattgtttctatctttttacttcaaactcacctgtagtagtggctgttgcaaggtagccacttacacagtataccactttcttccctgcatgctgggaactgcactgcatgctggaaagcacagcctggcactgggctggctctagggtaaagaaagaagagacactggcttgccctcagggagaggggtggggagctctggcgctgggcatgtatcatgtctactaatgtgatacttaatattaggagccacccccttgaagacagcggagtccaaaagggcttgctgagtcatcaaatactaagttggttcagcataatcttaggattctgtgtgttttattttccaagtcggaaagtagggttaggggtggggagaacactctccaagagaagctgactcaagctacttctcaaagaacaaagtgacacacaggaaggaggttggttgggaggggaaaggagaggtcattccaggaaaggcaaacaatgtcaagaaagggagcctggcagggttaggtatgtgccaggtctttgttctggcctgagtttaagatacctgggaaggcatgccaggagctgttcctggagaagtctgtagagggcataccctgagaggcctttgatgccccaccaaggaggacgacttcatcccaaagacttcgtgaggctgctaggggttacacatagaggcctgagcttggcagacatgcactttgggaaatacactgtggcatctgcaggagggacaacagacttagggtttctggggagagttggtgggtgaggaatccgagcctcctaggtacaggaatcatgacttgtttactgctcacccagggccttgcacagtgcctgacatgcagtaggtgcccagtatttattaaatctgggaaaagttgttaaacgaatccaggcagggaatgccaagggtggtggcagtgagaatagaagatagggatcctcttagaaagacatttaggagggacgtgggtgaaaatttttaatctgaaatccaaggaccgaagaaacttcattttttagtgaagcgcaaaaactagaaggtagctttgaaaaggcgtttgacttcaggaaccaattggccaaaggaatgtttctagacctttcaaaactttaatctgtgctttgtgaattacacagtttggttctattcaatagttccctttttccctcaaatgccacctgtgaaataagttaaacaccatactgttttaatgtaaaaatatttcctcaaatccactgtataaattaattactctttggggaataggataatctaatttcccttctacaatgtgctccattcatatgctctccattgctgtagaggtaggttatgaatcaactgtttctgaaggattatgagctataataaatgtcaatatgagctctgattgatttcctgcagcctcactagttgtgacttcatttagtaacttaatactaattgtgtcgctttgattactttgattttagctgtttccccagcacctactggagtgtctaggacaagcaaggattctaatgaatgtctgttgaatgaagggcttttaatctttttaaaatgttccatagaggattttagagaagtcggagtgaatgcctgcagttcagatgggtattgactgaagaggcgaaaccataatttcaattcttgagaaagtagcgcagaacttctctagctcactactgtatcgcagtacctcagtgcacagtagacagtcagtgaatatttgctgactgaccctgtattgtagtgtctgatggtgagccacagcccttagttcaagtatatgccttagagagtaatgcatcccttcatgtatgcattcaacatttattaagcccctattgtgtgtcaatgcaatggcaaacatttatgataggctcaagttttgaaccttgcaacaaccctggtagatattattgtcatccccttttgctgacaagcaaaatgaggcttggaaacactaaactatttttcatataattaaaaggtatgctgactccctcatctagatcctcatgatacctaacactaagttttggaaacactaaaccaagatcatataattaaaaaggtaccatccatccaattaaaaaggatccatcctcacctggatcctcatggtaccaataactgggtcctgaatctcctttcactaactaagtcagcagcgatggctatgaaggtgggcattaggatgtcaaagggactgtcacacataggtttgcatctctggcatcatgctatgtgaccctgagcagtccgtttgtctgtctgagcctcagtttgtagtgcccaggttagaggtgatacaagacctctaaacatgaggtcttatatctcatacatgaccgtgatcatctcttcacaggaggagcttcaaagtcacatttccacaggaattgatatggaaaggcatgaacaggtatagccatttttgtaatctaccatagcgattgcctgaaactgttacaatctagtccatttctctagatatcctggaatatgttctgaccaagcaggactggcagaagctgcatacctggaccacagcattatagtcttctgtggaattacctttatgcttggggctttagcgatgcatcagccgtatatagaggaagttataggaaaccgaactcatgcatctcactatcgtatttactaccagcttgttgctgagggcattgttcattttactgcaccatgggagagattactctcttgtctcagcactaggcaaacctagacttctctaaagctgggcttgtttggttttttcaattttatggatttgtaacttaggaagccaatggatttctctcttcaagttgtctgctggaaagcttaaggctgaatatgtgatctaccaccagcaaatacaaagaccatgtgacatgtattttggcactgatttcacttttagcttcatattattattcctttaaacagatctcatctgtacatactttaagttttattttgttttagtgatgagcaaaaactagaaggtagctttgaattgcatactttgtaagttgcctaaaatcctgtttgaatacagtaggtgataaataaaatcactaaaatgaatgaacaagaagagtaccttcatatacccagaaatgcactggaaatcgggacattttgtttcttcgtctttaataagttgtgtttgaagtcctacattgagccaaaattcatacctggaaactgaattctagaaagattattttggaaagcctgtagttacgtgtattaccactagatgaccttccctcattattgtctctaaagtggagctgctagttatatggactttccagaggactgtaggaaatttatgaataatccctctaaagcaacaacgacaacaacaacaaaaaagtctactttatatggtgttgagtgtacaaatatttggcaaaggaatgaaaaaagttagaaagttgtctgtctgtgggctaggctctgcctgcaagatacttacaatctaggtcagaggttcctaaatccttctcaatgccgtttgcactggccctgaggaaagtgtgaaaatgaagactattgtagagtcttacatgaagctaaatttgttcatttatatcacttctcttttattatgagattatgtcctctgcagttttttggtattaaaatgtcttttatgaaaggatagtaagagttagatagtagtcttttttgtggaaaaaaaaaaaaattgttctcacttgacaataaaaagtggacaaatccatggagccctcaaaattctttttggaaattttgttctataaaatccaatattctgaaaacctgtggttgaataagagaaaaatatttagtataatctttctcaatacatttgcatgcatcaggaccttaacagaaaatactacctgttagcatttgcagttgagctcctattaaaaaccatgtttgtttgtttgtttttaaagatgtttaggaaaacagtttaaggaacattctccttcctcccctctcactgggaattctgaatctactctttgagcaagtcaaaatacttggacctcagctcaggcccctctacacgtcacctccagaaagctacattctgctactatgttcttagcttttatgaaagatgaaacagccaattaaaaatctacttctgccttcattttgttttttgttaggacagtcatgtacatagtacatactatgaaattatgtcagtttgattgacaaccatttgattttactaaaactctgcctcctgaattcaagtgattctcctgcctcagtgttaaggacactttctcttatatcacacagtagacgttaaggaaattttagtatcctttctaatttcctttgaatttatcttttctccccctttcagataaaaagataacatgttaccttttttgccttggctaccagtggtctcaaagtcaggtgttgtactcagccagaacagctttgttatacccttaagcttgatatcttttctgtttcctggtttcttccatttttatcaaccttataatgtcttttattcagagctcccaaaagcctatattggagtgatatacaattactttttaaataaatagaatgttttatataataaatggtatttttggaaagtactggattatgcagtatgaactgtaaatgtctccagagtatattacatgattgtcctaacaaaaaaaaaaaaaacctttagtactttattaagtatttctcatattcaaaattatctcacctgtgtgctgaactagactgtaattccttttgtggaaggaaattttgttttgtatgttgttttaaatctcttgcagtttctctcgatcagtgccaggacatcagacatgctcaatgaatacttgctgattgactaatccactgatctgtgtgttctgggggagttagaaaagctttcctagaggagatgcaaagagatggccagaagacaggctgtttgccactctaatccttggcttctcacatgttaaacatgatggctaaggtctctaactttctggggcttgacagttgtaaaatacgaggaggataggagactgtgagggggtgaaagccagttttcagattcacagaggctggaaataaatttggtatatggggaagctttggagatggagaaatgctttcgaaactgtgaagtacatactatgaaattatgtctctttggtttacaaccatttggcgttactaaaactttcacttgatgccctaattcagctctaaggggtctgtcttggcatttatgaaagccattgtggactggtgcaacctttatttatttattttattttattttattttatttttgagacggagtcttgccctgttgcccaggctggagtgcagtggcatgatctcggctcactgcaacctccacctcctgagttcacgttattcttctgcctcagcctcccgagtagctgggattactggcgcccaccatgcctggctaatttttcgtgtgcggttttagtagaggtgggatttcaccatgttggccaggctgggctcaaactcctgtcctcagatgatccgatggagggaggctgctactctctaccatttcctgtgtgcctccactgtggcctcaaccctggcagttaaagccactgctcccttcccctacctggcatgtgtgagcccttctcactggattttatacccttgtgtctgtgtacattatcgatctatatagtatatatatacattatatctatctatatagtatatatattcattatatatataatgaatatatatacacacaattgataaattgaatatatatataaactctgcactggtgcatcttgtaagcggcagtgtagactccaggtggttatcttggcagtggggtagctagcaccaacatctggctgagtgcccttcttaacaggtgactcgaggtttgctaatttatagcaaggatgatgctcattatgatgtcaacctgtttgataagtgtcatgtcatttggattctgccattgatttcttttgactttatttttttaatggttaaattatataaactttgtataatgtaatccataaacatgctttgtgactttgtgactttcttttttggtggtgacaggatttcgccatgttgcccaggctggtctcaaactcctgagctcaggcaatccacctgcctcagcctcccaaagtgctaggattataggcgtaagccaccacgcccagcctatagtatactcttaagtgtactcttcttaagtggcctacgacgagcaggtaaacagccattcgatagactaaataataaatagaaaatacttgtttaggttatattgtgataatatatgatagtaaataatgaacactgttttaatgatatttggtgttatctttgcatacattaatttgacttgggggactctggactgcattaactttttttttttttttttgagacggagtcttgctgtgtcgcccaggctggagtgtagtggcacaatctcggctcactgcaagctctgcctcccgggttcaagtgattctcctgcctcagcctcccgagtagctgggactacaggcaccagctatcacacccggctaattttttgtatttttagtagagatggggtttctacgtgttagccaggatagtctcgatctcctgacctcgtgatccacccacctcagcctcccaaagtgctgggattacaggcgtgagtgcattaactttttaatcaaactagcagtaattatgttttcagtttaagataagttgcctttataaatttggggataaattggatttaggtaaggcagtgttattactttacttcttttgtattctccataacagctggctcttcatggttgtacagtagctattgttaacttgcttgaggccagctgtgtgtgagcattaccgagagccagaatgtcctcctgagaaggggctcctcacgcctgttctcatgatcatctgcgtagcagaagcctatggagttccgatgagaaagggaactggaaatccctttgagtaaacaagtccccagaagagggagagcataggtgtgaaaaataataattctaccatctaaattccatttctcagccttagttaacacaggtcagaagatctgtcatttgattaaagtcacttccctgggactgagaaaagattgctactgtactcttgaagggtgattctactccactctgtagtaaatgcctccacatggtagatcccctcaaattgggtcatgtatctctcctctgccctcaacccttgggttttatttcccatttatagctttcaaaatattggagacaccatggtttggaaggtaaaacaatagcaatgagagacacctgtttataagtagagcaattaaaaacctagctggtgaccaaacctgcccaactctatgtatattagttttctatcactatataacaaattaccacaaatttagtggcttaaaacacataaacggtggggttttttttttgaggagggtgatgctcagcatcgaatgacgaatttgtcattcacctagcatttattaagcaaccacaggatgcaaattacactgtgactaattggagatattaaaaaatcacataataatatcctgctcttaagaaatttgtgctttcccaagagagagttttcaaaaaagaatacatgtaatttgtacacagcaggcagtaagaagtatagatgtcatgctaggatagttccaaggagaggaaaattatttcagggaaatgggcatggtgacctgcgagctggacttgaaacgctagagagatatggagagatgtaggctttgtctagactataaagtaagaagtgacattgggaaagaagttaaatccttaaatggcagactctaaggcggttaggctccagagtctaagcttttctttttccagatttattgacatataattgacaaatgataattgtatatatttaaggtatcaaatgtgatgttttgatatatatatacattgtaaaatgattaccacaattcagctaattaacatatccatcacctcacatctttgtgtgggtgtgtgtggtgagaaaatgtaagatctactcaatttcaagcatacaatacagtatcattaactatagtcaccatgttgtacattagatcttcagaaattatttatcttgtgtaactgaaactttgtaccctttgactgacacctccacatctctccaacatgaagttccaccaccaaggccctggtaaccaccattctactctctgctttcatgaattcaactttttttacattccatctataagtgagatcatgcagtatttgtctttgtgtatctgactcatttcacttagcataatgtactccaggttcattcatgttattgcaaatggcaggattttcttcttttttaaagctgaataatattccattatatacatatatatgtgtgtgtgtatatatctacttatatacacatatgtgtgtgttatatatatacacacacacacaccccatattctctttatccattcatccatcaatggacacttaagttatttccatatcttggctattgtgaataatgctgaaatgaacatgggagtgcagatgactcttcaaggtaatgatttcatttcctttggatatatactcagaagagggatagctggattataaggtcattctatttttaatgctatgaagagcctgtatactgttttccttaatgaccataccagtttgcatttccatcaacaatgtacaaaggtttccttttccccacattctcaccaacacttaatcttttgtcttttggcagtagttattctaacaagtgtgaggtgatgttggattctggttttgatttacatttccttggtgattagtgatattgagcatcttttaatgtacctgttggtcatttgtatgccttactttgagaaatgtctattctgttatttgatttttttgctactgagtcaagccccttatatattttggatattatattccttatcaggatatatgttttgcaaatattagcttctattccataggttgcctttccattttgttgattgtttcatttgctgtgcagaagatttttagtctgatgcaatctcacttgtctgtttttgcttttgttgcctgtgcaacaaaaaaatattattgcctggaccagtgtcaaaaaacttttttcctcttttctcctggtagttttacagtttcagatcttacacaattcagtctttaatccatttgcattgatttttgtgtagagataagggtttgattccactcttctgcatgtggacatccagttttcccagcaccatctgagagactattctttctccattgtgtgttcttggcaccctggttgaagatcatcagttgactgtaaacgtgtgggtttatttctgggctattccgttccattggtctataagtctgtttcttatgttcataccatactgttttgattactgtagcattataatattttgaaaccagaaagtgtgatactttcagctttgttcttgctcaggattgctttggctatacaggattttttgtggttttatttgaattttaggattgtttttcagtttctgtgaaaaatgcctttgtaattttaataaggattgcattgactctgtagatcacttttggtagtatggacatctttaattcttccaatccatgaatgtagatctttctatttatttgtcttcttcactgtctttcttcaatgttttatagttttcagtgtacagatcttttacctccttagttaagtttattcctaagtatttcatttttgtaaatgagattgttttcttcatttctttttggatagttcattgttaatgtatagaagtgcaactggtttttgtatgctgatgttgtatcctgcaactttattgaatttgtttattagttttaacaggtttttttgttagggtctaggattttctatgtataagatcatgtcatctgcaaacagagacagtttgatttttttcctttcgaatttggatgccttttatttctttttcttgcttacttgctccagctagtagttcagtattatgttgaatagaagtggcaagagtggacatccttgtcttgttcttgatcttagagaaaaagctttcaatttgtcactattgagtatggctttagctgtgggcttgccatatatagccatattatgttgcggtatatttcttctatacctgatttgttagtttttatcatgaaggatgttgaattttgtcaaatgcttttttctacatcagttgagaggattatataactaactttagtccttcattctgttaatgtggtatatcacgtcttgatttgcacatgtcaaaccttccttgcatcccaaggataagtaccacttgattgtagtacatgttccttttgatgtggttttgaatttagtatactagtattttgttgaggatttttgcatctgtatctatcaagaatatcgatgctggccttataaaaagagtttggaaatgctctctccctttcagtttttttgaagggtctgggaaactttggcattaatccttctttaaaggtttggtagaattcactggtgaagccatccaatcttgacttctcattgttgagaggaattactgattctatctctttacttatcattggtctgttcagatttgctatttctttatgatttagtcttagtaggtggtatatgtttcagaatttatccttccaagttattcacctttttggcatataattatttatagtagtctcttaggatcctttttgtttctgtcatatcagttataatctctccgctttcacttctcattgtttgagcctttgactcttttcttatagtctagctaaaggtttgtcaattttgtttgtcttttcagaaacccaactcttagtttcattgatctttctgttgtttttctagttttatttcatttatttctgctataatctttattactttcttccttctgtgaattttgggctttgttttttttttcctagttctttgaggagctaaagtttctaaagttacgttgtttatttgagatccttgttttttcacagtcactataaactttcctcttagaactgcttttgctgcgtctcttataagttttgatatgttgtgtttccatttttgtttgtattaatatgtatttttattttccctttcgatttcttccttgatggttgttcaagagtggatttagaggtgcattgtttaatttccacatatttgtgaatttttcaattttcttctgcaatttctagtttcatactattttgatcagaaagatacttgatataattacactcttcttaaatttgttaagacttgttttgggcataatatatgttctatcctggaaaagattctatgtgctcttgagaagaacatgcattctgctgctgttggtagaatgttctgcacatgtctgttgggtccatttggtctatgtgttgttcaagtccactgttccttatggattttctgtctggatgatctgtttactgttagttagactggggtactaaaggcccctattattattgtaatgctgtctatttttaccttcagttctgtcaatattgggtgctccaatgttgggtgtgtatgtatttataattattatattctcttgatgattctcttgatgaattgattcctttatcatcatataatgattttctttgtctcttttgactgttcctgacttaaagtctattttaagtatagtcacctctactcttttttggttaccattcacgtggattttttttttcactttctttttttttttttttttttttttgagacaatgtctcactttgtcacccaggctgaagtgtagtggcatgatctcggctcactgcagcctccacttgaatcagttcaagtgattctcctgcctcagcctcctaagtagctgggattacaggcgtctaccaccatgcccagctaatttttgtatttttagtagagacagggttttgccacattggccaggctggtctcaaactcctgacctcagattatctgcccaccttggcctcccaaagtgctggaattatagacatgagccaccatgcccagccttgacttttttcactttcaaccagtgtttatccttaaagctaaaatgaatctctgataggcaatgtatagttgatcttgttttttaatccattcagccattcaatgtcttttgattagataatttaatctatttacttttaaaataattattgatagttaagaacttactgttaattgtttctgttttttagttccttttttcctttcttcctctctagatgtcctcatttgcaatttgacaattttttgaggtagtaggctttgattcctttctcttcgtactttgtgtgtctactagtttttatcttcatgatttccatgaggcttacataaaacatcttatatctataatagtctattttaagccgataacaagctttgattgaatttaaaaatctacatttttaacttctgttttccatattttatgttattgatattacaatttataacttttatgttgtatctctattaacaaattattgtagccatagttatttttactattttgtcttttcactttataccagaattaaaagtaatttatatgccaccattacaatattgggttattctgatttttgactatattcttaccattgttagtgagttttatactttaaaagttttcatattgctaattcgtgtctttttgtttcaacttggagaactctgtttggtatttcttgtaaggaagacctaattataatgaacttttgtttgggaaaatctctttgtcattgtaatttctgaaggacaattttagcagatatagtattcttggttgacagggttggttgtttgttcctttcggcactctgaatatatcctcactgtctcctcacctgcaaggtttctgccaagaaatccacttataatctcatggagtttcctttgtctatgaagagtcacttttctcttgttgcattgaaaattctctctttgtatttgacttttgacaatttggttataatgtgtctcagtgaagatctcttaaggttcagtctgttcggggttacttgggcatcatggacctggatgctgaatatccttcccagaattgtaaagtttcttgtcattatttctctaaacaagttttctgcctctttctctttctctgctccttctttgactctcataatgcatatattggttcacttgatggtgtcccataagtcctgtaggctttctttacacttgtttattctttttgtgtgtgtgtgtgcctcttaactagataatttcaaatgacttgtatctgagcttaccaattctttcttctgcgtgattgagtctgttgttgaagcactctattgatttttttcagttcagtcgttgtattacttagtgccaggattttttatagtttgtatttctttatcaaacttctaattttatgcatgtattatttttctgatttcatttagttatctaattcttttgtagctcattaactttaagatgattattttgaattctttgtcaagcagttcatggacctccatttctttagggttggttactgatgttctattagtttattttggcggtgtcatttttgcctgattcttcataattcatgtagccttggattgaaggggcagatacctcttctagtcttttccatctggttctggcagataaagactttctcttggctgatgggactatctctgggatcatattctactatcttgctgatgtcacacccctcaatataaatgttttatgtcacaatttctataggtcagaagtctgggcacagcatgactaggttttctgttcacggtctcactgggctgaaatcaaggcatttaccagggcaccaccctcatctagagcttggaatatttttctaagctcactggttgttgccagaattcatttccttgcatctggaagactgaagtagccatttccttgttggccctcagctgagggatgctttgagagtcctaaaggccacccacattccttgtcacatagctccctttgtcttcaatcagaaacagcatgctaaatccttctcatacttcaaacctgtgaccagaaagagaaaactatctgcttttaatcatgtgattaggtcaggccactctgataatttttctgaaggtcaactgtgccatttaacataacctaattgtgggagcaaactccaacacattcacagtcgtgggattatccagggtatgcagtacagcagaagcaggaaatctggggatcatcttagaattctgcctaccacactattctgtgtttccttcatgaagctgttgacattcgttaaaggaagctgcttatcacaaccaacaagcattatgcctagtcagtgctaggccctatggaagatataaaatgcacataggaataagcccatctctgaccctttacagttttcaaagcacttttatagctgtgatctcattttctcttttaaaaaccaaaaaacatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactcggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccgtaaaaaatgatgagttcatgtcctttgtagggacatggatgaaattggaaaccatcattctcagtaaactatcgcaagaacaaaaaaccaaacaccgcatattctcactcataggtgggaattgaacaatgagattacatggacacaggaaggggaatatcacactctggggactgtggtggggtcgggggagaggggagggatagcattgggagatatacctaaggctagatgacgagttagtgggtgcagcgcaccagcatggcacatgtatacatatgtaactaacctgcacaatgtgcacatgtaccctaaaacttagagtataataaaaaaaaaaaattaaaaaaaaaaaagaaaaaaaaaaaagaaaaaccaaaaaacagttttaccatgttttcattttataggtaaagaaaatggcagatagagaggttaaaacattaacttgaggtaacacacccagtggcttggaagctgggacttttgactcaagaatgagatcctctacctctaaaaccagtactctccctgtggcatagtttcattgtcaagaatctcattgtcaagaatcttgtcatggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaagaatcttgtcattgggaaaagtgagacacagctgaagattaggaggaaatatcatactggtgcttttatttattttttttaatttttaattttttttaatttatttatttatttttctgagacagggtctcactcctgtcacccagaatggagtacagtgatgcagtctctgcttaccacagcctcgacctcctaagctcaggtgatcctcctgcctcagcctccctagtagctggaactacaggcatgtgccaccacacccggctaatttttttgtattttttgtatttttagtagacatgggtttcaccacgttacccaggctggtctcgaattcctgggctcaaacaatccacccaccttggccttccaaagtgctaggattataggcgtgagccaccacacctggccagtgatgcttttaaatgaggcttatgttcaagggcagtatggggctggggtagcttggaatacatgtgggggagataggtatcagttatgcagagtgggagaaaaagagtgttgcagtcagggggcacagtttgagcaaagacaggaacaagcaatgtgtgttgtgggagcatggggagatctgtcaaagggttaatgactgagtgttgacaatttggtcagggaggtgggtgagtcatgggaagccttgtgagagagacccaggaatttgctgtgggatgttagacattagggaccttttgtgctttctttttttgctggagagtgatttaaaatagcagttttacaatggagagttggagattcacatagtcatgcattcactcagcaatttcaggtctgaatatatatccgaggttcattaatgccttatacagtgaatttagtggattttgaccagcatgtaaattatagaattaaatggacttgaatatattaaaggacataggatataagagtaataagtcctatttcataaaatagttccaatttgtgtgtgtttgtgtgtgtgcatacatattttgtgttttgtgtagtctggtgtgatataaattatttatttatttatttttttatttattggagacagagtctcactgtcattcaggctggagtgcaggagcacaataatggctcactgcatccttgccctcctgggttcaagggatcctcccacttcagccttccaagtagctggaaacacagtcatgcatcaccatgcccagctaactttttaactttttttggtagagatggggccccatgtgtcaccctgttgggtcatgatctcctggcctcaagcaattctccggcctcagcctcccaaagtgctgatattacaggcatgagccactacacttggcctaaaatgtatttcttactgttggtttcagtaaaaagtttgaaaaatactacccagaaaatcccttgtacatgtgtgcacagagacgagtacaataatgttgctagcagcactgtttattatcaccaataattggaaacattctcaatctccatccccacgagaatagataaataagttgtggctatgcatgtaatgaagtacagagtaacactttaaaaacaggaaaactagagccacatgtgtcatcatggacacaaataagaaatcaaatgtgaaagaaagatggtttctgaattataaatgtactatatcatttacagaaactttttaaaaatgtaaaacaataccatcaatcatttctagatctgtgcatatcagtaggaatataaatatgcatggaaattatgaatgccaaattgaagatagtggttacggctgatgaaggagagaggggaatggagttgagggaaggacgttcagtcatatctgttgggttaagacaaatctgggtgatggaaacccaagtgtttgtggtgtcattccctatctttgtctgaagacttgaaatattccgtaatacgtttgttcacagcagaatttcagaatggcatgagccagtgctggacgaagactgatttggcagcttgtaataatgtagttttgaggccgtgtggacctggactaggttgataggaataggccattctcattatgcagccataaaaaggaacatgatcatgtcctttgcaggaacacggatggagctggaagccattatcctcagcaaactaacgcaggaacagaaaaccaaatactgcatgttctcacttataagtgggacctgaatgatgagaacacatggacacatggtggggaacaactggggcctgtcagaacgggtgggtggggggagggagagcatcaggaagaatagctaatggatgctgggcttaatacctgggtgatgggatgatctgtgcagcaaaccaccatggaacatgtttacctatgtaacaaacatgcacatcctgcacatgcaccctgaacttaagagctgaagaagggacaggcacgatggctcacgcctgtaatcccagcactttgggaggccaaggcaggcggatcatgaggttaggagatcaagaccatcctggctaacacggtgaaaccctgtctctactaaaaatacaaaaaaaaattagccgggcatggtcgtgggcacctgtagtcccagctactcaggaggctgaggcaggagaatggcttgaacccgggaggcagagcttgcagtgagccaagatcacgccactgcattccagcctgggcgacagagcaagactccatctcaaaaaaaaaaaaaaaaaaaaaaaaaaaaaaaagttgaagaaaaaaaagaatagtccgttctcatatgacagtatgtatgataacagtaatgacaatatcttgtgttgtgaaagggcttttcaaaatagaaaagcacttctatagacttcctcttacctattgtcacaaaataggcaaggcaattgtttattatgaacctcagaaagctggaatttggagaaagtcagtgactgaaggtaagacagtagtgtgtggtggagttcggaattgcaattggctgtccatggcttttctagcctttcaaggctgccctgttgtgcctacctttggtctaagctcaagtgtcattctttacatctccttctgttttctgtttatgcatgtcacaaacatataactatgtgataagattttgatcgctcagacagcttcacttctcacacagcaagagcattgctataccgatcctcttggctgactcccatctgcaaggtagaggagcagatcatcccctgggcttccctgtcacacatgtgacatgctccatgtgtggcagatgacactgaaagggagagttcaaggacaaacacctggtgaattcatgctggtgaagctccaggagatgtcagagggcagctgttgggagtatgaggcccagtgtaaccttctgcaagaatgtttgcaaccagcctatttgtgggagagatgttcagactgcggccagatttttttttagaaaaaaaaaaaatcaataaatccagatatgttccatataccaaaaactgagaaacaaaaaagtgggtatataacaaaaaggcagcaggtaaataggtaaatgggaatggtattgttcagaagtggtttcattacagaaataaaggaagaaaagaagaaaacaaatgtttgtgggcctgatgggtgacaggcaccatgtcgtgttttcatgaacattatttcgtgtaattttcccatccctatgaggcagatgttaatgcccctcattttaaagacgaggaaaagagagctgggggattagcttgttggcccaaggtcactggctagcatgtgatgtagccaggatttgagctacggtttttctccatagcttgcaatgtttcctccatatcacacagcagtaacattgaaagagaaaagtacacacatttctaagccaacatgtggccaccatgggaagaagcagagaggaagtttggatcttttggcagggaaaccatttgaggttcttgacagttgttgaggtgaatgccctgttcccccatgttccaccagcagtgaagcccatgatgggcaggagctgcaggacgcagtggcagggagaaggctgttggcagcccccagagccatctgagcgtgtgcacagccacatggccctgccgccccaggaattgagctgttacttgtctgtagaggtgctaggagaagctgtttgcccggcatgacaagttggaattcagaacacattttcccacagaaaccatgccctcctgggtagttgggttctggtctccagaaaaacaacagaattgtgtcactgttctatacgtggtgatcgggttcccagacctgtctataaaagtgaatacactgtgggctggattcacttttatagataggtctgggaacccaatcaccatttacagaatgcattttgtgggaaaacacgttcatagttcagctttcaaatgtttggaacgtagcctgcctctaggttgagaacagcatgcattagaatattgagcatcgaggtgttacaagtcctgagtttcagtgctgactgagaggaggggtgaggagtaacatttagcaagcagccacacggaccccatgctgagctgactgtcctgcctgccctctctcatcgcgttccagcttagttctgtgaggtcagcaggagcatctttgttttaatgcagagcagttggaatgttggagagattcattaacttttccaagggtatgcacctagcgaaaatagagatttgaacctcaggttctttccagagagggtcagagccaaatctaaatcaagtggagaagtgagcagaggaagtgagcagaggtttctatcctgtccccagccttatctctttgtccattgtgataaaaagagcctgtaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatagcgtgaacccgggaggcggagcttgcagtgagccgagatcccgccactgcactccagcctgggcgacagagagagactccgtctcaaaaaaaaaaaaaaaaaaaaaaaaaaaaaaaaaaaaaaaaaaaaaaaaaaacctgtaagaaaccctcatgggtgaccttttaaaagcaccctaactcgctggagacagtgtgacaaggcaggatgacagtgccctcctacctgttcctgctcttctgtcctcggtgtttggatgcaaattcttactatcagctggggaatggtggctcacacctgtaatcccagcactttgggaggccgaggtgggtggattacaagagcccaggagtttgagaccaaccaacctgggcaacatggcaaaaccctgtctctatagaaaaaaaatgcaaaaattagccaggcatggtggcatgtgcctgtagtcccagctacttgggaggctgaggtgggaagattgcttgagcctgggaggtcgagactgcagtgagccatgattgcgccactgcactccagcctggacaacaacacaagatcctgacaccccttcccacccccccggcaaaaaaaaaatcttactacccaaattagtgactgtttgaaatcactaagaatgggggctgatgagaaagagggaagaggggaaaggtgcccaggaacaggagggacttgagagggtggtgaggtggggcagctggacatgagctgcacaatggtgctgaatgcagctcagcatgggggttgccttttcctgcccggtccctctctctgccccttctgcctcacagcctagggatccactggactcttatttcctttcactccagtctgttcccaagcctggatgaatccttttttttttttttcctgagataaagtgtcactgttgcccaagctggagtgcaatggcacgatctcagttcactgcaacctccaactcccgggttcaaactattctcctgcctcagcttccccagtagctgagattacaggcatttgccaccacgactggctaatttttgtatttttagtagagacagggtttcaccatgttggctgggctgttcttgaactcctgacctcatgatccacccacctcggcctcccctcttagtagctgggatttctgccctctgtgagccagcctctgcctgagctccagagtatccagcccgacccaggtgtgcccaaatgatccaggcttccaaaatcaaagaggctccccacattgccttaggtggagaccttaggcctcttccctggggtctcagctgcttcccaggcttcagcagcagacatgggaaagctgtgctccagatcgctggtgctcagacctccatgtatcgaacaagcattaacccatttcctaccccatatcagtattgtgtgatgtgcatgaggggaaataagatacagtcttggtctggaggacttcctagtcaagaaagagagatagaagttaacaaagtatattttatgcatgagggatatacaaggagctcgggagcggaaataagtgagcagctgagtctcctttgggagggagggattggggaaggcttctctgaagaggtgacatctgagctaggtgtcaaagaagaaggaagcatttaccagctatctagggggtcagtcaatcccagtggtgggaactaagtggtgatatggtataaacaggaaaagtttggaatagagaacaaagatgagctgagtttgaaaagtcagctagtttcttactaaactaaatgtatgagcttctctctttaatcagattgggattggaagctctcttctatacaagtaatgggtgattgctggaaaggtactatgagtggacaggcctggaagtcagacactgtgaatcctaaagatttgttttaacaaggtgataagctttggctgtgtccccatccaaatctcaacttgaattgtatctcccagaattcccatgtgttgtggagggacccggcaggaggtaatttaatgatgggggctggccttttccgtgctggtctcatgatagttaataagtctcatgagatctgatgggtttattagaggtttccgcttttgcttcttcctcatttttctcttgccaccaccatgtaagaagtgcctttcgcctcctgccatgattcggaggcctacccagccatgtggaactgtaagtccaattaaacctctttttgttcccagtttcaaatgtctttatcagcagctttaaaatgaactaatacacaagccatatgttcagaacttggaagctcagagggcctaaaattgcacatgtgtgtatgcaagtccaggggatgcagattgtatttccaaagagtcctgttaagtggagaacattctcccttgaattattgagcagaagactcccccaactccatcaccccaagatctgctagttcaacgccctccatttaaagacggtagctactgttatacccattctacagatgaggaaaccaagacccaaagaagctaagaaacttgcccaaggtctgcgaaagtgacagaaagggacttgtgtctgtgtttttgttaactatgcacatcgatttgactgagagacatagcacagtttttcgctggtgaccgtttcagcatctgctaaccatgaaagtcaggacatgcatcatccatcctacctcactgttgcttcttttccagcaaaagttcagttttgtttgttttgaatttttaaaatcacaaccagaatgtccttgaggtattccttgtttgtgcttttatcttgtgagtatttgtttcatcctttattaaaaacatgtctttagaggaatcactgtctgtggtggttgagtgaaatgttggggcgacttctattttgctgatgggtttgaggggagagtggccttccacaaatgacacagtgtgtgtcacccttctgtgggtaggaacgcagtcagattgtgacattgttgtggttttctctctttcttcttcttctccaagtacaaacacaagataattatccaaaggccttttttttatgaaagtcttccaccacattccagaagtggccatctgtttttctgatgcactaaatgcatcagtgcctcatcttccagaaggttctgtgaaagcttattgctaagagttttgtattttataaactgagttgccattcagattgtccatagtatcaacttaacactggctccatggggacagaataagatattagttctatctagttactccagattgagtcacttgtgggaactctttgaattctaaagtttcctggtgtggacagggtctaggttgatcctaaagacaaaaatctttaggctcaattgggccaaattgttaatgatagaaccaccttctgtttgtttccccttctacatggtagggttagaatcctgcgggcctcctggctggggagcgcagctctgttttggagacagcagaagcatgtagcagcagagggaggtggaagagtggcaatggtttgtcgggcccctaggtgaccctggttctcctggcttggaatgctgttgtttaagagcagcagccaaagagggcgtgtggggaagaaggaaagcagccaaggaacattgaagccacaagctttagggaacagggctgggtgaggcaaaggggagctcttgctaaaccaaaatatttaactagatttcacttttttctgtcagtccaaattctttgtttgaaagtttcactttgaagttgtttcttttcttattgttccaaaaaatactgttgttttaatcttgtttctgggtggggccattgaccatttagattatttctaaattatagcattaaatgtctcaaattcttggggacgttttctgtcacaggccttccttggtgctacccggaatctcctgtctcaagtaggcaagaatatgtgtaagaacagcctggctgaaactgacaattggactctttagcaattgatatgtattataccttgcaaattttcagagattcagaaagttgctaaataggtacaggcacgtgcacacacacacacccacagatatatgtgtgtatatataccaaaatacacatgtggtaacatatacatgcagctcttctagacttctttacagagtgtttatgccagctatttctatagacaacatacattataaaaggcataataacagaggtcattttaaggatcattagacttttaaagaaatagctttttaccaaaaatcgtgtatacaaagaaagcacttttaatactttgtttggaagaacaggaggagaagactcctggtcaaaccacctagttctgatgacttagtttctcctgcatatgtcccacccccaagtattggatgacactgacgaatttttaacaagctcgacgccttatgtgagaagtgtctcttccctctttggcctcctagggtgggaaagcagatcccttctcgtccccaggcgtggcttccaagatgccagggccctgcgatgtgtgtctcatcagggaacacctctgtgtcagccccaaaggaagtgagttcagacgctccctggaattgcttttcatttctccctcagatatttagtgagcgccagacatttagtgggctcttactatggtcccaatcctgtgctgggccctaggatcacccagatgaataagtcatggttcaggccttcaaggtgctcccaggctttcaggggaacaagaagtgttcctagtgcaggctaagctgagcaaagaggaccggtcaagagatggaagccaggctatcttggtgggcagagccctgggggttaggaaaggcttcgccgagccagttttaaagttagaccttgaaagactgctaagaattggtcaggaagatgagcaagaagacccttccaggccaaggtagcaagagcaagtactaagggcagaaggtatccagcccatgatacatttgaagagtgctagtttgactagagtggcgacatcatgacattttaaaagtcaaacgggacacatccctgaggccatgagtttgaccttttgactataggcattgatgggtactgagacaaggaaggccaggaggtatacgtgatatcaagtataaatatgctagaggactcattgtaaaggccaggagttgactgaagactggggagaagggtccaccgttttgcagacgtcatttctccattccctgctacactctctttgtgccccaccctgtgctttgggctggaatcttccacagttcttcctgtttctcttaggtgttttttgtttgtttgttttgtttttttgttttgagacagggtctcactctgtcacccagtgtgtagtgcgagatcatagctcaatgcagcctcaatctcctgggctcaggtgatcctcctgccacagcctccctactagctgggactacaggcacataccaccccacccagctaatttttgtattttttgtagagacagggtttcgccctgttgcccaggctggtctcgaactcctgggctcaagcaaccctcccacctccacctcccaaagtgctgggattacaagttgagccaccgcatctgaccggaacttattttttaaagattgacaaaggcatgtgtcacttatgttaggaacaccccagcttaagtcctgcccactttatgacaactttttcaactaatccgatttgctccgaccttttttccccctctgaactccacttgcactactgtcagtatttaaaggtaggaccacttgacaaaccttagtaaaaccataaatgttactgggtacaagaatttcatgtggcttagttctgtctccgaagctaaattgtaaatctttgagactatgttttatatttctttggaatccaatctgttgtctctagcatggtgtaatgctggttacacagtatatacaagataaatatttgattgatttgctgtattttttttccatccaagtagaaatatggatgcttgtcccctgcggagagtccaagtcctctgagctgacatcatacacagagcccacttcctgtctaactattttttcacattgtcacatactcatgagcccctgatatgccaggccctgttcatccacatcataatgctttctcttcactcctagatttaaggttcaaacccaggcaaactgttgttctggccagaccttaaccacctgtgaggtcatagaaatgctatggagtatctcaagggtagaaaggcccttaaaccaggaatgctgcccaaatactaacgcaggctaattacatgccatcaagcccgtggtatgtgctcccctggcaaggccctgctccattttcttcataaaacctgatgaggagcattttataaattaagagctgttcccttctgccgctcagccgctccagtggactctggcagtgggccaggaggaacgtgtgtgcattcaagggcaaatgtcatctctctgcattgtgtggagaggcccactttgagccgaaacactgggagccgcataaagccccaatgtcttccccacaatgccccccagtatgggaagctcctttccagctgcagagccacaaatcttctcaccaagagacactttggctctctgtttgaccataagctctcacatctcaaattctaaaacatccaggcgtggttagtgtcttctttctgttatgactccatctggtgaaagcctatttcactttccttccaaagtgactgattttgggcagccaaagtgtttcttttttaagactaaaacagcaattaagattctgcagcattccgtggggaaatgctactaattagctacagtcaatactgtggattagtgttctgtgcaagacttactcactcagaaagctctgtatttcaaagtcttgctctcctcctggagtacctgccttctagtctttgaatggtcaaatcttaccatctttactagctcaggtacatctcctccaggaaaccttctgtgatttctgctatactccccttctgaattcccgtaggttttgtttgctcttctcttggaattcttgtcattgtcttctttgtcttaatacatgacctttactcttctgtaagatccttgagggaagaatctgtgtctgaatcatcataagccccacagtacctggtataatgccttacacatatgaggcactttctaaatatctggagtagaaaaagaatgattgggaattattaatcacacccaaccattttcagtgacccccaaaactggttcatgttatgcagtgatgatgatgacaatgacaattaaagtagtaacaacagccatcattaactgaacactcattacattctagacactacattctgcatttcacctgcattatctcagttaataccctattatcatgcctgtctttttttttctttctttctttttttttttgagacagagtcttgctctgtcgcctaggctggactggagtgctgtggcgcaatctcagctcactgaaacctccacctcccgggttcaaacgattcacctgcctcagcctcctgagtagctgggattacaggcactcaccaccatgcctggctaatttttgtatttttagtagataggagatttcaccatgttggtcaggctggtctcaaactcctgaccccaggtgatccacccgtcttggcctcctgaagtgctggcattacaggcatgagccactgtacccaacctatcatgcctatcttaaagatgaggaaacttggttttggtgagaataaataacttgcccaacaaccagtgagataattaaatgataaaatgagtgcatgttggaagcgagatttgagtccaggctcatgtgatgacagagcaagagccattaccattctgttctactaaagactatcatttaacacttcctgctgtgtgtgagagcagatcctctccctttattgcctcaatgattggctgggggtagtggggagaattgatgcatttatgaaatcagcctagaatggaagcctttagcagctagagaaagcactccaggatagctactctcacaccactccaggggttgctcccttatggcctccatggagcttccaagacaagggggcagaaaactgggtgagcatgtccaggctgccggactttgcaaggcactgtcatgggcctgccaagactctgctcctgttggccgctttataaatgactgtaattgcaccagtctttggtgaaagactttgaacttaataaaaatgtcaaactcattaagagcgttttcaagaccaaataaactctgaagaggctgtaatctttgatgacttcagatttgtgaatcacaaggacgtggaaaaaatctagctgccctgtacagagctactgaaatgtcactatttattgcttcagcgtcatctggtaatggaagtttggttgcgagatcagaaatctctcctgaaaatatcatagcactctttttctttactgtgtcaaagcagctgtgtgcgtgagcagctctgtatgtgccacaaagcagtatctagaataaacacaagtttgattagcctggagtcatgtccagaatctcattatattggaaatgtttaaagttagactgaaagggctttttttctcttcagggtagcttaggaaaaccatgtgaaaagcagcattattctggagaagacttcacatgatgtaggaggtgggatttcagctggatcttaaatgttgggtttggagtggcagagttctaggagacagaaaatgagttgtgggtaagaacagacaggaggggtgaggacagtaataaagaacaggggtggtctggagctaaaggtctttgtacttgagacactgaaggagccaaaaaataattaatatactgttagcaacttattatagtcctcttagatgctaaattatgatgtagacattttgaaaaatggtctcggccaggcgcagtggctcatgcctctaatcccagcactttgggaggctgagatgggcagatcacctgaggtcgggagttcaagaccaacctgaccaacatggagaaaccccgtctctactaaaaatacaaaattagccaggtgtggtggcgcatgcctctaatcccagctactcaggaggctgaggcaggagaatctctcaaacccgggaggcagaggttgcagtgagccaagatcacatcgttgcactccagcctggacaataagagtgaaactctgtctcaaaaaaaaaaaaaaaaaaaaaaaaaaatgaaaaagaaaaacagtctctatccccacagcaatcctataaggtaaatgttacgttcagtttagagaccactaaaaccaaggctcctgcaagcctgtacaggcagaaggcagattggtggctgccaggggctgggagtagaagggaatgggcagtgactgctaatggttatggttatggggtttcttttttggggtgatgaggtattccagaattggatagttttgactgttgtaccactttgtgaatatactactgagttgtacattttaaaaggataacttgtctggtatatgaattatatctcaaataaggaggggaaaaaacataaggctcaaagagatcaagtgacattcccaagcttatgtagccactggtgagaaggcaaactggggtttgaacccagggctttctggctctaaagcttgtgctctttccccgctatgttgcctctgtcctttcaggacctgtgagggcttagcggtgaggttggctacaaacttttggtcaaagaataaaatgcatttttgctacaaatgcaatgatgtctgacaggtacaatgtagaactgatgtagagctttgctccttggttcagctaaaaccaggtttttgtcacaccaccaggaatgattaggaacacagacacattgaagggtgaggggaatggaatttactgggcaaaaagaaaaaaaactctctgcaaagcaagaggggatcctgctaatgggcccccaccgcacagattgaacaccaggtcaccacacaggaactaaagaagccaggctcctttccctgcacacagcacgaacttcccgtggctccaccccgttctcccagtgcagaggtgggtcagagattctccagggaccctcccctttatctgcctcctgcatctatcagaaccaagtgggtcatgagatgcgtagttaagttttgagtggaaggttactcccaagacactggctttgaagagagcaagaccaaatctgcaccccgccatggtcaggaggggaatcctaatatggaggctcccataggttcagggactggctgagcaagccgatgggatttttggtgcctgaagctggtgggctgtgacaggtagggtctttggaagggggccagattatgaatggcttgaaatgcctctccctctggtgggagaatttgaatttgacgcagtgggcatgggccatggtgcattaggaagacaattgctgttattggaaggttcttctggcagtatataaagggtgggttaggctgaagagagagtggtcagagaggctagctgtggtcatccaggcatgagttaaggagaattcagtccaaggttttagtaatggaaatggagagaagaactgaatatgggcaagaattagaagaaagaaaaaatagccttggccacagatgaaggagagaaaagaggtatagaacactcttaagttgctctcctttttaactttgggttttctaagactagaaacatgaaagtgctgaagatgggcatgaaaaataatggagaggaaaaccatggggatagtgaagataatgaaataagtttgggccctaatgagtttggggtggtgacatgaagatttattaaaagttttgctagtgttctgcccagaccctcagcccagacaggtgcagcctttttcttcctcccactttaggaaggcaaggtctgattgatgtgccaatgagaaatatgaaagtgtaagaacactagaaattcaatgcatttttataacactttgtaatttacagattgttttgccatcttttattctatttattgtcacacagttttatcgtaatccttccacaatggttactttaccctacatgaaaccatatagttggacttactatggcattttattcagcagtttgagaatttcagaccaaatgtatttaaatccaagagatgacctcagatgagtgacacagggaattcaagaggaagaattagaaaggcctaggatattctaatgcaaggtaagacacccacacaagtacctggtgaaatgtgtattatctatatcaaatcagcaaatgcctcatttaaacttagaggagcccaaggaaagttctagcaagcaagggctaggaaatgtatatgtatcattcaatgtcagttatttactgttttaagttatacaaaatgtcacttgtaatatgcaagccagaagactgtggagtgtcatctttgaagtgccaaaagtgaaaacaaaaacaaaaacaaaaaaaaaacctgtcaacatagaattctatatccagtgaaaatactctttatcaacaatggcagaagaaatgctatggagaaaaataaagcaataaaggtcagtaggaaatgaatggggagtgggttctcagttttaagtagaatggtagaggaagacctttttgggaaggcagtatttgctccgagacccaaaggaggtaaggtggttgccatgtaaacaaaggggagaacattccaggtagaggaaataacaagcagaaagacccaagaaaggtgcatctcttacatgtttaagaaacaacaaggtgaccagcgtcactggaacagaaggatcaaggaagagaagataaggagataatgtcctgaagttgacagggaccagaccgtgcagggcattataggaagaataagtatatattttgtttgcctgggaccatccacatttatacctactgtcctaatattattatcaaaacgtcctggtttggatgagaaacttcagagtcgttctaagtataggtcatgtaaagactttggcctctaggtggattgagatgggagcccctgaggggtttcacccagagctctggctctaatatgatcattctgactgccgtgtggggaacagacaataagtggacagaacagaagaagaagtgcccattactaactactgaacaaacccaagtgagggggaagatggcttggaccacatggcagcagtggcagtggtgggataacagcaaaccttcagcctgaacagggggaaggatgaagtagccagcagctgtgatggggaagactgggaagaacggctttgggaggaaagatcgagaactagattttagactgtaaagtttctagggccttttggacacctaagtaaagatgtcagagagccagtgagtgtaaaagtctgaggtttgggagagcttcaggttggagatgtaaatgtagtattcaatgccaagaggcaagatgagattaccaagtgtagacagaggagagatggaggtcaaagaactgagccctgggatgctccgatgcttgaagtctgagaaatggggaggaaggcacaggagactgagaagtagcaaccagagacagagagacaaaaccaacggagtgagctgtgcctgaggctacttgaagaaagtatttgaagcagggaggagtcatcacctgggccaagtgttctgttaggtcagggaaaataaggactcatcattggccatcagatttagtgatttggcatcactggtaaccttgacaaaggaaatgtcttcatgtagtgagggcagaagcttgactctgggtagttgaagagaaaatactgtctctgtttttgtttttgttttttggttacttttttgttgtttttctgctctccctcttcttggttcttgcgaagagcaaaagacaaaggtgattcctccaagaaacctcttctaaactactttgtgcagtggcagggcagagagaccacataagttgtattattttctgttgttggtgtctggctccttttgggggtaggagtattttgcagcagtgtgataattaattttatattccttgtcacttaggcttctatggcaaagtgaatgcagtttggaggcacaaactccagcaaggaggcaggataaactgctcagaggaataagacctcccagaaataacatttcaaatggcaattgtttatttatttatttatttatttattttttgagacggagtttcactcttgttgcccaggccagagtgcaatggcatgatctcggctcaccgcaacctccacctcccgggttcaagcaattctcctgcctcagcctcccgagtagctgggattacaggcatgtgccaccacgcctggctaattttgtatttttagtggagatgggttttctccttgttggttaggctggtttcaaactcccgacctcaggtgatccacctgcctcagcctcccagagtgctgggattacaggcgtgagccaccatgcccagcctcaaatggcaattgtattgtagctgtccttaaaattgggagatcaaatctgaaaacattttggaggaggggaaaaagcaggactggatgacagcttggctttagggatgcatgagtggaatactctgaagattttggagaaaccaaaagctcagcaatgctccaacagaagtgtattggtaggaaaagatgggccagctgggggccacatggtaagttccatttggggcctttgaaggagatacaaatggagatacagtatcagagatgctctgacactggctgacaccagagagccgttatgcctaaatatggatccaggagtctctgaccagaagtggtggaggaactcgtgtttcacaggagaggtggaattttaggagcttctccagaggttggggaaagacagcttggctgtcttgagaataagtggtaatgaggaagatcacaggcagatggtccagcttgcaaaaatgctcaaaggcaagaatggatggcatttgtaaatgacaaggagcctgagaggtgaccatggtaagttaagatgttaacataggaaagtctcctgtactcctttgacgaactgccaaggcccaagtatcatgcccaacacttgaggattcaaaggtgagaaaggtatgttgtccacacttgaagtagttccctgtcattccggtgaaacagacgtgtgtggtcatcacagcacaaagcatgataaggattataattggggaatgaggagggtgctcaggaaagcaccggtgtggcagagccttacccaacccccagtcacaacggaggtgtggccttagagccgtactgagtagggcttaatgaggcgtgggtatggggcacctatgatgttttccaggtggacaaacatgagggcatgtggaagggcatgagaggtcctgggaggtaggagttcagaattaaggaagtgcctagaatctggaggagagcaagaagtgagtagagtgtgctcagggagaggaggacaggactcatgtgttatgtgcctgctgtctaacagtctctttgccaaggttttcatattgtttcagtgtagttgtgatctttccattttaaaaaatatatacttagcctgggctgggtggcttacacctgtaatcccagcactttgggaggccaaggcgggcggatcacgaggtcaggagttcaagatgagcctggccaacgtggtgaaaccctgtctctactaaaaatacaaaaaattagcggggcgtggtggcaggcacctgtaatgccagctacttgtggggccgaggcaggagaattgtttgaacccgggaggcggtggttgcggtgagctgagatcgcgccactatactccagcctgggggacagagcaaaactctgtctcaaaaaaaaaaaaaaaatatatatatatacacacacacacacacacacacacacacacacactcattgtagaaaaatgataaaactcaaaaagtagaaagaagaaaatcctccattgttagcgtcctgatgtacttctttctggattatataaattctctaccatcctttcattacttaacattataaaagggatttcccacattattacaaattctctgtcaacatcattttaagcaatctcttacacacatgatatgagcatgcaataatttatttaatcatttccctaatgctgtgcatttgagttgtttccagttttctgtaaatataaattaagctattataaacatacttgtctttaaatctttggccttgtttcggattatgcctttaggattggtttccattattggagtgactgggtcagaggccatgagcattttaagtgtcttgatccctatcaaaggtaaatggctttccaaaaagtccttctaatctctgtttctactgccagcatctcacctcatactctccaaaaatgaatattataatttaaaatttgctatcacttaatcctcatgatacaatcatgcagtgagtattctaatgcaatgactattatccccaatatgtagataaggaaagtggggccggtggatgatttcacacgccccatttcacagagttagtaaggcggtcagaaccaaggcctggtttggctaactcaagaggacatcagtctctccctgggcaggtgatgagccccacagaaggattttaaatctggaaagtgacataaagtccaggatccccttggcttgctcttcttagtgctggcttatctattggtaatgatctaaagaacattaactaccagctgacgccagagaactctttcttaacacactgttgttcttcagagcatgtatgaactgaagactggtaatgtgaagacaggggaaaaaaagaatagaggatgtaatgtaggttattaatgcaataagtaacacatatatgaattcatacaaattagttaacaaatacaagccactgcaggactttctaaacagcactgtatagttcatcactgtggaaggggtcatttcactaggagtaaagtcaaatttctcttagctcagccctgtccctgattcctcagcatctcttcaggttttgttcagacctgaaggtcagaggtaacagacttccagggccagggtcacctcttgatttaacttgggctgtggccagattagccacattgatctgctctcttggaagcctgaagaagccagtaatctcacttgggcacacatggagggagagagtataagaaaaaaaacaacaggccgggcgcagtggctcacgcctataatcccagcactttgggaggccgaggcgggcagatcacgaggtcaggaaattgagaccatcctggctaacatggtgaaaccccgtctctactaaaaatacaaaaaattagccgggcatggtggcaggcgcctatagtcccagctactcgggaggctgaggcaggagaatggcgtgaacccaggaggcagagcttgcagtgagcggagatcatgccactgcactccagcctgggcgacagagcaagactccgtctcaaaaaaaaaaaaaaaagaaaaaaagaaaaagaaacaacaaccagaactaccatgtattgagggcttcctatatcccaggcactgaaagaaagtgaacttgctcgggcatgcttggggcccagtaagcaagccaaattaaatacaggcggcctggcatggaatccgagactgtcatcgacaataaagaggtgaaaactgtttgcagagagatttaaataaactgtttcaaagtacatccagtcatgcacagtccttcgctaacttcaagaagagcacattggtgttaagtaaggggaaagcatcagattgataagtaactgataatgatcagcactgatgtttcagaggaaatatgtgttgcagagaggcagagaaccatggtggcattttgcccagtgagatgtgtcatgcccactacaggcccctcctttagagagggcaccttctgccatcttcatctctccccttggtttttattcattgttccttccagtgcaagaggatgtcacatttcatagatatatgtgaaccacagagacccaccttcatccagggaactgcaattcttaggaaggcactggggcatactcaaggcaatgagaattttttcacaacagaactcctgtggcaacaggatggaacttaacaaaggggactgccctttcagaaacagtctgtcctgcaacagcatggagatgacaacagggacaggttctacttagtggtgacagggatacaggcatcctggctccagaaatttataacactgtctgtgctcatgtgtaaacatgggtgacttatgtacctgtatatacttatatacatacatacatatttactgcaatagacacatatatttaatagactctccttccccatgctgtataaagtgcccatctttatagctctttccttacataatgaaaggtaatgctctgataatcattctccagatataaattggagggaagcagagagcagtaggggcagttatgtcatgggatggggagtctagagaggtgcccctaggtgagttgagatgtatgtagatatccacatgtatgcctacatgcatatttatatgtgtgtagatgtgtgcatatgtgtatggaaagaagaagtgagaaggactggggtatggaaaagattgcatggataaacaacgtgttaccctagattcttagcatacaactatttacagagggcttagcaatttttaaagtgtttttagacgagttaaaataaaaatcactggacttacagccaatacacttggcctgagccgtgattatgccattttaccagttttgcagttgtgcaatcagtaagtatgccacaaatagcagagacagccagtttcagcgcatggactccatttcccttgtgtatcctctgccctttgggtttcctagtgttgctatgctggtcttctcttttctgcatcaggcatttggagggtcttgagtgtttcattggatgtaaaaataatgccattttccttctagaaagagatgaagggtgggaccaggccagccttttccatttgctgctgcctacttcctgctgccagcccctaccccggcaaaaacccctatgctaattctcactcagcaacccctgtgcccattcacagtgaaaacgctacagtgcttctctcttttcagtgaacatcctatgaacacctgctttgtgctaagcactggggacccccaaagagctcccagtctagacataggagacacagatcaataacaagcaaccattgtgtaatatgacaggtgggcgattaatgttatgtgcagagaacagagaaggattaacccggcctggggtggccaggaaaggtttcagagaacatgacatttcagttggaaattacaggaggctttttgtttgccaagcgaatgaggacaaataaggcagagcctacagcatgggtgaaagccctgagtcaagaatatgcaagacaggattaaggaacagagaatattctgaaatgcctggatccctggggttgctggatgaggatgtaatggtggggaggggaggatgggaaatggctgtaaattagtttggaaaattgggcagggatgaggtcttggaggctttgaactgagcagttgagtgagtactcttcgccaagaactgcatttaaatcagttgagtattgtgtaccagctgcagctaagacttgtggggtcccaggaaaactgggtcatttggaagatatcccctcttagccatttctctggaaatggacaactctcaaagacttgggaaacactagctgtgtggtcagggaggggccaggaggcctgggagacctttggaaaggggtcatgaatgacctgacatctttgtgcttttgtcagtgtgatcactaaaggggaattaaagccttttgtaaaagatgtaatgaggctctctgaggtcagtcggatgagctcacaatttcaacaatcaccccccggtgggattgaggccagatttcttctgcaaacctcttgtgtaagatggttccttgaaggatttctgaaaataaatatttcatagaaaaagtggttgcacaaagagggaggatctggaattcaaagggcaggtcccaggaagcccaactgctatcctaggctcagtgaggttgctcaggttgttaatgtgtgaacctaacactgttaggctgttttctgggctgacacccatgaaagggatgggttccgtgctgcagctgttgatggagacaagagggatatgcagctgcttaaacttttgacacattgctaggggactggaatgggaggccattcaacttcctctcatgtctgctatgccttctgaatttgacaactcaaagggtcacagtcagaaagaggccccagctgtgaaattatttcccaacagagagtcaatgcattgatatggctcaaaggtccaagccagggtactccaaaaagcttagaacaaaatggatgggtgttgctttgctgaagtttctggtgattgctaactatggctaaagacagaactctattgccatcagtaggaagaagtaaactcatagattagttttttggcagtaattctatcttgagtgttattgtttgtttaataagggcccttgtcacatggtcacatgtaaatggtcacaggtaaaggatttgtggagtctgcttccttaattgaaaagcattgtgaaattcaccttgacttatggaaaagcaaatgcattttcatttgttaatggccctagtcaagggtgtagtatttgtataagcagaggtggtgaaaagcagcctctcccaaagcatgtttcagaacctcaaaccctgtgagtcttgcatgggaagagttttatatggaagtaaattcaagaaatgccgtgtattatgtgcccctcttggagattcataaggctcgctggcatagtaaagcctctaggatatcttgcactaaggaaacttggttaatttggtatcatttaacatttcccaaacttgtccctggatccattgtttgttttttcaatttttaacatttttttaagtcctgcagattcagaaccactttacgaaaccctgatttgaagaattaagacataaataggaggaggatgtatgggtttatcaattgtctattacaacttaatctttagccagaagatacatatggagccacatatataaaataagtcacaatctattaaatttctcttccttatctagaccctctcattttcacagctttctacatccacccaagcaaaactaaactgactacatcttcatttttttcctctgcaacttatttatgaatccataccttcaccagctattgtgttctgaagggtttcttctgtgcacacacaggatcatatctcatctaaaccataggttccatgcagaactctgtactccaataaaccagtcctgattaggtggaaaatagtatcatattttggccaaattccctgctgagcaatatgcctccttttatgtggggtataggtatagctcatctgggctttgtatatctgtaactgatatctgtctatggtctgaatgggggtttgctgcatgtagactagaccataaactcaataaatagacccttttctctatcctcgtaatacaaggaatattcattaatgcaacttttaagcatggaagccatctccagacagccaatttctgtggttgaggcaggaacagaatataaatgcttgttctctaaagaaccctattcttatctttctataaaatgcagcaactctattttggccaaacatttttctgtctgtcccaggttaaacacttcttcccaaaagtagaagtaagtacagagaagagtacctttgtttgggaagaattcgacccacttcttgcatttcctcgccaccatttacttcattctgtatccattccagcctggattcggccaccattactcttgaggacactagaagttgcctaattaccaaaaccaattgtcattttcgcctgctttttccacctcagagccttctggagaattctagtctcctgactgagaggatgctaagttttcctggttctcacacctactcctaaagtcctccctgctagtctccatcttctgtgtgcaacgtttccattcatttatctcacctatccccgatgacctaacggatgttgttttcagaaggagagaagagtaaattttggttcctaccttgtggtgtgtcacctcactgaaaagaacatccctaaatgtgaaattttaaaataatagtttctgaaaataattaaatccagaaatgtttgggttataagacatagttcaagtataggaagagaatgagaggtcaatattggttatgatcatggtagaggattccaaagaaaaaatgagattctgagtggagatgaagcatatgtaatgttcaaagagagcagcaacggaatacaaggaaactaggggatgattacttccttcttttgaaggagagaggcagtcagctggacctgaaagggaaagaagcatccactagtataagcaaacatcccagaggttcaagttaactgaggccgactcctggctaggacctctgcggagcatgcttccctccacgagttcttagaagcctgtgcatgaggtgttgcgcggaataggaagatgccaccctctctatcaaactactgcccaattttcaaaaacaggacctgagaaagagctggcattcagaatggctctcagattacactactttctatgtaaattgatttgtgcagatttggttttgtaagggaaaacaattggccaatttttttatagctctctacttctgcccacagacttgttcacttttcccttttacatgtaaatggaaaaatggaaatgagatttctgtgatgcatggaatctctatttttagaaaagataaacagggtcccctggtcagagactccaaaggaaaatatggttcccaaaggatggaagattaaaaataaaatgtagataggtacgtaagtaaattaataagacaacaagcaaaaacctgtaaattcaatccactttactgtgctgaggaatgccactgaaagaaaatgagaaccagggtaagaagggaaatatgcatttataaatttatataaatatatgtaattatgtattttatactatataatgtaccttacacagaatgaatatttttttaaacagaagctacttcttttcccattatcttcatcatcatcatcctttagaataagtaggtacagagtagaggaccaggcttcttccttaggccccaagaataatgttaacaatgtcaaagggaaacaagagctgtttcctcttgtattctgtcttttcctggatggaaattgctcttcacatgagaaagggtgtaaacaacagcgaaaagaggcctctgcagccctggctaggtgagaagatgaaggacccaggcatttaagatgaagttgggcttcccaccaacactcattgtgtgcaggttgagcccagcaccccagggaacgatgcctctttagtgtggatgaatatgttctcagaggcatcttgtttctgagctcctgtaaccttctgtgcattcatgtgactctcctcactgaatagaggctccttgagagcagaaattgtgtcttattcactgacccacctcacagcacaacatctggcccaggatagacacacagtacaaatgtgccaattgattgaaaaactgtaagactaaagatggacaaatgtccatgttttcaaaatggaaggtgggtataatttggaaaccacatctaagcttgatggcagttccttaaaaaaaaatctgttgaacagacagacttgaatagctgatcttaatactctgaaattcacctaaaaatggtcagaaaattggaactgaccttcagtaaaaaccactagtatgaaaaaaggtttaaaaagtgaatctaattgtggaatgtcttagtagaaaggtagggttctgagcataatcctcttatgttttgctggtcagactacatcatgttccattcttaggtgcttattttaagaaaggccttcataaactagaacatacccaagggagggtgaccaggaccagtaatatagggttccaatccaaagaggacaattgagaaagagatggcatgatttaacctgaagaagaacaggtagaggcagacaagtggtggcaacagtgccatcttcaaaacttggaaaatagggttagaacttttctgtactactcacaatgcagaactgcgaccagtgggtagaagtagtaaggggcctgaattcaatccactgtgaggaagcatttcctagaaaatagaattgcacccagacgcaaagagctctcttcactggaaatgttctagcaatggctggatggaaagctgtagatgagattcctgcattgggcaagaggcttggattggactgggtggtcttcatctccaagcatctgtgactgtttcacttcattcatcatgaataggattaactctctacgagaaagctttctcgattagggccactgtgcagcaaatctcctcgaaagcttcatttacactgttttctagatcaactgctcacagtaacccatgcctgtaataggggctcagaagggtttagccattagtttaaagggacttccaacctgttaccagggagtggccaatctagaattacttctaattattagaagataatttataaattagagaattgattcatattgcatcatgtgatatcatggcaaatgtcctcagaagcttagagtgataaaccaactaacataaactccaatctgagatttcttaccctcctcaaatttcctatcctccagttgatgttagaacatttaatagtaattttctagttttgcaataaaatcagatacaagccagaaacgaattaatggaagtatgtgaaattaaactaaaatgattttttaaatattttaatttttaaatgattttagtttaaatttttttaattaatatcatcatttgatttaacttctgtttttgtcagtcatttctcattgccttctctttttcttcttctccctttctttcccttcatctcagtttcctctaaggatttcaattttttaaactttcccaggactcaattaacctcacttaaacaattttttggtgggaccagtgaagtcttggagctgctgcctttcatactcagccgaaccctggaaaccaaatccgtagccaaacatttggctttggtttagaggcagaagtcagaaaggggaattgatatgcaggtgtggtgcaaagctggtcttaaaaatacagatgttattacctctgggccctaggggcctggaacaaaatgcagtgagccacccccggaggtgaaacgatggtcataaaatggtttctccattcgtgaattttgctgagctgcctctgcaacatttagtgactatttaataacactaacagctctttgagctaaattactaacatttgggggagcaaggttatgtaaaacaaaattgaattatgaaaacaattttccagttagctccagcgtttcttgatttctgtttatcttttttctcaaaggggccatttaccaattcccccctggctggcatgagctgatgtccaaagactccaaacaatcagcacacacctctgaacaacaagggtccgtatttttccatctctgttcctagcccaaagcttggaaacactttcagtcatggaaagatctaaaaccaagaaatatccaaagtggtcttctgaagaaaagtatgatgctctttgaaccctggttaagttttcataaaaattctctgttaacctaatgctgttggaggtcaccttgtttagatacagaaactgcatgaattgacaagcaaaagttaaagacagaggcactttctagtaaaattgaaaatgcacactccataaaagtaagcaatcccacttccaggtatacactttagggcacctctcccacatgcgcacactttaacagcagttaaaacgactaaactatacgcatatgtgtcgacgtggatagatctcaaaaacaacagagcgcagaaagcaagctactaaagttatgttaccaatatgcaaattgctaaagacaacacaaaatataaaatataaaagcagggatataccccggcatcacaggctgcctcttgggagggggtggaaatggggatggtgcaacaaaaggttcttcaacattattttattattaagagacagggtctcactctgtcacccaggctggagtgcagtggcacaatcacggcttattgcagcctcagcctcctgggctcaggtgatcctccaaccgcagcctcctgagtagctgggaccacaggtgcgtgtcaccacaccaggctgacttttaaaaaaattatttgtagagacagggtctcgccatgttgcccaggctggtcttgaactcctggacctaagcgatccgcctgcctcagcctctcaaagtgctgggattacagacataagccaccgtgcacagcctcttcaacattattaataatgttttgttttctcaaaaaggaaggtactttaaacaaaagtaacaaaaacttaatttggtggatacttgaatattcttttttttttctttttttttgagtttcgctcttgttgcccaggctggagtgcagtggcacaatcttggctcactgcaacctctgcctcctgggttcaagcaattcttctgcctcaacttcctcagtagctaggattacaggtgcccaccaccacgcccggctaatttttgtatttttttagtggagatggggtttcaccatgttggccaggctggtcttgaactcctgacctcagatgatccacctacctcagcctcccaaagtgctgggattacaggaatgagccaccgcgcctggtcttggatattattttctatatctttctgcatctttacatatcttacagatttttaaagagccaaaccaggatttaaattaaaaagatgaaagcattgtcaaacacccagaaaggtttctctgcggacccaggagagccaggatagttagcatctggaaaacaaggcaggccccagtgttcggaaggggcagaggcaccgggagagttacgtttgagcaaatttgttattttctcattcagtagcctgctcctaagattccataaatccttgctggatgacttatgtcctggtcccattctacttgcctgaaacaaagttttacccccagttggtgataatatacattgaaatttctgttgctcctatctattctgtttctttgtggctcaagttttctcttctctccgtgcattatattcaaacatgtaactccaaacagaacatacaagcatagggcacagcacgctgtctgtttcagatagaactttatttggtaggtggaaataaatgcatacacatggagggaggtctgtctgacagtaacagttcatttttccaactaattcaactgatacctgattggtgatcctgaccaaggtttgacgttgtttaactatttcttaatatttcttctgttcagctagtatatattcgacatattctccatcaagtgtgaccagcctagaagactagagttacatatagctctttagaaattcaggtgtagtcctagaagtcagtgagaagaaaaatataggatgttctgcaagttgtaatgatgtgtggtttaaaggcctttgagagtcctaagaaggaggcatagaggaaacagcccagcatttgaagcagacaaactgggcttcagagcctagctcagccactttagtacctgtgaggctttgggaaagttacctaacatttctgatattctgttttctcatccaaaaaattgagttgttaagaatgaagtgagctaactaatgaaaaatgcttaatatggtgtctaacatattattggtatttaaaaacatagttgtctggctgggtgtgggggctcatgcctgtaatcccagagtttcaaggggacaaggtgagaggattgcttgagactaggagttagagatcagcttggggaacatagcaaaactctgtttttacaaaaaaaaataataataataacaaaattcgccgggcatggtggtgcatgcccggagtcccagctactcaggagactgagacaggaggatcacttgagcccaggaattcaaggccaactttttgtctgatgatatgtcattagcagggcaccaagagtagctcattattcttgctgattaactcagctgaagcaaccttattaatgatagtggtgacaaataacataattagatctatgtactctgtgtataaccttgcacaaggcttgagaaatgaagcctcagagtggatagattcaacctgcacatatctgatgccatccttccaactttgcccacccctccaacatagacttattgctctggtgaccactcttagtagtggagacatgtcttaactctcaggtggggtagagggttaaaaaggctaataagcagcagggtcagtttctggctgggagtccaacctatgttatggtctcctttctggctgcctcctattgtgttattttgggcagataatttctttggctgtaaatttattgatctttaaaataggatggtaggacgttggacaagatgatttctggggtcctttgccccatattctatgttcatgatttcttttcctttgtaagtataattatacacccaaagtaccatggattatcaattctaaaatgcacaattgtttcacatcttaacatctaagaacccaggatataacttacaattaatggtaatttagattgctgtgaaatacaatatataattaaatgtgtgagaggtactaataaaaatactacttaattacgagtttctacaggaaaaattgaaaattgctgtcaagatattgactgaaaacaagcgtacattttttgtaagttcaatggagatcattaacatggaaaagaacccatgagttgctaggacagttgtcccagatgagggattgatttgggtgttcctaaaggtccctttcaaccctgagatgctatgaaacactaactttattccagttatttgttgttttgcacactcattcagtaactgaagagcattttggagaaaaaaaaaggtagtttacggggatgacatagtaatattgtacctattaaataatcatgtgtacatttccattggagtgttaagttattgatattctgattaactgttactatagctatcattcaataatattttcaaaaattaatagctatgtttggacactaaaactgtggtgaaaataatttcatattcattgatggctgaaaacgccttttagattcttgtagaagttcaagtcatttgctatgaacacagtgccatataacaaaaatattcacttgtgctctagataaatggaacttccatgttaagtctcagtaatagaggagatattattttattacaattgctaatgatttgttgttgttgagtttataggtagaaaaagaagccattagttacttttgggtaacttgttgcttgatttatcaagacttctttgtaatcatgatatattatctatcattaatcttacttggctgttagcatgactgagaatcgaagtgattttgaacctgtctcaggaatgaggcccagaggtgtggttcaggtgatcttggaggagctgtttagaaagcaattcccgatgccaaaagttgggatcagttatccaaagggctgtatttgaaggctgggtttgatttctgggtttccctaatttacaatagaaatctcgatttatcacatgtgccatgaatttgttactctgaaggaattaatcaaaatgttctttctataaacatttttattgattcatcatttctgaaatcatgcaatttatgagttggtcctattttgggtaatagcaattacttatgaaagctgctagagagtttctgtcaagtttaattaaaccttttctactggagactttttcaagagtttgtgaactgttgactgttgataccatgtcccaaatattactcataaactggaatttttaccagcaaaaataactcagaggcatcagtctcccaaatctggaagccagttgactcctttttgacaaattccgtatgtctctttacttcattgcaacttagcatttggccttgtgtattatttacacgtgtgattcacttttctctaacatgttctaaatacttttttcaagatgttcaatctactttttattaccctctttttgtaaattttaatgatgtgaaaagcagctaaggaccaatggagaagctcagaatagcaatttttgtaggaagtcctgatgaagagtttatcaagggagatttttaagtcagttatgaagcctgagggaaagctagaagtttagggagacctttgatcatacagtattggaaatgcaggatactgttagggtaagtgaaggctcaggataggcagaggtagctatggacctagattgaggggagatttgttcaatgggatctacattgagctgggcaggatttggattgataaagaaaataagagcaagccagagtgagccatgttccaaggacaaggaagaggagtcttttctgttgcagtgctggttggatggctccagcagtgccagttgatggaggtctcggtaatcaggagtccctgaaaaatattgagcagaggaaaatgtaataaaagccatattttaagaaaattaatttggtgccactggaaagaattggagggaaggggtaatgaagaggaaaactgagtgttaggaacaccaatttctattataataatcaaggagcaaagtgatgattaagacaataactaaggttaccagagtggtgccagtgttatgccattaatgacaacaactaccatttattgaatgtttatgtgccaggcattgtgcgaaatgctttacatagattatactctttaatcatcacaatagccttatgaaagaagtactttaatcccgtcttacagaagagaaaactgagatttagcaacataaaagtatttcccgtaagtaaacagtagagccaagatcttgacctacgccatctgatacctgagcccatgctataaaagaggagcattagaaatatttgaaagatagaaatgagaactagtcaatatttattttgcttagcactgtattcagtattatggcatcttaaagtagttaagactcaatatttcatcaaaaaagtttaaaatctaatcagagaatcggccggaagcagtggctcacgcctgtaatcccagcacttgagaggccgaggtgggcgggatcacctgaggtcaggagctcaaaatcagcctggccaacgtggtgacaccccatctctactaaaaatacaaaaattagccaggcatggtggcgggcacctgtaatcccacctacctaggaggctgaggcaggacagtcacttgaacctgggaggtggaggttgcagtgagccgagatggcgccattgccctccagcttggatgccaagagcaaaactccctctcaagaaaaaaaaaaaaaaaaatctaatcagataatcaagtcttacaacagtgaattaattcatgaaccagacagatgtcatggattggcttccctgggaaacagactttgagatttgtctgcaggaggtctactagggagagtgatcgagaacaacacgtgaagggtaagggctgcaagaatgatcaggtccaacagataacttaacatatcctacagggagttctggagccacaatgacctttcagagttgtcccaatagaagcaatgggacagggcctttatgcccctccatcacccaatcagtggataccagctgcccccagtgagaacacttgagcaaagcagtcctatgtgggggattcagctctgagtctccagcctcagtcctgaaaggaatccggactgcataccacagcatccacaacaacaaaatagatgaacatgttatatatttgaattatttaatcttcaatttgtaaacactttaaatcacatttttggggaatactttcctgtaaaagtagtttttggtggggaggaaatgtccaataaatctgccagtatatttctttgccatggagtgacagccttagttcttgatgaaagtaatcaatatggaaggcattttgtgtgtggcttaattgaaaccctgtgttttggactcatttggtgttaatgtgtaaatccaatcctgttttcacacctgccctcttttttttatgatgccttgttcaagtggaagtctagtctggctttttgcttcagtctaaagaaggccatggactgttgtcattggccaggaatccaactcatatggtggcatgaagtcatccttcaagcccagcaaaaagaccctgtcagccttgcctgcagagaaagccatgtgaaagatgtcctgtgctaggatcatctggtgagcaatccattatactgtcattgatcttgacagatattgggcatacatgtacacctggacttcacctcctaaagaatctgattcctggtggctgggatgggatccaggcatacttatttttttctagtgggccagtgaagagcttgttttgttgttgttttgtttgtttgtttgtttgtttgtttgagatggagtcttgctctgtttcccaggctggagtacagtggtgccatcttagctcactgcaccctttgcctccaggttcaagtgattctcctgcctcagcctcccaagtagccaggactgcagatatgcactaccaccccccggctaatttttgtatttttagtagagatggggtttcaccatgttggcctggctagtcttgaactcctgacctcaggtgatccacccgccttggcctcccaaagtgctgggattacaggtgtgagccaccagccacagcctgggccagtgaagacctttgataaatccatctattctacagggttcttggagatgagattgcctgttgagtatattgggggctcttcaagagactaaatctcaaagaaagagcttcttgaggaactgaggagtaccatgtagaaatgagaaagaaggtgaggagaagtttgaaaaattctgcactcaaataaaagagaaaaacaggaggacaaaggacagagttgggtactagagactatgataaatctctaagattcttaggtcttcttggttactgtcattcccatatccattactcttagatgaaagtggtccttgtgtttatcttgacaaatagcaaataagtgggaccatgcaaacaagcattggtctcttttattcattcatgcaataagtattaattagcagtaactatattccaagcactgtgctcaatgctaggagtgcaggatgaggaaaatttagtctgctcagggagctcacaattccagggtggagggggtggagactaagaggtgatagattgctaaggtagagaggggcacagcagctgggatagcacagactggcagtccataatcctgtttagagagtcacggaagacttcctggaggactctgcaggattagaaatgggtaaatcaaatatggttttgtcattcaaaattgtggcacatctctccagttatttagatcttcttttacgtccttttagaggatttttatacatttttctacaaagatcttatacagtgtttgtgagcttaatttctaagtaattcataatgtttggtgctattgtgaagagtatgttattttgcattctttttgtggttggttattgttggttatagagacgtacaatttatggtatcttgtaacttgcaatcttttggtactctctaattctcagagttgttggattttattcggttttctaagtaagaaaaacaacatctgcaaacaatggcaaccttttctcatgttttccagcactaatacttcttatttccttcctgtgtgttattgcacttatatcttattgaacaacatggtgactgtgggcatctttgtcttcttccagaccctcagtggaatgtgtattaaattttctcttttgagagtggtggtttctgtggaggtaggttctggtagaaaccattttcagattcataatgtgcccttctgtgtctaagtttttctaagaatttttacactaaatatgcattgaactttaacagatttttaaagcatcaaaagatgctttatttaaattgcatcttttgagattcccatatgatttttcttctgtagtaccaatgatggaatgaattacatttagagattttatccgattttgtactatccttaccttctgtgataaaaatcatctgattataacgcattaccacattaacataccactggatttcattatctagtgttttactcaagatcatgacatttcaaaataggtagcattgacgtgttattttctctgctttcactgttcttatctagctctggaatcaaggacatactatgtcattaaatgagatgggcagctttccttctttttctgtactcagaaacaacttgtaaagtgggaattatctgctccttgaatgtttgatagaacttacccataaaactgtctacgtctaatatttgaggaagggaggtaggacataggaagattctctgttatatgaatttagtccatggagatttgtctgtatacattttctgtttcttttgtgttggttttgacactctttttttttaggtgttcatggaagaaaaggaacatgtcctgaggttacagaaagggaaaggagagctatcccattgctgggcagaggactgtcagaatagatgtctgtgtgaaggggagttaaatgttccttctctgatcagtgtgttctattcatccatcctaaggagggaacctcaagaggaagatgttcagctcatatgggtttgtgtagtatgtcacctctccgacatcttcatctgtgacagggccagtagggctgaatcatggcattggcttttgatcagtgacttgagccccaggcatcaaagggccagtgctactgaaatgactttcctcagagaatctgagcttgcacaagctcaggccgtaccacaacaccattggctgtaaatggcagccccttcactagatgagaagtaggtttagcttttagaaggacacatgggtatcaaataaccagttacttgccttcagaggagtttgaccaaggttataggggtccagaaatctcatatgaggaccgcctgttggatctgagctggaaatgacagtaggggaaaaatatttctcttcttataaattaagaatccccatggaatgagaattacagattattttcagggtattgtacaatagggcaggggagaggaagattttggttcagagtaaggagagattttttccagttgagctgtgagtcatttgtcactgaagagtttaattatatggtggtttcaagcagagcatctcctgggtcaaggcagaaatttggttttcacaatgaacaggaacttcatgtgggggttaccagcagactatgttttcaggaagacaaagctttagaaaggttcacatatggacaacctgataaacgttcgctgggcccttccatattccagctaagcattctcttacccttaggtaagtggcagagtttgggtgccccagagtcatgggcacacagtaggatcacctgggaaacattcaacaagttatcatggccaggcctgtgccagcccaagtcagtcagagtcctgtgggtaaggcctgggcatcggtagcttttcaaagccttcaaagtgattctaggatacactcagggttgaaaaggagagagctttgaaaggagggaggattccattgacagaggagcagaagccttggatcatcttaatttcattaacaagggggtaaaaaaggaaaggctgagaatgacacacagccttacttgaaaccttcttaactggatagttttatgttcacacttcctcatgtttcatagcaaccctatgcattatttattctcatattaaatatgaagacaccagagatcagagaaattaacttatccaaggtggcgcagcaatcaaggagcagaacgggaatttgaagcaaggtgcaccaggtctcagcccatttggcagagaccagggctgctcaccctttgggacgcatacacgagtccccttgggatctggttaaaatgcagattcctcttcaggaggtttagggtgaagcctgaggttctgcatttttaacaactcccaggcaatgttgatgctgttagtttgcaggtgacactttgcgtaacaagggtgtcaatacactttgagaatcgaatcttgatcttgatggagacgttcaagagtctttgattacagatgaatttggtgactcttccccaggtgagaaaacagaaaatccatgcaagtttgggaagcccccaccttgactcacaactgctgcttgtcctgctgaggcaccagccaggcatccccgggaaacaggcagaatgaggctggcagtgacagaaatatggttggtcatccagccatctaactaatatttattgagtgcctatggtgagctggagactgttctagacacttgcgatgcgaagataaacaaggcagttttataatctagtggtgtgtgtctaaagcaaaacagttatcacggggtttggttacgtttgtaacttaccagacccttgaaacaccctgacttttctcactctgtcagcctctacatccaatctgtcaccgggttggctcaatctgaataaacaatgtagtggaacggccagaaaactcatgggggctccctctgcatgaacagcagcatactgaactggcagtagagacccgcactgtctgcccagtaaggctgaagctggacaactgacagccttcaggtctcccagccttatctcaatgtggattgcaacaaactgggcctcatctagggggcagggcggccagacagtagaggagacccaaacccttttgcatcaagcactgttgagagacctggcagtgtggaccctgcttcaagacagaagagccagtgggaccctgagggcctttccgcagctgctgggcctccgtgttccctgtgtctttcaggccacactcagatatcacccgccctaactatcccagctaaagcgtcctcctcagtcactctccatcacattttccatttgtagtttcttgagaactcagctctagaggatgtgacacataaagagatgctcaggccccctggttgttcttttgtgatgttgggtagacttgcgtcttctacctccccacaccccactccacatcccatacctacattgttgcctcagcctccctgtaagcttctctttgtttatttacctcccttgcccccatcccaaatcaaatccatcctatatgtagctgatagccctgcttttctatacttttttctcatttgggatgcgtggtttgcaacctcagctctcaggagcctatttcctcgggttactctggctgtaaggtagtgatggcttggctctggaacccttggaggcgcctttgtacccgcaagccacgtggccaggcccttgtgtgctcagagaggggcctctgtctctcttggccggctttgctcctcctgtctctagttggaatctcttgacattttccactttccaagcatcaaacttatgtctttgtaagctggctctcaatcatgttctttcttttttaaaatttgttgctatctaactacactctaaagtcccccagtaaaaaaagaaaacaaacagacaaaaaacagaaaattctcctttaatcaatgcttgctgtcttaactggtgcttcagacaagcacttcttaggcaaatggatgaccacatggctattccagggaggggaaacggggatgctaaattggcacagagctctgctctgtctcgtcacggcactgcctttgatctttaatttgagccattctaggcagggctcagtatactctgaaaacacactttgtgattaaaaaatgtgcagtacatcagccaaaacatttgtttatattttacccccaattttggggtttcttgtcatgctttcctcaaaaactttctttatataattaaagaggtgtgagtgctctgagcatgactgtgcaatagaatacaaagcacagttcccttctctgaagacagagaaaggtttttccccatctattcaagcatgaagtctgtaaggatatggcacagcgaccttcactgcattgtttctggaatggtaatgacagtctgggctgtccaggaaagagcgagcttcacaaagactaaggcccttccaggagggtctctcccagctctggggatcccctcagagacacatgggtgtttgaatgcaccagtgtgtgtctctggttctgtgagagcagggtttttcaacagcagcactattcacatttcagaccaataattctacagtgcacaggatggctcctcacggcaaaggtttctccactccagctctatccacatttggccctgaaggttctttgcggtgggggctgtcctgtgcgttgtaggatgtttagcaatacctgtggcctctccccaccagatgccatcatgctctcctccccaaccaccaactggacaatcaaaaacacccgcagacatttcccagtgtctcctggggagggcaagatctccccgcagttgagtactctgcattggatggcttggaaaaggatccccctaggtaagaggcacagtctgggtgccccagagtcatgggcacacagtaggatcacctgggaaacattcaacaagttgtcatggccaggcctgtgccagcccaagtcatgcagagtcctgtgggtaaggcctgggcatcagtagcttttcaaagccttcaaagtgattctaggatacactcagggttgaaaaggagagagctttgaaaggagggaggatttcatgacctccattgacagaggagcagaggccttgaatcatcttaatttcattaacaagagggtgaaaaaggaaaggccgagaatgacaaacaccctcactaagtctctgtgtttgctctttttgtcgtctttagtggttagtagaactcttaaaatgaagaaggcctgtgctcttttcttctggggtagctggaagggaagagctggggagatcaggtagcacctcacagctaggcttgaaagaggaaccctaaatgagtaggatgtatcttagagattttgaaaaggaaaagtatgctgagtctttgaggcctcagagaaagaggccgaaatagcccaggagggcttagccatcagtccttggctacgcggttccagtcaactgagggtaagaaatttgcttctgcagtgttggctggggtcttgtgatgtcccaccattttcctctaggatacatgagtcccagaccaaaaggagaagaaaaacaatgggtgctgtagtgtcaggtgtctctgggtttcggttcagggaactatcattccgtccaatatcccaagctacaaaacctcctgtagcacggaaattaggagcatgggctttggagtcactacagttgtgtttagttctcagctttgtgtcttactagccgagatatcttaaagaactaagctacttgacctgcctgagcctcggttttcccatctgtaaaatgggaaatataataatcatacctatcttatagagctggcagaaaaagtgaatgagataatccatgaaaagcattgagtccagtgctcactaattattaactactatcattagttcttgttatttggcccaacattcaagaagtcctgtttccttctcttccttggaaatgtattttgaaaatctgaccccttcttcccatctctgttggcgttgcctgagttctgtaccaccagtcacccttggggttgaaaaggagagacctttaaaggagggatgattccgtgtcccctcctgatgactgtatgacccctccttgatctgccacccagttgacctctctccaggtgttaccgggtcatgtaactcttgattcaaatttccagggattgtttgcaaccaacaggctgaaagccaaaagccctatggccagaacctacttctttggccactctgtggtcctccagcatgttggaattgttagtttgggttcccatgaccagagagtgttgactggcttttcttgcttatgttttaaatgtctgtatgttttcaagtcactctaagtgttggtggagtgaactcccctaacccacagtttatatgtcttggactgaagtgttgcacatttttgtgtgtgatgttttaaatataaaattttgttttcccagcaactgctgtaagtgatttggaaacattgcctggtcctgattaacttcttttctgcatctcatttagggtcttgtttatttacattaataagaagactacacaaacagcttacatgtgaaattttctcttgaggacacagaggctgacgataaaggctaattcgtgagtgagaggaagttgaaatctaagttctttcagctcttgtctgagcctattgctgtaacaagtctcctaatcaacagaccttgttaaaggcagttattttattacaggcctcccaagtttggcagcttacccgacagcttgccttttttcaggaggcaggacatcaaggtgaggcaagaaagaaaagaggacaaaaaggaaggcatttaggcaaggcaaagttggtctcttcaggttcttgttgtaagtcaacccccatctattgtgtgtataaatgatcagccccacctgtgagaaagataccacagaggctgaagacaggtctaactgggggaatatagtgccttgaatcaaaagcagtatttcttcttttctttttctttctttctttctttttttttttttttttttttttggagacagggtctcactctgttgcccaggctgaagtgcagtggcgcaatcatagctcactgcagcctcgacctactgggttcaagccatcctcccatctcagcctccccattagctgagaccacaggcacatgccgccatgctggcttatttttgtatttttcgtagagatggagttttgccatgttgcttgggctggtctcgaacttctgggctcaaacgatccacctgccttggcctcccaaagcgttgggactacaggcataagccactgtgccctgctgaaagcagtatttcttttgaagggacaaatttggattccttgaaacatacagctcaaatggatatttgtataaattattaatatttgtctttcagttcatttagtttcctgctgggttatgattatcaaaaattgtaaacttgtctatttccctctgctagactggcagttaaataacaggaaagtcagagtagcagaatggatatgggcatgggatttaacaacagataagcctggtctagtccaatgtccactgcttaccagactcccagcttggtttatgcccttccacaaaaaactagctccatcatctgtgaaatgaaagaatctggctgggcacggtggctcatgcctgtaatcccagtactttgggaggccaaggcaggcggatcacctgagatcaggagttctagatcagcctggccaacatggtgaaaccccatctctactaaaaatacaaaaattagcagggcatggcagtggacgcctgtgattccagcgacttgggacactgaggcaggagaatggcttgaacccaggaggaggaggtttcagtgagccgagatcgcaccattgcactccagcctgggcaacaagagtgaaactccgtctcaaaaaaaaaaaaaaaagaaaaagaaaaagaaataatcctagtagccacctcactgggttgctgtgaggattaggtgggattgcataagtaaagcagttagcagagtacttggtatagtcaacccatggcagccactacagtgacagggaggatggttttttaagttccttgggaacaccagtcttgtatctgcatcaccagcttctagctcagtatctgggaatgagagtgtcggaaatgaatacatgaaagtcccagtctttgccatctttagaatgagtatttaggtaagcacaagcacatctgcgtcccaatgccatgtccactttggctgcagctggacaagtaatattcttaaatccccataagatttaggagaagggatcttccccagggcatcagtcacgcagggaatttgaacagagagcagtggctgggggactgtctcattgagggaatgggtgggaagaacaaggtaaagaaaggtcggtcagaaatgagagagtaagatctcctcggaagtcaagggaggaagttctcaagggagatatgctgctccacggtggcagcaagttcaaagagaaggtcattccatgtacgccttacgcatacctatgtggagtcactcatttggacacccagtcttattagagttgcatcgtgccatacattcatttttctctattttgattagcagctattgaagagcctttacccaccatgacaaatgaatactccatcttaatggctgtcagctgggctgtggtttgctgccattgtttgccattgtttgcacacaaaagcctgatcccattaagaccgtcagatatttcctgccatcgcatggcctcctgctcacaaacatttgatgctatttaaagcctcttctcagcaaatatgcatcggtcacatgtatgcactgcccattaattaaggccagatttgaagctctcacagctgtcacttctattaactgattgcagggaatgtaggacttcatttttctgggagataatgtgaacatcggagaaaagccaagagatcttcgaatccctgtggcacttaccttgacttccaggcttgtaatgaaaaagcttcttagacaaaaagggacaaaaagaccctttcacagaaatcataaacaatctctgccaagcaggagatttagtgggtgggaacacacacacacacacacacacacactctttatttgaggcaccctggaaaatgaaaagctatctggggaaagtaatcatgtgagaagatggccttgaagatagcagcttgattttctttgaaagaaaaaagtggaccaatttacagtagtgactttgctaaaaggctgaaaagagttgagtgtattttctcttcagtctctctttttctaaaggaaacacgtcatggattgattggaaaacatgatcttctagttatcaaatgctttaattaatggcaaatcaaaaacataccagacaaaggttgccagttatcaaaaaatcaaatactaattttctcccagctgcatgattgggagcaagggtgtggagctggaggtgagactggaaatagtcacaatcatgatattaatggaattaacgtttattgggtgcccacaacatggcactttaaaagaatgcattttcataaattatcttatttgactcttgaaaacttagatgttatcatatgcccattttatagatgaggaaactgaggcttggcaagcttaagcaattttcccaaggtcacccagctggtagatggcagggtcaggactcagatctcagtgaagtctgtctgccatgaagttcctgttcataaccctttgttatcctggtacagtggaaagcacgtgggctttggagacagactagagtttcatccagattctgtcatgggaccttcaacaaattgtttaccttctcctcaactgaagtaaaatgaggaaaatagaccaggcgcagtggctcacacctataatcccagaactttgggaggccgaggcgggtggatcacttggggtcaggcgttggagaccagtctgaccaacatggtgaaaccccatctctactaaaaatacaaaaaattagctgggcatggtggcaggtgcctgtaatcccagcaactcgggaggctgaggcatgagaatcgcttgaacctgggaggcagaggttgcagtgagccgagatggtgccactgcactccagcctgggcaacagagccagactctgtctcaaaaaaaagaaaaaggaaaagaaaaataatagctgcctcatgggctactacacagattcaatgaaataagggtaaacaaaaatcagagatactcaaagtgttagtttaggggtattctgcaccccacctcccatttcatttcattccagttatttctttctcctgtcactggactgaagctcccaccaccttccgctatgttgttcctgcattctccacttcctcttggctctttgtcttggggaccaacacagagaaatctttttttgcccagttcttcccagcagtgcctgcagctgtgcctttgacaatcctgaccccagctggtccccgaggacctcccagcctcccacctctctcctcagactcccatgccatgactgaaaaacaggaggacctgcgaggcatgtgagaaatctacaggcttgacatctgtgggccaggcgctctctctcaatatttttttctttttttttttttgagacaaggtctcactctgtcacccaggctggagtgcagtggtgtgatctcggctcactacagcctccacctcccgagttcaagtgatttccccacctcagcctcccaagtagctgggactacaggcacacgccaccatacccagctgatttttttgtatttttggtagagacggggtttcaccatgttggccaggctggtcttgaactcctgacctcaagtgatccacccgcctcagtctgccaaagtgctgggaatacaggcgtgagccacagtgcccagcctcaagtccaattaactatttttcaccgttgtttacagagctttaacttctcatttgctttcaaagcacctgcatttagaattttagatgataactaagatggtttgcattacaaattcttaaaacatttggctttcagaaaccatcttgggctgtatacatggagaaaatgcagtcaagccctgaagcccagggctaggagacagcaaaggaaagaaaaaaagggaaacatggggagccatgatctcagtgtcgtggaaggcagtggcagagaatagctcaagagatgagggatgagaactgagaagaccccacgtgcagggaaagtgaagctactggcatcctcagggaagaaatgccagtaacctggtgagggtagcagtctatggcagaaggttaaaggaacaatgattatgtggaagtgggaccagcactgtggttgcactgtggtcgccaggggctgggggaggtggcaatggggagttgttgtttcatgggtacagagtagaggtggatggtagagtgatggttgcacattatgaattttttttttttttgagacggagtttagctcttattgtccaggctggagtgcaatggtgtgacctcagctcagtgcaacctctgcctcctgggttcaagcaattctcctgcctcagcctcccaagtagctgggattacaggcacccgccaccacacctggctaagtttttgtatttttagtagagacggagtttcaccatgttggccaggctggtctccaactcctgacctcaggtgatccacctgcctcagcctcccaaagtgctgggattacaggtgtgagccgctgtgcccagccaagagtatattttaataccactgaactataccttaaaaggggctaagatggtaaattttatattatgtttattttaccacgtttttgttttaaaaagtgcaggaagcatcaagcttggagccacagtgaaagtcaagaatgtcagtgattccacatttaatatctacatttttgcagggcagttactcttttgtagtataacattgagctgatagcacatagtgtagacaagtgaatacaggattctctgggttatatttccagaagtctggaggtcatttggatatttgtgggcccttggcttcactctgacttgtgtgacacataaaaattgtgatgaaatgtcctatagatgtcctgcaggtcttaaaagaacctttccaaactatgaaacagcccagcagcactgagttagaggtaaattctgaacccttgaacactaaaactattctaactgcacatagaattggcaagtagcattctatgtctatgaacagtatgtcttttctatataacagagaaaatctttttaagcaaactactcagtttaaaacctaattcttctcataatctcagtacttttgaatgaagacatatcagtgcaacagtacactcttattcaggcatttgaaagaaagaattcgagatctagtttgtatcagatattataaattagtatggtttagtctttgtcatgaaattctacttaatttttggactataggtttaagaatgtaagcagaagttctgcaccaatcagaataagctacattatgcttgagtgacaactactgtaatgacaaaatatcagtggcttaatacaatggtttttctctcatacttgttcataaagagtcagcaaggaccctgctcattatggtccctcagggacccaggttgttggaagctccaccattttagatagctcccttcaaagtcagccatctttgcagtcatgtcccccaacagctgcaaaatttgctctgatgctcaagaattgagcatcggcagttaaatgcttcaacatgaaagtgacacctgccactcccactcacatcccattggccagaactagtcacatggccagacctaacttcagaaggttggagaattgtaatcctccatgtacccaaaaagtagagaagccagatactgagaaacatcaataatggctaacagaaatccattctaccattccctttgcctaaagtgaaaagatgagtactttcatcaatttgtaaactgtacttttgaagtaaatcctggtagcttgcatgggggctggatttccagaaagccatatgtaatttgggaatgacattcacttaagctcatagaatatcattatttgatgtaaaatgcccccatttgcaatacaggaccaaaatgcactaaccacaaaattccactccacaagggtctgggttctaatttcttcattctttaaatgaggcattctatgatttggaatggaagcccagttgtagtcgtaagaattttacttaattcaagaattattctcactgaatatgtgccagttctgaaaggaatgcaaagtcaaattttgcatcttctttgctcaagggcctttagatgtaacaacacagacatgatacaaggctgacaatgacattatgatttaaatatgttaaacaacttattaaattgtgaatcaacaaaaaattatgttctttattttatggttttgcatagtcctgactcactgcctacatatccctcttgttcctcagctcttatccctgatttcttacaggatggcctaagacagctgtagatgtttttatttagcaaaaaaaaaaaaaagaaaagaaaagaaaagccaagccagaaaaatatgttactcctgttaatgttttttccttattcaaaataaaacttactttagcttcatgagaaataatacatcttacaatatatattactgacttttttcagtaaagataggtcaagaaagaaattgtactgctcattagccaccaaaatactagtattgggggcttattggaaaagtggtaacaacggcaacttttttttgcaactttctttttcttttattggacagtctcactctgtcacctaggctggagtggagtggcatgatcatagctcactgtagcctcgacctcttgggctcaagcgatcctcctacctcagcctccctagtagctgggactacaggtacacactgctatgctcagctaattttttttttttgtagaaatagggtttcaccatgttgcccagggaggtcccaaacctctgggctcaagcgatcccccaacctcagcctcccaaagtgctgggactataggtgtgagccactgcacctggcctaggcaaatttctaatcctaaatagtgaaattagagggccaactgtggcaaatctaggggataatttatggcaagagagccagggggttgccaggactggtctcaaattctcccgtattggattaatttcagtgatgtaagttgaggccactgacccacatgactccttcagaaccgagagcaggaaggacagcatgacatagataaagtcccaagccatgctgattattgtttaaaaacttcaggctttccccaaattgcatgatatcttaatctttgatttcttcttattttaagtgtaaaaatccatccctttattttataaatcctgattttgccatgaagcggtctctgaactcctcagctgttactgcccagtttatcccttaattccaattccacctaccatgtggttcatctcttgtttatctccccagctagatattaagcccattgagagcagggatgtaacatatgccacttttgatttctctaaaggaccaggtcagtgctaggcacacggtcgatgtttaattaatccttcattaatataacaagtcacctgatgatttagatctttccttcaaaacccacctacagacacacacacacacacacacacacacacacacacttacacactctgatcatttagtctttccctgaatgactccggtggtgaagagctcacttcctcccaaaacagcccttccatcttcagtcaactgctaatgtaatgagctaagatttactgagtgcctactatgttccaggcatggtgctaagccctttacagagattataacattaatccttacagcaatcttttgagggaggcattccctaaggctttgtttcccaatcactacgtgggatcagtccttctataccattcctctgtaagccccagtccaatgtcttgggaccacagataggaaatctaatctttcttccaagtgacgaagtttccaatgtgggggctatctagcaatgcctgtcttcttttcttcttgttaaaccccccaggtctttacaccattgttaacaacaatcactgagtctcattgaacactcactgtagtccaggtactgtgaggaaggctttctttttgtgctttaaattattttttcccatttatgattgacagaaaggttatgcgtcttgcctgaggtcacacagctagtgtatggccaacagaactgcaatcctggaggggtgtgattccaaagacagagtttctcattactgtttggcatcatttctacttatggtgattttcactgttttaacagtttagaatcccttatgtcactttcataataaaagggagaaaagggcaaatactttgtcacagaaagaagattcattaaagggatatttttaagccactgttttcacaagaaaaccaaatgctagaaaaggtacaatgctaaaaagaaactgtaaaaaaaaaaaattgatacctataccacagtaaagttattccaggtaatttaacttttgagctagaaaccgagggttctccttgcatcagggtgctctcaccctgtagtcctgagaagacgacctgttttaggcaaatacataaaaccaaatggaatatattagaaaggaagtgtcacagaccagtgtccaaaggtttttggagggcagaacgtggagcaatggaccgtacacagagagaagaggatttattacaagtcaggatcattcagggatgaactggcttccttaatgggtggaaggctgcctgtcaccggagaaagtcaaacaaaatcagatagacagggctcttgcaaggacagaaatggcttagaaagttaccaggcacccaggagatcatctgaaggtgtgttaaaagttaacattaagagtctaggttcttttagaatggcaatcattaaaaagtctggaaacaacaggtgctggagaggatgcagagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggctctattcacaatagcaaagacttggaaccaacccaaatgtccaacaatgatagactggattaagaaagtgtggcacatatacaccatggaatactatgcagccgtaaaaaatgatgagttcacgtcctttgtagggacacggatgaagttggaaatcatcattctcagtaaactatcgcaagaacaaaaaaccaaacaccgcatgttctcactcataggtgggaattgaacaatgagatcacatggacacaggaaggggaacatcacactctggggactgttgtggggtggggggagtggggagggatagcattaagagatatacctaatgctaaatgacgagttaatgggtgcagcacaccagcatggcacatgtatacatatgtaactaacctgcacattgtgcacatgtgccctaaaacttaaagtataataataataaaaaaataaaaaagagtctaggttctgggactggaatgcctgggttacattcctgctcaacatcttactcatcttagacaatttactcaactgcctcagttttctcatctctaaaattgaaataatagtatgactttcctcttggggtactgggaggagtcagtgagttaatttaaatagtaaaacatttttaaagtgcccatgcatatgctaaatcatctggtccggtggtcctaacactttttcatgaaaatgatcttgtttccaaagaaaagagatataagtaatcccaacacataaaacaaattttttaaaaccactaatgtgttttgttagcataaattaatttcttttttgagacaatttttaggttcaagagtacatgtgcaggtttgttgtataggtaaactcatgtcacaggggcttgttgtacagattgtttcatcaccccagtacgaagcctagtacccaatagttattttttctgctcctctcctttctcccaccctccatcctcaagtaggccccagtgtgtgttgttcccctctatgtgtccatgtgttctcatcatttagttcccacttgtaagtgagaacatgtggtgtttggttttctgttcctgcattagtttgctaaggttgacggcctccagcttcatccatgttcctgcaaaggacatgatcttgttctttagtataaattaatttctaattaaaacattaacatctaactcttatacaggcatttagtgaacatgtggctattttgtccattagaaaatttagcacaagtaatatggaaaatgatttggatgccttagcgtttactttatttctgaattgtgtttcaatttacaacctttgaagagttcttaattaacataggcaggaaattacagacagtctctttggttgaataaaaatgggagcagtttgttccaaaggctgcataaaaatgagttaatgcagagatgtctggtgtgttacacgtaggcgtatactgtggttgagtatatatgatgtttatcacagttcttcacattttgaaaatatatcttaaagattatgaaaatactgaagtagagccttggaatagcttgaaagccactgacctgtctcatttagcagacatgatttataggttaaattagccccagtgactgtccaaggtctcaacagaaaacagtaggactcaggctaacaccagggtctaactgattgtggttaaaccagatgatctctatgttttcttctgttctaagagtctatgattctagcattctatgtttagtgggaatacttgccaataagcctgattttctatgataagcctcttcttccttcaattggttaggccattttgttcttctctatactacaaatctgttacgaaatgaaatttcagagctatattttctgaaaaggataaatgtcctttgctccaaattcattttatttttattcctatccacttcagtttgtataaaatacagaattctaatcttcaccagcaagaatttgtggtttttcctaatacaaactggtaactgtaagctccagatttacaaaaaaaaattcaaatttgactttcacggccagctaggtcaatactctatgccacctttgtattctgttcctctgacattttagcttttattttttaaaaactggttcaatatgttgctgactttgagtcacagcaaggaggaagatggatatcttcatctatgctgctgacatggttttccagccatcctaagaagtgaataaatcacttttactggttactaatctgaatggctttgtatcaatcatgtcaccattaccaacttatttgaggcagggatttctctagtattcaagtagacacttccaacaacttcctctagcagtccatttcacccctcagctcaggggtaatgccttggttagttcatggaatccttaggcggcaataacggttcaaaatgaacattatactgcagctcctagtaagttatggatttatagcctgcccctgctcaagagctccagaagttccttcagcttaaaggtaataggctgtttttctatcattatttaaaaacacaagtcgaacagtgatttccttgcagccctcaatcatatacagaatacagtctcaaagctggtacctcagggctcaaaatggggagccccagggtcactagggtgactcaaacccagaggaaagatggtcttggggtgtattagcctgttttcatgctgctatgaaggcctgcccaagattctgcaatttataaaggaaagaggcttaattgactcacaattccacaaggctgaggaggcctcaggaaacttacaattctggtagaaggggaagcaaacatgtccttcttcacatgatggcaggaaggagaagaatgagagccgtgcaaagagggaagcctcatataaagccatcagatctcatgagaacttaccatcatgagaatagcatgggggaaactgcccccatgatttaattacctcccaccaggtttctcccaccacacatgagatttgggtggggacatagccaaaccatatcatgaggaaatcctggcttgtcatcgaaatcataccatggttttagattccctttctgataatcgaagaacattctggaggcctgaggcagagtgagccaccagaagaaataggagctgtccaaaataatttaaagtcccaggcccttgggtttgctttggggaaaaaagcttttatcacagccttttggtgcaacagaaaacaaaatgtttgggagaggttttagtaccagcacttcaggcagtgcatgtaggcaatggataagagagaactcaaagcttctgggaaattggaggtgtcccatgtttataaaggggaaattcaagatgcaattaagacgactcctttccaagaaataccaggacaaagcaagtactccaaagccacccagtgccactttccctcatccctccacctgtccaacacgtgcacctttcagtgggtgctctgcacttgctggcatctgctattcactaccatattccctgtttcaatcactccattaatctccttgcctttgtggcttccaccttaaaactctgcttttgagtttttgaactagatagatacgagcacagatcctagcacttggctgtgtgacctcaggcaagttacttaatctccctctttcctccattattaaaatggtagtaaatacattcatcctatcagataagcaacaaataccagtttcttttctttatattgcttttcttggtgctcaggagcacctctgcacacctctctgaatagagggagcacacttttcttatggaacctaaagtcaccagagtccataagttgtcaaaatggaatccttgattctttttgactttggctctttctctcttttaaccagagtttgttctctgctggagaaatgcttttcattttacttccatatttgctgccgtttcacatttttaaaagtatattcaggccattctctagctaaataacattccaatcagctactgtttaagctgggaattgatatcatttatttgtgtttctttgaatttgccctctatgttatctttaacttgactttaaataaaacataatatgcattgagttccttccatgtgtcagatgctttttacaaacataaactggcttcatcatcataaaaccaacccagtaaattaggagatataattaataaatagtgtcactaattattacgtattttcactttatgacagcaaagtatttttgctgtcaaagcataaggacactggatcattgtcaaaatccctaccttcactcagttgtccacacctgggttaaggcttattcttgagcggctgcagccctgggcactcccttccacctggaatcagagaatcacatataggcataatgcctaggaggaagtaatcagctcgtttaagtgatggctgacatcaggaggccttttgagccagaagaatgacatgatgatagctgtgtctttggaagataaatgtcacaaccacgtgcagtatagattacctgaaaccacaacatttagcctttatgcttacacatctggggggcatgatttaaaagctcataaatacaatctggattttaaagaagggactggtgaaaattaagaatttcaaggttctaccaaagaaggtgaaggatcggtgtttttccaactggtttatgtgtcctaaatatttatgtatacaagtgcatattgttagtgcagtctcttggaagccatgtgtgggcagcagatctgctattgccctacctttcagtttaaagttgcaagagaacggaaattctctgccagcatgagaatcattcatctggcagccacctgaattactgttaagcaacacattgagtttgacagataaccctgttcttagccatccttcaagaaaagcatgaaggagccttcatgtttaaacatttcagccaaatttcttccttctgacaatgcatggaacacaatgtctttatttcctaatgaaatattcatattggatgtatctatggttagaagagagaataataaggaattatctttatttaatttcttagtcattctggtctcagagagcaagctctcgggttgggtaatgacgtcgcccaaggaacctgatgtttttcattgagttataaatatctctcaacttggcaaaccaatagttcccattcccaggatgacaaatgagaaaaatcgttactatttcagtggatagttttggatctaggaatttgttgtgagaggaagggtggtgttatagatgtcccttcatggggggtaaatcagcacaatatgggacttcagaggacttcaatatgggattgcaagggaatcaagagacgctataggagatgctgaagcagtgtggccaggcctcgtgggaggggaggcctcggattgggagtaaagcctgtgtgtaagcatgttggggaaagcccgagagcagcctgagagatataagcgtataggtggcccttggtcagtcatctaccaggccctgttcttacaagaagggtttctgttgtcccaagagacaatacaactagcagaggaaaaagatcctagacttcggggccagaaggcacttatttcaaacccgccaccatcacttctgtgtgagctttgacctattacttaccttctcagagctttggcaaaatagggatagtaattcttacctcctggtgttgttgagagaattaggcaggataacatattaggtaaggtgccaagcacatggtgagtggtccagccgtaacagctgtcacatatatccatggggcttcctactgcctaaatccctaccagatgcttgaatgccctgattgcatctgttttccacctacaactcatctaagaccatgaccctacatgcccaacccataggctccatccagcagtctcccttgctctgtttctaaaatgaaaataatccctttccagttttttaggctttccatagctggtctccaagacaaaccgggaaagactaccaaaagaaagcattttctttaagttttttgttgttgttgttaatgagaaaagttacaaagataaaagaaatctctggaagccttgatcaccattgtcccagagcattattgaaatgcaaatagattgtgacagtttacctgttacagctctgtcttcaaacaccacttgagaatcatgtgaaaagaaaggggggttttggtggacagtgcaaatacacaagcctcccctgttggtagagaagtatatgtagcttgtgtgaaaaaggggatcccatggccagactgccaagggacgcgtctcgaggagaaggagaggcacaacattttaccagcccctacttcatgccagttctgaattaggtaccttcatttacacatttcatttaagcctcacaagagatttgtgaattatactttgatccctcattttacaggtaacaaaactagggctcagaaaatgatgtcacctgcgggtgtaatgtgcattattaggaaggctcttaggtgaacattcatgtgtctagaagaaaagacgttttgaacatatggaacgtagaaaagaaatttttgttaaattctttaaatcccagcaagtgcacttcagattcaaagtccttaggagtccccccatcactcagagcttctctttggctcttctccaccatctcctagtttctcctctccctttcctctctgtccctttcctctctctccagcactggaagcaaaactaggcttttctatttagccagatctcagggcttttttgtttgttttttgtttttttgagacagagtttcattcttgttgcccaggctggagtgcagtggtgtgatctcaactcactgcaatctctgcctcctggggtcaagccattctcctgcctccagcctctcgagtagctgggattacaggtgcccaccaacatgcctggctaatttttgtatttttttagtagagatggggtttcaccatgttggccaggctggtcttgaactcctgacctcaggtgatctgcctacctcagcctcccaaattgctaggattacaggcatgagccgtgcaccagcctgatagcttcttttgctatgcagaagctcttaagtggatcccatttgccaatttttgcttttgttttgattgcttttggcatctttgtcatgaaatctttgccagttcctatgtccagaatggtgttacataggttgtcttccagggttttggcagtttggggttttacatttaagtctttaatccatcttgagttgattttttatatggtataaggaaggagttcagtttcaatctttgcatatggctagccagttatggcagcaacatttattgactagggagttctttcagttctgtgatagttcatttgctcttcaaccatttcctggtgaaaacagccaataaggaagtcagaaaaggactgccagctgcaagaagtgacttctgacatccagaggagggacggcagagaccttctggtagttggaactacttaatatagagggtggcaatctctcacacctcagaatgtctctgagtcatctagagcaagagtcagcaagttatagcccatgggccaaatctagcaagtaaaccaaatctagcatgtgagcctaatccacctgccgtctgtttgtgtaaataaagttttattagaacatagccataagtcatccatggctgttctcacgctgcaacaatccagcagagtggctgcaacagagaccatatgactgcaatgcctgaggtatttactctctggctctttacaaaagaagcttgctgacccacaatgtagagcagcacctttcaaacctgaatgtgcataggaatcacctgagaatgctgttaaactgcagattctgattcagtagccctgggaagcggtgcaagacttctaaaatgccccagacgatgcctgcactgctggtccatggaccacactttgagtaacagggggccagagaaaataaactaaggcttattgtaagattctccccgggggcctgaaagcttaaggagatgaataactcctcccttctcaggcccagtcccaaggcacaaggctacttgcaccagcagtgtgctccagcaaaatagcagaagcaggaagagagccagccggaagacacgtacccctgaaaatcaagaaagaggccatccgggtacaacatagcagtaatgtcagactaggacacttcctgtttacaggagactataaaactttcgccctgtcctcacttggggctgacgccattttaggcctcagcccgcctgcaccctggtgctcattaaaacagcatgttgctccacaccgcctcctgttgtctgttggcacgctctcagggttcgaaccagtacaagaaccttacacttactagtcttgatttttttaaaaactgagaattataaaatatactttagaaggattcctatccaaaaagctaaaataaaaatgcatagggttttagaggaaaattctgatgaaagaatgggagagagagaattattataactaaattcgatgaatgaattaatgagtatcaagatctatgctcagacccttgctgtaagatggctccatcaaaggcctgccccccagtggagtttctgcctcaagaacactagtattctttcaggttgtcaggccaggaaccttggtcttccttactccacctttggtagaacatccatcttcagtccagttggccattccttcagcgtgatgttggtgggcccttgccctccattctaatttcatctctctggtccaggcctccatcactttgtgcccatcttaatgcagttgtctgtgtgtgtcccagtctccagtctcttccatctccagtccattgcccgtgtttgccagacatcttctgaaaagagctcttcagcctgccatttcccactcaagagtcttcggatttaagatcccacactttcgttgccagccttttctctcatcatctcgtcccactcacccagtcagtcctctcagccgtccctggagatggcccaatgatagctaagaagcctatatattccccaatgttgtaactcatttacacagattttaaagcatttttcttgaacattttggaaatacaagatttgaatatttcacccacctttttttttttgatgttccaaaaaaattttaagaaatgaaatcatgccttaacaacatggcagaaacttgcacataagagcacagtaaatatgcagtcagcctgcatctctgggtccacccttcttgtgtttctcaacagtcattgtttttgttaatgttggatcactgcttcttgtacttaaactagttgtttaggtaagtaccctcttgcaaaggcttagaggtgccatcttgtggagaaaaatgcaaacaggcacatttggctgtgtgttaaggaaatgacaaagatgccggcgtgaatctccatcattgccttctggccatggggacggtcccgtgagagccttctggggacctgcattggtagacacaggccatctgcgctcaggaggccctgtaaatcaggccagtgtgcaagcaacctccatcctggatcagagttcatcaacccaactcactattgcctttttgctgataatctagcctccagaactctgccttatagggtgtaggcagtgtctctctgctccattctgcaaggaacttcctagtcttgaccccttatcagccccaaaccacagcttctaacagacccatcccacgtggttttttcctgctgccagcccctcctgagacactaaaaaattacaataaaatctggccagacatattatgatctctttaaacacaattcaccatacggctctacacattaaaagtaaagtgaaagtctagaggtttctagtattctatacaaaaatatggttaccttacttttataatagagcaattatcactgtcaaaagctatttcaggcctctctcctccttcccccatttcaatccatggaggaggaaaattatgaaagtaaagcattagaattttagagtttgggatatccccaccctccagagaacgatgacccttgttggaattgggggaggtggtaattatcttacagaatatgatatgtttacctctcgggactcctttcttcagatttgtaaacatagctgcagttgattcttacccagttttatcctacaagagcgccaacattttcttccagttgagtcccttgataagatgctatcctattatgaactaggatgaggtactgaaaagtgacagccataagcttgattaaaaccagatcgctcgttttacaattgctttcatttaggaagccaaaataccttttatgccatggaccatttcttctcttcaaatgaatggcatcgtcaatttgatcttcattgattcctgtttccaatttaattttgtgtatatacagcaaatttccctccctttaaacatggcaggattcttcatatcagggctgtatctctttttaaaagaaaaattttggcaccagaagggaccttagagatgagccagttcgaagagcaggttggtcctgtaactttgatcttttgattcttcaaccagctgctctttcattcaacaaacgcttattaaacacctaccaagtcgcaggtactgtgctctttgcaatacataatgatactcctgctgaagctaagccaagaggcaatcttaaagaactcgagaaggtttgatagcagtaaggaactatttttggaaactggataattaagtgttctttgcttattagcttctctgacatttacaaaggctgtttgtgcacttctgtggaactaccatcattttaaagctttctggggaatctgtcatgtgctcctcggtgtcccatgagctttggaataaagagcagtgattctcaactgagggtgattttgctcccatggggaacatttggcaatgtctggagacatttttgtttgtcacactgagagggatgctcctggcatctggtgggtagaagccaaggatgctgctaaacatcctacaatgcataaggcaacccccataagaaagacctttcaggaccaaaacatcagtagagctggagttgagaagccctcaccttgaggaagaagagcaggcaggaggatgagaagctaggtttctaaaccctgacagtccttcaaccaaagcagttctgctcttctcattttgcatagtggagctttggatttccacatgagattttatttttgaagtatatttttttctacttaaaaaagttgaagactactgtggtagaagacaactctctgccttctgttttacaattgagtcactttggaacaaatcaagtgggtgtatatgatacaggatgagggcagtcaggggtagatttggaagcatctacctgagccttggttttggctgcacaggactcgacatttacaaacaatattgaagtgatttgattgtgtctgactttcaatttagaccagggattggcaatttttttctgtaaagggccagatctaaatattttaggctttgtcgactttcctgtttgtgttgcaactacttaatctgctgttgcagcacaaaagcagccatagacaataactaaacaaatgggagtgtttgtgttctaataaatctttatttataaaaacaggttgtgagccagatttggcctactagctacagtttgctgacccctgatttagactgtaaataggaaccttgtttgttttaccttcatgtctccgctgcctaccactgaattggcacgtagttgaagttggctcaggaaacatttactgaactatatcgaaggtcagttttacaggcataagtgttagaagattttaatgagaataacaactggaaaaagatccacccagaatagattaactgtttccttatgttgaacatttaggatgtttccaattttttattaacaatactgtgatgagcccttcatacagaaactgttggcctgatttcttatttcctggcataaattcctagaagaagaatttactggatcaaacggtctatattgctaaattgctttccaggaaggtggtattgatctacatgcctaacagtaataacaggaagatatttatcatatacaaaggatttctttcaacagaatgtcatgaataaacgttttggcatccatatgcatttccacgaattagctcaccgtaaatataagtaaattggtgtcagctactaatcattttaatattctcccatactgttctaccagcatgattattaaggcacgctgttttacctgtgggggtcatctagccaaacagttgaggttaccctatctcatgtgtttactgagcacacacagacacatctgcttcccattagggaatcaggacctccactatctgaatgcctggcaccagcctaccctgctgtgaaggacagaggcctcctccctgtgaaattcacctccaaatatgtcatccagattgctcatttccctcaggaaatttcattcaggttaattttggcacacaattgggggtaattcttgagcaatttctcctgtgatggcttgcgatgtgtaaaattttcctacaacgtgttgcagaaatcactggaaaaaatacaaaggacatctgatggttatccactggtctttgtaacagcaagaaatatctattctgaacagcagtacacgatgagcaagaaacataaaataaaggtagatcagagagtagatgttctttctggcctttttcgacaggtaccgtttgagcagtgagaatgtagaagctgtatgaggtgtcttgactttatggtgaaccttggccgattttgttttgttttgttttttgcacttcaaagttttctgaatttcaccaaatgaagaagaaaatatttctgactaagaagtagtagaaagtgttacagaagtacgggtgggtccgggtggttgtatgatgatgagatttacttaaaagtgaatagacttcagacaaaataaaatacataaagacaaagatgacaaaacccagcattttctgagaagccaccatattgcagaattctgctaattacattctatgtttgcctcatttgattttcccaacagtcctaaggggtagctgctccatccccatccaggcagaaaaaaaatcccagggctcagaacagctcatcaaaatgtccaaagatacagcactcgtcagcagcagagacagcacaagaacgcatattctcctgcccacccaaagcagtggtgcctcggaaagagtctagacataggtcagcactaagtcgtccctatcagcgaccaattgatcagcctcctgatacacaaaccagaattcaagccagattcgtttctgaacactgtccttgggaagaagatctggatggtggtggaaatgttttcagcacctacctcaaagagaagtgaccaatccagcatcacacaacaagccagggactgggccaggactgcaccccaggttttctggtttgcagcccaacattctttccattattccaaactgtttttcctgataaatgacatcagctagtgattatacctaatgattatacagctgtgttttggaggagactatcggctgctttaaagaaagtcatagcacgtaatctatacatgtgataatagttcatgaaacatcaaaaaaagtgcatctaaaagataacaaatacaaacaaggcctattcttaagttaatagtagtatactgctgtcaatggcatacatggttttgacaaagtgctttggttatgtaagatattatcgttagggaaagctgggtgaaagaccaccgaaactctctgcgctcattttaaacttcttatgagtcttacactatttcaaaataaaacattataacaataagaaagtaatgcaacaggaagatgggctagaatatgtattcacacactgtgtataaagtataatgttaaaagagccagtgtaagagagatacataatggggttggtccctcttaatcctgcaagaggagaaagccagagtcacttctaggccaggccctctccaggcttcatggtaactatgctttgaacttgttcctctgcacctaggtcactgtcacgatctactccttcaacaaagctagaaccctcaacacgacctccgatcctttgacctccgacttttacctaatggttaaaaacatggactttgatttggggccttgctttaaatccaagctctatctattattagcattttagccttgggcaaattaacctgtcttctaagtcttagtttcctataaatttcagcaatctcacagatggctttttaggattaaatggaaaaacatatatgtttccgaggacctagaagatagtaaagactgtaaatgttagacatgataatgttgaggaagatggcaaggaggaggatgaggacagtcagaaaggcctgttcattttgcatcctaagcatctctcaaatcccttcacgccatccccagtcccctcattcaggctgggatattgcaacatcctccagactttatgtacccaattgttaattatcgactttctaaaggagatttgatcctgtccagcacgacatagagcatgcaagcgttcctcatggcctgatagcttgtgattctctatgtgtatgtctgattgctcctgttagactcagattcccaaagtcaggacctgtgtctgattcagcttgggattttccaggcagccttttcagtgtagtcactcaacaatatcagtgatgaaatgcatctttacgtgtttcgatcttgtcatggcaggtccttcatgtcattcagatcctagtccagaggtcattccccagccatgccctcctagacatctagtccaattcttccctcattacatcatctgatcttcacaacagccctgtgcaggagaagggacagttgtcatgtgtgtaatttgcccttggcctcagctaaatattaaggtcttgaatatgtgttgtctgcctagttctcattctggagttgtccctcttgctttgtgaagtaaaggagagatatttggtaactccatgggaactcagtctcttagaggcctgggtagccactagaacactgaagagtgctcctagtatgttctaaggaagctattgatcatggctcccggtagacaggctgtcacctttagttcttggcatccttgtgcagccgcatgcttcactgaaaccaacctccaggctacttcgacatctaccaggaaaaactcttgcagcctttccttcccatgtctagattgatccagagcaaccatgctctgcaggaaatctggtgggggtgtgtccatcaaactgtgcagagcattttcatataatgtctgattcacaagatcaaataacattttgtctgtgtctgtggttatctgaagctatccatgctagtgtaatttccttgtgatagttccattctaactgggctggggctgaggattaatgtgattaatgtgacgtctgtcccatctttggcgactctcattcattcttgaaatatctctgacaccctagttacaggagagggactcactggacggttcattgtctccactctaggtaaggcccgctccacactgcagtcattgttaccaccgaaaagcaagtctgagcatggctctccccttctccagacatctgggggttgctgatgccataggatgaaaatctaattcttcaatctggcaaacaagattcttgacaagttccgctgaactctccagcctcgtattatccctcccagcaggcttgcacttcagccgtgtcattctgtgttctttcctacctgtgtacacattgttccctttaacagaaggacccctatgagaatgagctcagtctggacaagtcgagtccaggggtagcagcaacagactggaggttgggaagggagggagtgtgagatgtcactagacagggcaggcaatgggtgttgaccacctctcctgtctaccttcccccttgatgacagtcagaggcatctccttgattcagttggaatcttgccttgataacatgggttctactattcaaaacccctgttgatggtgacatttttgttgttgttgtttcaaagcaagggagaattcaaggggggtggggctatggaaatcacacatggaaaacatattccttattttttctgctaaaatgtgcgtggggcagattgagaaggatttgagggaggagaaatacatagcaaacatggcatttggaaaggctaattggatgtggatgagcatattgagatgatgttctattactgtcagagataatgttttacagagatgctatttgtgaagagagaccagtcattattgatgggtcaatgtgcgcttgggaatatggaagcaataatgcccaagggcagtgcctgcagaaaggtttcaatcaggcatgcaactagaggggaaggaatgggcaccttttgatttgactctgcccacaggatttgacctataggacctacctgaagagacccagggttgcataacaaaatcaaaagtggactttgactggtttgctgctcactttgtcctagagatgtggtctgattattgcacttagaattcaagaaagaggacaagcctgtgatttggagaatatgtgtctcaagaattagaataccattctgatttcaagtatctttccatatcctcatgacccagtgaataatcctgtactcacaatatttcattgtccaaaccataatctacccacttccatctgctcatggaaaagtgacagaattctttgttcagaacatgagtcccaattttagattcaggaaacatgatcctgagccctgtgaggtcaggagtggaaagcttcagaagtagaaaaagattttgtgaagatcattccattttgttccaaagtttaatttttggtttttttaaaatagggcctgctctgttgcccaggctggagtacaatgatgcaatcactgtagcctcatactcctgacctcaagtgatcctcccaccttagcctccctgagtagctgggactacaggtgtgtgccctcgcacctggttaattttttactttttgtaaagactggatcacactgagttgcccaggctggtctcaaagtcctaagctcaagcagtcctcctgcctcagcctcctaaagtgctgagactacagacatgagccaccatgtctggcccaaagtttaatttgtgtgtgcgacataaaatggtcccaacggaaacatgaatgaggagggagagataaagcaaaaagatcttagaatgagtaatgggaagattccttttgtcgggggagggaattcaggaaagtcagaattcctttatacactgatgagaccagctctacagacagcactctgtggtttagcaggttatgatctcgtttgttgatgattctggctcttgcttaccttcatccttctgctctgggaaaagtgctctggggtaaccaaggaaaagtcctgcttctgaggcctctagagccacagttaccagttagaggttcagctcccaaaccatttaatttcctaagaaactggtccagggaacactacttttggaggtactttgctaagagtagcatctataagaagacatgagggcaaacttcagtttcagatgtggcacttgtcatgattccagagagattctttatataaaaatcccagcacagaccatcctctccccttccagagtccaacggggattttcagaacaacttcactgtacaacctgtttaagtaaatttctagcaccctacatcttccctagtctttttcccagtgttatttttctcctgatcatttaccaccaccaaacaaactctgttttatttacttgtctggtttaccgtctgtggctcccaccccactcctagaatatacatttcgtaaatagctagaaaagaaatttcttgcccagggatcttctcccttccttcctctgcatgctcctgatacatactatgagtcttttgttttctgtctttttgcagagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaactatttgggtaagcttggtctttttccagagaaaaccgtctgtccctgccagatgatgtattccttcagaactgtgagatagacacagcagtgtccgagagtcccggggcatgcaggcagtgcccctggggaatgtcaaagtaccacctggcctgcgccttgaaatgagaagcttgagtggagaacgttaaaaaaaaagtccttcttgcagataaatacttaatatctatacatttaaaccagcctttgcttttcccaagagaaacatggttataaagtggataacagcccaaattattgctctgagatgggagaagctctttgcaaagcgcggagaccagccagtgtttgttctgttgggatttgaggtggccagggacaattgatcctatctataccttcactccctggaggtctaaagcgaagccatttttctcttctttctgcctcatctgcctggggcagcagacctatacatagtagtgtgcatgtcttctgaaaagctgtggaatcctccagcaatcattttgggcaacatcatcaatactgagaggccaattttaacccatttttctacaaaagatctttgttgatacttccttctggactttggagctatttgcattccatctgataaaaaccacaagccaatcgaacacattatttatttatttattttttttttttgagacagaatcttgccctgtcacccaggttcgagtgcagtggtgcgatttttgctcactgcagcctccgcctcccaggttcaaatgattctcctgcctcagcctcccgagtagctgggaccacaggcgtgcaccaacacacccagttaatttttgtatttttagtagagatggggtttcaccatgttggccaagctggtcttgaactcctggcctcaagtggtctgcccacctcgacctcccaaagtgctgagattacaggcatgagccaccacgcctggccttgaacaaattactttttatgaatttctaatagatgtaagcatgtttaaatcagttaacaatataagggagccatttgtttaatgaatagctatattcatttttatcttttaattatttattgaacaggaacttacctaaaacaaactatgtgtcaggcactattcttaatgtgttgcaagcattcaatctttgaattctctcaacagggaaaagaagctattcccatccccactttacatgtaagaaagcaggcacagagagattatgtaccttgccaagctcaccataccataacgaggtggagctggggttcagaccaggcagtctagctccaggtgtagtagcctgtcaagagatgatacccatgggcagtctcagaacctaagttcctctggtgtgccactggccgtgcagcagtcaatggctgcagcacttgaaagactattaagtctgcaactttcaaatatcaggatcacccacaagttaactccagactcgggaactccatattctacagctcttccatccccatctagtcaaatgcagccaaaactaagtggttttacggggggggaggaggaagggatggcagatgggactcagagacaaacccaatcaaagaaaaactgttcaatttgctttgacaaaacccaggagccaccagagtgtcagaaaacctagtttcccagtgagtgctttgtatattctttttaatactgaaaaatagtgtttgtgtgtttcctcctttcttttgtactgctatgagatcacatctccataaacatcctgcctcctagaatgggaaatgttcttctggggattatttgaattgtgattgtgttcagatgtaccggcaaacaatgccactttttattagctttgtgttgcttttagtacattttccctggctatagttagttgtattcagtaagcagttttcaagctgtgccccctgaataaaaaatagacattctgggtgaatatctactggatgtctgaatggaggaagctctcggaggcttgttgttttcatctggagtatgggaataagaatcttcaccttataagtagtcatgcgattcaataggatacagatatttcagactcggcagagcccctgacacctattaggcagttgacaaatgttcattgcctttcttttgtctcagagagattgtcagttttgattccatcaaaattgtggaataaacatttcctctttccttaaaaaagatgaagggaaggcagagggaaaatggagtcagtgaggggcgggcagggaggttcatgtctgtaagcccagcgctgtgggaggccaaggcaggaggactgcttgaagtcaagagttcacgaccagcctgcgcaacatcaagtgagaccccatctctacaaaaaaatttaaaaatcagccagatgcggtgacacatgcctatagtcttagctacttgggaggcttaggcatgaggatcacttgggcccaagaggtcagggctgcagtgagttgtaatcgtgccactgcactccagcctgggcaataaagcaagacactatatcaaaaaaaaaagaaaaagaaaaaagtcaatggagaggtgattcaaaaagtcaagttcaacttcctatgcccaaagatcagtggggtgcacatgaaatcggtagcgtccatgaaaatattacataaggtcccgtgtgtgaaggagagagagcagaaacaaaagagcaggctctaatgaaagcagattccagagatgacgaacagagattccttctagagcacttacgtcacctggggtgctttgtgtattctctttttaaaaaattgatctataattcacatgccataaaattcatccttttgaagtgtacgttggttacggcccttttctcttcacaggtgttctctttaccaaacccactattcctgctctgtgaagtctgtatattttaaaagtaaatatacatgagattgcttgagatcatgtagaaaccactaccaggtgtatctagctattttgaactcttcgacggctattttttacattgtacattgtcaaacactgaaacctttttcaaagagatatgtggtaggtttctccataattctctaggtaacaatgagggttctggttttcttaccttgtgagttctggctatgaaaactgtattttctgtaaaatttgacttgatacacaaaatttactcagctatttgcataagtttgatctgcagaataagcaatataaaggaaatgaatacttcacatttgtatcattgctttcaagattccagaacttttttttttttccgagacagagtctcactctgtcgcccaggctggagtgcagtggcgccgtctcagctcactgcaagctctacctcccgggttcacgccattctcctgcctcagcctcccgagtagctgggactacaggcgctcaccaccatacccggctaattttttgtatttttagtagagatggggtttcaccgtgttagccaggatggtctcgatctcctgacctcgtgatccgcccgcctcagcctcccaaagtgctgggattacaggcatgagccaccatgcccagccaaagattccagaacttttacaactttatttttttttagtttcctgttgtttccagaattacctttagttatttgtcatgcaaataaaactttccctgtgaaatatttggtatttttttaaataactgattccccagtaacaatagaaaatagatttctatgaaaaaggcagacttgtatttattaatgctgaagctgatgatttaatcacctcatttaatcttattttttacttttattttagcttcaggtgtacatgtgcaggtttttatataggtaaaatcacgtcactggggttttttgtacagattgtgtcacccaggtactaagcctagtatccaatagttattttttctgatcctttccctcctcccaccctcaagtaggccctagtgtctgttgtttctctgtgtgtgtccatgtcttccatcatttagctcccacttgtaagtgatagcatgtggtatttggttttctgttcctgcgtggttttctaagtataatgatctccagcttcacccatgttcctgcaaaggacattgtcttattctttttatggctgcatactattccatggtgtatatgtaccacattttctttctctcatctgtcattgttgggcatttaggttgattccatgtctttgctataatgaatagtgctgcagtgaacatatgcatgcatgtgtctttatggtaggatgatttacattcctttgggtatatacccagtaagggattgctgggtcgaatggtagttctgtttttagctcttggaggaatcaccacactgctttccaccatagttggaaaatatttacatttccagcaacagtgtataagtgtttccttttctccataacctcgccagcatctgttcttttttgactttttattaatagccattctgactggtgtaagatggtatctcattgtggttttgatttgcatttctctaatgattagtgatattgagcttttttgcatatgcttgttggccatacatacgtcatcttttgaaaagtatgtcttctgttcatgtcttttgcccactttttaatggggttgtttttttttccgtaaacttgtgaaagttccttatagatgctggatatgagacctttgtctgatgtatagtttgcaaatattttctcccattctgtagggtatctgtttactctgttgacagtttcttttgctgtgcagatgctcttaagtttaattacatcccatctgtcaattttagcttttgtttcaattgcttttagcatcttcatcatgaaatccttgctagttcctgtgtccagaatggtgttacctaggttgtcctctagggttttatagttttgggttttacatttaagtctttaatctatcttgagttgatttttatatatggtgtaagcaaggggtccagtttcaatcttctccatatggctagccagttctcccaggaccacttattgaatagggagtcctttcccaattgcttgtttttgtcagctttgtcgaagatcagatagtggtaggtgtgtggccttatttctgggccttatttctctattctgtttcactggtctatgtgtctgtttttgtaccagtaccactctgttttgattaccgtagccctgtagtatagtttaaagtcaggtaacgtgatgcttccagccttgttctttttgcttaggattgccttggcctttggggctctttttttgatccatatgcattttaaaatagttttttctagttctgtgaagaatttcattggtagtttggtaggaataacattgaatctgtaaattgctttgggcagtatagccattttaatgatattggttcttcctatccatgagcatggaatgtttttccatttgtttatgtcatctctgatttccttgagtggtgttttgaattaaaatttcagagatctttcacctccctggttagctgtattcctaagtattttgttctttttgaattacctcattttaaatgattttttaagccctcaatatttaaatgagcatccctaggattctctttttttaacttttaagttaaaggtacaagtgcaggtttgttacatagttaaacttgtattatgggggtttgttgtacagattatttcatcacccaggtattaaacctagtacccctaagttatttttcctgatcttctccctcctcccaccctaggcttctcagttaataacagtagtcataccacacatatataatacttcagtctccaaagcattttcacatacatggccttctgatctttaacactggacattatttattaatactttgcttattccaaaaagctttagacgtactaaaacttactattaatactttgcttatttcaaaatgctttagacttactaaaacttactgaaggtataattatagagttaagatatgaaaattaaaatttaaaacttaaaaactaaatagaaaacggaggcatgtattccagaaaccttggctgatatatttatagtgatggtacattaaagttaactctgagtttctggcttaatttagtttgaccatcaaggcctagcctactagactcagattctgaaggctttgggtctggccccttcccagccataactcctaggaggagtggcctatgtagagctgggggaagaggccaactcaccacaatgcttactcttgtctccaagcaaagctagagaaatcataacatttaatggtgcacatatttcaggagataagatgtttattcatctcatttggggttatacaccaatgaaactctgcagacttgagctccaaatttctgtttatttgaatttgtttacatgctccaaaatatagactgtttcatgagttctagagtcctaaatttttttaaatgggaaagactttagaactcctgtatctattgtaagctatgaattctccttttgtatgtgaattattctgaactctgccatttggggaaaaaaaagtttatttaaatgattgacattttgtattacttgcctttttcttaataaaagatattgtaaaattattttagctgaaatatcaaagtttggcatagttcagtcagttcagtttactaatgtcattatgcaacagttaagaaatcagacataaaagcataccaagcacaaattgattatacaagacatgtaccacctgccaacatgttagattgtcatagagttttagacttggaaggaatttttaaagatctgtaaactttcaaaaataaactggcagtattcttacttttaagcatgttctcctaaaagttttaaacaacagtaatggtcagcattgaaaaaagtcaagtatcatggatcatctataatttgcaagctttaatttattctttgaacagctttctttacaggaaacattggatgtttaaatactatgatgtcttacattcgtatgactattaatccctaatattttttgcatgttcactgtaaaaatttcaaggaagacaaatgaaatagagcaaaaaggtaaaattccctcttcatacaaactccacacttgatccactgccttcaagtgtaaagactacttgaaggtaaataaccactgttcacagttcattgtgtattctccagccctttctgtaagtaccaataaatagctattttctaaaattgatattactatacatactttttgcaatttgtgtccttattttaatatcatatcatgggtatcttttcatattaatacatataagcctatgttattgatttttttttagtgcagagtattctgtacagtggatgtaccattatttatttaggtacttccctactgagggatgtttagattgcctctagttttctaacattacaaataatactttagaattttggttcaagatggcagactgagcacatgagcttttcttccctttctccaaagattccttcaaaatgatactaaagcgatttaactaaaagatgtgacctaaaaccactaagactggagtgggggcatcagtgagcaaatatcttaacagatttttggaagacagaaagcagatgggaggatgttcactagcagagcagaggaaatcacagcccaggtgtgcagagggggtctgggatgagaaggggctgacctgtgagatgaagccccaagaggctctgagcctggaagacagcaggtaaaagggaggggagaaggggagaatgtggctgaaaatggggaaagaagtgaaaaaacctgtctgtggaacagacacccccactcccagcacacacacacattcagaatgctggcattgcctcctcgtccaaatacggaaaggaactaggacatggatgagaggtgggtgctgcaagacttctgtcttcattgtggaattggagaaagggcagcttgctgactggtaccccactctctgactctgtagaacttagccttttaacaaactctcacaacgtgcacagggttctcaggaaaccttcacattgcttttgtcttgaatgccaatggataactgaagataacatgaatgggtgaccaaggatcactagacattttcttaagcctatagcatgaaagataaggcccaagataaataactggaaaagttatttctggaagaaactgagcaaattcttggagaagaaaacttaaaggttctctaacaagtactgcttccatgaatatcctaatatgtatatcttttcatacttatataaataattctgtaggatagactcttggcagaagaatttgtaggtcaaatggaatgcacacttaaaattctggaaaataaagcaaaatttctctccaaagtcgtgccaatttacactcccaccagaagcacatgaaataattctttcttcacaccgttaccaaaactaaatattataagtgtacttaattcttactagatcttttttatttgcattttcctgaccactaatttttattgttctttatactctatgactttgacatttttaaattgcacttgtagttttcttattgattttaagaactcatatacataatcagtaataaccatttttggtgatgtctatctaaaatattagcctttatcttacatttcaactctgcttaaattatctattactctgtggtgaaaaattttcatctttttttattatactttaagtcctggggtacatgtgcagaaagtgcaggtttgttacacaggtatacacaattctgtcctttttttttgtggctgttggttttctgacagatacctttcaccaaaataaggatttttctttctataactagcttttaagaatttttattaaaacttgcccgttttgtttagttttcttctgaatgtctgatgatcaatccttagttgtcagtttatatttataaagataatggatagttgcttattctaggtacgttcagttgctttcctccacaattactttcatctgtttttgcaacagtccttttctccaaatggagcagagcccagtatgctgccaggctgcagtcaggcaggtttcctctgagtgtgcgtgggcaggggtcagacaggcagacagatacaaatcatcctctcttagaggcatatgaggattcagtaggataaacacgaattgcctagcatgataatgaatttaatacatattttccctgctttatctcaagactccaatatgtatcagtgactgcttaacaaacctgtttagtttgccttgcaatttccttgcaatgacaagaaacaggcttctcttcagctccactgccaaggaagcctccaggattatgccacttcgggtgtacctttttttttattattatactttaagttctagggtacatgtgcacagtgtgcaggtttgttacatatgtatacctgtgccatgttggtttgctgcacccattaactcgtcatttacattaggtatttctcctaatgctatccctcccctatcccccaccccatgacaggccccggtgtgtgatgttccctgccctgtgtccaagtgttctcattgttcaattcccacctatgagtaagaacatgcggtgtttggttttctgtcctggcaatagtttgctcagaatgatggtttccagcttcatccatgtccctacaaaggacatgaactcatccttttttatggctgcatagtattccatggtgtatatgtgccacattttctttttttgtttgtttttttttagatttaaattttacatatatgtatatatatactttaagttctagggtacatgtgcacaacgtgcaggtttgttacatatgtatacatgtgccatgttggtgtgctgcacccattaacttgtcatttacattaggtatatctcctaatgctatccctcccccatccccctgccacacaacacgccccggtgtgatgttccccatcctgtgtccaagtgttctcattgttcatttcccccctatgagtgagaacatgcggtgtttggttttctgtccttgcaatagtttgctcagaatgctggtttccagcttcatccatgtccctacaaaggacatgaactcatcctttttttatggctgcatagtattccatggtgtatatgtgccacattttcttaatccagtctatcagtgatggacatttgggttggttggtaccaagtctttgctattgtgaatagtgccgcaataaacatacgtgtgcatgtgtctttatagcagcatgatttataatcttttgggtatatacccagtaatggaatggctgggtctctagatccttgaggaattgccacactgtcttccacaatggttgaactaatttacagtcccaccaacagtgtaaaagtgttcctatttctccacatcctctccagcacctgtagttcctgactttttaatgattgccattctaactggtgtgagatggtatctcattgtggttttgatttgcatttctctgatggccagtgatggtgagcattttttcatgtgtctgttggctgcataaatgttttcttttgagaagtgtctgttcatatccttcgcccactttttgatggagttgtttgattttttcttggaaatttgtttaagttctttgtagattctggatattagccctttgtcagatggatagattggaaaaattttttcccattctgtaggttgcctgttcactctgatggtagtttgttttgctgtgcagaagctcttgagttcaattagatcccatttgtcaattttggcttttgttgccattgcttttggtgttttagactgaagcccttgcccatgcctgtgtcctgaattgtattgcctaggttttcttctagggtttttatggttttaggtctaacatttaagtcttgaatccatcttgaattaatttttgtataaggtgtaaggaagggatccagtttcagctttctacatatggctagccagttttcccagcaccatttattaaatagggaatcctttccccacttcttgtttttgttaggtttgtcagagatcagatggttgtagatatgtggtgttatttctgagggctctgttctgatccattggtttatatctctgttttggtaccagtaccatgcttgttttggttactgtagccttgtagtatagtttgaagtcaggtggcttgatgcctccagctttgttcttttggcttaggattgtcttggcaatgcgggctcttttttggttccatatgaactttaaagtagttttttccaattctgtgaagaaagtcattggtagcttaatggggatggcattgaatctataaattaccttgggcagtatggccattttcacaatattgattcttcctatccatgagcatggaatgtttttccatttgtttgtgtcttcttttatttttgttgagcagtggtttgtagttcttcttgaagaggtccttcacatcccttgtaagttggattcctaggtattttattctctttgaagcaattgtgaatgggagttcactcatgatttggctctctgtttgtctgttgctggtgtataggaatgcttgtgatttttgcaccttgattttgtatcctaagactttgctgaagttgtttatcagcttaaggagatttggggctgagacgatggggttttctaaatatgcaatcatgtcatctgcaaacagggacaatttgacttcctcttttcctaattgaatacccttttatttctttctctggcctgattgccctggccagaacttccaacactatgttgaataggagtggtgagagagggcatccctgtcttgtgccagttttcgaaggaaatgcttccagtttttgcccattcagtatgatattggctgtgggtttgtcatgaatagctcttattattttgagatacattccatcagtacctagtttattgagagtttttagcatgaagtgctgttgaattttgtcaaaggccttttctgcatctattgagataatcatgtggtttttgtctttggttctgtttatgtgacggattatgtttattgatttgcgtatgttgaaccagccttggatcccagggatgaagccaacttgatcttagaggataagctttttgatgtgttgctggattcggtttgcaagtattttattgaggatttttgcatcaatgttcatcagggatattggtctaaaattctctttttttgttgtgtctctgccaggctttggtatcagaatgatgctggcctcataaaatgagttaaggaatattccctctctttctattgattggaatagtttcagaaggaatggtaccagctcctctttgtacctctggtagaattcggctgtgaatccgcctggtctgggactttttctggttggcaggctattaattattgcctcaatttcagagcctgttattggtctattcagggattcaacttcttcctggtttagtcttgggagggtgtatgtgtccaggaatttatccatttcttctagattttctagtttatttgcatagaggtgtttatagtattctctgatggtagtttgtatttctgtgggatcggtggtgatatcccctctatcattttttattgcgtctatttgattcttctctcttttcttctttattagtcttgctaacgatctaacaattttatcagtcttttcagaaaaccagctcctggattcattgatttttttgaagggttttttgtgtctctatctccttcagttctgctttgatcttagttatttcttgccttctgttagcttttgaatttgtttgctcttgcttctctagttcttttaattgtgatgttagggtgtcaattttagatctttcctgctttctcttgtgggcatttagtgctataaatttccttctgcacactgctttaaatgtgtcccagagattctggtacattgtgtctttgttctcattggtttcaaagaacatctttatttctgtcttcatttcgttatgtacccagtagtcatttcaggagcaggttgttcagagagtctcgctctgtcgcccaggctagagtgcagtggcaagatctcggctcactgcaaggtccgcctcccaggttcacaccattctcctgcctcagcctcccgagtagctgggactacaggcgcccaccaccacggctggccatatacttttcttcttagacatcaaaagcctacctgatttaactggcacagttgtgtgttcttatggcttttgcacccaactgtctgtcggagtagttgcctcttcccagaagaacaaaaagagaaagaaaagtagacatgcttcttctgtgcgtctcctgtgctgacctcattctattcagagaatggtttctctaggggtataaatgtgtgatgatgtgtttatgcctctccaccttactcccccagccctaggctgcatccagtggtctaagtggcattcctctgctcttgctcttatgtggtctccagttcttggccttgtcttccatttacagtccagctctgcccattgaaattggtctttgcagagctcttatttccagctgggatgctcttggacaagttccttaacttttctgagattcggtttccccataggcaaaataggaaaacaattacaatgtcatagaactattacctttaaatgagaaaatgtaggtaaaataccctgcatgtcaaccctattagttcccatatctccctggatcagtgcttttcaccctggctgcacattgcactcatgggaggcatgctgtgtgaggcatgtttgaactatgctgatgcctgagtcccacctgcatgtttaattggtcaggggcacagcctgacagcctggacttcaggatttttttttaaactttaaaggtgattgcaatgtcctttcaggataaaaggccttttccctatgtcagtaggtgtcaactagggactattctgcacccgctccccatacatttggcaatggctggaggcatttcgattgttacagtgagggcagagaaggggggaggcgggtgctgctggcatctgtcgatagaggccagggatgctgctgaaccttccacagtgcacagggcggctcccacagtgaagaattattcagctctaaacctcagtggtgctgaagtaagaaaccctggcctgtttgatcactaagatccctttcagtgctgaagttttgtaggccacttatttcagaatgatatttttaaaataacaataaatatctaaggttttctttgaatgaccgttttatgtaccattaagttcacattcatcagctcactctgaatccttagcttccaatccaatccccctcctttggtttactttccagatttcactcagttcttggtagtgggcccctagattgcttatctctgaacagctgtgaggcagccccaacaacagaagtaccatcttaaaatgcccttttatagccagccctgtggtgtttggagtcctttcttgctttcttaatacatggcagaagaataaaggacagaaaaaaaagaaaagcaaagaaagtcagtttttctttggattctcatagaactctgatcatctctccagctcggtacttaaatatattttactgtagtttatctgtttacatgtctgtgctcttcccggtgaggccgtgcaatccttgaagacaaacaggccagccttagacagtcttctctggagtacacaccatgagccaggaactgtgctcagtggtgtggatacagaaataaaggtcgtgctggctctcctgaggcccatgcatggtgtgcagcccgtgtgggggttctgtgctcagacatcttagcccctcttgatcatgagacctcgctcgtggtactggagtcatattactactcactagatgcttggaatcctgggtctcccacctccttcatctaaccctcacaacactcacacaaggtgggaactaatgtcatcatctgcattttatagttgagggacctgcctgtggtaaacaatttgtgaggggtggagtcaggacttgaacctgggcacaggcctcacttatgaccttccctgcatgtttatgaccatggccatttgcaagaaaaatatggcagggtggggtggtatttgtgtcttctcacttcccagccactggaagaaagacatgttccactgaattccttgcagccatcttgcaccctcctcactgttccatccctgtccccactgctacctcaaacttgattacaatcatgcatcccatgctctctttgggaatccttgggctaaatctccatagttattatcttagtcactagacttgcaccatcttgcctcagcagaccttctggaactagcttttaaaagagtatccagctcttaaaaagagtagaacattttagagaaataaaacatcaagtgtgtgttttttctttttttattgtggtaaaatatatataaacataacatttatcattttaatgatgttaagtgtataattcagtggcattaagtacattcactgctatcaccacgatccattttcagaatttttttttgagacggagtctcgctgtgtcgcccaggttggagtgcggtggcacgatctcagctcactgcaacctctgcctcccgggttcaagcgattctcctgcctcagcctcttaagtagatgggactacaggcatgcaccaccatgcctggctaatttttgtatttttagtagagacagggttttaccatgttggccaggatggtctcaatctcttgacctcgtgatctgcccacctcggcctcccaaagtgctgggattacaggtgtgagctactgcgcccagcctcagaatattttcttatcccaaaagctgtactcagtaaacaatagcccccttctttccccgtcctccaagcccctggtaacttcaactctctgcctcatgcactgacctattctaggaacctcatacaagtagaatcacacagtatctgtccttttgtgtctggcttatttcacttagcataatgttttcaagattcatccctgtggtaatatgcaccagaatttcatttcttttttatgtatatgccacattttgtttatccattcatctgttgatgggcacctgggctgtttctctcttttggttattgtgaataatgcgctatgaacattggcatacaactacctgtttgagtcactacttccaattcttttgggtatatacctaggagtggaattgatgagtcatatggtaactctatatttaactttttgagaaactgccaaactgctgtctacagcaactgccccattttatcttccaaccagagtttcaatgtctccacattctcgccaacacttcaagtgtgtttttgaaagagtatttaagcatgtgatataataggcaccaatggtcagctctgaggcatcaggacaagatgctgcgctgggctttgttacctgctgcaggtcatggcagcccctggagacgattaagtcacaaacaactcaaagtgatatcctgactcttggctgaatgttcctcgtcaatgctggtagatgaggaaagtgatcattgagtatttgttttttatttggactcagttcttgccttttcttcaccaaaagcttttatgactcttgtccagaaccaaatattcacaaaacaaagattccatgccaaagagactgtgccctcttgctgtgatttggaaagatgctgttgtttgttttagcactcctggacttacttttggattacatactttccacatggtgtctgacagcgcacctccctttgatttaggacagctctgatgtccttgcatctgtttacagggactttcttttcactttcagagtcctttgccttgaaaagctttcagatatgctggaacgaaaggaaatcaactctgccccacccccttctgctgattgtttcacattttctgctttgtattgatagttagcacctagctaccctggaaatgtgagactgagttttcctgtttgtacatggatttgtctttcattttctggggaaatagttaagctgtggtttgtttttgcttttaattgtatcgtctgtctcagaaatatgcaaaatgcccacacctgttttcctacacttaatgtgatactttcctcaaatgcaggaaacagttgctgagctggctgagtcttgaatttttatggaagtgatttgacaccgctatccttgcatgaggaataacattgtctcctagcccactctaggcagcagcgcctaaggacagcatcttcagcagggctgttaatcgctcccaggtctcctatctggattaggataatagctgagaatccattatctgcaagtccaatgtggttaacactgtccctagatccgcctattccctaacccacttggaagtgcatttaaatcttccctgtttgaatcaaagtcttgcttttttgtgatatgttagatcactgagctaccacattagggaactaatacaagctaagccccaagaagagatatctaaggtttaaacaacgtttaataaatatagttgacttaatgaaagagaagtgactcctgagaaaaacagtaatcttgaagatttcttaaccaacagctggggatgacccaccctttgcttctccatggttactgctctcactgggagcctctcttccttcctcgtgagcatcagagcttcagaaatgtgaaacctgccttctaagattgccctcttctctcttcaggccttactttcccatggaagaagttgagcaccctttccccttttttattaagcagaactctaggcacattgtgctcttcttctaaaccttgaagtcttgcagataagtcactgaaggggtggtctttgaagataagcctcctttctccctctcatcatgaaccgcctttattagctttgctctggctgttttagcatcaacagctttaagaataacttttggcatctcctgactctaccctactctgtccccaagccagacactattctctgaattagaaaccatataaatgtcagcatgggaaagactcactccttctgtctgaattctgaatcaatattcatgttcttccttggaaaatgtactttcacatagccccaccctttaactttctttgtggccttatagtcacgcctatatttgttatgctttgggggcagaatttgtctcattgatcaatatttatttttccctttattatctagtgtttagtgtgaatcaggactgattttctttctttgattaaagaaaacattgctctttgtctgaattgatattcctgcaagataattaaacatttcaatggatatctgtaagcacctactgtgtacaatatattatgaagagaaagagttgaacgatacatggccccttccctgaaaggcatttactgtccatttggaaatcctttgatgactttgaaaagagacccagtgctatgggagtgcaaaggatggagaaattaactctaataggataatcagaggaggcacctgggggaggtggtatttaaactgggcttgtagagcaggggctggcaaccttttttttggaaagaccatatagtaaatatcttgggctttgcaggccatttggcctctgttacagctactcagctgcacagtgagaaagcagcatagacaatatgtgaatgaatgggggtgcctatgctccaataaaatacgatataccaaaaaagccagccgccaagtttagccctcatgctgtggtttgcccacccttgttttggtggatggataggcttttctcagaagaaatagggaaagagcatttcaatctgaagaagcagcacaagctaaggtacagagaaggaagaatgtgaggcatgttctggacttagtcacttatgaaataagtgagggtgaccttgacatttgagactgcaaatacagggtatagctaggcctgtttcatcctgaaccacatcctttgtattaaatctgaagatgctcggctggagaagagttgtgacagggtcctgcctctgctctgcagacagtttggggcagttgtagaggaggagggggagcggctgctgtaaaaaggcctggcctataggaagagtctgaggcaggggaagtgactaataacaaggatactgctatgtcagtgggctctgtgattccaaacagtaaatttgaccgtgttagaaaaccagagtttttgcgtgtgtttttaatcagtgactgtaggttgagcaccttatgatagaagaacgtaatacacaccacagtattgctacatcagggagtgataaactgcacttggaaacttgagatgatctggagcaaatcagagtagaaaagacggataaataattttgggagttggaaatttaggtaatcagtcctctttaaaaagaggggagtggttgcatttgagataagctaaatcccttcccttgtctctaaagcagtacttttgaaacctagtccagcctttcctgtctttcctgttttgttggtaagttctgggaacaccaaggttctctaagccttctcccatacaaaggtcccaatccaaacagcaggttctcagcaggcagcatagatcctgtcctacatgaatgctttcagttgaattccttgatttttaattatccctaacaaatcacatatttgccaagtttttagaattgctgcgagaagaccaatattaacctgtaagataatttctgttggtagggtaaaaatttgttgatcagagaaaaaggatttaatcaactgcattaagatttcttgtaaataaatactccacatcattgctaggtcctccttaacttacaaaatcgtgcatggctaggactcacttggaattttaagaaaaatttgaattatcagtttcactggccaaaggacccaaagtactgtctcaaacatttcagtatgagcagaattgtgcaagttaagagttctactctcagccacgcagctttctggctctatagccttcagtcagttacctgacctctccgtatgtcattttctttacctgtaagatgaattgacaataatatttatctcatagggttattgggaaggttaaataaggtaaaacaggtaaagcatctagcacaatgactggcacaaaatacttattcaataaacatcagatgtcattactagtaattttttttttttttttttttgagatggaatctcactctgttgctcaggctggagtgcagtgccatgatctcagctcactgcaacctcttcctcccaggttcaagcaattctcctgtcccagcctcctgagtagctggattacaggcatgtgccaccatgcccagttaatttttgtattttagtagagacagtgtcaccatgtgggctagggtggtcttgaacccctgacctcaagtgatccacctgccttggcctcccaaagtgctgggattacaggcatgagccactgctcccggccctactatggtattttaattgttgctactgttatacaaattagtccaggattatatggttagagatccacataattgtgctttgagactttgtctagacaataaatacctttccaaaagcaaaagacaatttttttctagacttatcaagccaacaatcagtatcaaaagtttacgtggcacactgggcgtggtggctcatgcctgtaattccagcactttgggaggccaaggcaggtggatcacctgaggtcaggcgttccagaccagcctggccaacatggggaaatcctatctccactaaaaatacaaaaattatcagagtgtggtggcgagcctataatcccagctactcgggaggctggggcggcagaatcgattgaaccgggggggtggaggttgcagtgagccaagatggttccacttaactctagcctgggcaaaagagtgaaacttcgtctcaaaaaaaaaaaaaaaaaagttttacatggcacatgcctttataactaactgatagtgaactaagatcaagcaccgtttgagttgtatccagtaaatatggtgtcccctaactcagctcattggcttgaggtggtaccaagatgttcatgggggcaaacggaagttgatcaacacttgtatttcagacctaggcaagtatgaggattgggctattagatgttcctcttttaatatgaatactgacttactattctctgatgtgttggtctttaaaatgttcagctgtgcctcagagaacagtgaaatttctgctgtcagcatgtgagggtcatgggcacggtctctcagtaccattcagcatggggacccttggagcccctgtgaaatccgaccccccctggaaaggatgaagacatagttcaacccaaggtctttatggacctgctgaattcattacaattaagtaagttaaactttcatcacagactttatcccctcttctcaaagcacaagtgaaaaagagatacctgtttaagtgccaaaagcctattgtctggccagagccattggctggcttagcacttacttatttgttggataagctttttattgaaatgctaagtataaatacacaggaaaagttctctattcaaaactataagtacagcttgatgaattttcacaaagtgaacacagtcacgtcactagtactcagatgaagaaatagaacttgatcagctcccagaagccccttccagtgtcccctctctgtcactaacctccccaccgcagaaagaaccactaccgtgattgttcacaccatacattagtttttgtctgtttttagaaaaaccttatataaatggaataatacagcatatactgttttgtatctggctttttttttttttttctcaacatttttaacatttaccttggagtagagtataaaatgagaaggtagatttcttcctaatgtttagccaattttacaaaccaatttgttgagtggttcatttatttaacattggaatgtgtagaatgtgctaagtcacatacttaccatttattgtattccatttatctgtcaaataatttctgtaccacacagagtattttggttatcatagctttaaaatgtgatttagtatctggcatggcaattcttccctcttttgctactttctttctttctttctttctttctttctttctttctttctttctttctttcttcttcttcttctttttttttttttttttttgagtcgaggtctcactctttgcccagtctggagtgcagtggtgcaatcatggctcactgcagcctcaacccccctgggctcaagagatcctcctacctcagcctcccaagtagcgggaactacagactcacaccaccatgcctggccgatttttgtattttttgtagagacagggtttcaccatattggccaggctggcctcgaactcctggactatagtaatctgcctaccttgacctcccaaagtgctaggattacaggtgtgagccatcgcacccagccttgcttcttttcaataacaattttcagacagtctagcattattccaggtgaatttttgaaaccattttgtcatatgtaaggaaaaaaaaaatcctatgggtgtttgcacgcaattatgttaaattcattcaataaacatgtactgagtccttactgtgtgccgggtggaattctgggtactgggaatactcagaaaagggcacaccagccctgatggcatttacaaaattctaccggggaaactggagacgaaagaacaaaaaggtaatttcagatgatgagacatgctataaaaaataaaacaggggaagaggagaatgagtgctggctggaagagcaggctgctatttgagttaggttgtcaatgtcttaaggaatgtgatccttgaattccaacctgattcatgcccagagtgtattagatctataaattcatttgggaggagtagacatggttaaaatgttcagtctggccaggctcagtggcttacacctgtaatcccagcactttgggaggccgagccgaacggcctacttgaggtcaggagtttgagaacaacctggccaacaggtgaaaccccatctgtactaaaaatacaaaaatttagctgggcatggtgggaggtgcccatagtcccagctactcaggaggttgaggcatgagaatcacttgaacccaggaggcaaggttgcagtgagccaagatcacaccactgcactctagcctggacgacagagcaagactccatctcaaaacagcaacaaaaccattcagtctaagaacatagcatttattaccgtttattcaaatagcttacatctgccagtgaagttttgttattttccatataaattctctgcattccttgtaaagattcatcataggtatttaattgcattttgctgtggtatgatgatgatgacaaagaatggaatctgttcctttttatctctaaaattcttatcaatatacagaaaagttatgggtttttttatatttacctctatctggtaatttcgttgcgcttttataaattctgagtaatttgagttgattctcatcgttttctagtgatataatcataccatatagaaataattataatattgcctcctcctttccaatagtaattactctgaatagcagacatccttaacctatctctgattttaatgtgaatgctcctaatttttactagcaaggaaaatggatgtatgctcaataaatattttaattgaatatatgattacatgctcatcattggggtaagaaagtctatttctaatcttgtaatctttttttttttttaccaggatgagttttaaatgacattttggcacctacttacgttattttttctttaaagttttctatattatccttgaattcctggattataccctgtttcatcttgctgaatggtttttttaatgttctgttgaattcaatttgctaggaccttatttgggatttttaaaatctgtattccgaagtgagattggcctattgttttcattttgtgctacctctctgaggtggaggttaggttagtgttccaatttttatgtgctctggaaaagcttatataataatctgttccttcagatttttataaaaactcaccaataaaaaacatctggcactagaatatttttggaagaaattactgctaacttgtaacaattcttctatggctgtgagtctactatgttttcttgttcatcttaaatcaagctggtaattttttaatgtatctttttcatggagaatttcaaatgtagtatagaattacatatcaaattcacttttaatttcagcatcatctgatatattctcttatttgggctttattgcttttttattaaatttgcttattttcaaaaatgtcttggagaccagctctcaggttcttatgtgtgtttttctttcttgaattcacatacttctgttttatgatttctaccttggtttcctctttttaaaaaaaaaagaaataagagtatttaaattgcataaattcaatgtgtgacacttctgtttttgctgttttctcagtggttcttaaatgttttcatctcaggacccttttctcctctttaaaactgaagaccccagagagcttttgttcatatgaatttattcgttaatatttacagtattcacattttaaactgaaatttgagaattttatattactttgctttcaaataacaataataaactcactatataatacagtaacagtttttttaaagtaactatttcccagagcaaaaacattttgagaagagtggcatcattttacaatttgcaaatactgtatcttttaatgtctggcctaatagaagacagctggattctcatatctgcttctccaatctattgtgatagattatttggctaaagtatatgaagaaaatctggtttcacataaatatgtagttggaaaatagagaggtagtttagtggtcttttcagatcattgtgaatcttctcctttgatactataccaaactagaaaagtggtagtttcttaaaggttagttgcaatgggaaatctgaaaccacatcaataaacttgtcatgttctttatactcatgagtaagagaaaaaaaggcaaatagcatcttagagttgttatggaaataggtttaatctcaaagatcccctgagaggatcttaaggaccatactttcagatatacttttccaagtaaatggaaatatatccatttttttaaactttttattttcaagtaatgttaaatttacagaagagttgcagagagaatgcagagttcccatgtactcttaacccagcttcccctaataagaaatttttaaaactttatggtaaaatatatataacataaaatttaccattttaaccattttaaatgtacagttcagtggcattaagcacattcacattattgtacaaccatcaacagcacccatccatagaactttcttcatcttccaaaactgaaactctatacccatgatgtgtaagttggattcacttattaacccaaactacttgaggcatctgttgagatttacatgcttaactggttgcatttgtgctgttaatacctgattgtattgctttggagagtgtagtctgcatgattttgagggctgaggtgagaaagaaactgtttctctctctgtctactgaatcagggctatacagtttataccagacaaaaaaggacagctgttccctccacataggagcacctttgttttgagatggccagagcactgcctcttcatcacttcatcagtctctgtcagttgatataaaccatgaaatcagaacacatgggatagtgagagtaatgacatgacgtttcacccacaaacaccatattgctaagcttgggttataaggacaaaggaagaggaggagtccctagacccattcttgggggaaggggaagtcagtagtgatggaggacatggtgcactctgttgttccaatctctgtggggggaagcagtagcaagaaaactgaagatttacagccagataggaaatattttaggctttgcagtccctatggacactgtcacaactactcaactctcctatgcaaaagcagtgactgattccaataaaactttatttacaaaagcaggtggcaggccatatttggctcagagactgtgttttggtgaccgccacactaaatgaattcctggcaggggtccgaaaactggttaagacttaggaatatctcagtcaacactagttgaccatcttaaaggagagttctaccagcacgcagatgaacagtaaccaaggcaatggacagtcacatatcctgcctgttggctggtaccaaagcaggatatcacgcttccttccaacatttagttgataaaagtttcatagtcaactctgagcatgaggcaggtggcatctattaacccctagagaataaaaattaaactacagacttctcactagatgtccaccttctttaactgcttgttctttaaggactattgagtccacctcttaatgttgttaggttttgctgttttaaattttattctatatgaaaaattatgctataatttttagaagttatgggatatttgctgttaggaccaggaagctataaccagagcattattgcttcctcctgacagcactttctgtttttagaaaacaggcataagagaccgtgaaaaaccactaaaacggctgaactcacaagctaaccttaaaagccagcaccttggccaggcgccattgctcacaccggtaatcccagcactttggggggccaaggcgagtggatcacctgagccaggagtttgagaccagcctggccaacatggtgaaaccctgtctctactaaaaatacaaaaattagccaggagtggtggtgggcacctgtaatcccagttactcggaaggctgaggcaggagaattgcttgaacccgggagacggaggctgcagtgagctgagatcgtgccattacactccagtctgggcaacaagagtgaaactctgtctcaaaaaaaaaaaaaaaaacaaaccagcacctcagaaattcatctgtatcaaccattcatcaatcaaaaatatttgaatgcaaatatttggaaattactaatgcaaagtatgccaatatgcaaattaacctgtttgttcattttttctcatttattcattcattcacttattgagagtctgttatgagctaagtctgttattagccaagtctgttttaggctgcagttgtggcttcagttataatctcctgtaaatgtttgttttgttcacatgtgttcagatgtattctatgtaacagttgcctctaccttctattttaatgaaaaagctccttgagcacaaatctgtattttcccgtctcttcataattctccacagttcccaactgcatgctctgcatgcaataaagcatttagcacatgattttgatttattgactggtgggaagcctttacaagccagtcttctgtcttgagccccatccagaattcttctgttaatttttctatagttcccaaaggttacaaagaacattttcctttcagcctttaagagcttgtgtagaattagtcatcactgggacccagacttcaccctaaacatgagtgcatttacatgctccagtgaattaatcctgatgtcatattgtgaattgtgtcctaattttttaagagactccgtattccatttgattcataaaaatgaaaagtaaaatgctaatgtgtaaaactgttgttactccagttaatgaaatattttcccaacctttcataatcagttccagcctagatgagaagcttatttgcaaaaataatagatgaaaaagggaaattaaatcctctgtaattaaaaatagtaacattcttctattaggttccctgtttaatcatcttcattgttttgttttgtttttttcttttttgttgttgaggtttttttttgttttgtatctctgtgtgtgtgtgtgtgtgtgtgtgtgtgtgtgtgtctgtgacagagcaagagagagaagagagagaggtgcctgtaattttctaaaacctgtgtttgagggcaaaatgttaacatcttggaataatcaccccctgccagtgtttttttctttttcaattatttgcttactttgacattttcattccccactatgacagatgttccagaaccacgtgcatatggttctcctcctgggcaaggccatttccctgcctcctctccatcccggcccatgagataaagctcaggaacgccttttgtccatctttggctggcaggcaagagccagggatccccacactctgcaactgtatccataaggccctgtagagctcttcagtttacttcctcctcaatgagattctgaaagatggtttatctaaaatgtgaccaagatatactaataattctactggaaatttctacgaagtgtttttaaccctcaaaaagtcagaccaaggatggattttgaacctggtgtggcctctctgctctgggagccaccacctggttcctcggatgctcagtagctctgggcttccggaagcagcgtctgtgaaggggcaggggagagagtcccagacatggagcctcaagtcaggctctgaattctgtgtctgccactgagcagctctgatcttgagcattgttatttgaactctgtgactctcctttctcctcacatataaagtgaggataagaggaaggtagagaggatgaaaggagatcatgttgtataaagctgcctccatatacagaataagccttccccctcagtgctgtcataaaatcagtaacccacaaaggagagccaagttcctccaggcttcacgcctaaccagagaggtgtgtgggatagaaaaagacctacaccatcctcctagctctgtgctggatgagatttgtcacttggggcaagactgcgtgcatcacctcagtttctgcatccataaaatggaactgataccatcaccctcattgagatcatggggattgagaagatgtacacatgaaagtgccagcacctcttctggacaatggaagagattcctcgggtgttatttccctccagtttgggttctgagtccagaatcctttctggagcaacctgtttgggtgttcttccccgtccctgaacgtgagtggaggcttagagctgactttttcatgaggcaacctcttcaaccctgaacaggtcttgctcttcaaaagtccttgatatttaaccaaaatatgccgcttcaaacttcccactggtgatgcatgaaatagagtaaatgcccccaaactcttctccaattaagattttttatcccagtggaatcagattcaattaagcatcaaagtcaatctttggtggaaaaataagtcaaatttcagccagagtgatctttgcagaagggccatccttgcctttggctctggccctggagttgtattgaggttttgtgattaatgggtaattgcctgagccttacattttttaagatcttttggtggaactgtcctctttggtgttgctggctctttcttcggaatcacaaaagcccagaatccttgctgagaatctggggtccttgtggcatgcagctgcagctgccactccccacctcctgggatggtgcctgagtctgtacttctagatagtcacaaggtcgtctagcagagtaggagccaagagtcagtatacatgcctgactggggcgtggggacctgagatggcaaggaggaccgagtcttactgatactcactatggtagacagaataatggccccccaaagttgtccacagcctactcccgagaacctgtgaacatgttaagttacatggtgtattagtccatttcacactgctgataaagacatctcctagactgggcaatttacaaaagaaagaagtttaatgacttacagtttcatgtggttggggaggcctcacaatcatggcagaaggcaaggaggagcaagtcacatcttacatggatggcagcaggcaaaaaaaggttgtgcagggaaactcctccttataaaaccatcagatcttgtgagacttattcactgtcatgagaacagcatggcaaagacctgcccccatgattcaattacctcccacaaggtcccttccacaacatgtgagaattcaagatgagatttggatgggaatacagccaaaccatatcacatggcaaaggggaattaatgttacagatggaattaaggtcctaatgaagacccttgtgatggaaagattaccctggattatccaggtgagtccagtgtaaccacaagggtccttctaggtagaaggggcaggacgaagagttgagtcaggaagagatttgaagaggctgaactgcgggctttgcagatgaaggaaggggccacaaactaaggagtgcaagaaatacaactctagcagctggaaaggcaaggaaacaatttttcccctaaagcttccgtaaaggaacacagccctgccaactccttgattttagcccagcaaaatccatttcagacttctgacctccagaactgcaagataatacatttatgttgctttaagccactaagtgaatggtgatttgttacaacagcaaataggaaaagaatacactcaccttcctttatcatcaacacatcctgctactcaaggcagggacttcacctggctggagaccatgcctgttcaggtgttagctgatcgttaaggagcagcttgtctggacgggaaggagcacagacgttggatcgaggcagagctgagtgaggcagtgccatcactttctggcttcacagccttgctcagattgtttcatttctctgacctttatgctctaaagcaggaatcattacaggattaaactacagaatgtactcctggttgattacctggcatgcagtcagctctcaacacatggtctcttttagtaatgatgagttgaactgtgccttttcttccctcccctgggaagtgtttctctttttttagggtgtgagagagattgacattctctcccttgtctagcacaggactgccttgccctggggatccctagtgaaccattgctgggaggctcagatggactccaggcagctggacatggcgaatacatgagagattggcatagcgtatccccaggggaatgagaatgaaactagaatcaagattcccgaagatcaagccgtccaggtggaaacctcaagtagccaaacacagcagtgtggttgggctggaatgtttaacctctctgggagggataacaacattccagctgggacgttcaccaaaagtaacaagtaatcacatgggtgtgttctctatccaaatgaccagagcctccatctggctagcttcccatgtaattagtttaagagtaacaaaataccaggacattaatatatacaaaggagtgttccagaacatctaggcacagactgataaaggagacgtgggtgtatgtgcacgtgtacgttaaagatgagttaatttcaatgtttctattattctaaactgaactgctgctatgggtttcaagaattacatagcttatgaggtcatctggctggaactatgattccagagcatccctcaaaacacgagaggacttttttccccacttttatgttgttagatgccaaggtgatttagccagagtcaaagctgtactttatggcaggacatatattcttccactgtagattttttgtttttgttttgttttgttttttgttttgtttcattcaccgagttggaagatttagctctgcagtgtacagggagctaccagtaaactgtaggtcaggagctggccagggtgacctcagcttagccaccagagcccaactctcaagttgttcaactctgtgtctcctcctctgtgcttgatggagttaactaggagatctctgagttggagtgtcgctctgacctctgagggtacttaaagggaagcagcaggagaaagtggggaggcagagagtggcaccaaggtgctgcagatgacgtctgctggctgtgttcctggtaataagaagcgctgtcctctgaagggactcatgttccagggaagacaatttggggaaatgctgaccgaggtcatattttaatgtttaaagctagcttttaagtatttaaagaaacgatttacaagtcagtctcctgaaattacaattccataaaacttccaagtgggcaaagaataataacttaaggaagagcagtttcctaaacagatgagagtgaagtccaaattgcttttaaagggagataaaaaggtctcaaatttcttgctatggttctgaatgtttagtgataggttcgtttgaagatgaaatcaaccctgatgttagctcaataatttcaggatgtggggagggtggggggaaacctagcctatgggaaaggaaaatcaggaaaaccttttagtagacagacatttttcattgctatcaaaggatgtgtaaggccacaaaaacctcttagcaggaagcatcctggggtgatccatacattctttctggtgaggcagaaggaaaaggaggtccaagtctcatgatctgtctctttagatccagtagcagcaaggatcctaaattggtggataaagaaacaaagccaactgggcttggtggctcacacctgtaatcccagcactttgggaggccaaggtgggcagattgcttgagcccaggagttcaagaccagcttggtccacatgatgaaacctggtctgtacaaaaaatacaaaaattagccaggtgttgtagtgcacaccggtagtcccagctacttggaggctgaggtgagaggatggctttgagcccaggaggttgcagtgagccatgatctcaccacttgatatggtttggctgtgtctccacccaaatctcaccttgaattgtagctcccataattcccatgggttgtaggagagacccagtgggagataattgaatcatggaggcggtttcccctatgctgttctcatggtaatgaacaagtctcccgagatttgatgattttctaaggggtttcgcctttcacttggctcctactctctcgcctgccaccatgtaagacatccctttgctcttccttcatctcctgccatgattgtgaggcttccccagctatgtggaactatgagtccattaagcctgtttcctttataaattacccagtctcacatctgtctttattagcagcatgagaacagaatcatataccactgcactcaggcctggatgacagagtgagaccctgtctcaaaaaaaaaaaagaaagaaagaaagaaagaaaagccagtgtcaaggttggaggttgagcagaggtgagcataaagatctcctctcagatgaaggtggaccctttggtggaaaccatgtgagaaatggtcttggtcagatcctctatttggaaaaaccatgagagatggaatggatttccatctatgttctggtggctttatccttcttgtaatgtcatggttggttcatctgattcagaatacttggatttctcttctttcagtttctttctctttataatctattttatcccaaaatatagatttggacctggttagcatttttcacttgcctctaagatctgctgtctctgatgacttttaataaaggtctggcatctttcaagtatgactctgggtcaacatattttcttttaacatggttaagcttttgcaaggattatacattttccttccagttgtgcagcaagttgcctggcaatttaacttttcatttctgtgtatagtttaattgaaatttttattgaaataattgggaattcatatgcaattgtaagaaataatgtgttatttcagattttaactgagtgaaaaattctgcttccaaacaaaagaactgttaaaaacaagaaatccagcgattgctgcccatattatgatgtcccaagaaaaagtacagataccaggaactgaactgaaattttcaggacatgctgttataactctgtgtagctttgtcaggagaagcctgaagtacaactctgagacagtccatagccccttgatagcactgaagaccaccacactagaccccacaggaccacagcaaaccacccagaacactcccctgtatccacctggagtcgtgtgcacctggccaccaggatggtcctaagtgcagcagcccacaggagatggagaggtgtgccgaggaaccagcagtgcatgtgatggccctggctctctcttaatttgaagtttgccttctgtgccccttgaattcacatctcattctgtctcctcacggccctctttccaaaacctcccacggaatacgcatatagcttaatgagctattacaaggggaagaactagaactctgctagtccccagaggcccttccacaggctgtgtcccaatctttgctccctctcttcctctcttgacttttagagaaatcatttccttgcatttctttataattgtataacccaagtgtgcatccctaggcattctggtttaacctggcccattttaaattaggtcctttaagcctctctaatctacagattctcccttctatccttttattgtatgtgtatgtgtgtgtgtgtttgtgtatgtatgagtgtgtgtgtatgtatgtgtgtgtgcaagttcagttcctgatacctataattttcttgagacgctgtaatatgggcagcaggcattagattttttgttaataatgtgtgtatatacacataaaatatttgtgtgtgtgcatgtgtgtgtgtgtgtgtgtgtgtgtgtgtgttacagcccagggtatttgactgtaacatttctcatagtggtgagttttgctgattgcagagccattctcccttagtgaagggacagatgatggtgaccactacagagacaggtaagaaggtagcctgagtcccaaccaacccagggagccacagcccctgcacactcaggaggcaggacggatgttgctttcttcttccttcacaagggagaagaataccttcagaatcagattcaaatcttgactcttcctcattgttagctctgtgaccttgggcaagttacttagcctgtctgagcctctgcttcccatctatacaatgaagctaataatgcccacccagagactttgtgaagattatataagacaataagtgtgtgttgggcaagttacttaatttatctgtaaaatgtaaatagcagaggtaaaatgattgtgataactaaatgagttaatacagataaagcatgcaggatgtgcctggggcacagagaggcctcaataaatgttagctagttttactagtattatataaagtatctaatttgttgaaaattcctgtttatggtaccttttcttaggccattttgtgttgctgttttaaaaatacctgagactgggtaatttataaagaaaagaggtttatttagctcatagttctgcaggccgagaagttcaagagcatggccgtggttttggtgagggctttcgtgctatgtcacaacatggtggagaagatcagaggagaagcagacccatgtgcagagagggaccaaacaggaggaggaacctcactttataacaacccactcttttgggaactaacccctttacactaggactaatacaatctcatcagaacaagaattcactcactacagctaaaaggaaacaaagccattcctgagggatccacccccaatgacccaaacacctcccactaggcgccacctcccaacacattcaggatcacatttcaatatgaaatgcatattgaaactatagcatagctattatcagttaaaaggagaaaatgggggcttccaattagctgaagataatggtggcagccagatgcccatatcccaatatttcctccccaaatgatatagatcaaaaaagggagaaaggaaaagacacaaaaatcacacccttggcataccttgaggacagagagttaaaaataactttaactaaagagagaaagaataccaaatccaagcacaggaaaactcatgcttccttccagcccaccccactacagggctttgaggcaggcagagagaaagggagctgatctataaggaagagtgaaggagagaactagtatagaggcctataggtgatctaaaaccactcccagccacaagtccacccaaagcctgaaaatacaacacgaggtgtccaggtcgatcatggtgcagtgtacaggacagtcacaagcccatgcgacttgagaggcagccttcagaatgcacagcttctcaggtgaggagaacaggagaaaggaaggagggagtgccctttggcaactgggtgataagacggtgaaggagcaaaaggggatgattcaagtggccactgttaagagcccacagatacaagttattgtatagaatggggaagcatgagggaaaatgtgccagagagaataccggaaggaatattaaatcagagagcttagaaagaaacaaatcagaaaacgaggcagaggagccatgcggaagggtgagatgatgtaatggaaagggggatggaggacagcagcatgaacaagatctatgagaggtgcatgaaattggggagtgaaggagccggctgggggtgggacttgctgggacacagcagcttcagtggtcaaacttggtgttcatttcaggacaactcttgctcaggggaagtaggtgcataggcacatcgacatagacacacacctgtctcccagcaagcctctgccagaggatcccagggccggcaggcaggcaaagaagtagggcacatccaaggggctctgctgtaaagaaagagtatgcactgggatccagacgacagaagaggaggggacatgtggtgattatggacatcatagaaaagaaatgctgtagaattcagatcagtccaaaacgcaccatgtaaaacaaaagaagagagggcaactttggtaacactgattaacatttaggattttgaaaatttatggtgtttgcaaaacctgcatttgagttaagtattttgcaggggagatgttattggttatttgtagaacatcatatctttccagttacaaaatataaattcattttgcagcacaagatatgatgtctcatctttgaagttcttttttctctatgtatgcatggaaagggaacatggtagaaataatcctttttttttttatgggggtagataatagatgaaatatggcacagaacccccacttcagcacgtgaatgagacacagaaggcagttctctcactgaagaaggggccaagggcctccccctcatcagctcagccccttctcacactgcagagtccctcgggaccgccccaggacctgggggctatgtggcacactccttgaaaatcatttggtacttgtcacttcctgatgcctattgcagtagatgttggagccacacagataaataagtaccattccctgcccttggataactcagtctagaggagagacagaaggttaaacaaccatctggaatgtagtcagctgggtgctaaggtagaatctgagggagaagaataaactctattagagtggccgttatcaaacaaaagataagtgttgacaaggatacagagaaaagggcccccttacacactggtagtgggaatataaatgagtgcagccactatgaaaaacagtatggaggttcctcaaagaatgaaaaataaaactaccatctgatccagcaatccctgggttgctgggtatatatatcaggatcaggagatcctgatttcaattgagatcagtgaactcccttatttcttgcagcattatttacaatggccaaaacatggaagcaacctaaatgtgtatttatagacgaatggatgaagaacttgtgaaatatatacatgcatgtatatatacatgaaatatatacatgcatgtatatatttcacaagttcttcatccattcgtctatacacacacacacacccaatggaatattattaagccttaaaaagaaaaattctgacatttgtgacaacatgggtgaacctgaaggacattatgccaagtgaaataagccaggcacagaaagatgaatattacatgataccacttatatgaggaatctaaaatagccaaactcataaaagcaaagagtagagtggtggttgctagagcttggcaggaagggggaaatgggaggtgttattcaaagggtacaaagtttcagttataaaagattaataagtcctagagctctacgatacagtatagggcttacagttaacaatactgtattgcatacttaaaaatgtgttaaaagagtagaccttatttttaagtattcttatcataaaatggtaataataaagaggatgggaggaaacttttggaggtgagtaatgtgtttatggcatagattgtggtgatgtcacagtctctaaaacttatcaaggtgtatacattaaatagctacagcttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatccagcttttttaatgtcaattatacctcaataaagtggctttctttaaagccaattattccatttgtttctctgcattagacatttcacattttacttgacagggacagcccagagtttgccaaagccacatccaaacctgagtccatgctgagatcatacagctttctataccatactttcatcaagagcttccatgcctggaagtgccaagcaacaggaactggttgagagatggcaggtccagaattctgttcttgatggaatgggttttctatattaatatgacggtctttgttgtttcgtggccagtctcatcagaagggctttgtggggggcaaattgtagtcagttttaaaaattcaaataattccaggagtaaaaaggtcggttcattttaggatatctattacgcaccaagatgttaagagaaaaatatcatcttaattgatactgaaaaattacttgataatatttactacccaatctgtacaaattaataaaaagctatgaatagaagtaaaattccttaatttgataaggaaagtctactggaattcagtagtattcatcatacctaaaggtgaaacaagagagccaatcctatttcgaggaaaagataaggatactcaatatcactatgaaggttccagccaatgaaatgagacaagaaaaataaatgaggtataaagattgtagaaaaaggataaaacccaccttatttatatatgacatcatttcttaccaacaaaattattgccaacttatgaaaaactattagacctaatcatatattcatgacactgtccagatcaagtaaacatttaaaactcaatagctttcctatatataagcaagaaccatatagatcaggtagttttaacaagatgccattcactatagcaagaaaaatattaaatatttaaaataaatgaaacaataaatgtacaagaaccataggaaagaaaaacaaactttactaaagggcataaaatttaaataaatgacaaaacaacatatttcagtcgaagacaactccttactaaaaagccatcaatttcccccaaattaatccataaattcaatttttaaactcctcaatattccaatggaattttcatgagaatcacctgattttaaaattcatctagaagagcaaatgttcaagagtagccaaaagcttttgaataaagatgaagtgaaaatatgtcctacaagatatgaaaattttataagcccacagcaattaaaacacgtggggaaggaacagggataccaaagagatggtaatgaaatgaaataatctagaaatagacccctgtttgtagtatatgataaaagcacatttaaataattgaggaaacaactcaataatcagcattaggataataattattattaaaaaataatgttagatctctgtgtcacagtatataccaagataaaaactataaatataccaaaagaaaatatagaaaaataaaatctataaaaatatcccagaaaaatatttttaaattttgtggtgaggagagactttctgacaagaactaaactcttttggcctctataagcattaaaaaggtttacaaatctgatttaataagaattgggggcttctctatgtcaaaagacactattaaagtcaaatggcagactgagaaataatatttctgaacaaagtgctaatagctaatatccttaatattttttaaagctcctgaagttcactaagaaaagataaaacaacccaatgtaaaaaaggcaaaggatgtatgtaagtaattcccaggggaaaaagtaccaatgatttttaaatatatgaaaagatatttattacccactagtaatcaggacaattcagattgttacagtggggtacaattttacctggcagattacagaaatttaaaatgatggtaaaatataatatggggtagggagctgggggagaagtttgtgactcactaagtattgagtgtataatgtaccacagtaagcaaacccttgatttagcaaaatagtcattaagagcacaaagacctttataagaatgtccattgcagccagttttataagctgaaaaaattaaatgcaacctaactattcaacaatagaaaaatgattaaatgttacattatttccatcctatgaaacactctttagccattaaaaataatggactagctctatatttaataacacaaaatgaaggtccttaaaatgatggtgggctaaaaaaattatagtagggtcccattttgtattaaaaaatacatgtgaacttttatataattttgtttatgcctgtccgcacatgcacagaaagatctggaaggattctcactaattgttaaaagtggttatccttgtggagtgaagcgagattggggccaagcagaagaagtgagaccttccacttcttttaggaggcttaaattgtttttaatgatcatgcattgcttctgtgatttaaaaaaaattaaaattgtgctgatgaaaaacatatggaaaataaaactgccagaggtaacactgctgcacagcctataaatcaaatctgaaaagtgtctttggaccagatgccccctgccaggcctcctctccatctgaggtattctgaactgacagtcttcagaaatttgactgtctgcaaatccatccgtgacttcctccttatgggtcaggtgctcccatctgcttgctcttcctgctgctcagaattcttccttgagggcaggcctcgtccaggggccccccagaaccactggaccctgcagcctggaatgttgtaacgggaccagggaaagacaggaggaagttgccatcaagcctctgaagctcatagtcatatttaaactcttagttaattgattcatttcatcattttgaactcattgttttaattacattgaatcttttaaaagaatttttcacttaaagagtccttggagatatccttttgttcaatcctaacattttatgtgtaaggaaggggaggcccagagaaggatggttaataaattgtattagatttaagaccctgaatttgggggctcaagcctcattaaatttcttgattcttatgtgagccaacttctgcccctcctatgcagaatgttacttgagaatgctattgccaccctgtaacccacacacctccagaagagccaacatgattatgtctcttcatgaggacaaaagtcatcaactgggctttctgtcatgtcttcataccaagttcttctgaccacggggcctttgcacagacagttctttctttctgcaatgcacttccctgctcttcacaaggctggctctttccacacactcaggcacctccttggagaggcctttcctgaccactgcactcccttcccaccattctccctttcagcaacctgtttccctcaaaggaggcagagtccgtgcctctctgtccactattgtatgcatccagcacatggcacattagtgggtgctcaaaaaagagtttgagtgaatgagcaaatctgacacctagttttgaaaggtttctgacccctgctcttttttttttttttaaatggagtctcactctgttgctcaggctgtagtgcagtggtgccctctcagctcactgcaacctccgcctcctgggttcgaaggattctcctgccttctgagtagctggaattacaggcatgtaccaccatgcccagctaatttttctatttttagtagagacagagatttgccatgttggccaggctggtctcgaacccccaacctcaggtgatctagctgcctgggcttcccaaagtgctggggttataggcgtgagccaccacactcggccaggctcctgttcttatgtgattatctcatcatgtagacccagaaatctctattattatttaatttttctgttattattatatggcaggtgaaaatgatagttttattattttaatttgtgttagattacaagggagatttaacatatttccattagcttatgtcatttgctcagctgtccattggcatcttaatgtttcactcaatcattcctggttagtggcctgattaagcaagggaggaacctatgagtggttataacctgagatacagcaaagagaggggacagggtcttacatcgcactggggacaggtcttacatagcactggggacagggcctcaagggcttggtgctctgacacacaggcactgagtccagctgcagggctcagctgcaggcctaaggttctaccacagcctggggtggatggagatgggtctaattcctagggagcctcctcaatttcttccttgtcagcactgtattctgcgcctgtctctggtgaggggcaaggatcttggcaaattttagccaatatttaatgaaaaactctacaaagattggggttttttgttagtttgtttttgtttttgagacagagtcttgctctgtcgcccaggctggagtgcagtggcgcgatctctgctcaccgcaggctctgcctcccgggttcacgccattcttctgcctcagcctcccgagtagctgggattacaggcgcccaccaccacgcccggctaatttttgtgtttttagtagagacggggtttcaccatgttagccagaatggtctcaatctcctgacctcgtgatccgcccaccttggcctcccaaagtgctgggattacaggtgtgagccactgcgcctggcctgaaaaactctacaaagtttttaacagaacttaaagtgatttctccccaagaaaccagttttcttagagttagcaccctaacatgaagattgctaagtgacaagatagcacattacattaatccttgatatggtttggctatgtccccacccaaatctcaaattgtagctcccataattcccacatgtcgtgggagggtccgggtgggaggtaattgaatcatggggacaggtcttcccttgctgttgtgacagtgaataagtttcatgagatctgatggttttataaaggggaattcccctgcacatgctctcttgcctgccaccatgtgagacatgactttgctcctccttcaccttccaccatgatggtgacacctccccagccatgtggaactgtgagtcaattaaacctcttttcccttataaattacccagtctcaggcatgtctttattagcagcatgagaacagactaatacaaccctgtattatataattcagagctaagtatttattcagttattatgcatgtatccagcaatcaccatgaaccaggcacttggtcctggacatacaggggccggttggctacaacccctagctacaatgatttgtatgacagaccagggagaagcatgatggcagtgaaaacagcaagtgtgttgcagcctaaatccaagtttgaatccagactgtgacgtgcagacacggcaagccttagcctctgtgaacgagaagtacatagtgataccatcttcacggactctgatgtaaagtgtttggcctagggaaggaataaaaagtccactttgggccttcaaatcagagagaaaccagtgctatatgaagtgatcaagggtggaggaggtgtagaggaggtagaatgtgggcccagccctgaagaatgggtagaatttggaagggaaaatgcagaagccaaagaatgaagataatcctaatccactgaagggcagtcaaggagctggaagaatggaagggtagctggaattcttctacccttgcagggaaggagcagggccagagggatgggcacccggagccagcccacagcaggtgtccctcaaactgagtcttcaaatacttactgaactttcattttgaggacaggctgagccctgtgtgtggagaggaagagcaaggcgggcggcacctaatttgcacaccgcaactaacaaaactaaaaccccacagataaccagacccacattcctcagacgccattggactgacttctattgttaatgaagtattgccttgttggggagggaagtgtctcctctaaccccgagcagcttatccaggacattcttcttgccatgcacaggagttccatcatctccttgcatatctggtcagatgttgctgtcctggaggtgttttagagccccttatagaccaacactctcagcagctgccaggctggcccaccccttattctagttctcagaagagacaagctattccagccctgtgtcaggacagcagccaggaggaaatgagaagctcctgcagctttttcatcagtggggaagattttgcagtcattcagtcattcaatgactacatcatggtcacctactacatacaaggagaatctaaaggagaaaaagcgcaagacatgaactcttccctccaagagtttgtggcagttcatataatgagggagataagtaaaatgccctatatgccctgaaagaaatacagaaactgtgacggtaatccagagtggggagacattacttctagttggggtggcagggagagaggcagagaatgctttgagaggagaaggatcttgaaggatacacaggctttgggacatgcagacatggtgaggaattgcatctagagaatcataaagcctcagagattgtgtaaccccttatttcacatgtgaggaaactgaggtcgaggctggtaaatggcagattttgaaatggagcttttttctattcagcactctcctcacctggggctggccttccgaacagaagacagtgtgggcaccaacctggggtgtggaagttttgactgctcatggtggaatgaggatgcagcttgcttgtaaaataggattttgtagttgattcgctgctaggggtaaaagaagagccaggggaacccagaggtctccagcctgatgactgggaggacacctgagccagtgaacaggaggaggcagggatgggagaaaaaaatggtgtgtttggtttgggacatgttgaactggaggtttttataaaatatacaggggaaatctctaacaggttggggaaacctggtgctggagttcaggacaaaagatataaattgtggatagttgggattgtccaagggatagaatgcagagaaaaacagaaattgaccagagaaggttggtggacagtggtgagcatagccaccttctaaagactgtagcaccagctcccttcggagaggagaaccaggaactggacccgaggtagacagaggttggagaatgcaatgccctggaggtgaagatgagagatttggggagaagcagtctacattctagcaaaaagggttaacatgctaccaacgtgacatctgagaaaagagacagctgcatctagcagctacaacatctcgcatgacctttgcaggtgcgaggcagccagagtgaatgttatctaggaagtttgacactgaagaggaggaggaggattaaggggtgccagaactgaggcaagacgtggtttgtcttttcctttttaaggctaggataattggaatatgtttcctggaggatggagaggagttggcagagtgggagataagagatgggagggagaagggatgcgtgacagaggataatcctgaaggaggcaggaggggttaaggtcaagggtgtggcctactgacagttggagttagggtctctgagctgagatgggagggtggttctgaagggtgaaacagaggggagcctagaagtcccagcaatcaggtcagtctcacgcagcacgaaaaccacaagctgagactccaaccttgggagaaacccaaagttaagggtcaaaaaggcatcaaggatgggacaactgaaaaacagccgtgatgtccagaagcccacacgagttggtcagtagtacccagcccagaagacagggctgactgaagatgaccaacaaggataaagtttgcttttgaagacagattagaataagctatagtccattaaagccacataccaaatgcatgatttccctgcttgttctgcactttagagtccaaatattttaattaaaccaacatgtgaatatcagagatatcaaaagaacaagaacattattaatttgggaaccaaggcaactaaccactttattcttttaagtcatttcctcatttagctccaatctcggtaacaaacatttcgatatctctacgataattttcctggatttaaaaccacagttttgatttttaccccttggggatttatttcttatctcttgggcccttttgaacaaggcagttatcagattaacttttagctcactggcctggggttgaataggtcatttccctcctgaatcataggctcctaagaattcaagccaaaattccaggctggctttaagtaatgaatactgtaattaacttctaaccaagcaagctaacattttgcttggagaaagcatccttttcccaaacaaatgcctttcaaataaaaacaatttcatgccctctttttccagcctgatactttccagggcttgggaataaccactgtgttgtgcaagagtatattcttggagcctcttaaaatccagtttgctctggtttttggttctgccatagaagctgcaccatcttttaggactatattgtttttaagagagttaactgagttcccttccatctgtactgtctgggaagttttgtggaagtcctgccaagcctggttagatgtgacttctgtctgcccaactcactggacacaggacaaaaacagatcccagaccttagcagattgggactgcagtctgtgattgaacgtcatcaatgacctgccaaggctggggaggagggagagtaggagtgctctgacccagcaggggagagtattttacacgatgataataaaaagcaccacttctagacagttttatgactgtttttcatcctctgtagacaatgcacctccttattgcctgcatctgggacctaccacgcccagtgcctggccaagggctatcggccttgtctttagcccaacccatgaaataagtgaaatgaagacctgtagtagggtcagtaatgggagtttgaatgagacagtcttgagaaaataccaaacgtgcagccagaaaaacaaactatatagaaactaactgaaagggtatatcatttaagtgtcagctgtgagattttttttcagtcctagggcaaagccatgtcaggaaccaaaaggagaataaggcatcacatatatatatgcagcaaggaattcatcttgagctgggttaggaatttttgccaaacggattttcattctgacctggagtgtcttttggtgttttgtttagtttggtttggtttggtttttggctgagccatgcatgtggcagtctttctctgaggaagtttttaagtcaccacctaatttctgtcagcacttaaagtgaggggcaaatagcgttgccctgaaacctggcctattttctcagcactgtggcaaagacccctgtcctgctgttatggtgctgcacacagctgtgcacagagcgtgggtggccctggaacactgccacacgaagcagcgctaagccgaggtttccctgctgtgaggtcccgtccctggactaccgtggactgtgcagttacgtgggaggtagagtcgcgtggtgtacagatcacaaaatggattacatcccctactctgctacatactaaccatgtggtttgggggcacgcctattctttgctctaaaactagctttctcacctggaaaacgggattggaataaggacagccagggggaggagtaattaaaataaggtgtgtgaatttactctgcgaactataaaatgctacagggatgtaagggtgaattgcctacaggttctgctgatttggttttctggttgtcgttaggccttagccagtaattagtgaccaaatgtaagatgggggaaaaaagggtttagcagcagcacctgtgtgaaaaaaaatcaaagcgtttttatcatgtaggtggggttccatggaaagctgagctgcagcaattgaagtggactgtggagaagaaggggcatcacggttctgctctcctgtgccatgatcagacccgtcctagttattaccttccaggggggctcctcactggtctatagatgacgtagatcagccggataacatgtggcaggaggaggcatctaggaagcaccaggaccttaactggaaacgctgggaagaaagtgaagctgtcttcgtattttcttaagggtcttatgtagaagttggatttgacttgttatcccagctttccagggaagagtaagagcactgggtggacacatgcagggtgtagatattagcttatctaaggcatggttcccaaactttgctacaaatcagaatcaccaggaaactttcaaatctcccattgcccaggccatacctgaacccattaaatcagaatttctgggagtgaggcccaggcatcagtttaaaaaaaaaaacttttcaggtgcttgccatgggcagccaagtttgagaagcagtgatgcatgcagtagtaaaagcatcaggactagtcaagacggggtgagcggctagggatgtggggaatcccctgcctctgaagctgctcagatccaggctggatgtcacttggtgatgatgaattcaagccttccgcatagaggtagactaagatagataaacttcaagctctttcccatcctgagggggctgagtcaatgctccaaagtggaagttttccagtttatttaattccaaggaactatttgttcaaataacataaaatatttaaaacaaagcaacagggaggtgcccccctccattccattccaccctctgttccaggatgacctctgaggacactttgtagaaatctggaaacttaatgaaaatctcttggactccaaggaacacagttttaaaaaccaccaatttaagggaagggaaataggatttccacagaaattattttcttactcagccatctgtagttggaatcttgattattttgatgaatagaagtagcaaatcccaaatggaggagggccaagataaatgaccatggacctaatctgtttattagttgggaacatgaacagcatcagccagaatgtggttgacccagtgcctcagaaactagacccaggtcaattttggcttattatcttggtgccacatagaggatgtaagacccacctcatctggctcatacggtatcttcaaggggaaaaatactttattattatttgtgaaagttcccaagctctgcattcacaagttgagtgttaagcctggattgagctctttccttatgacctgcagtgagcagagcaggtcttgaacctaggtattctcagtgccaatatatttttacaatttcatggtacgttctgttccacacagactctagttctgtatcaaagctgtaacttacaaatgaggaacaaaatgcagcctggtacaggggaaagaagtagcatataggtttgagtcctggttcaactcttcaccagctgtgtcagagcagacaagtatctaacttagtttgcttgcctcttaaatggaattcattatatctgtttacctatttaccaagattattgtgaggttaaaagaaaaagccaaagtcatatcctcttaagttctataaaatatgcatgattattgaaagcaaaatatatatatgtatatatatatacatatatatatataacattgggagaatttcaatatatgtagatgaaatacacatggcaaatataacataaataggggagacttgaaggacctttattttgtgtttgtttggtttcagattttttttgaaaataggctttattttttacatcagttttaggttcacggaaaaaccgaaggtacagaaaattcccctatattcctagcctccacacatgcagagcttttcccattgttgcttttaaaatttctacattttgtttgaaatggtaaatattaactcaaagtagactatgacaaattaggtttgtatgttttaacacctggacaacaactaaaaaatagttcaaagagatatgaccaacatgcaaatagataaattatacagaatactgaaaattatgcaagtacaaaaaaagaaaggaaaaagaacagaggaataaaaaaggtgacaaagaagagcaataaaatagagcgaaatctagtcatgactcgttgtaaatacagatggtcagattagattgaaaaagaaagacccagtgatatgctgtctataagaaatccactctaaaggtaatgatatatataaatagatttaaaggaaacacatttttgaaaagatatttcggggaaatactaatcaaaagcaggagtggctatattaatattacacaaagtagacttcaaaacaaggaaacattaccaagaatgaagaggcagattacatgataataaaggggaaattaaccaagaaaacataacagccataaaggtatatgcatctaaacagcaaaactctaaaacacatgaagcaaaaactgatagcgttgaaaggagacatagacagatccccaacaatgcttggacactttagtcttcttcttaaaataattgatagaacaagtagagaacttgacctaattgacatttatacaacactccaaccaacagcagcagaacacatattcttttcaagtgtacatggaacagtcactaaaataaactatattctgggccataaaacagactttaaaatttttaatatagctataatataaacatcgcttttctcatcataatggaatttaactggaaatcagtaacagaaagagatctagaaatttcccaaatattaaaaaataacataggaatgaaacaacacacttctaaacaatcactgaattaaagtggaattctcacatgaacttagaaaatattttcagctgaatgaaagtgaaagtacaacatgtcaaaatgtgtgggatgcagctaaagcagtgcttagcagaaatctgtggcattaaatgcttatcctggaaaagaagaaagagctcaaatcaataatgtgatgttcaaccttgagaaactaggaaaagaagagcaagttaatcccaaatcatatttctttggattttgctttgcagaagggagaattgcagaagggaggaaacaataaaaacaagagcagaaatcagtgaaatttaagacagaaaaacaatagagaaaattaagaaacaaaatacttgttctttgaaaatatcaatacaattgataagcctctattcacagccctttaccctagtacaacccaactattcctcaactaaggaatgaatgacctagggtacatcgatgaaatggaatactactccagcaataaaaagaataaaccactgatacacacaacatggattaatctcaaatgcattatgctaagtggaggaagccagactcaaaagactacataccctatgcttccgtttgttatgacattctggaaaaggaaaacccataggtgtggagaacagagcagtggttaccagggacgaacgactggggaaggggaatttttcaaggaggtgaaactaataaattttaaaacatcaagtttacatctgtaaaagttgaattaattgttgaatcaacatactgctatgataattgttaatattatgatcaataacgaggtagcccaggctcctcaagccaaggaaacctgggaagtttagtttaaaaggcttttgggtaatggtagaaaacagtgactggaatcgtcttaatccaatatgccatcattgtaatcttagaaccccatatgctctggtccctcccattgggcaggacagctaccacagtgtccttgccaagcattaaattccccctgttccagggctgtgtggctaccctctggcctttgggaactgccctcaggaactgtcttggtccttcctgctgttttcctaatgagctcctagtatcctctgcagggccccagaggctgttgtatggaggtcactgtgcccacatggccctccgcccacacctatgttgctgattctttcagcagctgttgccccttggggttctgaaaaagagatatagtggggtttacacaatcttacagcatcttacgttttattgatgtcatgctcgaatgtcttccatctagcttgaaaatagatttatataaagcttcattgtgatatttcacaatcccctcccatcgccatgacaaccagggtatcattagggaggaatcagatgactactgtgagctttgccaccaaatcggacatcaaagtagaatttagatattaagtctctcatcctgcctctaccccagataaattcatttccaacttctaccaagttacaggggtcatttgagccatcttaaataatagattagaaatgattaagatagtacactaaagggaaagcattgatgttttaacaggcctaactagttaaaaggatttgtggatggatgtgaaacctaaaaaaaattgtactggacaatgtttcagaacctgtgagaagctgactgtccagttgcccccacacctactatcttatttccttgttccaatgtggagtagaaggtgagccatagaacaagacaagcagatatggggtcaagtcatagctccaatagttacttactgtgtgactttggacaaagtacaggttggtgcaatagttattgtggtttttgacattatttttaattgcaaaaaccgtgattacttttgcaccaaccttaatacttaaccttcctgaacctattcttctcatccacaaaaccctgtcccagaggattatgagatgaagatagtttatataagcactgaaatgtaagctttatgagggcaaagatgtgcggtgggtgttgtgtgttggggggggaggggttctgttttgctcactgctgctatccccagcacctaaaacagtgcctgacacatagtaggtgctaaactactctttgttgaatggcggaaaatgcctggcagggtggtgcaggcatggggtggacttttaggataggttaggataggttaatggataagctttaggagtgtctattgtacatgacttctaaaatttaaaagcagaattaataaaattaaatatagctaaaaggatgctgaagttttgccttggcattttcttttcttaagataatgctggccaggagcagtggttcactcctgtaatcccaatactttgggaggccgagtgggggtggatcacttgagatcaggagttcgagaccagcctgaccaacatggtgaaaccctgtctctcctaaaaatataaaattagccgagcgtggtgacgcatgcctgtaatcctagctacttgggaggctgaggcaggagaatcgcttgtggaggttgcagtgagccaagatcatgccattgcactccagcctgggcaacaaaaccgctgcaacacacaatttacccacataacaatcctgcacgtgtacccccaatcctaaaataaatagatgaaaactaaataaatacaaataaaaataatgtcttaaattgttactgtgacagaaatgtctcctacctgttcaactagtgagtgggtggacaagctgccatcattagatacataacccttataactccagagacataagtgggtcagtcttgcaggagtatggcatgcgagaatcacaactcgacactcaaaataattaaacaggaatttgtttatgtacatctgttcccaaaggacattaaaattgatattcagttatcgcttggagttctaatactcaaaaacaccaaagtttgggttcatttgtgtctctacaaaacccttgtattaaattagcatctatgtacatcctgtgttttttaggttaactacttctgccattagcagtccgtttggtagtcaggaatgaattcctgccatcatcttggaacccatggcgacagtgccttgttggttacaactctgaatggatcatttgaaattcccctcacaatcctgcatcttttcattggattcaagcttatacttcaaatttcctatgtttagtcctaacttttggaatttttgtttaattacccgaattcccagcattgaatgggctttggattctacagtgcttagaacagaaatggaatttagttgtgtgtttatattttttttaatgagaccaggtaattagaacagaatgtggaagccactgtgtgtgtatgtgtttgtgtgtgtgttgtaaaatcaaagaaagaactatcctatgttggttcatagtatagtaaaatttaaaacatcagctgtccatgacattgagaacaacccttccacttattccccgacgtcatcgcaatttagtcgcagatttggggctcaaaatttggaattaggctctgggttttttttttttttcctctatttaggataggtctatttaacactggcttcaaatattggtgttttagtcttttgcaagccaaccaaaacacccaccactccacaaccaccaaacatgccaaccctgaagcaagcacacacatgaattagataatagggatgtgtattagttacctgtggctgccataacaagataccacaaactgggtggattaaaacaacagaaattcattctctcacagttctggagaccagaattctgaaatcaaggtgtcagcaggattggttccttcctgagggcttagagcaagaatctgttccgtgaccctctatcagcttccagtgcttgctggcaatccttggccttccttggcttgtggcttcctaactccagttccagcctttgttttcacatggcattctcactgtgtgtctgtgtctgcctgtccaaattgccttcttttctaaggacaccagtcatactggatttagggcccaccctaatgcagcatgagctcatctaaataacatcttcaaagatcctatttctaaataaggtaacatttacaggttccaggtggatatgaattttgggaggacactattcaacccagtataggatatgtttggccatgcaattaccacataaatgaaagaagtaaatccacactacagtgcaatcgtgctgtaggattgcactgtagtactacgctagaatcgcactggagtattgatttaattctttttgttcatagagcactttcctgtttgttttatagagtgtggggtgtgtgtgtgtgtgtgtgttggtttttgtttttttttttgtagtctaatgaccagtgctttagatcatagctgactgtacttgtggggtgatgccaggccagcgagtgggctgttatcctgcccagccacggtgcacacctgaccgcacactatcatcctcctacccgacttccagggcctttttccctcaaaccaagcaggtctcacttcttggggcatccccccttgcagtatatacaggatgcttctttcctcatgtgttctggtcactcacatagaatcctggactttcctcatgtagaatcctaatatttaactccatgaggtcaccaaagatgtttctccatgggaacttctgggtcagacctgaccagatgaccaagagccataaaagctgaattctgaccccacctcggatatcttattttttagacaactccagttttccctctctgtgccaggaggaagatgcattctggggcacatgttgctgccttttgcatacatatgtgagccctgataagatacttttcctcttcctagtgatgggtttctgtttttgaaaatgggccttcttggcttctggtgttttgtaacaaatacctaatgagtcatcactaaacactagctctttactgacactgtggactataacaaagaaatttaaaaccaggctccagaggcctaggggattggctaagtaaactgaggtaggtgaatgccatggaattctatatggcagttagaaagcagttatctagatggacatttcagcaacaaagacagtgtaaaaagcaaagggaaaacccagtaacatttatgtaaattacatgtctgtatcacattagtgtaggtgcttgttgggatagccagggactgatggtggtggaatctggcataaagggaaaaataagacaagacaggtggaccttatacaacaaaattgccacaggctaaagagtctgattaattcacctttctgctcctgaggttaaaaaaaaatcttgagaaacttaaatatggcatttagcatagcaaaaaaaaaaaaaaatcacaaaagcaattgattaaacatcaaagaacagggcatagacactaagattagggatgagagttagaagcaggagctagcagcacgggagacagaggagcggtaatggggccattaagtgactggcccttgaacaagaccccccaccaccatgagagggggctgccagcattacttggcaatatctattgagtgtctgttggtcaggtactaaatgagacagggctcctgccctgtgaaaaacttacagcaggctgggcgcagtggcttatgcctgtaatcccagcattttgagaggccaaggtgggaggatcacttgagcccaggagtttgagaccagcctgggtaacaaagcaagtccctttctctacaaaaaaattaaaaattaactgggcatggtggtgcacacctgtagtctcagctactcgggaggctaaggtaggagaattgcttgagcctgggaagttgaggctacagtgagccatgatcatgccattgcatgccagcctgggcaacagagcgagaccctgtctcaaaaaaaaaaaaaaaaagattgcaaaaactggaatctgagtaatgggagaacaatttctttttttagaggagggaattaggaagcaactactttgggatgagaaagatatcaggtttctcttctagataaattgggctacaatgagacccattgacaaaattagcctcctggaattccttctgaagggcagacatagtccttccctgctcgtagcaagtggacagctcagcctgaagaggggagcgtggcctgagatggccacagttgcagggctggttctgtccatgggctgggagaggcatggtaggtacgtgagaactgtttgtgtcatgaatgaactttgggtatcacatgctacccatcttcctatttagctgccagcgtaggctcctaaaaccagatttcagttgttgtatcctgatcaaaaatcttttaggcatcccagtgcccacaatcagccgtcacagtctgcctgatgtcttccatccaaactcatctccaggggctcccatctatgcacgctcccagcgccccacaacttcccttctccatccttctaaggtcgtgccccctcctgcctctgtctttgtccatgccattcttcaagacccccaatgcccttccttcatcctctgtccggtgacccactcctccctgcaaatctctgctcaaatgccacccgctctctgagagcctctgcatctcgtggaaattttaccagcctctctggtcacgttgtattggcatgtgtctgactgctccatggactcagctcccaaagtcatgagctgtacctttacaacccccaatacttttttgaccagtttattttcttattataccataggtgggatcaatttcatacaacattatttgaggcttaaacatacataaactttctttaaagttaaaccacacaaactttctttaaagttagtattcaaaggaaatttggagtcagaataaatcaaaccttctaacatttaaagaatgagaattagacatactttgctataatttagcaatgaaataagaacaaagccttggcacttcccttcgttcaaaccccttacaacctgtgattagagtgccaaagagaaagccagccttctgattttcagtccaaatgtgttacatcatgttttagaaactcacacaggtttgagtccatccaaactcaaaatgccaaagtgaatctgactgaaaaaaaattactgtgtgatatctgcgtatatttgtttaacagaaaccataatttggacattacatcaaactagacttggtctacctaaggagaaatgtttgcttttcttttaacagaattttaatgcattaccgcatgtgtttgccattttggtcagaaggaaagaaggacattttggagattagaattcttaaacaggaatatccagatggaagcagaactcctaggcagtctatgggtaccttctcagaacagtgttttaaactcataaaataaaatacagaagagtacaaaggaaaccaattctcttgaaatacaattatcaaaacatgtattttttgagacaaggtctcactccgtctcccgggctggagtacggtggcacgatctcagctcactgcagcctcaactccctaggctcaagcaatcctcccacctcagcctcccaagtagctgggactacaggtgtgtaccaccacacttggctattttgttaattctttgtagggatggggtttctccatgttgcccaggttggtctcaaactcctgctcgcaaacgatctgcctgcctcggcctcgcaaagtgctgggattacaggcatgagccactgcgttcggccatcaaaatactctttaacaaacaaatttgctgtgtaataacatgtgctttttttttttttcttttttttttttttttgagacacggtcccactctgtttgagacagggtcccactctcaggctggagcgcagtggtacaattacggctcactgcagctttaacctcctggactcaagggatcctctcgcctcagcctcttaagtagctgggaccacaagtgtataccaccactcctggctaatttttttactttagatagagacaaggtctccctatgttgcccaggctggtcttgaactcctgggctaaaaggatccgcccacctaggcctcccaaagtgctgggattactggcatgagccactgtgcccagccatatgcttctttaacattaaaataggagaactcctagaagatctaataattatcataatttcaaaatagttatgagttcttaaataatatttcaaaatatcagtaacttctgtaaagtcccatgaatatctatatgatttccgttggtgatagagtcacagtcctgcatactattatgggtgttaccacattcataataaaacgaaatgctaaatttcagttggaggttagtgaaaagaaggatggaattcacagaacccaccaaggcagtacaggaagagttatatttcattttcagggtatccacattagctaacacattctgagacccatttgggttcatgcccatgtgtgggattccatggaagctcatattttagaccagaaatggcaaagaagccaggcttctgacctccagctggcattgtactggtggccaatgatgtctgacacttcagtattcggtttgttcggctacttaccgtagcttccaagaactgctgaagcattgcaaagcttgcgatttgttgctaggagaaacttttttttctttttaagctaacctatctcccagccagaaactaggaagaacttcaccttcatttctcaaagaaggaaacaaacatttagatcatagtcatgtgtctcctgtaaggaaaccagcttctttattttggttgtaggaacaagtggttgggtcatcatcacaatgggcattaagattatgggattatggccaggcatggtggctcacacctgtaatcccagcactttgggaggccgaggcaggcagatcacttgagatcaggagtttgagactagcctggccaacatggtgaaaccctgtctctattaaaaaatacaaaaaaagaccaggtgcggtggctcacccctgtgcctgtaatcccagcactttgggaggccgaggcaggcagatcacaaggtcaagagatcgagaccatcctggccaacatggtgaaaccctgtttctactaaaaatacaaaaattagctgggcatggtgacgcctatagtccagcttctgctactggggaggctgagacaggagaatcacttgaacctgggaggcggaggttgcagtgagctgagattgtgccactgcactccagcctagtgacagagcgagattctgtcttaaaaaaaaaaaaaattagctgggtatggtggcacatgcctgtaatcccagctacttaaggggctgaggcaagagaatcatttgaacccaggagacagaggttgcagtgagctgagattgtgccactgcactccaacctgagtaacagagtgagaccctgtctcaaaaaaaaaacctaaataaataaaagattatgggattaaagtatatgataatcagggcttgcatatataagctcttgttatatgaatcttggagaatggcattgttggtacccacagtttaggccaaaaatatttgcccagcaccaagactggaataaggggccaggcatgatggctcacacctgtaatcccagcacttggggaggccaaggaaggaggattccttgagcccaggagttcgaggttacagtgagctataatggtgccactgcactccagcctgggtgacagagtgagtccctgtctcaaaaaaaaaaaaggaataaaacccaaatgtcaaatgagagtgaaggtatctttatattgacatagccatgaggttgcccttcaaacaggctttgttaaagcttgaccttcagtgaacacagcgtctagcaaaagccaggagccacctgcacctttttgtgaggtagttctggatgccattcctagccctggaactgcttgcaggcatataaattgtagccgcagctgtttttgatatgcaaggccagatgggggctagtttttgagctgtttcagaagccaattcatggacctatggaatcaggaccacatttgctaataatctgttgtggcattttaaaaattatttgctattgtatgattcaagattaacccaaacctttagagagaatgagtgagtaatagtaatagatggtaaaaagattcaaggtaccaatttttaatctcatagggaggtccttgcagattcctcctgtgctgtctttcaaatggttctttaatggactttttagttaccagatgataacctcttctacgatattcccattaaaagcaataaaatcgtggccagaacctacctcaattctgcatttttgatgtgtgaatgggatcgtaagaagaagttataaaaaagagaaaatatctttcacaagtatttctgcttgtaccatgtccgttacattgattcaaaatgtttaaactttaaagaaggtaatacatgcatatggtaaaacaaattgtaaagggcagtaaagagatatcaaatgagaaataaatgtctcccttcttatctcccatctcaacataaaccccagttcctgtcccaaatgttaatagttttgtgactatccttctctaaacattttatgtatatattttctgtctatgcttttatttaaaagtgtgcacaaacgggattataccaaacacactgttctgaatttttctttcattcacaaatgtataatggaattctttccatacccacacacaccgacctagctcattctttttcgagtcacttggtattccattgtgtggatggccagtgttagaaccatcttaagcaacgttctatggatggacatttaggctagttttttttttctctatttaaaaaaaaatgggcagataatatccttgttagaaacatttttgtatactcatagaagtatatctctcaagtagtttcctagaagtagagtttttgggtcagggtgtatgggcatttcaagttttagccatgtaatcaaattgccctccaatatggctgagtctgtttacattcctaccagcaatgccatcaatacttccttgcttacccacctggcaatacttgcaatattaaattttttaaaatgtttgctaatttggatggtcaggatgatcccattgtggctttgattttcatttcttgaattataagtaaggcagagcctcttttcatttgcttatggagtacttgtacttggttttctgtgaattgcctatttattattctttgcttttcttttgagctctttgcccttgtctactgtgtaaacattcaattcttactatgtggtgagcactatgctagactctcaaactgtaatggagatgaaatcttttggagctggcagtgtactaggagacaaacattgatcaaataattctctcagtaagtgtatggacaaactgaattaaactgaattaaatgccttgaaggaaagtttcttgcatcccttagagcatggcagggaagagagggggctggactaggggtgggagaagactgccctggagaaattgacatctaaagaatgaatagggccaggcacagtggctcacacctgtaatcccagcactttgggaggccaaggcaggaggatcgcttgagcttaagaattcaagacccagcctgggcaacatggtgaaacccccatctctacaaaacatacaaaaattaaccgattgtggtggtgcgcacctgtgggaagctgaggtgggaacattgcttgagcctgggaggaggaggttgcagtgagcagtaagccatgattgtgccactgcactgcagcctgggaaacaggagtaaaaccttgtctttatttaaaaaaaaaaaaaaaaaaaaatgaatagaacttggagttgagggaggagcatttctggaagaagggacagcaccgtggagggaagatgatgttgtagatgggctaaaagaaggcgcaggagcagagcacagagagaagaacagtgatgcaagataaggctgggctgcagcatctgggggaggaggcctctatgatgggatatatatatatatatatatattttttttttccccccaagatggaattttgctctgtcacccaggctggagtgcagtggcgtggtctcggctcactgcaagctccgcctcctgggttcacgccattctcctgcctcagcctcccaagtagctgggactacaggtgcccaccaccacgcccagctaattttttgtatttttagtagagacggggtttcaccatgttggccaggatggtcttgatctcctgacctcgtgatccgccagcctcagcctcccaaagtgctgggattacaggcgtgaggcactacgcccagtcttttttgcctagagcaatagaaagccattgaagaattttgagccatcgttggtaatctaatctacattctgaaaatactgttctagctgaacagaagagaaacaggaagatcaattagaagatattttattagtccagatgagatctcatggtagcctggccctggattatgacagtggacatgaagagaggcggaggaggttaaataagatttgatgacgggttagatttggggggataggaagagaggaggtatccaggatgattcctgggtttctgattacatggatggtggtaccatttactgagataagaaacactgaggccggggttgggttcagccttagacaagacatctgactaaagctggcaaggaggtaattaaataagatttgatgacgggttagatttggggggataggaagagaggaggtatccaggatgattcctgggtttctgattacatggatggtgataccatttactgagataagaaacactgaggccggggttgggttcagccttagacaagacatctgactaaagctggcaaggaggtaattaaataagatttgatgacgggttagatttggggggataggaagagaggaggtatccaggatgattcctgggtttctgattacatggatggtggtaccatttactgagataagaaacactgaggccggggttgggttcagccttagacaagacatctgactaaagctggcaaggaggtaattacatatgaaattctaaggccagaggcaaagtttggcctgtcaacataaatttgtgagtcattcacatatggtagttgaaatcatggtcctaggaaattgctcatgaaaggaatatagtgcccaaagcaggtctactcttattccttaagaaattctgatatttaatagccaggtagagaaagatgagacagaaaagaaaacagaaatgagcagcctgagagcaggaggaaagcaaggggagtgtggttcccagaagctggggtgagagtgtttcaaataggatggaatagtgccaagtgctgccgagacatctgaaaagaggaggcctgggaaacacccattggatttagcaacatgggggtcttggtgagctaattttaaatttcctcaatggaatgatggaggcagaagccagattggagatggttgaggaattagtgggaagtgagaaaatggtagacattatatggaccactttttttccttttttttttctgagactggagtgcaatggtgcgatcttggctcaccacaacctccatctcccaggttcaagcaattctcctgcctcagcctcctgagtagctgggattacaggcatgcgccaccatgcctggctaattttgtacttttagcagagacggggtttctccatttgttcaggctggtctgaaacccccgacctcaggtgatctgcccgcctcagcctcccaaagtgctgggactgcaagcatgagccaccgtgcccagccgcaccacttttgaagaagtgtgattcttcatagagaatagccccaaatctgttcttcctcagtttccacccttgacccttttttgctactcagtaagctgaattgatcttgtaattcagtagtgaaaggtctgcagctttgccctccctgcagccatggcaccagccagcccagtgtggagtctgcagggggagcccagctggagtttgggccactccagcccctctgtgcagtttctgattctacaggccagagctctgggaaggcccattgtaggaacgcggctgaaaaaatgagtttaagaaaaagttcttatattttagtggtacctactgaaaagttgaaggatacatatttgcaatgtgacacaagagaagccatgagctgatccttgttgaagctgagcaatgggtacatgggggtttattatattgttcacaccacttttgcatatgtatacatttttccataacaaattataaaaagttaaatttaggaattctataaaccgaaggtgcaaagagccagtggccatcacaggtccactatgtacatagcacttaaaacaggaccttcggctgggcgcagtggctcacgcctgtaatcccagcactttgggaggctgaggcaggcggatcatctgaggtcaggagttcaagaccagcctgaccaacatggtgaaaccccgtctctactaaaatacaaaaattagcagagcatggtggtgaatgcctgtaatcttagctactcaggaggctgaggcaggagaattgcttgaacccagggggcagaggttgcagtgagacgagatcgcaccattgcactccggcctgggcaacaagaacgaaacgccatctcaaaaaaaaaaaaaaggtaccttctctaaaccagtcctcctttggattgtgggtttccaggtgccaagggtagctgaagaaattctatttccagatgccaccctttcttctcctgttaactccaacaccttgttccttgcccccttctcctttcgtacccgcctcctgagtacacactagaaatcacaggtctgacccctatgggcctcatgaacttgaacaagttccctcccatctctgagccactctgaaaaatggggattataacatctgctgtgcaatgttgtgacgattaaatttgacagtgcacgtgcggtatctaacacagcccacagcctcagatgcccaggaactcaggaaggtcatagaagtgaatgaagctgaccaggtacatgagaaaatcatgtgaccctcttagctttagctttgccacttgtagtagacatgtaagtagagagaattataagaaaaattctgggccaggtgcagtgactaacacctgtaatcccagcactttgggaggctgaggcaggcagatcgcttgagctcaggagtttgagaccagcctgggcaacatggcaaaaccccatctcttaaaaaaaaaaaaaaaaaaaaaaatatatatatatatatatatatatatatatatatacacacacacacacacacacacacacacacacacaagccaggcatggtggtacatgcctatagtcccagctactcaggaggctgaagcaggaggattccttgagcccaggaggttgaggctgcactgagccaggatcacaccactgcactccagcctgggcgatggagcaagaccctgtctcaaaaaaaaaaggggagggctgggaggggagaaaaaattggataagaaaaagaacaatgcaagtatgataaatgatataaatcacccatattcataaataaaggggtaataaactgagacttaacctcagtgttggggggcaacagggaggggtggggactggggcaaatcagagcatatagggtccatctgagagggacagccatcctgggctccagccgattgctgccatgagggagtgtgaagccaatgttaacatgtcttcctggtttataagagaagccagaactcttaaattttttatgtgaaatatttcaattcttaaatttgggctcagttattttttttaataacactacagaagccaaactaaacccatttatgggccaaaatcagctcgtgggctgccagcgtgcaacctctcacctagataatggtatataatataaatacgtttcccttccccccttttttctcttcctcctctttctcctttccctcccattttccacatccttttcacctaaccagcccccaccctacatttctatactaagtccaagtgatagaagggattagggtgggttgaagcagtgattaagcccaaggggatgtaatctagatgcctaatggcgccccagggcctggatcattgcctggcacatagtggatcctgtcaaaaaccttgatgaatgaagaagccagaaactgggggagtcagttctgtttcttgtgcacaccctgggcttacccaaagaactgtctgatttttctcaacagccctgagaagtcgttctggacgctccatcatcaatgggaactgggcaattgatcgaccaggaaaatacgagggcggagggaccatgttcacctacaagcgtccaaatgagatttcgagcactgccggagagtcctttttggcggaaggtcccaccaacgagatcttggatgtctacgtgagtttggatgtttctggactgttctttggattttgaatcttgtcacttctaaggaacatactctgaacaaataagcaacaaatcattgcccatactcaataaaaaccctttgagcagagcctgttggaggcactccttgaatgcttggcgttcatctttgcctttacttctgaatgggcccagctcacagcaacctccaactccaccagatgcttattaccttcggagtttattgacccagtaaaaccaattttacttgttgaaccaaatcagaggcaaaacatgccctttatttcatgagcattggatctcctccaggcactttccttatactgctaatttggcatgttttctttttatggcaaaagaaagcaagagcctaaaggaaggcaggaccgctcccagctcccagccctgttcagactctgagagcaaatgaagaaaggagagctccagagccctccagatgaaacaataaagctgagagtcacagtagagagatttactagaagctccctgcttcatagaagacaaaaccttaatttcttttacgtgaaactaagatattaaattgctcaagagttttaaatggtccttacgttcaaaggaaaccactagaattcaatcttcttaaaagaccaggaaataaagggtgataagacataaaagcttgaaataacattttgataaaaagattgagatcacccatgaatatacacattatttctgtccccaaagctgagctgattaacatatttgctgtgtcagagttttagaaatattattaattgcattgtcattacttctccacctacacacagttctatgtcctttcctcttgggcctagtagactcgaaattacaaaggaagccttgttgtagtttattttggattttttttttagactgtccagttggttggttgaatctgaatatattttaaatggcatcagaggtaaaaactcaggttgttaaaggcctactgtgggtggtctaggaatggaagccaacagcaatttcataaacgggacaaggttttgcactggcagaatgctcaggcagaagaggcaccagagagggagggaggatttccagccacagaccgagaggaagattgtgtgaaaagggagtgaggggatgagggatacacagcaggaacctgaggtcacacaaccgtgtcccttggggattcagtgcccaccacgtttctgcaacgccgatggtttgatattggttcctgggtaggagaatcccaggggttctcaggtctgccttcctttgggtaatttataaaatgaagacccatttcatcagtagggagtggcaagagatcatggcataaacaggaagaatagacacaggacccaccatgcaggagtgactcagagatgcttctagctggaaaggacctttgaaagtgacatgattctaacctcttccttccccaaggaagaaatcaaaaactgcagggtgaaggggcttgctctaggttacacagctggtcaataggagagctgctttataaagcagcagagacagaaacatcaaacccgaccgtgtctccttgcacggctcatatttacactgtggattctcattctgctgctgggtttagcccaccaccctgctccccatcaggaaatccatgggcagcaaagactgtgtgctctaaatccaatagggagggacgtattctgttgggccatgctcatttaatatgttttcagcccagacaatgttcagctgctgacttccacagtcctacgtagattcctgcttgccatcctatttttgtcatcattcctaagagaatatgacccagcaagagttgggtcgcttctacttgttttcctggccccatgtctttgtgtttctggggctttccctgaataagagggagggacctgggggccagcctcaccagccaggtcaagaactttgagggaacctaaagcatcccggggtggctctgtccaggaggtctgctgcttgttcgcatgactttgtcacgccacctagtgttaaaacagttctcctgcagtgtacacgtatttatctgtgttggatgtttcaagagcactgagcaaaatctaaggacagaaaggttctgctaccgttgctccatcttctcctttggagtttagaaaatcttgactcttagcttagtcttcttctgatttgctcggcctaagttcttcattcttcaaaagtaaatgacaaaaagccatccaggaataactttgtttaatctgccacaggttcactgatattactggatgcgtactagagtgaaccaacccagtcatttctcagtagttctgcaaatgccattgaaacccagaaggggtgtgcatacgtgccaagtgcggtaacactgatttttgtgtcagcagatgatacaccagcagccaaacccaggcgtgcactacgagtacgtgatcatggggaccaacgccatcagcccccaggtgccaccccacaggagaccaggtagaatcccttgtcttgtggccggggactctggtcatttccttgtaaagccttctctctctcaattcttgtgcatccaccctctgtctctcggtcaacacagagaaaattgagggacgcatatttcaaagccaaggggccttgacattggagcaggcttcaccatttgtctgagccttcactgatgagactgtttcattcactcgattccaaaatggcatgagcatcctgggtctgccctgccagttcaacatttgaaatgctttatactagtttccaggccagacaagggggctcatgcctgtaatcctagcactctgggaggccgacgcaggtggatcgcttgggcccagaggttcaagaccagcctgtgcaacataatgaaacccctgtctctacaaaaaaaattacagaaattagccaggcatggtggtgtgtgcctgcaatcccagctactcaggaggctgaggtgggagaatcatctgagcccaaggaggttggggctgcagtgagccgtgatcagaccactgaactccagcctggacaacagagtgagaccctatctcaaaattaagaaaaaacaacacaaatttactttcttagagctctggaggttagaagtctgaagtgggtttcattgggacaaaatgaaggtgtcatcagggcccctctctctccagaggctctaggagagaacccacttcctcgccttttccaacttctaggagccacctgccttccttggttcctggccccttcctccaccttcaaagccagcagggtggcactttcaaatctctctctgaccctggcctcatcacatctcctctctgactctcatcttcctctctctttcctttataaggacccttcagattacactgggcccacccaagtaatccaggataatctctccttctcaaaatctgtaatttagtctcacctgcaaagtccatttttgctatgtaaggtagcatgttcacagattccagggattaggatgtggacatctttagggggccattatctgtctactatatgccttttctcttggttccccttttgtttctgttaataatactttgacctataagacaagaataatgagttcacacctaacaatccatgttgagtcttcctggtgggctctgcttatggacagagcaggcagctttctctcggctggcactgggcatgggactgctctctgagtctgcagacatttctctaccggaggatgatggagcccaccacccaaatgcaggcagtcttttccttccttaaaataggaaggtctgcagaagtattcatggtaattatagctcacacacattgagtccttgctgtgtgcaagggcttagaaactgctgtgctgagctctttgcgtagattagttctttgaattctcatgacagagggaggtacttggagggaagtactattattagccttattttaagagtaaggaaatggaagcttaggaagagtaagttaataattgtcctgatctcacacctgggcagtgacctgaggagggcctgtgtgaccatactttgtgcttgttatatcactgagaggttacttggtccaatccctaccctaggaggaaataaaggcacaagtgccaaacccgccccatccattcttctctgaactttggacgggataaccaggttatctgattgctacagactggggaggacaacagctgggtgcatccccagaacatggggtgggtgtgttgtccaaactccaagtcagcaaactcagcacaacagagaatttttatgtcatgtccagaagcaatccacagtttgagaaaccaagtttgggtaagatttctggggtccattgctggtttacagggataatcagacagactatttgaaatctatcaggatgatgatgatttctgtcaggcctgatggggctcagctcatgaatagcatgggggttctgggatcagctccctgggacagggcaggcctggaggggtcacctgtaaaaagttggtaagcaggggcattgtcaccaggcttcctcttccatgtcaatggagtctggaggcagagttggaatccagctctgcacctttttgctgtgcaccctcaggcgggtcagcaacctctctgaacacacacccagtctacaaaatagaagaaaaaccctataaggtggtttttggcaggggagaggacatgggaagagattgaataaattagttgtccatcctagcatagagcccagaacaaggcactgaaaagacttcttaaatttttttgtccaacaacatcttggacagttctcatttatgtcaacatgcctggtcctgattttgttggtcatatttgcatgtcatattttaaaccatgaagcataataaccaactaagtaagaaagccctggcaaaaaagctgagaggtctggtgcagtggatcacgcctgtgatcccagcacgtttggaagccgaggtgggcagattgcttgagcccaggagttcgagaccagcctggacaaaatggcaaaaccccatctctgctaaaagtacaaaaagcagctggatgtggtggcactcacctgtaatcccaggtactcaagagactaagacacgagaatcacttgaacccaggagacacagggtgcagtgagcctcctgcactccagcctgggtgacagagtgagactctgtctccaaaaaaaaaaaaaaaaaaaaaaattgctgagaaagccctaattgttgttgttgttgttgttgttgttgttgttgttattgctgaaatggggtctcgctatgttgcccaggctggtcttgaactcctgggctcaagcaatcctcctgcctcagcctcccaaaacgttgggattacaggcatgagccacctcacccagcccccttgtagttttaactgtgttctacagtaaccctagaatttgcctccttattttctattaaaatgagacatacttgaacaatattcagtcaaaatagaaatatatacagtcaaaagcaactgccacataattgccaaaacttggaagcaaccaagaagtccttcagtaggtggatagacaaaaactaatggaatattatttagggctagaaataaatgagccatcacgtcacaaagagacatggagaaaccttccatgcatattactaagtgaaagaggccactctgaaaagactacctattgtttgattccaactatatgacattctagaaaagttaaaactatggagacagtaaaaaggtcagtggttgccaggggctgggaggacagagggatgaaaaggtggaacagggaggatttcagggcggtgaaactactctgtgtgatattacactggcggatgcatgtcactgtgcacttgtccagacccacagaatgtgcacccccaagtgtgaaccctcgtatggactatgaactctaagcaataatgacatgtccgtgtagggtcatcagttacacatgtaccagtctgatgtgggatgatggtagtaagggaccctgtgcctgtgtggtgggaggaggtgtgtgggaactctgtacttctactcacttttgctgtgaacctaaaactgctctaaaaaaaaaaaaaagcctattaaaaaaaaaaaaagtccacagctcccaaccccatgcccttcccagagggagtctaaccctttggtgggattttgcctagcccttttctatgcatacacaaacatgtttccagccatttgaatcatcatctacaatctcagatgtgcaaggaatattgcatattattattttccattagtcagtttaaatctgacctcaacttcacccttctttgaaaccagtagataattcaatcgcagtctgcttgggggttacacacacacacacacagacacacacacacacatattctcactccagatataaggaaagatctagagtcttagacaagccaaaacattggctagacccccctggtggtctgtccacactaattccgctgaggtgccaccgggagcagcctcatggggccttcaggttagggctctgctccttccagtctgcatggggggcacaggaagctggtgaggctggcagccaggccccctctcccgctgcaggggtggcttcctcctgggacactggacattgtctggtacacctaaggatccatggcactcaggaaacccaagactccagactcctacctctcctccatcttgaaaacctctctctctctttctcactctctctctctctctctctttctcactagctctctgtcttgctctctgtctgtccctctctgtctctcttaccatctccctctcttttgctctctctttattgctctctgtctctctcgcactctctgtttctctctctctctcttgctctctgtctctcttgctctctgtttctctctcttgctgtctctcttgctctctgtctctctctcgttctctgtctctctcactttctgtctctgtctctgtctctcttgctctctgtctctcttgctttctgtcactgtccctgtctctcttgctctctgtctgtcttcttctctgtctctgtctctcctgctctcttgctttctgtctctatctctctgtctctcttgctctctgtctctttcgctctctgtctctcctgctctgttgctttctgtctctgtctctctgtctctctctgtctctcttgctctctgtctctctcactttctgtctctatctctctgtctctcttgctgtctgtctctctctcttgctctctgtctctgtccctctctgtctctcttgctctctgtctgtctctcttctctgtctctcctgctctcttgctttctgtctctatctctctgtctctctcttgctctctgtctctctcttgctctctgtctctctgttgctgtctctgtctctctcttgctctctctccgtctctcttgctctctgtctctgtctctctcacactctgtctctctcttgctctctgtctctctgttgctgtctctgtctctctcttgctctctctccatctctcttgctctctgtctctgtctcacactctgtctctctcgctctctgtctctcctgctctctgtctgtgtctctctcttgctctctatctctgactctctgtcttgctctcttgctctctgtttctgtctctctcgcactctgtctctctcgctctctgactgtctcgctctcttgctgtctttgtctctctcttgctctctgtctctcttgccctctctgtctctctcactctctgtctctgtgtctctgtcttgctctctctatctgtgtctctgtctctcttgctctctgtctctctctctcgctgtctctctttcttactctgtttctctgtctctcttgctctcttggtctctgtctctgtctctctgtctctctctcacttgctctctctctcccttgctctctgccactgtctctctctcctctctctctttctctctctctcaaaatgtgccctcctcctctctctgggctggcccctcagggacatccactttacccttaatgaaagcctaggctttgcactcttggaagggaaagctgttgacttctagcagcttttgttttctgtcctgcacaaaaacaaagcaataacatctaaggacttggctactctttcaaaccggaggaggaagtggaggaataaagatagtaaatcacacacaaattagtatctcaaaaagtgacctgccacacctgtgtgtatgtgtgtgtgttctgcttttttctttcaccaaacaatattgtcatttcttcatgtcggaacgttatatttgctgcattcttttcaaaactcacatagtattccattttgtacttgtagcataacgtagtttaaccagtaccactggtgaacatttgtgtctgtttgctatttcaaataatacctcagtaaccatacctgtatattcagatttatgtacaagaaaatatttgcggaacagatgtgatagaaactgaattgctaggtcaaagggtatgtgcatttcaaatttggataaataatgccagatttccctccaaaaccatggatctatttgcaggctcatccatagtgactggaagtgtgttttcctgcaccttcaaaaggagtttagggatttaagggtttccaaactttccaatctttggtgttaggtggtggtgttcttttcatgtgtatttatggaattatgagtaaagttgaggatttttgtatgggttttggctgtttgtgtttctttttatgtgaactgtctatggctcacaattcctgttcctactgcagtgttcgtctttgtcttattgattttcaaaagtgctttgcatgtgagggaaagcactagtaggtgtctgcttattttaaacagatgtgcttatgtgctgtgacttagaaacgatctcatgctacacagtctctaatgtcgaagcaatttcctctttacaactcagggtctaaactgatcctgattctgtgtgtgcacgctcacctctcctaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggtgagcctgtgtgggggacgggtggatccctgcagaaccctaagcaaggagtgtgtgggtggcccaaggcagcggtccccggcttttttggcaccagggactggtttcgtggaagacgatttctccatggatggtggcggggttgggggatggtttctgggtgaaactgccctatcgcagatcatcaggcattagttagagtctcataaggagcatgcaacctagatcccttgcctgcacagttcacaatagggttcacgctcctatgagaatgtaacgccaccactgatctcgcccacccaccagtcacctcctgctgtgcgacctggttcctaacaggccatggactggtgtcgattgggggcccctggcccaagggaaatggcaaaccctcacctctgtgagcctgtctatgagatggctcatgggtgtgacagattgcattggggccctcaacaccaccctcaggtttaatgattggctcaaagggcttacgagacccagaagagctgttacaattcatcacagtcaaaggatagggattcgagttaataaaggaaaaggtgtgttggcaaagtcctggagatgccaggcgccagcttccaggtgttgcctccagcagagtcacacagggatgcacttaattctctcagaaatggtgtaattcagaggctgagaacacatgccaagtactgccaaccagagatgctcacccaagatttggtgtccagggtttttactggggtctctcgtctaggtatgcagctcccacatgagtgacactagctactctccctttaccatcccagaagccaaaccaatactgcgtggcccaagacctcagcataaaaaaacactcttatcaggtggcatattccaagggcttagaggttctctctcaggagctggtcaagggcctgtctttggcatgtgcagggtttgagcaactcaggcctgctgtgcacatatattcattaataaacggaatacactcatgtacttcaagatctaaaatttaatctccaagtcagggttgtggaagacttacacaaatcccagttgaaactcattctcaaatctcaggatttcagaaaaaaaaaaaaaaaacaaaactttgcaggcttggcgtgttagctggcttttacactgaccaacactcacagctcccatactatcccggtaaaatcccaaccctgtattcattcattattccaacctgatcagctaggaccaccagggacaaacctgaagcccaacaaagtcagctttattgacccctcaccacaagggagtccacacaccggaggaagcatggggcgtctctccaaacaaaagaaaagatagagttgtaggatttgggaggatacagtttaggtgaaatttaaataaagtagggttgtgataggctgaaagcaagacatggcagtgttacaggggtcacatcaggatgatgaagtggacccagggtcccgtttccttgaaaactccaaagttaagatacatgtggaatgtgctgtccagaaaccctttatctgacattccataccagattggaaatcaatgctgcttctgtttcaagctgactcattgcaaagatacacctatgaactgtgtagttataatttccttcatatatatgataatagcctcctgtttgtagtaaagtcctattttatcccctgaaacagctcttctttgaggggaggttgctaaagaaacaggaaggctgtatcccccaggaatctctgcaaactggggaactgtgtgatgtcccagagcattggtttggggtggttttttttttttgctttgctttgctttgctttttttttttcttttcctttcttttcttttcttttgatactggtatctaagagtacaaagtttggaacctctcacaaaattagcacactgaaaaatctcatgacagcttctaaagtttttatctttttcataagagcattggcttagtggcttttgagaatagaatttaggtctttggttcttcttgggggctggagcttttcctgcctggaacctctgcagttccataatgatttggtaactggagtgttgatttatagaggttttattgtgcaaattttattatgcttatacttaataaatgtgcaaagaatctggactgcagattcattggaccaacttcttttatatactttgtgaggaaaaattaaatgcatataaaatatgtcttgacagagtcagaaagctagaaatatttttgcattaaggccaaaaccattttggtgagactctgtgatattatagaggtaagcagtatgtaacataattgatataggaacccgaaatcaaaatgtattattattgaaatattctacctttaggtaatgtgtgatgcccatcaaaggaaccagatacactcagaactaggtgaaaatagggaaagtcataaaaaggatgaaagctgtcactgcgtggttttcaacaaagggtgccatgtggagaagattctctttcaccctgtccggagcccataggccttgtgttgtgagcaggatgagatgagggcaaatgcatgtgctggttccctgtgtctcctccagacgctcccacggtctctctaatggagcaaactcataaccaaatgttccagtttttgcccccacaacccatccgcacgctgtgtcatccacactgaggtatggagttgaaatttaaagaaagcaaggttttgatagactgaaggcaaaacataactgttactacctcactatatgctagtatccctcctttacgacactctggtatctggccagcaaagtcctgctcgtactccaagctctgagaccacctcttctgcaaagccttcctgattctgcaaagaacaggtaggcatttcatccttgggacctcacagcaattcaggacacatttctgtcccagccctgcttggcttggctgtctccatgaatatacactttgcaacttctgcaccaggcatcataccaagcacacagtaggcactcctgtgttttttgaataagtgactatatcatcaccacatttcaaatgcggaatatatgagctactagaaaagacataagggtagattttacatctttattgtatcctagatatacaagtctattactgccttttcccatgttctgtcaacatagcataaagaatgtggatttacctgttagaaattgaataagcggccgggcatggtggctcatacctgtaatcgaagcattttgggaggccaaggcaggtgtatcacttgaggtcaggagttcaagagcagcctggccaacgtggcaaaaaaccctgtcctcaccaaaaatacaaaaattatctgggcatggtgatgcatgcatgtaatcccagctactcgggaggctgaggcaggacaattgcttgaacccaggaggcggaggttgcaatgagccaagatcatgccactgcactccagcctgggcaacagagcaagactccgtctcaaaacaaaacaaaacaaaacaaaaaaactgaacaatctctttctctagatttccatatgattttgtttaatcttctgtcctttgcattgcagaaacacacacacagaaattcacaagagtgtgaggtatgggactgagcatgcacaggacccattttcaatatttagcccatatacacccatgtgtgcatgtacacacacacacacacacacacacacacacacacacacacacactcggcatctgccactcagaatgtctgaggcgacatgtctagctcttctttacccagtaaatggcaccagttctcaggcccaagagatactgaagaggtgccttggaaataaagcaaacctagggatgtgttgtttctcatccctcccttctctggcaatcctagttcctttttctttcaagtgacaagtggcagcggcccgtggaggcctctcctttgctctgtcccaggcggtgatggcaccagacatgcagggtaggtgaggcaatgcggaggcacagatgcagagcacatctaatggtcgtcagcagtcatggcaagtgaccaggaaatcccaagcctcccggcattgtccaagtcacttatgcacagaataagtctgttccccttgtgatcccattgtgtattttctcacataccctcgcctaaacccttctccagtcctccctggtggagctaaccacaccacacagttctgtgcttttcatggtcaaatttccctttgtctaagtgcttccagcatcatgatatcaccatctcagggaagggccctgttgctggcatccaagagtggtccatactcacacagccattgatcaggcctctgtcaaactcttggcttgtttcatttgattcctagagttccaagtctaaagtcatttacttttttcttgctctttattttgtctctcttccataatgtcccactgacctctacactagcccctgaattcactgacctcatttattatctgctaattacctgtgtacagttccccccttcaacatgacatatttctattttgatcaacatgtccgcatataaggcaaccgaactgatctcgaatagttttcctgctgcctgaagcccagccagtgcctgacctcaccaccttgttcctgcttgctagcaaatagaggaataattgaattgcaatcttgaacaatgggaggtggccaggtgctgtctccctttctaaatatattaaaactgacccaaagaaggaaaccactgcggtcactagactcaagagttgtagatatgggtcaggcgccgtggcttatgcctgtaatcccagtactttgggaggccgaggtgggcaaatcacctgaggtcaggagtttaagacaagcctggacaacacggcaaaaccccatctctactaaaaatacaaaaatcagccaggcgcagtggcaggcacctgtaatcccagctacttgagaggctgaagcaggagaatcacttgaacccgggaggtggaggttgtggtgagcagagatcgtgccacttcactccagcctgggtgacagagctaaactctgtctcaaaaaaaataaaaaaagatttgtagatctggcattttcccaccttcagagagccagagggcctctgagttcatttccgtggagctggaccatggacaatgtccataaacgccgtaaaatgtcaagggaagacaagcagtggccaggtgctggacaaccccagcaggacccatcttcccaagacacagagcattcctatgggagcctgtatccttttgattaaaaaaatttgatttctcccttatttgagtgccaagtggttgagatagttccttttgctttcctatccacaaacatctaagtggaaaagctaaacccgcatggtctgaaggaaaaggaataggctaaataagatctttacttaatcccttaatagccgggtcccactgcaagctgtgaaccatgtattcacctttataactgcacagtgtacttaatgtttgttgaatttaattaaaaatctgttctatttaatggaaggagatctgtagctggacaaactttaattccacaaaagttctttgcatcccattaactttacagtcagtactgccttttactcagccaataattgtgcttaattggaacgttattttaaataatggtctcaagttatagccacactgtaaatttttactaccagggtaatttaaacaaatgatcgtttcagattcaacactgtcttgcaaactgtcaagtttcttactaccctctgggtcagtgtgtcatacaagatgagcttgaaaaaccactgaaacactttcatgactgatgaaatattaagatgtttatgttaaaagatagcccctatgttgcagttaaaattgtaaggagttggaacttcagaaaatatgaatgcctggccaattagcaacagagataagacagagttgtagaataaagtatagtgttcttcccggcaggagttgtatactggcctggactgtggggaagacagttatttgtgaagaagcatcttcccgtggttggttcaggttcaggggttacatttctcacgttataaacgtccattaataatagctcagtgttgccaccaggtggcagcagagaaaggaaggcagaattgaatcagcttttttttttttttttttttttttaattgacacctagacattccatttaacaaattctggctttttatcgaaaatagatgtatccttattaatccaatgaaagtaaaacaaaaaacctaaaacagttataaacattcattcaacaccattcaaacattcattcaacacggtcatttattgagcccctgctactctcctaggtactggggctacagagattaagaagtagccctgtccctcagaagctcacggtctcatgggaagtagacaaatgctcagatcactgaaataccattggatgggtactttattagaagaacatgaaagacgcttgccaaagggggaggcagctgctcttccgccctttcttgaatcttctacttctgtgcttcaacctatcccttaaatgtacctggtgtagcaggctagtttgtcaggcaggtactttcattccagtttaatgacctagacagcctcctccctccaaaatatacatgcacatatctacccaaacccaattctttctctagaacgaagcttggcccatttaggacactttctctttgacgcttccagagaactttagaaaagttactatttgtgttccttctataatcattcccctgcctagggaatctctcttttgttatcttgaactataatgaagatgctttgtatctgcctttgagcatatttagaccgtgtccacaaatagattattgattccttttagggcaggctcttctttgcacccccacagttcctagcaaagacctgtgaggtaggtgtgtgtaaaccctcaaatgaagggggagcgtaagtgtgcatgcatgtgtgaattgtcctcactgtttctgtgccctctcttcatcagcacccgaatctctgtgcatctccacccatagcccagctttccagtgtgtgggactgtccttcagacattctcctgttgttgcaggatcgcagtaccctattttccgctgtgtgcacagaagcactcatgaagaggctcctgagagttactgtgactccagcatgaagccgacccccgaggaggagccctgcaacatcttcccttgcccagccttgtaagaaggcccctccatttaggtcgcctattaccgggtcacttcaggtcacttatgcacaggaccttaggaacagatataagtcagtctaaatctgagttagaaatacaagacttggaccatgcataaaatgcagtctgtttagcaggcacacctgtctttcaggatgaactcaggagctgatagcctttagcaagtcaacccacttctgggaagcccacccttgacaaagctggagcaattaggtttgagcctggtaaggaaaacaaaggaggaagcaaaaaacgagaagccagtgtagttggtgtcgtaggtgagctgttcacagagagaggataatgcaagtcacaaaaacatcagcctggagaggccaagaaaagtgtctcgggagaggtcttgaactgtttcggttttttggttttgtttttgtttttatggcagagtctagctctgttgcccaggccagattgcagtggcacgatctcagcaaactccgcctcctggattcaagcaattctcctgcatcagcctcccgagtagctgggactacaggtgcacattaccacgcctggctaatttttgtattttttgtagggacagggttttgccatgttggccaggctggtcttgaactcctgagcactaatggtctgcccacctcagcctcccaaagtgctgggattacgggcgtgagccactgcgcctggccttgaactggttattgaatgataaatgggacacttgaagaagaacaaggggaaagggccctaaaagggtcaaaacctaatttgcagagtaataaaaatataattctcatccaagtatatggtgagcatgggctgatgtctcatttaactaataacagagcagatgacagaggagggtttgcaaaactgatacgggaattgttaatgaaaaataatgctagaataagattcctaagttagtagcaaaaatgagttaatgatctacagtgtaataaaactaacctttggaggttttttttttaattagataaaaatcatttgtacgttttcagttttctataacttttcatagaatctgggccctaatcactggtaaatagcatgtcaagtgtcaggcaaatttatctgcctttacagagtcagatgacccttaggcagactttttctttttctttttcttttctttttttgagacagggtcctactccattgcccaggctggagtgcagtggcacaatcatggctcactgcagcctcaatctcccaggctcaagccatcccctgacctcagcctcccgagtagctgggactacaggcacacaccaccacacccagctaactttggtattttttgtagagacggggttttgccatgttgcccaggctggtctcgaactcctgggctcaagccatcctcccacctcagcttcccaaagtgctgggattacaggcgtgcgccactgtgcccagcctaggctgactttcaagcaatgctctagtaagaaactctacccatagtgattctgatgattctgtgtacgctgctgcgggctcacgctgacttcctgttgactgaaggttgtctctcactctcgctctctcattcctgaaccagctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcggtacgcaggcagggcagcccgctctgcagctccctctccagctcccaccacactttccagcctcccccaccaagacctgagatgggtaaccctgagttccacaggagggaacccgtcccgtgggggtctggacggctgtttttgcaaaccacaggatgtaccaatagttcaatagagttcagggtagtgtgtgccacccacagccaactttatgagtgagcccagggggagccctctgatactggcctcatctgctttgtgagtcatggtgaagtgaaggttggcaactgctggtagagccaactccttccaattttccctacccattttatagctgaaaagactgaggcctggaagaatagagtagtgtcagtcaaaattaaggctgttaaggcagaaataatttgataaaagatttattggaagccaatgtaaggatcagcccaagaagacacacgaacaacgttggacatgttccaaagtctgttacaagttgaaaggcttttagaagaaagtttaggagaggagacggggaccccttgaatcggagttgtctttttcattggagggtacagcacagaggttgcaatcactggctacagatgacgacatacaggctaaaatgttttaagtgcaagacagtcaataaaacttcatgagtcagaaataaatcagcaaaactttatgactcagaaacaaaccaaacaaaccagtgtcctcttcaatgtccacaggttacgtattaatcagtatgtcaacagtttgaagaattcacaataagatttgaggaactgacaataatattctttactctaaacaggatgtaagccatgaatcctaagaccttcttcccaggcaacttagaacatagtttattcttcaagggcagaggtgcatgacttaaccccttgcctgccatggcgttgggtcctgtttataatttggtatcttattgccacagagagtccattctgtcagtcttatgatttctcccttaacatcagtgctggtcggttgtgtctagactgcaaaacggaggtggtatgacagggtgtgtccaaccttccatcctgtcatggccaggaaatccatttttaaggtttctctgggggtctccttggccaagaggaggcccattcagtcagctgggaggcttaggattttatttttagtttacagtaggcgaggcatctaagaaggtcttgtagaaaagggttgtggagttttctagggctcagatccctgccccagctggtgacatgcatgacagagcctcagtctcatggggctgatcacaaaggctgcgggctccatactggcaattctctcccagagctgaagctgctggttcccctgacgtcagtgtgctgtgtttcagtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaagggtgagtgtgatggcgggcagagcgccggggaccgaggtctgccaggtgcctccaaaaccacacaaagatgagtcactagctcagaatcccaagactgatttctggctctggggggaaaaaaaaggcccagagaggaattatcgtaggctttctatccttatgtgaggactgagggtctccaaaggtgaggagggtgtatgcaaaacttgattgaattctccttagcactccatgtggtcactccataatactaggtgaagtgaatcattacatcccatcgttcatatgtcttgtaagtgcctggtgtctcatagacactcagcaatggcaggcccctctactgctttttgccaactcaaaacatcccacaccccgttccctccccagtagcctggcctcccatgggaagtctcaggtgtcaaagaataactcaaaggcatatatagtcaaccattagcccaccagttacctggatataagggaaaacagtcatatattaaattcatccatcaaaggcaaaaggaggatttatatgaaaaggggtttctgcagatggagtgatgttggttacacaacagcatgaatgcacctaatgccctggaggtgtgggcttaaaagtggttacgatggtcaatttcatgctatgtgtattctaccacaatcaaaaatgaagtttgagaaaagacactaaacaaattgtagaacataccttgggacagggagaagaaaagaggaaggagataaggaattgtgcttcctttcctggtgggatcggcgcattggcgggcatgggatggccagtcagagggtttgcccagggcagctgcacagctgtgagaggcaccaagtccagattctggattctctaggagatctagggagtttacctgggatgaggacatgattggctatctctgaccttggttagcggcctacctctcggatacactagttctgccccacttcccttgctagaatcccgtgcgtacacgttacctgtgaaccgcattaaagtgtaggtctgaggcagcaggtgtggggaggagccagggattctacatttattttctttcttttttttaatatttttatatttttaaatttttatttatttatttatttatttatttatttatttattttgagaccgggtctcattctattgcccgggctggagtgcagtggtgcaatctcagctcactgcagcctcgacctgctgggatcaagcaatcctcctgcctcagcaccccctgcccccctcccgccaacgtaggtgggactataggtgcgcgccaccaccccggctaattttttgtatttgtttgtggtttcaccatgttgcccaagctggtctcaaactcctgggctcaagtgatctgccacctcggcctcccgaagccctggaattgtaggcatgagccactgtgcctggccacagcctacatttctaataggttcccagggtctctgaggccactggtccaaggaccacactctgaataacaaggccataaaaaagacagaggagcccagccatgttcttggatcttaggagacacgatgcagcccatgagcccccaccccgtccccactcccagcatcatgagaacaacaaccatagtatctcagactcaaagaaggaccctttcacgcagtttggggatatcagcagacatgccccatacggccacattggctgactccaactggtcagtgtccattctgaccggtcaatggccaccatgcacctgttattgagtattttgaatatcacccctagaggtgttcacataggttttctctccctctgcggtgtaagatgccccttcattttgtccctctatcaccataacaatccacttccacagggagtgttatccagaaagagaggaaggacaaacctgcaaatgcagccttcactccacctccagagatggtcctggagattcttacctagcggctcatcttcttgtgtgttccccacacctcatggcatatggcccctgccccttaggcccacgatggccccagatggacagcccttggtgcaaatactgagcttccaagatgagcatctgactgtgcccccagtcccaggagcagacactaatttggccatctgggaggctctaaccaaagagaaacagatggagagtaagtgctgatctggccactgactcaagcttctgccctaaagctgagtccaggagagctcatcctagttcttcggtgtatccctattttccaagcctcccatcccaaacattagcgcatggtactgcggaaacagtgggggaaggtgtttgtgagctcagcctccttgccagcatgaggaatcctctgcagtgcccctgacataggtcacagctcttgcccaaaccctttatcagaaattcaccctgtgtccagacaattacatctatttcttgtacagctcaaggtgtcaagaggtctccttttacagttaaccaaagtgtttcttactaagtcccactgtcctttagaaaaggacagccctacagccattggggaaccccttccactttctccaggctaaaaatatctagtttcctcaactaatccttttgtgcttcagtttctgaactcattcgtgttctcagtaaacttgatggatttcctgtatcagcaaatggatgaaaagaatgatgctggactttcatttttatattggaatgattctttttcttaaaaatgttggcttttttctggttaaaaagtaacacagtattgttttaagaatatgagaaatttggaaaagtatgctccaaacctcttcaccaaaagaaaatttgagattaagctatacttcaagttttttcttctcatacatactttacctacatagctttttttcctcatacgtattttaaagatataaatgtatctttatatcataatgtatgtataatttggtcacctcttttcacttaattattataagcataaaatctttaaaacatgatttttattataataagctatagaactatataactgaaacaatctcctatttctaaatgtttgggattttctagtttttatttttatttttatttttatttttatttttgagaccaggtcttgctctgttgcccaggctggactgcagtggcacaatcatggctcactgaagccttgacctcctgggctctagtgatcctccctcctcagcctcctgagtagctgggattacagttataagcctccatacacgggtgatgttttactgtttaaaacagaatattttaaaagacttcagtaagtgttcttgtgcataaatctttatatgcacctcttcttatctctgtaaaatagtgggggcgtggaatcatgttaaattatgggaaaatattatgaatgctttttgaactcttaatacattttagctaattgttctccagaaagattatttcggtgtagtcttccaagcagcaactgagagcgcttttacagtcattttgttgccatgattctttagtttgtaaattccatgtctctacatttgccactctctgaaaaggcagggggcacagagcacaatacgtacagagaaaaaacaactctgtggggaaaatagctgcagtggttcattcctctgtgtgtctcccacatttatttagaacagtaaaaagctacatgtaaattttccaaagatttccactctacctatttcctctccaataatgacttgcagatttccccttaaagtaattttgctttgcatttcaacataagttcttgccgaatctagcttggcttaaaattataaatagagcaaagaatgagcactttattctattcagggaactctttcgttcgttttggaaaagatgttctaaatcatgcaagttgggtgctatggtgtaagtaaataatttttgccttatctaccctcagaatagatcatgaattctaaatgttcatgcttattttagagtagatgagtgggaagggagtactattgggtttaagaaacgcacattggctttggtatcatctccatgaccatcacttatttcgtatttgaccctgagccagctactgattcaccgagcttcagttttttcaactgtaacattgctgagtaaccgctgcagtaatatatttgaagctatgacctagatgaggttggcacagtgggaaggatttcctgtgggctgcttcattcttcttcagctgcgtgttaccaggggcctttgggccaccagttggtcttagaaaaggttcagcccctggaatgaccagcggatggcagtcttccacttttgaatagttgctttgtgtagaaaatggcctcgttaagctttagtctgaactatgaaattttttattactgggaataaacacgtgttgagcacctgttacatgccagtcatgaacgagacacagcttccgactcaataagctcaagagggagagaccaaagaaaattaaagttcgcaaacacttaagagtacagagtgtgtcttattgcccaatttaaaattaattaatctttacctaagtgaattgaggttgtaaccccagtctgaatcttctgttaaacttctagggacacaaagtttcttctggcttaatgactcaccttaaaaacatcttttcagctgcttgtacttgagagtgggccttatcagaagtaagcatcgttgacttttcagttctacaaatcaatgataggtttaagcccatgtgcaatttttaatcacaacaggaaaaaaacacttttagaaagtccaccagccttagtttggtaacacctaatttctaagaaagttttccaggaaaaaaatactgaatcatttaaattataagaaatgatgcataaagctgaagttcaagaatagtcattacagccttatagtcccttaggggccagttgggccaagtttaggatttaactgttgctggaatgagaaggcagtccccaccagagggttgcttaggaattccatgtgtttctgtgttttatcagcccagaagttcaattacgagtcatgtcctcttctgactagcaaagcagatttggtccttttaggaacatcctttaaggacagtgggtgggtgtggtttggagcctcacctggaaggttagtccccactccctggtagggacttctccttccccttgcttctgctgacaggcttcctggaccaggtcgtgagtggggagctcctttcatgtttacacttgttgggcttttcactgaaggtgttgtaataaaatgaaactcctctacaggcctcatccatgtgatgtcctcccattgggcactggcatggtccttcatattcttcttttaaattaggtatatggggatgtgaagacactttcccaaatgtatgtgcattacttggttttgaaagcagaaaattaagttagctagtcagatggaaattacttggaaacaagtagcctaagggttggaaacatgaagataactgaaattctgtttaccttttattcttttttttttttttttttttgagatggagtctcactctgtcacccaggctagagtacagtggcatgatttcggcttactgcatcactgcaacctccacctcccgggttcaagcgattcttctgtttcagcctcccaagtagctggaattacaggtgcacaccatcatgcccagttaatttttgtatttttagtagagatggggtttcactatgttggccaggctggtctcaaactcctgacctcaggtgatccacctgcctcagcctccgaaagtgctgggattacaggtgtgagccaccacacctggcctacattgtattctttacaagagtatttaaatgtcttgagttttaaagttaggaagaaaaccagatcatacatggctgaaacaaacaaacaaacaaacaaacaaacaaatcctttagcctagaatattccaattattgtaacaaattttaagctaaaggactgagtcattgtcccagatttctaatagcaatctagcaaaatagcaaaggacatgaaatatgcaaatagcaaaatagcaaaggacatgaaaaatgtctgcaaacctgtaggggaggaaaaatgtttcctctgcattcttaggttctctggctgcagtctgtgaattaagctgacaaaagattaacagataaaaagcataccaattttgtttgatgttaatatttttgtagtggcatggggggcttcataggaaagaagtgacaaccccagagaagcagttagacttgagggattatataccattttaacaaagggtgataaactatggagaagtgattagacaaaggaaaggggctggggcttctagggacagtaaattgtgagaaattgactaagaaaaatatgggggaaattgacagaagataagggtccttttattaaagtttatttgtgcagacttgtcttggagtcaactccccatctccagtgataagaatcttctcttcttcctagcactgggagggcacccttctcatgggaaatttatgccctggttttaggcagaaatggggaaggcagagagctcttcctgcatctgctatttctcaatagccttcagctcaaaataatcaacatgccaaagcaacatattttggggtggcatgttctgatccccttcaagccctttgctccagagggagtttcttccctaaggggtcaagcccagcttagcagtggaaaggtaaatgtttgatcgctcatgctggcatgtgattttacaagactagatgtcagcatacaaaaatgaaagtggaaattttgataaggaaatgaggttgtaaggattgtttttcccttttctcaatttttatttaaattctattgctttattttctaaaataatacgggtagaactcaaacattgactctatttttaagaaaagacccagaaacccttagaaagggctttggtcatgtgctaaagggccacgtctaggattagaaagtgctaatagataagagaaatgaacaaggcagggcccaagtctatatgcaactgatattcatggatttactcatgaataagacactgacctgagaaagaattagagatgattcgttagttcctgctctcaccaagcctgcttcagcaaagacaaaaaaaaaaaaaaaaaaaaaaaaaaagacaggacacaaataaccataatacaaaggcaggaagcagcacatagagtgccatgagaattccaaggcttgaaagaacatcttaaattggacactcaagatagtcttcacagaggacagaggagaaggtatttgaggtgagccttaaaggcttctgatctgtccagtgaagggaaagagcattctgggtggagggaatgacaggggcaagggctctgtgagccttttatgtgatcagggaataatagccactctgagtctgtccagaaggaggtatgggggataggataataggaaattagtctagaagaattgggtcaattggggccatattatagaaaacccttaatgctagaagtccatatgtgacttctgttaggaatgggataacttcagagggaatttttagcatggagttctcaacacctggcagcccaatgcattggaaaagctggtgaggttgagcaagaagctacagccacagtccagggtaagaaagtaaactgtgctgggaaccatggatggaaaggggcaagacaggttagagaaatgtggcagaactagagtctgtgagacctaatgattgtctagatgttggaagcaagagggtaggagaatagtcaacttttaaatccaggtagaaacttgaaagcaaatcagaaaaataaaaggaggaatggtaacggtggtgaaggtgtacatgctggattcaaggtatctgtaggacacccagataaggacgccccaaaaatgtttgaaaagataaagtttaggtgtggtggcacacacctgtaatcccagcactttgggaggccgaggcaggcggatctcttgcgctcaggagtttgagaccagcctgggcaacatggcaaaatcccgtctctacaaaaaaatacaaaaattagctggacatggtcgtgagcacctggagctactcaggaggctgaggtgggaggatcacttgaccccaagaggttgaagctgcagtgagctgagatcacgccacctgggtgatgcaatcctatctgggtgacaaagcgagaacctgtctcgaaaaaaagaaaagacacgataagatgagaaccaaaataagggcacattccaacgtatggcaagacagatggaaaatgctctatgagctttgggctgtgactcaggaatgttttcactgtatcctaggagaggacagtgtgattgtagtagaaaaatcactaatagatatttggctttaagtgaagattttatccctatgaggcttagtttctctatcttggagtgggaatgtaggggttgaagccccttataccatttactgggcacctcccatctgcaaagcacattatacagtctccatagccctgtcagaaatgtgtttctatgccagttgtctagatgagcatgccaaaggtaggaggggctgggtcacttgctccaggccgcacagctagtgaggatatcaacactgatgtacctggttccaaagccaagctctccctctataccaagctgtctcccaatcccctcatagctgtgaccttcagagactggaacaatttgccttaatatcaggcagcaacattgaggtgacagacttaagtccccctatttttccaacccagacttggctactagcaggtagaaatatgcccaggttttcatgcacccattcttcttcagctgaatatatatatatttttttatttttatttttagagacagggtcttctcactctgttgcccaggctggagtgcagtcgtgcagtcatagctcagtgtagcctcaacctcctgggctcaagcgatcctcccacttcagcctcccaaagctctggtaccacaggcgtgagccacaatacccggccaagctgaatatatttttgaaagcaaaagctgggaaggatagtctaacaagtataagtgtattaattgcagtggcaagattggatatttggaatttggaatgaagcccaacccagaaaatctaagacagagaattgccatactgatatctcataatggagtaggctatgcacgagaagctgccagatatttctaggggaaacagacggcaggaaaatgaagcattccatcctcctttccatcatttgaaagtggcttcagcagctgccagggcctcctgactaatgtgcccttcccctgtctcacagtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcaggtgagtggccagaactgggtatgtctgcctgtgtcaggcaaaaggcagcataccagaggggttaggaaccaggactttgtgtcaggtgtcccagctttgaatcccagcagtgccactgtctatctgtgaccctggagaagctatttatatttctggagcctcagtcagtcaacagtattcattgagcacctacggtgtgctcatctaagtacttgggttacatcagtgagcaacacaaatatctctgccctcagggggcttatggcctagcatgctttcctcatctatacaatgctggcagtgatggtaccttatgaggttatttttagaagaaatgaaattgtgtacataaagtatgtagcacagtgcctgacacaaaataaatggtggctgctgctattattcctgttaataaagccagtttttctgtatttgacagtatcagaagcagaaattttaaaagttggaattgttcattatgaagaataaataatactgaatactttaataattgatgaattacattttccctcactcttccaaaattgaacgtgaaccccactaagaaaatgtggaaatgactgccttggtttgattatcatcagtattggagttcttgagccacttagcatttggctcccagggctggctggttctccaaggactgtttggcttatgatcatgatttacacattatcaagacctctggctccatatagaattttatttcttttaagtagcattaaaaactgaccttggaaaaaaatgcactgccttatccttgtaaattgacacaagcccttgggaaagcaatttggcaataaaagtcaggaaccataaaaatgttcctttgccttaacccagtcaccccactcctggggattcattttaaggaaataattaacaaaagaaaaaaaacagcctttttcaacagagatgttcatgacagcaggatggttacagatattatggcatatcataactcagtaaaatataaggtgacaatgacagcgatcgttaggaagatgtgaaagtgcatgtggtataatggcaagtgagaaatagaatgtgaaaatattcaaaccctatcatctctgccacttcaatgtagagtttttatgcaaaaagcatagggaaatgtttttctattcaaattccctttaatgttttttaaaatatagagaattcagaaagaattcaagtacttccagtgctactctggtgaatatcaaagttagacacatttgctaactgatcccagcttgacttctcatgagttttctggctctaggtgagtgatttaacctctctgagcctgtttcctcatctgaatatgaaggtaatcatatcaacctcttaaggttgttacgaggttttcataagatgctatacataaagagaattacccattgcttgggatatgggaaacacttaataaatattggttcccatctctctatgtttattttttctgccagctatttctatctcattactggtagtaaaatacataggacctaaaccccaaagataattcagcagcgactgtatataggacaccaattataccaaatatccatagatgtgtgaaatcatatcagatcattacagtcacacacgtgaagataagcagtacaatcgaactcatatgtctaccattcttagaagagaagggagcaggattcagggccttttttgcttgtggcttcctattgactttagacctaagcttaaagaaccaagggtggtatgaaccctggcaaagacaacctttatttctgctaagattagaaacaaaggatttgttgccctgttgtccaaaagggtcaagatacaattgaatgtggccaagggttttggttctggatttataaggatgtcagggcctgctggaaattccctgccctaggaatttgacattatccccaaagaaaatgaaataagagcatgcttatttcttgaaaggtaagttttaaacattaactggcttcagaatataaaaataaatgttccttctcaccatatgggttgaatgaaagttggtatttcgaataccccaccagcctggtcacagtgattagtccaggagtagacatgtgatccaacaggtggatgtgtgacccaagctgagccacagaatccttcccaaggacatttcatttgtgttttagggaagagactcactaagaggttgtgagctcaagggctggcagtggccctactgaggcttgtgcaaaaagccagtctgagagaatgagacctaagtccatggagaggcagagaccaaggagtttctggctttagagtctttctgactccaccaagaaaggaatatattccatttctgctgcttcccagatccctggaaactaactaggagtatatcaagcttagggagtctttttctactctggaggcacagtagcccaactcttactcatgagagtctaccaagtctattatttatgcccagaattatttcctttcttctctatcaattctgagtttactgcaaccttagattgtcttagttccggggagatctgtcacagtctctagtcttcaggagcagccattttgtctgcctctgggtctggattgcattttattgattgcatttattgcaatagatatatttattctcatctcttcgcgaatcagtgatccacaaaagtgcaactgcaggaattctttaggtacagaaacatgcctaattgccatcacttctcactgaaagcatttatccctattaaatattactttttctcatgtgtgcttttctctgtggattacattttatctactatttgaattactccatcttgtttcttattgttgattttcacctgatgtatcttcatcaatttcttaattttcaaacgttctatgtatttttaaggtatgtctttcaggactatttttgtctttatttttacccaatctataaacctctgtattttaagagttaaattttaaccatttatatttattgtaatcacttatatgtttggacttttccctaccatcttattttgtgttttctattttcatgctttcttgcttctttcctctttcctttcaacatgcttgttattagtcaggttttcttaattccattttttcccctccaacattttggaagttataaatcttctagtggtatttcttctgtgataagattcaaatttttagcacagaattttaaacttttatgtctccattagtgtcaagttatcagtgaccacatcctctcctaaaagaaaatagaagccttccccttttatttacctccactctctcaatctacaatatctccaaaaagatgttgatattatctggatctagctccagattaatgttaattttatagaaaatatagatttaaattttaaaatagttttctgctttccccccaaagatttttttattgaaatataattcacgtaccataaaatttaccctttaaaaatatagaattcattggtttttagtaaattcacaaagttgtacaaccatattcagcattatccaattccagcacatttttatcattccaaaaagacacctggcatccattagtaataacggcttttattggtgtctttgccagctccttcttttatgtcctgtgtcttcttcctggttcttttttattttgctaaagactataacccaggaagtctttcaaataggatttgtaagtggtaaggtttctgagcccttgaatacctgaaaatgacttcattttgcactttgacacgaatgcttctggcagatgactcactgcttcctcttccttggcacagtcaggccagcccggctgctcttggccagtaactcagctgatcactcattgtcctgaggcctccatcctgatctccatgtccaccaccaatatagcctgaagcacatgagttttgctagagctcctcctctgtgtgcatttggactatagtttccttcttcaatttgatctcatctgtctttcattgttcaaagattccccataatttctggtccatcaaggctgattgccctttcttgtcttcaaatgctgtctcatgcgcgtgtgcaaacacacacacacacacacacacacacacagagatagagatacacacacatgaacacattcattcactttccagacgcacatattctgccatttctgagcatttacagtaagagaaggctgagacgggctcattctccctgaagtacacaatctcttcaaggacttgccaaaaatagcagaagataactacaagttttgatcaaagtttgcagtcttctgttctgccacacacttagtacagatgtaggatctcatagcattgaggggtctttcagattatgttttcaaacccctcactttctcttttcagataagaccacagcgacctgggaaagtgcaacgtcttagccaaagacacagaactatttagcgacactgtctagactctagtttccatgtctcctgacttcagtctagtgttccacccctgccgcccacccctgccccatcctcattcctcctgcaggagaggccagacctttgcctgctgcagcttgtggctcttctcctgccttcagttcttccattgcctgcagcacttgaaagaaaaggacaagacacgaatacactccaaatcataaactaacatggaagaaaataggagaaacagagtgggaaatcttatagtttttttttggctgggcacagtggctcacgcctataatcccagcactttgggaggccaaggcaggcagatcacttgaggtgtcaggagtttgagaccaccctggccaatatgacaaaaccccatctctactaaaaatacaaaaattagccaagcataggggctcacacctgtagtcccaactacttaggaggctgaggtaggagaattgcttgaacctgggaggcagaggttgcagtgagccgagattgcaccactgcactctagcctgggcaacagagcaagactccatctcaaaaaaaaaatttttttttagtaaaaaaatcccgtagttttttaatgctacgaagatggcaaaaaagaagacatagacaaagcagaaactgatggcctctgctatttcatgccctgtgtgactacttcatcatttgttggtttgggggttttataattttttttttctgtagatgcgtgtttttctttctctctatttttatttgattgtgtggctgcctatggacagcaaagctaatatttagagtttgaactgcagacattgttgcaggcttcttataaaggtagtcgattctttaaagtctataataaagtacatagaccacagctttacaactttaaatcaaaaagtattaagaggctgggcacagtggctcacgcctgtaatcccagaacgatgggaggccgaggcaggaggattggttgaggccaggagttcaagaccagcctgggcaatataatgagaccctgtctctaaaaacaaatttttttttttttaaacagagtcttgctcgtcacccaggctggagtgcagtggcacgatcttggctcactgcaacctctacctcccaggttccagtgattatcttgcctcagcctcctgaccccaggcgatttgctcaccttggcctcccaaagtgctaggattataggagtgagccaccgcgcctggcccccgtctctaaaaaaaattgttttaattagtcgggcaaggcctggcatggtggctcatgcctgtaatcccagcactttgagaggccgaggcaggcagatcatttgggttcaggagttcaagaccagcctgggcaacatggcaaaaccccatctctacaaaaaaatacaaaaattagccaggtgtggtgacatatgcctgtaattcccagctactctggaggctgaggtgggatgatcacttgagtctggggagtggaggttgcagtgagccaagatcactccgctgcactccagcctgggtgacagagtgagatcctgcctcaaaaaaaaaataaataaataaaagaacgaatgaaccaggcaaggcagtgcacacctgtggtcccagctactctggaggctgaggtgagaggaccacttgagctcaggaggttgaggccgcagtgagccatgatcacaccactacactccagcctgggtgacagagtgagaccttgtctcaaaaacaaggaaaaatattgagtaaaccaaacatgaacaaaaaacattttgcaaagtaatagatactaaatgggatgatttatcagcaaacagttgtatgcattttatttccataaactaatgaaatgaaccaacatatgtaattgcctggcttctttgtggggtcactaccccatggtgcagatttcagcaccacattaggaaacaagaagattgggctctgtagtcacagttcccgctggctgccctgttggaaggggagggttgaccatagggtacattttcccaagtcttaggtcttctcctcagctttgggtgttcacaggtgtgcagagtgtaggagttcattcagtcacagtatccacctcctaagagaataacagataagaatgtcagttcattgtcttgcctcctgtgagaggtgccagagtctatgggacagagacaaccaaatgacctggctggtgtgttcctgcaggagagtttatggtaaactgtttccctctcagcacagaagacaacaagatcttagtgactagcatcctccaggtatgacaatcagggcacctagtctgcatttggagacagaactgttaggaaactgcattccatatgccatttctcctccagaaacatttccaagttctcctgggttcttcctcctagaattggtggtagaattgacggtgcccgtcataagcatcccttgatggacagtagctgccaccccctttccatcatgtgacactcatctttttctgcttctttctgcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatggtaagtcatggtgctcttgatggaggttgcattggcacaacgtcccccacctgaactcctatagacccctctgggccaggcactgggttcagccctgaaagagattccctacagcaatctaccttaggtggtagctgctggagtaccccgtgactcagcctgcttcgtggggaaggcctgagacctagatgatcttgctttctaaactgtagaaacagtgactctcacacttcagtgtgcataggaatcatctgaggatcttgtttgacaagaccaactctgggccaactgtggccgaggatttgcatttttagcaagttcctgaggtgtgttggatggagttgtctttgtactgcattttgagcaatgctgccatagaggattgaggattcaagggtgctgttaaaagaactacatctgatgccaggcgtggtggttgacacctgtaatcccaatactttgggaggccaaggtgggaagatcacttgaggctaggagtttgacaccagccaggtcaactagcaagaacccatctctgaaaaacattttttttaattactacattacacaaacacacacgcacacactctctgtgtgtgtgtgtgtgtgtgtgtgtgtgtgtacactttttaaaaatcctatagacattctggattatggattgtgggactgattctgttttctgtttgaactggctactaggaagcgcaaagccaaaattatgcctcacctagtataccagatcctgcaaagtggattttatgtgctaatattcctgtggcttctctttctttttcctacttttatcttcctttagtactagttttctcacttttttaaaatcttgtggccctctaagtctttctcaagtcatttcaaatcctttttgtaaggagggaaatagtgtgtaaatgaagaaagagagagattgataaatacagaaataagttattaagaaatgaaaggggaaaggatggatatagtgataagattcatttttttcaagttgaagagttcattttcaagaaacttcctaaaacagaaaacctcctcaccatcattccaggtgaccagaaaacctcctgagggccccatcccaggtgaccattggcgtagttctgtgggttggggtgggaagtggaggaagggtcattctgcttctcatcactgaagatcttcaagcagaggctgtagtgagcccagagtaggggggccagagcctttctcacagtgatccaagggtgataaaagggaattttgcttagaaaatatatgaataaaagctgagaattccatttccaaaaagtgtctgtctgctctagtgataacagccatttggctgtgtagcaaaccacatctcagaggtagatgggaatgaaggaggtgggttgaaaggtttctggcaacttctgggaagtggaatttaattattttgatgttgaccaaggcttgaggatacaataacagatcgcagttttcttttgtcatctgatttggagagtctacaaagagccatgctcaccaggccaagttgaaggagacaaacttcaaaaacaccccaaatgtccgtcagcaggtgaacggacaaaccatggtgcatccacacagcggaacaaaaaactcagccacaaaaatatggatgaacttccggtgcgttttgctaagtaaaaaaaaaagccaggttcaaaaaactacgtgttgtatgagtccatctatataatattctgtaaaaggagcagctacaaacgccaaatcagtgcctgctggaggatggggtgaccacatctgtgcaatctgaccgtagaggggcagcatgggaattttttgtctgcaatgaaaatatttcgtgtcttgtttgcggtaggagatacacaactgtatgaatttgtcaaaactgatagatgtgtataccacaaaaagggacatttttagatgcaaatttagaaaatatgaagtaaatggttactataatagcaaagactgatggaagctagacttctttgaatgtaccttgttttacaaatttgagtttggaactaagtaaatattttagataatcataaaagaaaattaagttttaaaaaagcaatcccccagaactgaaaatacaatgaaacaaattaatgtaaatatgtttctagttggtggcatcagcactattgcaagtgacttgaatacatagtaatttgacattctatccctaaaaaaaattactgcagaagaatgttcacactgtttgcaattatcctatttttggtgatagtgttgtgctggatatgatgattgggcatataatgtgtgagaaggtaaatgagtaattagatgatagtataattctgttagccccaatatccttgagaagtaggatgttcaaacttaggagaaagtagatacagatacaagatagatattgtatggcttaagtccgcaataaaaagcctgttgtcctgaatttgaattggaagtgtcagtataaacttagaaattatctctctaaaaatcttttctaatttcacccactgaaagagtctagaatcagtgaccaatctcgggattcagagggggtggccgcttccagatctggggcagcatatatgtaagttaggttgggatatctttttctagcaggcagcaaggaagttcttaaacacaacagagctcatgtccaaagcatcccagagccaacttgtagaggctcctgtgagccattgagcatcagtaagaataataataccatagattagatgaaacacattatatgtgtttaaatccatccatttacaatgaagtttataatactttaaaaaactgataagtcatcatcataggatgttagggaaccaacttattattatgaaaacccgtaaatgaagggaaagattcaagtgtttatgctttctttcttaaacgacataccactgggtaaccaaagagtaaaggtgctgagggaatatgatagaattagaattagaattctaaactccctgtaaactgatggatctgagcattgcacatcagtggccactaacatccccaaaagagaggcagccccccggaagtagtctcacaaaaaaaaccaaaaaaaaaccctgcacctgttaaggcctcttttaggtccaacttccaatgttcaggagatatagagcatagaggaacacgaattacaccgtgggagcacagtcagcaaaatccagactatgggcaactgcagaacaaatgactcagttccaccccaccaccgcaaccaaaaactttttaagtgcaagaatgaaaaagacagtggaagggaaacctatggattgaaagagttgtgagagacttattgaccaattgcaacttgcagacctgacgcagatcctgattttttttttttttttttttttttgagacaaagtctcactcttgcccaggctggaatgcagtagcaccatctcggctcactgcaacctctgcctcccaggttcacgccattctcctgcctcagcctcccaagtagctgggactacaggtgcccaccaccatgcacggctaatttttttgtatttttagtagagacggggtttcaccatgttagccaggatggtctcgatcttctgacctcctcagcttctgacctgctctgcccgcctctgcctcccaaagtgctgggattgcagatgtgagccactgcgcccagcaatcctgatttttaaaggaaaaaaaatctgtattaaaaaatcttggctggctgcccggccagccgccccgtccgggagggaggtgggggggtcggccccccgcccggccagccgccccgtccgggagggaggtgggcggggggtcagcccctctgcccggccagccgccccgtccgggaggtgaggggcgcctctgcccggccgcccctactgggaagtgaggagcccctctgcccggccagccgccccgtccgggagggaggtggggggtcagcccccctgcccggccagccgccccgtccgggagggaggtgggggggtcggccccccgcccggccagccgccccgtccgggagggaggtgggggggtcggccccccgcccggccagccgccccgtccgggagggaggtgggcggggggtcagcccctctgcccggccagccgccccgtccgggaggtgaggggcgcctctgcccggccgcccctactgggaagtgaggagcccctctgcccggccaaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggcggcagggtcctctgcctaggaaaaccagagacctttgttcacttgtttatctgctgaccttccctccactattgtcccatgaccctgccaaatccccctctgtgagaaacacccaagaattatcaataaaaaaaataaatttaaaaaaaaaaaaaaaaaaaaagaatggactttcccaggccagctgtggtggctcacgactgtaatcccagcactgtggcaggccaaggcgggcagatcacctgagatcaggagttcaagaccagcctgaccaacacggagaaaccccgtctctactaaaaataaaaaaaattagctgggcgtggtggtgcatgcctgtaatcccagctacttgggaggctgaggcaggagaattgcttgaacccaggaggcagaggttgttgtgagctgagattgcactattgcactccagcctgggcaacaagagggaaactccatcaaaaaaaaaaaaaaaaaaaaggactttctcaaagaaaatgtatttaaatgtctgcaccaataattccagcatgtgtatgaataaatatgatatgtcctttaaaaaaaaaaaaaaaaaaaaaatcttggctgggtgcagtggctcacgcctataatcccagcactttgggaggtcgaggtgggcagatcacctgaagtcaggagcttgagaccagcctaggcaacatggcgaaaccccgtctctactaaaaatacaaaacttagccaggtgtggtggcatgcacctgtaatcccagctactggggaggctgaggcagcagaattgcttgaacctgggaggtggaggttgcagcaagccgagatcacgccactgcactccagcctgggtgacagagcaagactccatctcaaaaaagaaaaaaatctataggattcgcaagataagtggaagtaggaacactgagtctatattgaagagaataagaaattattgtaatttctagggagaataatgatactgtggtaattgttaagagttcttgtcttttagagctacagcctgaagtatatggaagaagtgatcagatgtctagatttgcttcaaaatagtgggaggagcaggagggctggggatatggataggacacacctggcatgagttgctgattgttgaagctggttgataggtacatgggagtttgttttcatattctgtctccttttggaaatgtttgagattttccagtgtcttctttctccagtgtgctgagctattggtctgcccaaaaatctgatgttttccctttgttcccatgcagtgttccaagagctgccagggtggctttcgggtccgggaagtgcggtgtctgtctgatgacatgactctaagtaacctctgtgaccctcagttgaaaccagaagagagagaatcttgtaaccctcaggactgtgtccctgaagttggtaagtagagatttcaatcatgggggaaaggtttgtgttttttaagcttgtcagattctccggtgtgacaataacaagcctcttctaggtctttctgtgaccttgcacacagtcatggagttcagagggttgaggtgcttttggtattataaatttcatggtttaagatgatcattcatagcgaggatggctgtctaagccacccaccaagagacacactttagtgtggattgattaaaatggtaatgccttcaaagatttggctctatcgtccttaaggtcaaagtagtaaaatgtcaacttttaattgtaggtgcaaaccagtgtaggctggaccatgtggggagattctgggaccttagcagggagttggcagagaagggaggaaggggaggaggccaagaattggtagagacagtgatggagggtctgaccatctctcagaggggcgtagtgcaagctgagtccagagagatgcagtgactagactcaaggaggaggagtgacagcaggaagatctaggccacacaatggtcagagtcctgcaaagaacagcagtcttgcaattcagaagaccccaacctgcacccttgaaataggggccagtttcctggaggaaagcattggagagtgttagggaggttaggccctctcatgggctgcggttcatgaggaaggggcccatcccagcaggggagctcaagtacagccagaaaaccaaagaaggcacctcgcacatagattgggcagataggaagtgtgaggtgggtgaagatgcatctccagaggcatattggatgccccaaagcccaacttgaaatctactcagaatgcacccccaggtatagtcaggactggttccagaatggaggtgcaccgagccccttcagtagcttcttcacagtctgctaagaacatatttacttttctgtcttcacaataacatcaaaggaaatgtattaatatatcaataagctttcatggggtagattcctcctgctgtggaccaaattgaaggttttaatatactgacctaacatccttcctatcccagggaagatgtgtcagttacagcatagatgctttatgatcataagtttcctatgtcccagcaatgacccatgactaaagttatggggatgaccattcccagtagctaccaaaaaaacccataaattccataagaagaaaattaacaagtttataagatctatatagaaaaaataaataaaagtaagaaagccttgctatagaatataaagggaaatgtgaatagatagaaacattaacatgttcctgaatgggaacactcaatactataaaggtgataaaagaaggttcccaaggggagccgtatgtgccatatattggaacatattataaagctacagaaactaaaactattaggttggtgcaaaagtaattgtggtttttgccattattttcaaagctgcatttacttttgcacaaacctgatatatgatataggcataccatataccaacgttataatgcagaattctgaaacagactcctttataaaggaaagttaagtttgataaagggggaatgataagtaagtggggagaggagaggcttccattgtattgagaccacactgaagatccctttaaaaatataaaatatataaatgtctaatggattaaagactctaacagagaaaacagtctgtaaaaatgctagaaaaaagtatcttgggctggatgcaatggctcacacctgtaattccagcactttgggaggccaagatgggaggattgcttgagcccagcagttcaagaccagcctgggaaaccccatcttggcaaaaaacgcttaaaaattagctgggcatggtagggcatgcccatggtcccggctaattaggaagctgaggtaggaggatcacttgaactcaagaggtcaaggctgcagtgaggtgcaatcgcaccactgcactccagcctaggagacagagtgagaccatgtctcaaaaaaaaaaaaaaagaaaaagaaaaaagaaaagaaaaaaaagttatacacataaagctgcctgtttgtctcaggccagataatataactaaagacaatcaaaatcaccaggtccttggaattgattgtgtaattctcaaagctaggaatgactggcataagcaaatcaggtactctgaagagctgtcactcagctgcctcactatgtcaaaggcttctagctaatataatataatacaaaatgtgttgccactgtttttgtcttctgtatttgtctatggtatcttttcaagcaggggaaattgtctaacttctaattatataaaatccaactagagaaaaaaagggaaactatgagattaacaaaacagaatatgtagacaaagccttggtattctttgatgtgcctcaaaattatacctgtcaatgccaaagttactaaagatgtccaggccacaagccagagttatgacacacacttcggtatatcccagagggctgctgatagcaagaatctgtgtaggctctgaaggaaaagaaggctcaagtgcacattttgatgatgctgctgaagaagaaaatagtacctgagtacatgggtacatgtgtgctgttgtcagctttttgaaatctgcatataatctttcatttaatcccagagtgacatgattaaatcatcctacaattgatagcatcttaaaatcaaataaatgtcactcaagtagacagaaaattaaatccccaatatagacagaactcactcaattttttaaaaaagacaagtggtccagttttgtaaaggataaaggaaatgaacaaactcaccacagggccgggtgcggtggctcatacctgtagtcccagcacttcgggaggctgaaaccggtggatcacttgggccaggagtttgagaccagcctgggcaacatggtgaaatccttctctacaaaaaatataaaaattagccaggtgtggtggcgcatgcctatagtcccagctacttggaaggctgaggtgggagaatcacctgagcccaggaagtcgaggaagcagtgagccatgatcgcactactgcactccagcctgagtgacagagtgagactctgtctcaaaaaaaaaaaaaaaaactacaagaggctgaagaaatgctcaagctactagtaatcagaaatgcaaattttaaaaataatgggagtccatgtttttccataagattggcaagcttttaaaatattagacaatgtttgttcattgttggcaaccgcatgggggataggtcaagtggcaactcgtaacttggtgtaaactttttgaagagaattttatcaatatctatcaagatacaaagatattattacctttgacttaataatttcacttctaggaatatatactaaaaatatgctttcaaaaatgtacaggggcacacacatgcaaagaatagggctcatcgggtgtgccacctactcaggacgcagaggcaggaggatcacttgagcccaggaacccgaactgtggctgcccctatgaacagtcacggcacctcagcctgagcaacacagaaagaccccatctctgaaaaaaaaaaaaatagggcttaatgaattgtgtagaattaatgaatgaaccgtacaatttcttgtaacttataaaaattggaagcaagctgggcgacgtgactcacacctgtaatcccagcactttgggaggccaaggcaggcggatcatgaggtcaggatattgagaccagcctggctaacacagtgaaaccccatctctactaaaaatacataaaattagccaggcatggtggcacgtgcatgtagtcccagctactcaggaggctgaggcaggagaatcgcttgaacccgggaggcggaggttgcggtgagccgatatcatgccattgcactccagcctgcgcaacaagagcaaaactccatctcaaaaaaaaaaattagaagcaattacatttctataactagaaggaaatgacttatttaattatgttccagcacataggacaaaatacagacaccccaaaaaagaagatggtagatattatgatacaaaaaattatctaaatatatttatgagtaatattttaaaaagcaagcagctgagaagtatattgtcagttctttcccaaagtaatctataaatggaagcaatattaatcaaaatccaggcaaggtttttcatagaaaaatctgacaacctgtgtctaaagtttatgtggtggctcacgcctgtaatctcagcacttcgggaggccaaggcaggcagatcacttgagctggagtgggagaccagcctgggcaacatggtgaaaccctatctctactaaaaatacgaaaaaaattagccaagtgtggcagcatgtgcctgtaatcccagctactcgggaggctgaggcaggagaaaggcttggacccgggaggcagagattgcaatgagctgagatagagccactgtattccagcctgggtgatacagcgagactccgtctcaaaaaaaataaaataaataaaataaaataaatagaagtttatatggaagagcaaaagcaaggaaccaagaagagccaaggctgttttgatgattaaccatgttgagggacttttcctaccacatatcaaggcatcttggcacaaggatggataaaaaaagcaaggagagcagaataggccagaaatacacatataaaggatgtgtgatatatgatggaggtcatattatgaagctgtggggaaaagatgaacaattcaataaatggtcatgagacaattgtttatccatatacaaggaaaaaaacaagaaaactgaactccctcctctcatcctacacataccatacactccacaaaccctaattcctggtggattagtcaaaagaatgtgaaaagaacattttaaaacttttagaagagaacagggaaatttatattttatttcagagtacagaagggttttttaaatgaaaccaacaattccaaaccacaaaggaaaacatattataatatcaattacattaaaattaaaaatctctgtttatcaatcaacaccagaagcaaagtgatcagaaaagccacaggctgaagaagatatttgcagcacatataacctaactcacaaaggatcagatccattagatataaagaattttcgtgaatcattttttaaagttaactaaatcagaaaatgagcaaaagatcagaaaagcaattcacagaaaaggaagcttgaatggcaaatatacatgatatgttcagcctcacgtgggaatcatttcacattcactagctcagcaaaaactaaaacatatggcaaaaagagaattcttctgtttcactgacaggaacataaacagttataccgactttggagagcaaactgactgtatctagcaaagttggatataccttatgacccagcaaggcccaggcagaggatggtaacaaaactacttaaaagcattgtttgcactagaaaaaaaaaattggattaatgtccaacttaaatgtccatcaatagaaaatgattaaattgtggattatatacacaagaaaattcaataatgaaaatatagcattcatcaaatatgaatgaatcgcacaaattcaatgtcgagcaagttgccaaggagcttatacagtatgtatcttttatgtttaaatgtcacagagtggtgagggattccctcacatagagtttaagtgtaaagaaatgtttggggataagaaacgccaaatttggaacttctgattacctctggagtgatgaggatgaaggaggaagtgatcagagagaagtgaggacacagatgagtaacttattctctatacctatttcccttatcgtgtttaaaagaaagagaaaaacctgtgagcccttggcacacattcataccccacaatggtaataaacagcagcgcaggagttaaagccacagccactgccctttctcttcccactggtccaggctgcctcttgtgctcagggagtcttctgttcattctctttcgctacagatgaaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccgaaacactgctgtattagaaaaagtctctttctggtctttctggttttgtttatgaatttccctctgtggccacaaattcctcccctcccccatgactcacagtccatatggcccacccccagacttgagcaccaagctctgcattaatgcagttggcctgcgacaaggagctgtggacccttccccatctcttccaattcactttccccaactatccagttccagaggccgcaggcctggaaggatgcagtgcatattgaaaggtggaccctctgaaaacagttaagaggaatatatgtatgttttacccattaagaaaaaatggcaagctaaacaaatgttaaacttacagaaaatttgtcttatggtcctgagcatatttcccttttagagcaagcctggattcttagcaaagtgtttcccccatttgctcttttagctgacaaatctgccactgtgatgatggtttgcagcttttggaagcagtatggcaacctggcctgacatgctctttaggcttccactaacctggggctttcagaaattctatttggcctttctgtgggtagctttccagcttctcttctagggagccccaggcatcatttcccaaaagcatccccatctcctgattctcttggaactcctacagataagcatcctggcagaggcccaggctcccaaaccgacaaagtgaaaagagaccagagaggccaagcatattgactggtgctgttcagggcctgctcttttccactcaccacttgttttgctgcttgtcacgaggagagttgttcctgtatgtggctgctctcagatctttccaagcaagccagtcatttgaagaggttttcttttcatgctggagggcaggctaagatcaatgagtggaagagagaaaggctgttttagctcaagttaaaggaacaccttctagccatcaaagccgcccaacagaggcaagggccaccacacatgagagagcgctctgtccttaaagggaattctctgttgagtgggaggtgaacaccctggttcttccaactcaggaattctcgtggctgggctgggtcagtgatggctttgtctctttatgtctaaagtgccctatggctgctgaaggttacctaaccattctttaaaaggagaatgaccctccatgggaatggccagcctgccaactgtgcaattgaagaagacccgatggatcaaccccatgtctcccttggggagaaagtgcataaaccaggggtctctttttttttttcaacaaaccattgagctgttcttggagttcatctctggagaggttatacattattagaagtttgattattattatagtttgatcaatttatttgtcttagagatccaatttttactaattccctagttttttatttcagcatctgaatgtctttctccctagcacagtgcatacaatcagggccttgggtatttccagtgataactttccttggagaggatctaagaaaagcccagatttcggtagccatctccctccaaatatgtctctttctgctttcttagtgcccattatttccccctctcctttcttctgtcactgccatctccttcttggtcttcccattgttctttaactggccgtaatgtggaattgatatttacattttgatacggtttttttcttggcctgtgtacgggattgcctcatttcctgctctgaattttaaaattagatattaaagctgtcatatggtttcctcacaaaagtcaacaaagtccaaacaaaaatagtttgccgttttactttcatccattgaaaaaggaaattgtgcctcttgcagcctaggcaaaggacatttagtactatcgattctttccaccctcacgatgacttgcggttctctctgtagaaaagggatggcctaagaaatacaactaaaaaaacaaacaaaaacaccaaaagaaaaaaaaaagccatttaaagccagccactagagggagtcagttcagttccgtaaaggtatgctcagtgcccgctgcctgcaagctgttggggaccccagggagggcaaggcagcctgtccccgcccccagggaactagaacatgacaagaattctccgcactgtgcctacctgtccctttaccttacctctctggcccagagttcttggagggttttttctttattttcttatgtactcatctacttattctcaaagtatttagcattcaacactctttttgctttaaaaagaatggccttacaaagggacagaaaagagaagacacgagcttggtgtattttcatcaagttatgtggcagagaaatccagatattaccaggacctgtctaaacaaatgttgtgggttttcttttcattcggatagccactttatagttggaatatcaattctaatgaggaggaagacataaatataagtggtaaaaagaaacatgacttcccttaaaacaggctggataatctatatcagccttgtgggtggagactagtatttgatccttgccatataaaacattttaatatggtttacatgggaaaatatcgatggcttcctcacaaaatgtatgggtgacgtgaagttgaagagccaatggcttgggtgacacgtgctggatccaaaaagatcagggagactagaataaaacttggatgttaaaaattcaccaggaatccacataaagtactatatttgggctaaaatgaaaaactaaatacaaggtgggagagaggcaagaatttcagttgactaagctcagtgtgagtcaaagtgggatggaaccatgcaaaaacaaaacccacagacatgcaggctacgtgaggagaaaacagtggtgaggatcacatcacattgtgtttgcatttgccggaaccatactttaagaagaaaaccgatcatctataataacatcagtttatcaatgccccgtcctgatgaagtgtgcagactctcagaaacagcaggaaggacttcatgagaaccctcaggctggagaaggcactagggcacaaggagagctctcctaggaccaggaccaagaagctacaggcaggcacagtttagctcctgcagagacccagcttttcacaagttggagccttccagagatagagggactgtggtaggtggtgacccacccatcactggaggtggaagcagaggccgtttgccagggatgctggagaggggattcaagcatctggctgggcaacgtgatgctcagggccgtctccactcagggcttaggggagtctgtgagtagaagagctttaggtgatttgtttggtgggggaaggcaagtacacagctatgcactttccgtttctgacttttgccaccctgtcagccatggggagcccactgtgggactgaaaccctgagctgaatgcggcctcatgtctcagagaaacactggcaagttggtcagagccgccgtctgcatcgaggcgtagctgagcggcaggatggggggctgcctgcccagggtctctcaccgtggtgtaagcagagccatggcttgcctaggaccctatagataccatcactctttctcagctcgactggagtttctgcacctttgcaggggcaaagtaactccctgcaccctgaaccaccccccattcctgttcatttcagcagataatgatggagggggggggtgtccatcgtgctgagggtgtgaccgcaagagggtgaaaacttccagccaactttctcagtcctttctcttgcgagagggaagccacctgctatacaaactaataccccctgccttgaccccttccccacgactcagttgacagaaggatatactttgttataacttattattttgttctctgtaaatacaagatgtttataggaaatatgtattctgaactctatctgcagaatgagtcactacaccaaaatagttctattatttagaatgtgttaattttaaagggacctgataggtatttatttacatatgcgatccacatttgtgtgaaagcatgtgatcatactaacccagcctcctggaatgtcgctgtacgatgattgatgtctttttctcagtccatagttacaattgtttagtatgctaatcagtccagttccctgaggtttaagatcaaatataaattactctgcttttcgactcattcaggtagcattgtacctgaacctgattgctactttttcatcttaaatattatatttcctcatctaatctgccttcccctcatccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatctgctttgttgacaagcgtgtgctttctctggccttattcgcgttctgttctcctgcaaatagcgccctctaaaaagaagagtcagacaataaactggttgaaatatc

SEQ ID NO: 946 - DNA, 52299 bp, Homo sapiens
cgtctgggaaaccgccgacttccggccgcgcagcggtgggctgagctaaaatggctgaggagagagtcgcgacggtgagcgccgagattctctttagttgcccggccgcagggcaaggcaagctggcgggtggcttttgtcccatgcagcggttcctggagagaggcggagctgggtgccgagcgtctcagggtgggcggggcgacacggtcccctttttactgtcccgggaactggtcgcctggggcaagtctggatacttagcagcacaggtcctgttctaggactgtagtccctcttggggtgcgctggacggagaagggagacttttcaccagtaatggctcttaccgtagtgccatctttttctgtctcgggggtttggaaggtaatgactagcacttgtgtagacagttcctgttaatcccgtgaattgggaatttaacatgcctggaagcttgcagcgtcactgccttctgccagtggagcgggactgtgttttttctgtggtgattaagtttaggaaagtacggttttggaattcatctgaaggctgagttgggcgttcactccacagaactgctaatatagaggaacccgatgaattcaggatgacctagtcgctattttttgaggcatatatctataattggatctaatttcggtaaagtgccaagtgtgaagctttgtttaccttgctttagtgttgggtttgaaagcctgttctgtccatttgttagaatgattttaggtattcggaatttattgtctttcgaaaaacgccctggaaaacagtacaaatagcagcctttggctgttttacaacttagttttggctaagcagcaaggttagtgttattgttagagggccttttgtttgttttctactctcatttgcagagtagtcatattattctagtctaattagaaaactctgaagacagaaacttttttttttgagacggagtgtcgctgttgtcggcccgggctggagtgcaatggcgcgatctcggctcactgcaacctccgcctcccaggttccagcaattctcctgcctcagcctccggattagctgagaatacaggcgcctgccaccacgcccggccgaaacatttttattaagctaagaaatttaaaatagctaggccggacgcggtgcatcacgcctgtaatcccagcactttgggaggccgagacgggtggatcacttgaggtcatgagtttgagaccatcctggccaacatggtgaaaccccgtctctactaaaaatacaaaaattagcggggcatcgtggcgctcgcctgtaatcccaggtacctggaaggctgaggcaggagaatcgcttgaaccccggaggcggaggttgcagtgagccgagatcatgccattgcactccagcatgagcgacagagacagactccttctcaaaaaaaaagaaagaaaaaacagattttaaaataattaaataggccaggctcagtggctcacgcctgtaatcctagcaccttgggaggctgaggtgggtggatcgcctgaggtcaggagttcgagaccagcctggccaacgtagtgaaaccctgtccctactaaaaaaatacaaaaaattagctggacgtggtggcgggcgctggtaatcccagctactagggaggctgaggcaggagaatcgcttagaacccaggaggcagaggttgcagtgagccgagatcgtgccatttcactgcagcctgggcatccagagcaaaactccgtctcagaaaaaaaaaaaaagtaaatagcatggttaatgttactgggttttaaatattaaaaacataggaaagaaaatacttccactccagcctgggtgacagagcaagactccgtctcaaaaaaaaaaaaaaaaaaaaaaagaaaatacttctaagtaatcttaaagtgtaaaagataatgggtaacataacattgctacaaatatagcttatcctctagtgctcatcacaagtgtttgtgtaatagaatatgaacttgagtctgtgacggcagaattgtcatgtacatttgaatgtctaatactgttttaaagagaatagcttttgtttcgatatgacttagcaattaagcctgaagttaactgttttcattgttgtcaaatttattgctagtagtgttacgtttatagtaattttcatcttttcaagttaccaatgcatggaaatgtgaatttctgtccttttaggaagtggtattttatcttttttttttttttttttttgagacggagtctcactttgtcgccctgtctggagtgcagtggcgtgatctcagctcagtggaacctctgcctcccgggttcaagtgatttttctgcctcagcctcccgagtagctggggttacaggccctcaccaccatgcctggcttatttttgtggagatggggtttcaccacgttggccaggctggtcttgaactcctgaccttgtgatctgcacgcctcggtctcccaaagtgttgggattacaggcgtgagccatggccccctgccttattttttaatacaattaaaagaacccagtaatcctactcctagacctgtgtcccacagaaaaaagtgttaaacatgagcgtgtagtactagggcattcgttgtagtactatccgtagtggcaaaacgctggaagcaaattaaatgcccattaatagggtaattgatgacttcagatatttccatactgtggaatattatgcagtcattaaaaagaatgttacaactaattgcttttcctctcagaagcccctctctctcactagagaaagctgttctcctttctttcttctgcctattaaacctccattcctaaactcagaaagaaaaaaaaaaaaagagaatgttacgactaattgacttggagggacttccatggtgtacatttaaataaaaggtagatgtgaagtggggtatattatgtgatcttaatttcataacacaaaggaaaacatatagatccgtagataaggatatatggatatggaggagagaaaaggaaaagactcaaaactcacagaatttttgaagaaatgtatagctaaaaatctaagaaggctacagtcaaggccttgaggccagaagacaccccatcaaaactgagtaaaactagcccagtgtgggacgcagaaattctagtatgctaccaaaattacttacggattgctaccagttccttagaaggaaaactgaggactaatatttgtattttcagtatagtttagaattcttaaaaaatgagcaaacaggctgtacttggtggctcatgcctgtaatgccaggacttgtggaaactgaggtgagaggataacttgagtccagaggtttgagaccagtctgggcaacatgttggagccccatttctacaaaaaacacaaaaattagccagacgtggtggcacgcgcctgtcttcccagctactggggaggatcatctgagcctgggggaagttgaggctccagtgagccatgatcatgccactggactccagcaggggcagagtgagactttgtctgaaaaaaacaaaaaatgaatgagcaactaactctggctttcatgatttgtgcttataaatctttttatttatttatttatttatttatttatttatttatttatttattttgagacggagtcttgctctgtcgcccaggctggagcgcagtggcgcgatctcggctcactgcaacctccgcctcccgggttcacgccattctccagcctgagcctccggagtagctgggactacaggcgcctgccaccacgcccagctaattttttgtatttttagtagagacggggtttcaccgtgttagccaggatggtttcaatctcctgaccttgtgatccgcccgactcagcctcccaaagtgctgggattacaggcgagccactgtacccagcctataaattttttttataatgccctgattcccattatttgatgtatttggataaatatgtcatcctgtaaattgaaggattaaactgataagagcagaaaacagaaattagtacactagttgatctggctcagatatagtgcctatgtatcaggtgctccatgaatatttgttggatgaataaatgatcataaaactatataaaaatgaagaaataacagaataaaataatttgttctatataaatcctatgaatgagattgagtgggctaatagaatcctttccatctcaaaatgttctggaaagtcttgagtaaaagactcatcaaaaaaataattctgctttgtgcagaaagaagggttgctgacctttgaaggtgctttttgagtctttaacattctttagtagtatattccccaaagttaagaaattctagttagattttaaaaaattgagttaacatttaaaaaacagttttgttgaggtataatacacgtaccataaaatttactcaatttaagtacaaagtttgatcagttttagtaaatttatatagttgcacagctgtcatcagaggctgcttttaaaacatgtccatcactccagaagggttcctgtgtcaatggaattgctgggttatattgtttaagtatttgtttaaaaaaacagaaacaaatctgcctaacttctgcaggctatatacgagttaacatttccatgagcaatgcatgagggttgtgatttttccacatccctgtcaacacttggtttgtcagtttgtttttatttagctgttgtagtggatgggtagtgatggtgtatggtggttttaatttgtatttccttcatgaataatgatattgaagattttttatatgtttattttccacccgtatctctttggtgaaatgtctttataaatttttgtgaatttttaaatcaagatcattaaccaaatgagcccctcatttgggctcaagtgatccttccacctcaacctcccgagtagctgggaccacaggtgcaggccacgcttggctaatttttgtatattttgtagaggcggggttttgccatgttgcccaggctggtcttaaactcctgaactcaagcaattggcctgcctcacataagtattctcttttattttgaggattaatttttgttgttgtgaaatatatcctacctgtaaaagagtgcttaaaatgtcgtatgtgtgctttaaaggataatataatggaaacttgtgttcctactgcccaggttaggaaatgggttattaataactttgaaacctcctaaatgcctctctcctactgcattttccttcctccacatcagatgtagtgtttcttcaattttatattaatattttgtactttttatagttttaccatatatgtttatatatatccttaatatattagtttttaaaatttgttattaaccttcagtttattcattatttcaacactgtatagtatcttattgtagtaaagtatgtcaattaacttatccattccactagatggagatcgggattatttctggtttttagttattaaaaacaatgctgctgctgggtgcagtggcttacgcctgtaatcctagcactttgggaggccgaggctgcggatcatgaggtcaagagatcgagatcatcctggccaacatggtgcaactccgtctctactaaaaatacaaaaattagcaggatgcggtgctgcgcgcctgtagtccctgctactcgggaggctgaggcgggagaatcacttgaacccaggaggcggaggttgcagtgagccgagattgtgccactgcacttcagcttggcagagcgagacttcgtctcaaaaaaaaaaaaaaaaaaagctgctataaatatggccaagactaaggaaaggtaagtgaggtgcttagggttcacattttatggagtaagagtaagtaccttcttaaggtttataccctaggttcttcacatgcctcactttagtcctagccctgagcattattatgtaggtcttctgatgcaatatctaagagtttctctaaggtatacctagaaatagattgctaggtaatggagtaactttattacttacaggaaactatatggtggttgtaacaatttatgcttctgccaccagtcatggtggatatgaaattatgtcttaatgtgataatttacattgcaatttttttttttttttttttttttttttttgagacagagtcttgctctgtcacccaggctggagtgcagtggcgtgatcttggctcactgcaacctctgcctcctgggctcaagtgatccttccacctcagcctcccgagtagctgagaccacaggcgcaggccacacttggctaatttttgtatattctgtagaggcggggtttcgtcatgttacccaggctggtcttaaactcctgaactcaagcaatcggcctgcctcagcctaccgaagtgctgggattagaggtgtgagccaccacacctggctgtttgtttgttttgagcctgttcctcaggctggagtgcagtggtccaatcatggcttgctgcaactccgcttcctgggcttaagagatcctcccacctcagccttctgagtagctaggactaagggcacctgccactatgcctggctaatttctaaagttttttttatagaggcagagtctcgctgttttgcccaagctgttctcaaatttctaggctcgtgtgatcctcctgcctcagcctcccaaagtgctgggattataggtgtgagccaccacacctggctgatctatctgtcttaaactggagaattgcatttttttctacctcctttcttttttttaaaaaaactgaatttccatctgttacccctccctttctgctcctcttatttcatgccttggaagttatactttgccttcctttaatgagtaccaaagaaattaaaaaatacatgtttactgtaagtccaggcctaaatgttgctactacagggaccatcaaatgctttactaccatctattgccatctgcaaatgtatgccattgttgtttagttttgtagttcttaatgtattttaattaaacaccacaaattatgctttttgtttgttttattcagtcagtagatgcttagaatacttgcttattttaccaattcctttgcttattccactcctttgttctgggattatttttctttttcctaatatattttcattaaaagtttatttggtgagaatctaaaaactctcaaattctgaaagttttaaaaatttgcctttgttgttgaaaattagttttgatgggtgagagaatctagatcaggtgttagcaaacctttttttgtaaagggccagatagtaaatattgtgggctttgtgggccatagagtctctctgacaactactcagcaatgctgttgtaggacaaaagcaaccatagacattatgtaaacatgagtgtgggtatgttctcacaaattttgtttatagacactgaaatttgactcaattttcatgtgttaaaaattattattttttgaatttttttaaccatataaaaatgtaaaaatcattcgtagcttgtagaccaaataaacaggatggatttgacctgtgggccatagtttgctgacctctggtctaaattaacattcattttacttagtacctgacactggagtaattattcttatgatgtcttattgtgatattgtcttccatttttaattgttgaagagccagctgtcagtcttttttgtttttctttttcttcttcttttttttttgaaatggagttttgctcttatcgcccaagctggagtgcagtggtgtgatcttggcccactgcaacctctgccttctgggttcaagcgattttcctgcctcagcctcccaagtagctgggattacaggtgcctgccaccacacccagctaatttttgtatttttagtagagatggggcttcaccatgttggccaggctggtgttgaactcctaacctcaggtgatccacctgccttggcctcccaaagtgctgcaattacaggcatgaggcacggcgtctggcctttctttcctttttttttttttttgagacgtagtcttgctctgttgcccaggccggggggcgatggtacgatcttggctcattgcaacctctgcttcccaagttcaagccattctcctgcctcagcctcccaagtagctgggactataggcacgtgccaccatgccgagctaatttttgtatatttagtagagacggggtttcaccatgttgtccaggctggtcttgaactcctgacctcaagtgatcctctcgccttggcctctcaaataactgtcctttctttgttggtaatctggtgatatgttttcttgtttggctgcttttaagagctgcttcttgtctctggtgcagttcgctatgatgtatctaagtatgtatttattttcatttaacctggtcaggatttgttgagtatccagaaactaaggattggtgtttctcattacatctggaaaaatttgagccattatttttgcttatattgtggtatgtcataggaagttgagaaaagaaaaattcatttgatggttttctatgaggttatagtggaaaataactatctcccttttagaattgagtgctagacagtttctgtgtagatgatctcataagcttccttttatcaaacagcgatcacttttttggtttggctgctgagaagtatggcatcaagtataatactcatatgaggtgtttaagaactgagtatatttcttatgcacattttactatatactataattatacattaaaaatgcacattgtaaatattataaatatgtgttatacattgttaatagtttggatagcaaaagtatgacttgacatttgttttttaaaccatatttaaagtaactctatcacaatatggatttaatggattaattgcataattggtgagctactgattattcttgttatttggatgcttctttaagttagcaagtttatattgtggtgcttcaatatagactacttatttcatttcagagaactcaatttcctgtatctactgagtctcaaaaaccccggcagaaaaaaggtctgtatgcagtttcatggtatgtgtatgtttgcacagacagatttctcttttatttatttatttatttttttttttggaggcagagtctcactgtcacccaggctggagtgcagtagcacaatcttggctcactgcaacctttgcctctggggctcaagcaattctcctgcctcagcctcccgagtagctgggattacaggtgcacgccaccacacctggctaacttttgtgttttagtagagatgaggtttcactgtgtttgccaggctggtctcgaactcctgacctcaggtgatctgcccaccttggcctcccaaagtgttgggattacaggcgtgagccgccacgcctggccagatttctctctcttgttgattcttttatctattctatattatttcaaaatgagtgttgggaaaagaagtaatagtctaaatgttctgtcacatctagcttttatttaatagagttattagatattaggaggttggtttgacctggaaattatttaaatggggtttgattattatgtaagtgtgtactaattttctgcttctggaaaaaccactttgtgaagttccaggtatctttttgctttgttggtttctagtttaattctattgtgggtagagaacattctttatatggtttgttttatggcccacaatgtggcctgtgttggtgcatgtcccatgtacacttggaaataatgtgtattctgctcttgtaggatgtagcattctgtaaatgtcaattaggtcaagttggttgatagtgttctgtatatacttacaattacagatattcatattcttactgatgtagttactgattggaagggtgatagaagagtgttgaagtgtgcaaatgtaattgtggatttgtttctactttcagttctatcaatttttgatttgtgtattttgaagatctgttgttggatgcatatacatttaggattgtctgatttcttggtaaattgacccgtttgtctttatataatattcctcttcaatttctgataatattccttgtttgaagtctactttgcctgataatattttagttttagttatttatttagctattttagttttgctttggccagtctttgaatggtatcaacatataattttcgtagagtaaaattccctttttttagtacaaattctgagtttcgacaaatgaaactagccatgtaaccactagtagcaccataatcaagttataaaagtttaattactcccccaaaagtcacctttactttgtagtaaaccacttcttccattcccaattgcgggcagccattaatctgtttctttcttcctagttttgcctttcttggaatgccaaataaatggaatcatacattattattattttgagagagagggtctcgctctgtcacccaagctagagtgcagtggtgtgattatagctcactgcaacctgaaactcctgggttcaaatggttttccccagtagctgggtctacaggtgcatgccgccatgcctggctaatttttatgtattttttttgtagaaatgggggtctggctctgttgcccaggctggttttgaactcctggcttcaagtgatactccatcttcggcctcctgaagtactggcattacaggcatgagctattgcacctgggttatgtaaatttttcagtggcttttaaacctcatataatgtttgtttgttggtttgtttttgaggcggaggctcgctctgtcacccaggctggagtgcagtggtgcagtctcagctcactgcaacctccacctcctgggttcaagtgattctgctgtctcagcctcccaagtagctgggattatcggcatgaaccaccatgcctggctaatttttttatttttagtacagatggggtttcaccacgttggccaggctggtcttgaactcctgacctcaagtgatccacctgctttggccccccaaagtactgggattacaggcatgagccactgcatccagcccaatatagggaggtattaagaaaagagaagaactatcatccttaagtattaacgggactttaacaaattaaaaaagtagtactttgaataaaaagctgtcacattttactgtgaaatccttagactttttttatacctctagttcaggttttttcagctttggcatgaatgatattttgagcaagataaatctttgttggagttgtcctgtatattgtaggatggttaacaacatccctggcttctacctggtagatgacagtagcacttaattgtaacaaccaaaagtgtctccagatgttgccagttattccttctggggcaaaattgttcccacttgagaaccactgctctggttaagtagtgtaatacttggaaatagaaggcagaaagttggtaagtgcataaagaattcacacagaagttggattagcaagctgagagacgttatttgaacaagtagcaattggaggcattttgactgagaatggatgttgtgcctctccctcactctttcctcctcagcttgagaggtccatattctctcaaagtttgactctttagttttgagggtgatgactgccaactgtggaagggataaacagatttctgtttggtatttttgtccaaatatatcaggactttttcaagaacaggcaatgaaattattgatcagaactacttggtggttctgagaaaataatatgctacatgaggctactgaagtcctcttccttttgccccatgatgtaaccttaggtgactttcttctggctttcagttgaagatcttacccatcattgaggtgagcgaactgatttactgcttgagtctattttcttccttaaaggagtcttcattgaaaactttacccattttggggtggccatagctgaggatgagttttgtccacaacctgagacaacatactcactatgtaaaaaacctgatctcagcttgatatctggttttagactaattgtttaatagaataatttattattgtaaaatatatataaaatttaccatttttaagtgtgtaagtcagtggcattaagtacatttacaaagttgtgcagccatcaccactgtccatttctagaagtgtttcatcattccaaacagaaacactgtacccattaaacaataaatctccacatccccttgcctccccagatcctggtaatctccattctattttctgtatctatgaatttgactattctaggtttttcatgtaaggtgaatcatacaatatttgcccttttctgcctggcttattccactcagcattttcaagattcattcatgttgtagcatgtgtcagaatttcattcctttttaaggctgaataatattctagtgtatgtatatatcacattttgtttatctgtctgttgatgggcatttgggttgttttccttagagtctttatatgtcagtaattcttaaagaatttaaaagttgtagaaactaggaattttgtagatattctagaaatatgtcatttcctgtactgtatataataatttattctacagactaattactgtgtatatatttggttctcagacgtgattttgattttgtagatgctgtacatgctcttcacttcattaatcttttccttttgctaattttggttcttgtgtatacagaattatagagttacaaggtaatttagttgttacctaattcaccctaaagtctacatgaaaccactgtcacagtctttgataagtagttaccaaatctcactatttctactgtgatagtgaatgactttcattgattagctttctgaaagaatagtttatcttacttgtcttggtatcctcacctctgagtctatttgtctattgtaatctggcttttgctccaccgctccactgattaaatggatgagctaagcatttttttttttttccactgcaacctctgcctcccgggttcaagtgattctcttgcctcagcttcccgtgtagctggtattacaggtgcccaccaccatgcctggctaattttttgtctttttagtagaaacggggtttcactatgttggccagactggtatcgagctcctgacttcatgatccaccccaaagcctcccaaagttctgggattacaggtgtgagccaccgtgcttggcccaattctgtttaatttttgaggaacaatgttaacttctaatttaaatggaaggtagtatatatctaatttttccctattatttttaatttcaatgctagtaaatctttaaatctgaaatacacactcttgaattttgacagatatgtatactcatgtacatatttatattcctgtaatcatcagatcaaattaaacatttttatcacttagaaagtttcctcatgcctttttccagtaagtcttctgcttcacttcgccagatgcaaccaccattctgatttctgcctgtataaattgattttgaactttcctataataagttgtgcttgaacttcacacaaagggagccatacagtatctactatttagcttttggcagctttcatacaacatgttgttttggagattcatccgtgttgttatatgtatcagtagttcttttatttaaaaaatgctgtttagtattcagttgcatgaatataccaccgtttgtccattctcctgttaatgagtatttgcaatgtttccagtttttgagtactgtgaaagtttctatgaacatttatttatttagagatggagtctcgctttattgcccaggctggagtgcagtggtgcgatctcagctcactgtaacctccgcctcctgggttcaatcgattcttcagcttcagcctcctgagtagctgggactataggtgtgtgccaccatgcccggctaatttttctatttttagtagagacgggatttcaccatattagccaggctggtcttgaattccttacctcatgatccgcccgcctcagcctcccatagtgctgggattacaggcatgagccactgcacccggcctgaacatttatttactggttttttttgtgtgtgcatgtgtgtgcaagttttcacttgaataagtgcctagggagtggaattgcttggtcatatgtgaactgtttgttttaactttataataaactgccgaagtattttccaaagtggttgtacagttttacccgaccgccagcaacgtgtgaggattctgtttggctacattcttgccaacatttgttactatcagtctttttcatattagacttgctggtgggtatattgtgttttattgtgattttaatttgcattacactaatgactagtgatgttgaacaccttttcatatacttattggtcatatcttttgtgtagtgtctgctcaagttttttgcctatttttaaatttcttttttccttattattgatttgtgagacttcttaatatattctgaatgtacgtcctttgtctgttatatatgtggtaagtatttccccccagcctgtgttttactactttcattttattaaggtatcttttgatgatcaaaagttttaattttgatgaaggccaatttactattatttttcttttgttattaatgccttctctgtcttgtctaggaaatcttgatccttaccccagactgagttgtgtgtcctctcccttttctgcattaatattgcagaaattaattttttggttttagaaaatgtctaatttggctcaatcagtaatttttgatatctttctattgaaatatatatacagaaaagtacatacataaatcataattgtactgtgcagtgaatttttacaaagtaaacatatccatgtaatcaccatctagattaaggtatagaatattatcagtgccctccaggccgcctccttattccctaccagtcattaaccacccctcccaaaggtagtaacttgtatttaacttctatcttctacatcagttttgcctgcttttgaatttaatgtaaatggaatcatgcagtgtgtactttttaatatctaacttcgttgctcagaattatgtttgtgagattcatttatgttgttgcatgtagtagtggttggttgttttcttccttgttatatatattccattgtggggctctacctaagtctattcattttatacttgatgaacatttgggatatttttattgtgatgtattatgaataatgccaccatgaagagtcttgtacatgttttttggtacacatacatacttaggagtaggattttcagggtcaccaggaaggatatatttaggctcagtgaatactagcaagcaatttttaaaatgcggtcaatataatccccatgtgtaaaataaaggtgtacaaacgcacacacacacacttgctcatatgcttatatgtgcatagaaattccttgaaaatactcaagaaatgcttcacctctggtaagggataggaatggaatgggtcttttgtttagtatcctatgtgccctttgaattttgttttactgtaagtatgtatttttaagaaaaccaactagttatttttaaaaatcatttgaaagtcttcctactttgatatatgaaaaacactggttttaaaaaaaataatagaaaagctttaaaatcattattatttttttgagacggagtcttgctctgtcgccaggctggagtgcagtggtgcgatttccgctcaccacaacctttgcctcccggattcaagcaattctcctgcctcagcctcccaagtagctgggactacaggtgtgtgccaccaggcccagctaatttttttttttttttgtatttttaatagagatggggtttcaccatgttggccaggatggtctcaatctcttgacctcgtgatctgcctgcctcggcctcccaaagtgctgggattacaggcgtgagccactgtgcctggccgctttaaaatcattaatgttgcgttgctcagttatgtctaattgacagcccaaacatttacattgtaatattagaaaatcctttatgattgggcagaaacttggtttaatgtgtcaccttggagacctgggttatagtcctgcctcttccattaactacttgttgaatgtggacaatttacttaacctttagggccttaatttcctcctttataatgtgagaatgttctctgaattgcataactcactggccttacgtgactattcagtggaataataagagagaaaaactttgagatacatgcacacacacccttaagaaggatataattgttaaattttgctttgaggaaataaaataatctaagctataaagtaaaaccataattagctaatcttttatatgacttttttcttcctcatttcaagctaatgagaagcaaacaaactggatagcagcaatataattaaaaaattataggccagcttctagcatgtattcttgagtcaatactgactcagcccagtctcttcctcttccttcatcatcatttatgtacctgaacagagtagatgtttctcttgatcctgggcctgttcgccctcagatccattccttgccttctcttctctttttggtatagtgaggagctgactctttttttttttttttttttttttgagacggagtctcgctctgtcgcccaggctggagtgcagtggcgggatctcggctcactgcaagctccgccttccgggttcacgccattctcctgcctcagcctcccaagtagctgggactacaggcgcccgccactacgcccggctaattttttttgtatttttagtagagacggggtttcacctttttttagccgggatggtctcgatctcctgacctcgtgatccgcccgcctcggcctcccaaagtgctgggattacaggcgtgagccatcgcgcccggccgaggagctgactcttgcagcctccttttcttcccaggcttccgtgtcagcagtttctggctggattagcaagtggaggaactggcaggagattagaaggcaagaggaaagagaagacagggcttccctccccgaccttcaggcctcagagtcgtagtggttttttgctcatgcagacttctgatttgtctcaccattccctgttgggcctctcatttcttccattgcctgttctctgcattaaagtccttgtgtttcaaatcctcaagtggctttttgttaggctttgactgatacagggctcaaaatgatagtaatgaaaatgtcttacatttatattcttttcaagatttgttatctcttttgataccccaaatatcctattgaggtagaaaagtgttataattcctgtttggcatgaggaaattaacatttattgaatgactattttcagattctttggattttcgggtgaaaattttaggggggataaatggaggcccagagaagtgaaataacttgccctaggccccatagaaggctggtattgaatcaagattgaaattctgcatgtgaaaacttttacgtgctacatgtctgctagtcctggaagaaatcctttctttgatgagtattttttttaaaggctttacttgcaatatatttacaaaagccttagttatttagtaaatttttcaatgaaaaatctgaaccataataattttctgcttagtacttatatagctagcatactatccctagcattaatcaaagtgtcatgtaaaggtttgatttttgagcctaagcagaatttgaaattcttctaagagaatttagcacctagggcaaactacaggggagaattcttgaggtgtcatgtttattcacttctggaattgtttaaaatatgtcaggtgcatccttaaagggagaaagaagggggaagagatgttacaaaagagtagaatggggcaagagaagtggcaagggagtattgttgctaggttgccagccttctgcccccactgtcttggtgatggtggaggggtagtgtggcagctgggatatgaatgaggtcttttttataactcactaaaagccattaccttgtcttcatctcgtcagctggctacctgacctctgtggtaacataggctcctgaaatgtagcattggagatgatcactgtgctttattgcaaaataggggagactctgctctgcatttacatgcttatgttttgtggaggatctttcaactagtaattctcataatacctgtgaaagcatataagaaccagtatctccatttttagggggagttggagtgagcaatgatttggaataccagaaattcaacttatatatttacaggtaaaattctaattgtaaattcaggattcatagattctagggatttctgaggtatccagaattccttcatctttgatgataagtagataataatggtaataaaaataacagcaacaggcccagcacagtgacccacacctgtaatcccagcactttgggagactgaggcaggtggatcacttgaggtcaggagttcaagaccagcctggcggacatggcaaaaccccatttctactaaaaatgcaaaaattagctgagcatagtggcatgtgcctgtaatcccagctactcagtaggctgagtcataagaatcatttgaatctgggaggtggagattgcggtgagctaagatcgcgccactgcactccggcctttatgacagaactcgactccatctcaaaaaaacaaaacaaaacaaaacaaaacaaaaacaaaatgcaaaaaaacagcaacaataataggtaacatttctttaaggcctactatgtaccaggcactatttgaacctctttatatattaggtaatacgatacaactctatgagaatgagtattttatttcctgacccttctatttaaaagtaaaaccccccacccggcactgtttctctttcctgctttatttttctccatagaaaaatatcactcataagtgtaacatactttattatctgtcctgtgtggtagtagcccctgccctcaattataaactccatgaaatcagggagtcagttttgttcactgctgtattcccagtgcctagaacagtgcctggaatcatggtaggtacccagcgaatattggttgaatgaatgagtcttggttttacagatgaggaaactataaatttcccaggtcacacatttggtaataggacagttgtgtacactgaaatgttctctaaaatatttgatggaacgaaaattagcttttggacagctacatctccaagagtgtgaaatgaccttcagcactggatttggtggattttcctttttctaatccctagagttccatttaatgagcgtttgggttcttgagctaccttacaaattgaacacttttttctccagctttcactcaagaaacacaaaacatggcttgtcctttttttttttttttttttttttgagactgggtctcactctgtcacccaggttggagtgcagtgcacaatcatggttcattgcaacctctgcctcccaggctcaagcaatcctcctaactcagcctcctgagtagctgggactacaggcttgtgcctccactcctggctaatttttttgtattttttgtagagatggggtttgtccaggctggccttgaagtgctggactcaagtgatccgtccacctgggcctcccaaagtgctggggttacaggcgtaaaccactatagctagccctgattgtcttttattgtgagattttaataacagctaagacttgaaaattaacattttataaattttcttttagactacttagtgatatactaagtatctaaggtttgtaatacttagtataaactcaaaagggttcagtgcctcattctcttttactctttccctttagtagataggtgacagaggactgggtcatgcagttgagacttggtccaagatgacttagtaagctacttgtcccagaactatttatttatttacttatttttgagatggagtctcgctctgtcgcccaggctggagtgcagtggtgtgatcttggctcactgcaacccccgtctcctgggttcaagcgattcttttgcctcagcctcccgagtagctgggattataggtgcccgccaccactcccggctaattttttgtatttttagtagagacttggtttcattgtgttagccaggattgtttcgatctcctgacctcatgatccacctgcgtggacctcccaaaatgctaggattacaggcgtgagtcaccacccccggaccctggaactatttatgacggtgcactttatgcacttaacacactcacatgtctttaagcttggtgactcgtgtggctttttcgaaggagatttgattctggaagtggttaagtaggatgtgaatggctaaggtctggtcattggtgaagcctaggggaagaaaagaaaggaaacacaagtcttagaagaatttcagatcggccccaacgactagaagggtggttctactaagaaaatgtgtgtagtcagaaaatgaagagtcagttgcttaaaattttactttttttcttgttcctggcatgtaaagtcatatccatactttctgttataatttcttcttacaaattccattgataatccctattcttggatagcaatgagcagcattacttcttttttatttttttaaaaaaattaaattttttgttgaaatgagggtcctgctgtattgcccaggctggtatcaaatttctgggctcaactgatcctcctgcctcagcctcccaaagcgctgggattacagttgtgagccagtgtgtctggttgtaccttttaatttttgtgttcaggcaacattaactctgagtcacagtaagctttttttttcttcctgtcatattatggacatagaagttttttggttttctttagattgtttctccttaggttgcagaacatcaagaaatggattacagtcattttcctctcttccccatgctcttccctttcttttccttttttcttttctttttttttttttggagacagaatcttgctctttggccgaggctggagtacagtgtcatgatcttggctcactgtaacctccccgcaccaggttcaagtgattctggtgcccaagcctccctagtagctgggatgtcaggatgcgccaccacaccctgctaatttttgtatttttttgtagagatggggtttcaccatgttgtccaggctgacctcaaactcctggactcaaatgatctgccctcctcggtctcccaaagtgctgggattataggcatgagccaccacatctggcctcttttccatttttaaaaaggactgtctccaacatattaaaattcacaaaaaataatataaacacacatgtactcactggctaggcttaataaaaaacatttagtcatgtttactttaaagctttttatttttttgagaaataggcattaaagagttgaagtctcctttctgtcttttcataattctgttcttccctcttccttccttgagatcttcactattcttgggttaatttggatctttctactccttgttaccacagaaaagtaattcttaatgaatttgaccatattttaaacttctgatttcagtgggcaggtaactcattttatggtttctgtattgtgagccattttcaatgactcaactagatttttttcatcgttgacttctcatttctgggcaacagcataatgttctcatttgagctatttctaaagattgtgtttaactatttaaaatatttgtggtactctgatcatcagatgtgatttttttttttttttgagacggagtctcactctttcaccaggctggagtgcagtggcgcgatctcggctcactgtaacctccttctcccaggttcaagtgatgctcctgcctcagcctcccaagtagctgggactattggtgcgggttaccacacccggctaattttttgtatttttagtagagacagggtttcaccatgtttgctaggatggtctcgatcttctgacctcgtgatctgcctgccttggcctcccaaagtgctgggattacaggcgtgagccactgcacctggccagaagtgatattaactatcttatatgtatatttctgttgcgggaagtcaggggccccaaacggagggaccggctggagctgtggcagaggaacgtaaattgtgattatttcatggacacttaccagttcccaaataatattcttataatttcttacacctgtctttaatctcttaatcctgttatcttcgtaagctgaggatgtacctcacctcagggccactatgataattgtgttaactgtacaaattgattgtaaaacgtgtgtttgaacaatatgaaatcagtgcaccttgaacagaataacagcaattttagggaacaagggaagacaaccataaggtctgactgcctgtggggttgggcaaaatagagccatatttttcttctttgcagagagcctataaacggacatgcaagtagggaagatatcgctaaattcttttcctagcaaggaattttaataatactctggagaaggaatgcattccttggaggaggtctatagggcatgtctgtcttatgctgttgacataaggactgaaatacaccctggtctcctgcagtaccctcaggcttattagggtggggaaaaaaccccaccctggtaaatttgaggtcagatcagttttctgctctcaaaccctgttttctgttgtttaagatgtttatcaagacaatttgtgcaccgctgaacatagactcttatcagtaattttgcttttgccttttgccttgtgatctttgttggacccttatcaggagtttctgattttgcccttgtcctgtttcctcagaagcatgtgatctttgttctcctttttgccctttgaggcatgtgatctttgtgacctactcactgttcttaggccccctccccttttgaaatccttaataaacacttgcttattttgcagctcaggtgggcatcacggtcctaccgatatatgtgaggcccagctgtgaaattcctctcttcgtactcttatttcttagccggctgacgcttatagaaaatagaaagaacctacattgaaatattgggggcaggttcccctgatatatttccttagtgacattcctgcaatctcctttagaaagtctttctgttcaccttctataaccagggaaggagagattgagaagagacgaaggatgattttatgtttttcagtcccagtcattatttgatgagaaactgatattacaagctttaaaaactcaagatatgtattcaacatgtagtagtagaacaagtatcttagtttaatagtctataaatttttgatgcactataatatattattgtagtcagtagcatcaaaattttaatgtgatattgcagtatgtttatggttagtttagacatgaggacagtgctaaaggagaaaatctaatgactgtgttgtttgttttgtcaaaatatgctgcctagctccagagtttcctattttggagaagcagaactggttgattcatcttcattatatccggaaagattatgaagcctgcaaggtaagagattgccataataataaaaatgagaggcaggatgttgggtaggcaactaacagtgcctgctaaacagagtgtggcagtttatatctcagtgataaaacatgaattccttcttccccatacttcatacactggttatcttttgctatggtagtgatgtttaacatacaacctcaatatttcagtggcccccaacaaacaaatattaattgctcatgggctttcagatcagctgtgggttggctgggtttgactgcaggctgtgggtcaggtttaggtgtgttccatgtgtcttctcatgtcaagagcaaacaactctcttggacatgttggtcttctggtggaggcagatgttcaactcagcatattaacttttttatctttggatagatgaaaaatggtattttgtcgagtttttttttttttttttttttttttgagatggagtctcactgtcacctaggctggagtgcagtggcatgatcttggctcattgcagcctttgtctcccaggttcaagcaattcttctgcctcagcctccccagtagatgggactacagatgagtgtcaccatgcccagctaattttttgtatttttagtagagatggggtttcaccatattggccaggctggtctcgaactcctgaccttgtgatctgcccgccttggcctcccaaagtgctgggattacaggcgtgagccaccgtgcccagccctgagttttattttttaatttctctcttactgcaaggttgatcatcatgtgtatatttaaaaaccatttgtatttccctttctctgtatctttggtgacataccatatgtgttacaaacttgcaggcagacagtggtagtactaacatgcagaatgtatccttggtgtcatcttttttggtatccagagctttgtgacccatctaaggtttttaatttatacccatggcatttatacctatggcaatgcacagaactaattcatactggtatgacaaagattcataccagtttttttttttctttttttaagtggagttttgctcttattgcccaggctagagtgcagtggcgcaatctcggctcactgcaacccccgctttccagtttcaagcaattctcctgcctcagcctcccaagtcgctgggattacaggtgcccgccaccatgcccagctaatttttttttttttttttgtatttctagtagaggtggagtttcaccatgttggtcaggctggtctcaaactgctgacctcgtaatccacctgcctcagcctcccaaagtgctgggattacaggcgtgagccaccgcacccggcccataccagttttttttgacaccgctgatccgaaggcagataccagtatgaatctttttttttttgagatggagttttgctcttgtcgccaagggtggagtgcaatggcgtgacctcggctcaccacaacctccgcctcctgggttcaagcgattgtcctgcctcagcctcctgagtagctgggattacaggcatgtgccaccacgcctggctaattttttgtgtttttagtagagatggggtttttccatgttggtcaggctggtctcaaactcccgacctcaggtgatctgcccgcttcggccacccaaagtgctgggattacatgcgtgagccaccgcgcctggccaccagtatgaatcttgaaaggttctctttctttttcatctgtgataatacttggaaatcttatcacacttttcttagcttgcctagttagattttagacaggggttggcaaactttttctgtaatgggccaacaatattttagggtttgtaggccacatacagtctctacatcatatttgttatcttattttttataaccctttagaaataaaaaaaccactgttagcttgagagctgtacaaaaatatacagggcctgtaagccctgtagtttgcaaatccctgttctagaagaagtaatcacaacaagggagttgaaattttaagaaactgaatgaactaatactttactaggcattattaatactctaggtttttttacatatgattcttgtccacgtctgctttttcattactatttgttttcttttttttttcagacagagtctcactctgttgcccaggctggagtgcagtggcgctatcttggctcactgcaacctccgcctcctgggttcaagcgattctccttcctcagcctcctgagtagctgggattacagacacgcaccactactgcccggctaatttttgtatttttagtagagatggggtttcaccatattggttaggctgatcttgaactcctgacctcataatctgcctgccttggtctcccaaagttttgggattacaagcatgagccaccgcacctggcctgtccatgtccactttttcttaaagacacctgaagaaacttaaccactgctcagaagcatttttctccctctttcaggctgttatcaaagaacagcttcaagagactcagggattgtgtgaatatgctatctatgtccaaggtaagacacatacttcttgtcttcttgctagagaaatacacttttcctaggttcttgaaaaagatcaggcaattgaagaaacaagttcaagtacagtcatgcaccacttaacaatggagatatgttctaagaaatgtgttgttaggcaattttgtcattgtgtgaacattacatggagtgtacttacacaaacatagatggatgatatagtgtactatacacatgatatagtctgttgctcccaggctacaaacctgtatgagcaggtgttataccgaatactgtaggcagttgtaaaacagtggtaagtgtatctaaacatagaaaaggtactgtaaaaatatggtataaaagataaaaaatagtatacctgtatagagtacttaccatggatggactggaagttgctctgggtgagttagtggtgagtgaatgtgaaggtctaggacattattgtatactaatgtagactttatgttgtatactaatgtagactttataaacactgtacacttagcctacactaaatttatttaaaaatattttttctacaatgataaattaactttagcttactataactttttactttataaactttaaaactttttggctcttttggggtaatacttaaaacacacaacaacattgtacatttgtacaaaaatagtttctttaggtccttattctataagcttttttctttttctttcttttttttttttggtagagagacagagtctcactttgttgcccaggctggtcttgaactcctgggctcaagcagttctcctgcctcagcctctcaaagtgctgggattataggcatgagctacgacacctggccctttatgctattcttaaaactttttatttttttacttttaaacttttttgttaaaaactacgatacacacactactacagtggtggtactaacatgtggaatgtgtccttgctgtcttttttggcattcagagctttgtgacccatctaaggtctttgtgacacacacacacacacacacacacacacacacacacgcacacgcacgcacgcactggtctaggcctacactgagtcaagattataaatatcactgtcttccacctccttatggaaggtcttcagtggcaataacatacatggagctgtcatctcctataacaataggaataccttctggaatacctcctgaaggatctgcctgaggcagttattcttttttttagtaagtggaaggagtacactctaaaataaagattaaaatgtatagcgtagtaaatacataaaccagtaatgtagtcatttattatcaagtattaagttctatatatatgtaattgtatatgctgtacttctatgtgactggcagcacagtaggtttgtttataccagcatcactacagataggtaagtaatgcattgcactgttttgattgctatgacgtcactgggcaataggaatttttcctcttcattataatcttaagtgatcatcatcatttatacagctgtcgaccaaaatgtcattacaggtgcatgagtttaaatgttccagaaaggttttattcagtattaatctttttatggaatctgaatataattactgtgttggatttgacttcagaaatgactagtaatgttaaaaaattgctatgattacccattttttagtttctggctagtgttttttggaatggatgcttaggattcctgcctaatgcagtgatttcagggccaaaagatgcttttggaaggattgcttgtaatcaagctaaaagagatgaagaagagcttgaggatttctgtaaggtgaatcaggatgaggggaagaagcctggaaataaacaagataaagcagagcataaattcagctcattagaaaccaaagataaggaccactcacttactttttttttttttttttttttttgagacagagtcttgctctgttgcccaggctggagtgcagtggtgcgatcccagctcactgcaacctctgccttccaggttcaagcgatcctcctgcctcagcccccctattagctgggattacaggcacatgccaccatgtccagctagtttttgtatttttagtagagacaaggttttgccatattggccaggctggtctcgaactcctgacctcaggtgatccacctgccttggcctaccaaagtgctgggattacaggcatgaaccactgcacctggcccactgacttaaattttcctctttagtggcataagtagcattcttagtttttccaggaactttctttttgactcttgggtgtaaataaatggttttgtttaccattcattgcatttgtagtcttcagattaacatataattttctgacataattgttaagatattgacaaatttaggacatcatggcaaaaaatgctcttattcccagtgtcacaagtatcagactttcagtgcctgataaattcttctggaaacataggcctaggaaaaacctctggttctaattggttgttacactgacaactgaagtcttaaatgttactttatcctttgccagaatctccatgttgaatttgaggtattgattccatttgccccatttgggggttcgctctgaaaactatcagttggaagtaaattatgataaatgaagcatctgatggggaagccccaaaatgttgttaatgtgaagagtttgtgtgataatttgcaaaggaactgattatctatgtgatggatcctgggagtagagagagaagtaggtaggtttgagctaccttgctaaaagacagttgagcttgtcagcagttttggttgttgtttcagcctgtccaaagccatatctgattgttttaaggatacagttgtccaaaggatttacttgatgtggtttcccagttttctcttctccaatttttctgaccccaggctccattcttcccagaacatggttttacttttttttgtattttctgtttcttggcagcattgatatttcgcctagaaggaaatatccaagaatccctagaactcttccagacatgtgcagttcttagtcctcagagtgctgataacctcaagcaggtggccagatctttgtgagtattggcaacctggaggccctagggcactcacagagaacagtgtaaaatgcattcctaggtccagcctgctgctggcagctgcatcagcctgatacacaagtgggggaatggtttaataggtacagtgggattcactctgaagagcatggattaagtttgaaatttgagaaaatgagataactagtgttaaggaactaagcattttaaacactgtgcattctagtttgatgggggaccaatattgtttatcatgtaaatagagacaccttgtaccctaagtcttctaaacttattggcaatccttggaatttttctcatctactcttctaacacttagtatttgtcacacagtaagtttttagtaaggacagagagttcctgacttctgatggttcaacttacataatttttcaactttacaatgatgtaaaattgttatgtattcagtagaaactgtacttcaagtatccatacagccattccgtttttcattttcagtatagtattcagtaaattacatgagatattcagcattttattataaagttggcattgtgttagatggttttgcctaactgtcagcaaatgtagttaagaaagtggagataggaactccatggaacagagtaagtgttctgagcatgcttaagataggctaggctatctatgatgtctggtagagtagatgtattacatgcatttttgaattacagtgttttcaatttacaatgggtttactgggatgtaaccccatcataagttgaggagcatctctatttgttgagtgaatgtcctaaagattcctagatggaaagaatctcaagtgtttataaactactaggtactcccttttcagtcctttgttccatggagttcctatctcccctttcttagccacattgccattcatacctgtgttgtttttgcatagagcttggttttccctgtttctctctaaactcaggatccaatatcaaggaaagagacttagtcttggaaggaaaggatgtgtccctaatgggtgatgataaatgatggtagttactgcttaacatggtatatcattaggcttatttcttttttggtctgcatttatagtacattgtagaagaaaaattccacaagactctcactaaaattggtatagaatgagaccaaggccttggaacagctgccagtgcaatccctactaagagagcttctgctgttagtgtatagcagcttcactgaccaaaccagcacaaccacctcatagagaaaaggcttctagaattctctgctggatgaaatatgattaaaatgtgggactagtagggttagtcttctaagaattttgaggtaataattatggaaaatatatcttttacagatttcttttgggaaaacataaagctgccattgaagtatataatgaagcagctaaactcaaccagaaagattgggtaagtagagaactttcagttctttcttattagtaaacttgctaatggttccatttatcatctggctgtcttatttctgaattcttacattccaaaaatgtcttgattttaacctcatacttaattcatgatttgtataagtataggatcaaaaaccatgtttcctcataactttgcaggcattgctgcatgattttctagcagtttgctgacgagcagtctcttaccagtctgattcttgttgatgacccctagaagctttgggtatttttttcgtcattggaattccacagtatcagcaataggcatctagttgtgtttcatgtctttttcccgtccccatctgtgtgacattcaattgactctttcattctgaagacccttgcctttctttgggtcagggcctttgagtagttctttatttttcccctccccttctctttgtgtcaattgaggattgtgtgtaaatgcaacagaaaatttgactaaacattggctttacaaattcgtttttgtttttttttttaattctcatgaaacaagatgtccaggtaagtagttgctggcattgatttggtggtcctaggatgtcaagactgagagtttttcctcatggttacaagaagactgctgcatccagcatcatatctgcattctagggaggcagaaagagaaagcaacaaggagaaaaggacagagcctatactgggaaagcacaactttcccagaagtcccccacagacttccacttatgtcatatcagctccccttctataaggaaggctggttaaatgtcgtttttaatctggtcacactgccactctaaacaaaattagggttcttttagtaaggaaaaagagaagagtaggtagcaggtaggcaagtagataactagcagcatctgccacactgttttccattctctatgagagatgttctctaactattctctacaactcttaacttgcctctcattttctacctctgtgtccttttctttgtgtgtggtgcgggggggtacagaggctcactctgttgcccaggctggagtgcagtggcgtgatctcggctcactgcaacctctttcttccaggttcaagtgattctcctgtctcagcctcctgagtagctgggattacaggcgcctgccaccatgcccggctaatttttgtatttttggtagagacggggtttcaccatgttggctaggctggtctccaactcctgacctcaggtgattcacctgccttgtcctcccaaagtgttgggattataggtgtgagacaccacgcctgaccctccttgtcattttattatatgttcaggacatgtattcagtcttatcttccatatcatcatttttgtttttagctatttgtattctgttatataccctatccatccaatattttttatttcatttccttttattgtatttttaatttccaaaaatcttgtcttttcttcaatgtctctgattcttgaagttcttttctgcttctcagaattatctttttcttcctctctgcattttggttcttctattttatgctgttggtatttttcaagtatttggtgattctcagagagacattcatatctgtgagtgaagaactagatttattagtacagagaattagcatggatttcctttgcagttcttacggggcactattatttttgaagtgtgttcaatttgttagtcgcttttcttctgtacatcggaagattgagttgagtctttatgccatggagtatgttatagctaacagccagagtgaaactacagatgaagaaaaattcatgtacttttcattcagtcggtttttcaaaaaatgagtatgtctgctatatgccaagcactgatctatgccctggagatgcaaagatggactgttggattataagatactcaactagaataggaaatgaaggaagaagagcaaggtttggaagaaggtgatggtaagaaatcagagttaaatcctgtctttcagaggattttggatatgataagttttaggttctgaggggatatctaaattgagatgtgtccagtaggattggatatagaaatctgaaactcaagtgttttggagtagagatgtgaattctggagtcagcaacataaaggtggtaattgaaaccattagattggttgacattaccctgcaatgagctgaggatgggaccctggaaaaaaagagttttttactttttttttgtctgtttgagacggcacaggaaaagttactgctttaatgcagggaggaagccctgcattctctatgggggccaggatcatgggggtggccagtgccacaaatggtcaccatacaggccagggaggagccagggcccaccaataatccctggaacatccctggatgctagcagttttttactttctaaatttttttttttttttttaagagacaaggttgcctaggctggagtatagtggggtgatcatagcttactgtaacctccaactcctgggctcaagtgatcctcctgcctctgcctcctgagtagctggggctacaggtgcaagccaccatgcctggctaaatttattttgtggaaatgaggtctcatgttacccaggctggtctcaagctcctgtcctcaagtgatcctcctgctttagcttcccagagtgctgggattacaggtgtgagccatcaaaaagcaattttgaaggactgagcagaagaagagaacccatagagggagatagggaagaggtaaagcaggagagctcagggtcacagggggaatggaacgtatttcttaatctatccagttggttgaaagagctcatttggtattactgactcacttgggataaccatcccattgttactagtagatgtgatcattcacaaaacagccattctttttttttttttttgttgagacagagtctcattctgtcacctaggctagagtgcagtggctcaatcttggctcactgcaacctctgcctcctgggttcaagcgattctcctcccccagcctcctgagtagctgggatttacaggcacccgccaccatgcccagctaatttttgtatttttagtagagatgaggtttcaccatgttggtcaggctggtctcgagctcctgacgttgtgatccgcccaccttggcctcccaaagtgctgagactacaggtgtgagccaccaccttttttttttttaactttaaaatttttctttaaaattttccccttcatggcatttttattttctttttagaatattttaatgattttgaattttacttttattaatagcccttacctaccctacatatttcataagtacctgtagaaaaccttatagtagctggagcatggtggctcatacctgtaataccagcactttaaaaggatgctgagtggggaggatcacttgagcccaggagtctgagaccagcctgggcaacatagagacccagtttctaggaaaaaaaaataaaaattagtggtcgtgtgcacctgtagtcctagctattctagaggctgaggtaggaggatcacgttagcccaggaggttgaggctgcagtgatgcggtgaactgtgattgtgtcactgcacttcagcatggaaagcagagcaagaccctgtctcaaaaaaaaaaaaaaaaaagaaacaaccttgtagccctactttcttggactcatcagggtattccacagtcttgctgcaacaggggaatagtaattcctcctgccattatcttagttgacttttggaacagttctgttaagtagggagaatttcccccattgacaagtgaggaagctaaggctttggaagatggaagttgctacagtgaggtagttgctgagccagaactggaattcagacctgtgatctaggatgatctaagattcctcgtcttaagactgtgatcttttccactgtaccaactgcctttgcaggatgtctgctgggttcccttacctcctgaaagataggatttgactctgatttgttctgttgccctttccaaatttcttttgcagttagtttgttaaaggtatattgctgccttctcaactatctatgtcaaagattttaaaaggtcagaggttagccttcaggacatctatttacttacctaccttaacaattcctactgtagagcaggacatttaaaggacaagaaaggctttatttctgccttgtctctctccatgcatgcattcttatagcatgacaaagttggcagtatacaagttttggaagcaggcctgagttcaaatcccaatgttctataatatggacatgatttgtgattgaataaaaaaaatttttaaatgtgcggcatttgtgagataattggaaattttaacgtaattgaatatctaatatcaagcagtcactactttttttcgagtgtgacgatgtgggtagtttaagaaaaaggccttatcttttagaaataaatacggaaacatttgtggataaaacgttgggctgttatttgcttacaaaagttgtgggagtagatggggtgtggattggatggttgttgggacaggatgattagtacctaattctgtctgcacttacgtatgattgaaattctccctaggatgtagaactaaaaaagaaaaaaaaaatcccaatactctctgtcttaagttaggtaatctactcaacctctctgagcttcaatttccttatctgtaaaattggaaagattataactatgttgcaggtttgctgaaaattaaagtaacatatatgaaaacatctggcataaagcctgatgttagtaggtgctcaaccaatggttgctgttttgttgtttttactatttttggagacttggaaaacattaaatcagttgttatctctgagcctgggggtccatgtttcctcagacagggacacatctccactactaatagggtagttcttactatgtttcccaagagcattttccttacccttgctttctccttttccaaagctaccttaaataaagggaggtttattataaaggaatttgagagtccataaaacagtatcaagagatgcaggttggtcttttagtgaagcagaactggaacgcttcagcatccaaggtagctactctgccttttctgcttcatcttttctttctgtagatcaaaggttggcaaactttttttgtaaagggccagttaataaatattttaatttgtatagcttcatacagactctgttgcaacgacttaactctgcagttctaatgcaaaagagccatacaaaaacaatagttgtgtctgtgttccaatgaatctgtacttataaaaaagggcagggaatggatttggcccatggaccatagttttcccatgtcagctctagacttctgcagatggctccaattacatgtattccatcacagcagactccaggtggcgctgtcagtcctcaagttcacatcacctagtaaatttagtacttgtaactaactagctctcttccaattccagattcctagggaaaggacttcagttgtgtcaggtgtcactatccaactgtgttgccttaagggcggaaatgtgtggctagcagccctctcagcaggggctgtgggtagtctctcctgagaagaaggagcaaagggtatgggtgatgggcaactcttaaagaaaaaaggtatggggatgggctgggtatgtgccccagggttccccatagatccaggaagatcacctgtttattctgcttttatttcttataatctgtatttttttatgttgaggaacttatttttaacaattaatttgagtatgaactctaataaaaagctgactgtaatgcatagtttaaagtttaaaccttgccgagcaataacaatctctagatgtctgttgtttcactctaatacttactgtggaattacacctgagttgttttccttcttttttatgagcctaggagatcagccataacctaggagtttgctacatatacctgaagcagttcaacaaggtaatttatagaagtggtgatagatttcactgagggtgcacttgttgcagaagttgttacattgctcatttggtattatccctagtgcttgcagaggtttttggaactgaaaattgaaagtacctttatacatttttttctgttttaattctcacttgtcattattcatctgttgttttctgcttgtaataagaacatggaaagttctagaaatatgagggaatggcagtttttctcctttcttctttttctctacctccagttaaatttcccagtttagaaacagatgcttaataaaacatacatatcaaaaagtggacccttaagtcttaaaggtgtgatcatgaccatgtgagctatctccatgccctgacggcaacttagtttttagggtcattgaaaataaattttaaattttaagtggatctgatttctgagttttcagttttaattttatagttattttccatgatgagaaattatatttcactgtgattaagctatagactcctatatcagagaagacaagttgagcttacctcaaatttggtactcaggtaagaaaaagtatatatcataattgaggagtagacaaaattactgagagctctaaaacttagtgatgagagcgttgggtagtttccttcatagagctcacagttagtgattgtgaagttttattctcctttctccgatgccaccaggactgagaatctgaattggttagtacccatttgacaatgtttagtttgtgtcaatttgcagactggtgtaactagtatcccacactggtgtgaaaaaaaatatgcacattagcagttggggtgtaaaagtaacttttctcctgagataacaatatatatacataaaatacatttagtgggccccttaggttttgtagatggatctatagttttatatacttggttaggagatttttctcttcagagacaatttcaaacaggcacatttctattcacaggattattctgagtcaggggaaaagaaggatttgtctttggttggatctgtgctgagaagaaatatatttagattttactgtacagctaacaggctaggcaaatacaatacctggcatttatataaatgcttgttgaatctgtgaatgactaaacaaagcccttttgtttactaggagaaggtaagctcctccagagcaaggagttggttttataaactcaaatatatttagcatctagaacagcaagcagttgggtgaataaatgagaacaatctatttattcatttatcatcacattgatggggaaacctggcccaccatagggaaggttgtgcacttggtcagtgttacagctgggatttagtttagtgtagtactctacactgtactatgatggcccttttgacttatgaagtatgagtcataggtgtgaatatcaggcagaaaacattcagaaagattaatcgtcttgtataaattcttccaagtggctccagaagcagatatcccatgttgccagctgtcttttcaacaaggacagttttggtatgttttggtctttgggtagtgggggctgtttgctgaaatgtgatgttcctatgtcaatacagcagaaagtgtctttacattagccatataaaggtatagttcgttcagtggtagtgatttggttttctttattttgttaaacttgtcaggcacaagaccagttgcacaatgccctgaatcttaataggcacgatctgacttatataatgctggggaagatccacttgctggagggagacttggacaaggccattgaagtctacaagaaagcagtggagtaagtgtatctgtttcctttaaaacagtgagaaactaaaaaaattgagtggatatgtgaactcccaagcctaaaagagtgaatatgtttgattaattacttactgtatgagttaaaggttaagctgaagtttaagagctcccagtagcttcaataaggtagactgtgtttctttcttacctataaggatgactgctgctttaggttagctgggcagctctattctacaaggtcagccagggatccaggtttcttccttattaactcaccattccttaggctgttgtctttacctgcatggttgatgctgaatgtaacatccacatccaggctgtggtggaaggagatggtttgggaagctaagcatggaataagcatctggctatatatatatatatatatagagagagagagagagagagagagagacatgatcttactccatcactcaggctggagtgcagtggagaacacagctcactgcagcctcaacctcttgggctaaagcaatcttcctacctcagcctcccaagtagttgggactacaggcatgtgccaccatgcccagctaatttaaaaaaaaaaactgtttttgtgttgacagggtcttgctgtgttgcccaggctggtcttaaacttctgggctcaagcgatcctcctgcctcagccttccaaagtgctggaattacaggtgtgagccactgcacctggccttggtaataagttttaaatgacccagaaattgcacacatcgttcctgcttacattccatggttcaaaactacatgatagttacaagggaagtgggcagacatgcactcaagaagaaggaaataacagatttaagagttggccgacagtctgccattttggtatcatatgttaataacagatcttctgttttcagagatattattagggacagaaatctcctgattcagtaaaaaacaaaacaaaacaaaacaaaacatttggccttattagcatgagaccagtatcttttttcccccttccccattttcccttccccttccccgttttccccttccctttccccgttttcccttcccccttttctcttccccctttccctttcccccttcccccttcccccttcctcttccccttcctccttccctcttcccccatcccccttcccccatccccctttccccatccccctttccccatccccctttccccatccccctttccccatccccctttccccatccccctttccccatccccctttccccatcccccttccccctttccccttccccctttccccttcctcctttcccttccccctttccccttttcccatctcccttcccctttcccctccctctctcccttccttcctttttctctcttttctttccatcctttccctccctcccattcccatctttctttgtttctttcttttcttcctttcttccttcctttctttccttcctttcatttatttcaacagtctcgctctgtcgcccaggggtgagtgcagtggcgcgatctcgcctcactgcaacctctgcctcctgggttcaagcgattctcatgcctcagcctcctgagtagctgggactgcacgagcacgccaccacccctggctaatgtttgtatttttagcagagacagggtttcaccatgttggtcaggctggtctcgaattcctggcctcaagtgatctgcttgccttggtctcccatagtgctgggattgcaggcgtgaaccactgcgcccagccttgtgttgttacttttaaatgggatagctgtagcaaaatgccttgtctcatttgtttggtcccttaatagaatgtctggtctgtggttcaaggcttattattcctaataattagattctgaactaaacttagatttctattaatttgttaatcatctttgtcttctaccatggtagtaaattttctggttatatcagtcacagcactgctttctgaattttcttcaaccatattttgtgtctaaaacagaaaaatcccttggtttgttaagctacagaacagacttttgtcatcaagaggctgtatatttgggcaagtagtaaggagccatgtaacatgttcagtgcctctgtggtgctaggtagtagccctgatccctgacccctgccttctagaggttagctctttgagaatagcatacataaatcccaaggggaacattcttccagtaactgatcaaggactttggtcactaaatttcctaagggagaaatgtggacagctaaaatctgaagccttactgagaagatagagaccattgttcatgacctacagctttgaagagagtagtcatgttgtagtggggaagccaatattgctagaattacagaagttacctggctttggggagggaagtgatcaaagtggatgtttattatggcagaaagtgaaaggcggattcccagttgaattgagaaagctctgtttggtcagctcaggcctcccctggctggggctttgcatcttctggttcaggtcttcctataggtaaccagtgccctatatcattccttagaagcagaagacattgttcatagccctttggtgttttactgttgaaactgtctgatgatcctatggtcagatcatctcaactcagtgttgccttggttttgtgacaaagacaaatactagtgagggattgagcaggcaatccctgatgtgagtattttacttacatcagtgtttactcccaaaggtcagtagcaccttctttcctaggattggtatgtatcttccttcttttgtttagtttggctacttggtatagctctttgtttaagtggagagaacagcattaggggccttgggatcctaaattacatagaaaattatgctgcctggcattgtgagcacaatgaggatagaaaaaaaattccacaagagaggactggtgaaactgtgtgtgttctaggctgacttggtttataaagcattgttctttaattttatcagtgtgaccaagacagtcatgcaaaacattctataggttctttcttaggacttttaccctaagaaaggaatctgaattctaagcctcatttttcttgctgagcagttctccttatcaccagggttgagatgacctacttttgatggcaattcccaaattgccttcaggtatttccacggggaggaagaggctcagtggggtctgtcaagtattgcacgagggcatattactgtgcatgtgtcttcgtgtttctcatctacatcttgtttccctctgagcatctctatgttgcaggttctcaccagaaaatacagagcttcttacaactttaggattactctacttacaggtaatgaaaactctgtactcattcatgcactgatgttagaaatggttttgggtttgtgtgtatggtggttttcctgcattctgatatttattttattaaaggtcatataaagttcatgaactacactctctctattcgatactctttgctaaaggaattaattttctgcatttaaattggaagcaattctattttagcctagtgcaattataattcttatctaggctgggtgtggtctcatgcctgtaatcccagcaatttgggaggctgaggctggtggatcacttgagctcaggagttggagaccagcctgggtaacatagtgagaccctgtctctacaaaaaataaaaaaattagccaggcatggtggcatgcttctgtagtcccagctacttgggaggctgtgatgggaagattgcttgaactcggaaggcagaggttgcagtgagctgagattgagtcactgcactccatcctgggtgacagagccagatcctgtctcagaaaaaaaaaaaaattcttatgctatccaggaaagagcatatatgagaaataactctggtcttggaggctgttattttgttgtgaggagagaaacagatacaagtgagcacttagggctttggggcaaagccatttcttttgatctttcttcccagccagagtcttattggaaagagagaaggcaaagtatacttttatctagaataagaagttttctgtcccctcaacattcctgaatgtgaatgggattcttttagctccattgattctctggctgaggacccagggcccaggtatccaaggggcttttccctcttccccaatatacacatttgccaagttccttggtcagctgattctgcctccagccctgcctctgtggtggcctttatgtctatttcatttttctttaaaaggaatcaggagcttaaccctgggtcttcctgggctttggcttgggaggttggctccacgggagatgaggatacccagctcatttcctgcaaagaggcattaatgtggaacagtactagtgtggcagagatggttcttatcaaatagatactttgaccttatcaggtgacaaattaacaaaaatagaaggaaaaccatgactggggatttttagttttctttctttattatctggtaactgtagctgctttttttttttttttttttttttttaaagtcaagagaactcaaaaaagccagagcatttctgttctgggtgaggttggccagactgtttttttttttttttttttggagacggagtttcactctttttgcctaggctagagtgcaatggcgtgatctcggctcactgcaacctctgcctcctgggttcaagcgattctcctgcctcagcctcccaagtagctgggattacaggcatgtgccaccatgcctgggtaattttgtatttttagtagagatggggtttctccatgttggtcaggctggtctcgaactcctgacctcaggtgatccacccaccttagcctcccaaagtgctgggattataggcattagccaccacgcctggtctggccagactcttttaactgccgtctccttgctgatgtaaattgtcttgtttgctttttttccaagctcggcatttaccagaaggcatttgaacatcttggcaatgcactgacttatgaccctaccaactacaaggtattacaggctgtgaaggctctggccttcatatagacggtcccactgctcctagaggtgatctgaccctggaaagcaaaggaatagcttcttaaatttggatacctgagaaatagaaaaaatataaataaaaggtggctcttcttatttgaaaatagtgtcaagtatgctctacttatcttctaaaagtgcacatttgttataatagacgtgtaacccctgcagaaggcagatcatagtgctagtaaagcttatgtgttacttaggaaattagcaatgcctccacaactattgtcaaaaataaatctgcggcccggcgcggtggctcacgcctgtaatcccagcactttgggaggctgaggtgggcagatcacgaggtcaggagatcgagaccatcctggctaacacagtgaaaccccgtctctactaaaaatacaaaaaaattagccgggcgtggtggcgggcgcctgtagtcccagctcctcgggaggctgaggcaggagaatggcgtgaacccgggaggcagagcttgcagtgagctgagatcacgcgccactgcactccagcctgggtgacagagcgagactctgtctcaaaaaaaaaaaaaataaaaaataaaaaaaataaatctgctgggcatggtggcttatgcctgtaatcccagcactttggaatgctgaggcaggaggatcacttgaggccaggagttcaagaccaggctgggccacatagtgagacccccatttctacaaaaaaaattatccaggcatggtggcacacacctgtagtcctagccactcggaaggtggaagagggaagatcacttgagcccaggagtttgagtctacagtgggctatgatggcaccactatactccagcctgggtgacagagaccctgtctctaaaaagaaacaataattatgttgaaatgacttctagagtcctaatgatttgatactacaactttttttctagatgtgactttgggaatgagaaggaatagcatcaaatggatgaacatcattgaggagatgcagcaagacaagctgtttattaaaggatacaaactgaattctgatttaggaagtaacattagactgtcagctcccaccttgatacctttccttagagaaatgaaagggctgggctgatgaagcctaaagctgactcgccctctgttttacggtagaaagaaatttaccttaagtagccacgtacaggtgtatttcaggtatctagaacacttggtataccaaataggggctgcagagaacagattaaaggaagtttttacttaaagggctctggtattcattctgaaatactgactttcctggctagaagtaggaaacagatgggtaaagcaagtaacattttatctttttttttttttttttttttttttttttttgtgctgtgccagagagccacagtgtagagtgcaaggacattcctcaggaacatttgtcccaataggttggatatatttatgtccctggaagaaattttccagtcccatctatgctgatgggcctgctgagtatagactcaggaaagctgccccactgctacagccttttgggaatgactgaatgactttctctgtgccatgttttcaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggtgagtgtcccctcatgttctttgtttgtatttctacatgtggttattgggtctgtttagcttgcccttctcattgagtgccccttctctctcataggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcaggtaagaaacatttatgtggaaaactctctctgccatctgtaatgagggaaaaatggattagaatcatagaagatcagtggctgtctcataggagccattcccttagagatcctgtaggaatctggattactgtcctggagcttgaagaaatagaaaaagatgacaaaggaacttggttgtttctaacttgggggagtttgactcagagaccaacaggttaaataaagatcatccctagttcaccttttaccagttttttcctcttgccttgacaattcatttatgtatatattgagtccaactaagttccagacagcaagtgttaagagcttgggttttaggtagggtcctgcctctactacttattatatgtacctagggctgatgtgaggattgcatgattaagctctcaattaataatactggttttgttgaaatactgatttttgaaaactgttggttttactgtggttatataattggtctattattatcaatattgttgttactataattggcccctaggtgatacttccaagtcaagctaccttatgttgaaacccttatctcttctgagcatgttatatagaatgccattctcttcctgaaactccattttatgccatgcaaatactaaaattgatcataaaaataagttaaaattaatcaaacactttaacaattatgcacaaccattttaaagtactgactagtctttctaggaatttttttctccatatacatttacttactaaatgtaagacccaaagcagatttccatgtcctcatttggcagtcgtcttccagtggctttttgttcattactgtgggttcttatttaaaagagaaagcttgcaaaagcaattgtggttatttgagggttgcctgaatacaaagataactttaaaaaaaaaacataggttttattattattcagatatggtatgggcaacagatcagaagacatctgccactggaaagatagtctgttacaattcctgagaaggagggcatgctacaccgtgcagggccacatggggaagcaccaggtcaatcaggaggtagagggagcaaggggtaaatgtgggcacaattctttattgtagttttcatgggtagaaatgccctccccggggcaagaccgggaaagcaggttaaccaggttggggattggccagtttgaataatttcagtgggctctgggctatagggctgtctctaggtgtctggtacctgaccctcgggtgactaggactagggaatattggcccagtgtcagggcccagtaaaggaggcagttaagaatatgaacactgggttggtcggtctgcatacagaaggtactcttgtaggggttatatctaggaattagctgactgtgggagggacagtctccccagggtcagtaaggccccagatgtcaaaacatcagaataaaaaggctaaagtggggtgtgatggtacatacctgtagtgctggctacttgggaggctaaggcaggaagtttgcttaagcccaggagttgggagtacagcctgggcaacacagtgagactccattcctctctctttttttaaaaattttattttaggttcaggggtacatgtgcatcctgttacacaggcacgtgtgtcatggggattagttgtacagattatttcatcacccaggtactaagcctagtacccaatagttatttttttctggccctccccctcctccagtaagctccagtgtctgtttccctctgtgtctccatgtgttctcatcatttagctcttatagtgagaacatgcaggatttggttttctatcctttattaatttgctaaggatggtggcctccagctccatctatgttgctgcaaaggacacgatcttgttcttttgtatggctgtgtcgtattccatggtgtacatttacattttgtttatccagtctaccattgatgggcatttaggttgatttcacatctttgctattgtgaatagtgctgcattgaacacacacatgcatgtgtctttatggcagaacgatttacattcctttgggcatatacccagtaatgggattgctgggtcgaagggtagttgtatttttagctctttggggaattgccagattgctttccacaatggttgaactaatttacactcccatcaacagtgtataagcattcccttttctctgcagcctcaccaggatgttatattttgagtttttaataatagccattttgactggtgtgagatggttatctcactgtggtttcaatttgcatttctctaatcagtgatagagtttttcatatgcttgttggctgcatacatgacttcttttgaagtgtctgtttatgtcctttgcccattttaatgggattgtattcttcttgtaaatttgcttaagttccttatagatcctggatattagacctgcatggtttgcaaatattttctcccattttgtacattgtctgtttactgtgttgatagtttctttagatagctgggttctaatggaacacagaaatgtaaacagccataatgtaagagataacagcgatgctaactttacaaagtagagatggcattcaaactggatcctgaacaacaagctaaaatggaatagcacagaatggctgaggagccactgtgaagaaaggcatgcagccatgaaactgcagtgtcccttgctgttagtgggggttagtgttagagaatatgatgggagatgaatcaggaaagatattctggggtcagattatggaggtcatgcgtacagtgcaaggactttatcttagaggccatgtttgtccagctgtcttcctagatctcctcttaggtgcctggtaggagtgagtgcatagctggtggggaggtggaatgggcagggcttccagagcagctgtttttgttttatatattaggtgtcaaggaaatactgattttaaaaagtggggggagtgttttactgctaaatgaaagtgtaaagatcatggttatagatgtggggggccagtgaggattcctaagtaggatggtaatgtggtcagatttgtaaggcagtgagatacctggcagcgctgtggaaggtggaatggaggcaggtggggactttgacactggggaataaatggaaagcctaaaactacttgggcctgaacaagggcagtgtcagaaaagaaactgcaaaaaaaggatgcatagaacctggcaactgattgactgtagaagagatggttgaagatagcaccaggtatctaagctgacttagtaaactctggtgccatgagctgacagggtgaagtttactttgggggtagtctttaatactccttttgtcttctaagctgagctctccagctgcagtgctttctttgttgcagtggctctgaccaatctggaagatatagaaaatgccaagagagcctacgcagaagcagtccacctggataagtatgcactttgttgagaatggtactggcgggggttggactctccaaagccatgaggtggtgccatacatagcattggtgctgcctgtgtcagcccagctgttcctctatggcattagtacatagcagacctcagtgtggagggatgtgtctcctaagtatgtggtggctcagcaggaattgacactctgagaaaatgtttccagtcctaaactgagtaatcaggaggctagagaatgtcagaactggcagtgggcttgggttgctgatagctatgggctagctggaatatcagatgggactctgggctgtttaattcaagataaaacttgactcttccaggatttactccgctggcatcttctagacagcagggtagagatccctttttcaaccctggcctaggtagtctctgttgagggctgagatgccagatttggtcccaataccagctttgcttgttaggccattaactccttgattcttctccacaggtctgcttagcacgtatgtacctaccttgctgcataatggagaaatctctacttaaccagttttgttttgtttttgtgtaatgagaaggatctctaaatgaccatttgttgcagagcccccagctccatagaatctctgtctgccacaggtgtaaccctttagtaaacctgaactatgctgtgctgctgtacaaccagggcgagaagaagaacgccctggcccaatatcaggagatggagaagaaagtcagcctactcaaggacaatagctctctggaatttgactctgaggtatgtcttttattagctcccaagagtcataagtaagctctcaggagacttttaaaaatcaagcccagatcatccaaatccaaggtattacacgttcatggctgttctggctttgatgttcctagcagcatgagttcatcaattaataacagcctgagaaaaactttcctagaataataataaaaggaaattcaggcttactgagttgttattgctaattcaactcatcaaagttgaggtctgtgtctgtctgtagcttccttctatttcactttttttttttttttttttttgagacggaatctcgctctgttgcccaggctggagtgcaatggcgcaatctcagttcactgcaacctccgcctcctgggttcaagcaattctcctgcctcagccttccaagtagctgggactacaggcgcgtgccaccacgcccagctaatttttgtatttttagtagagacggggtttcaccatgttggccaggatggtcttgatctcttgacctcgtgatccacgtgcccagccctatttcacttgttgtaggaaatgcactgtttggcccggtaatgcaccaggcttgaattgttgggttttgagatcctatgtgaaccaccatgccatccagtaaaggcaatctgtaatctctactgtttgataagtacttcctgcctcaactgctagtacgaccagacactatttcagctaaaaccccagctcgaagaccaaagaagtgggttggcttgtctctgacagtcacgcttttgattcttttacttcctttgtggacacaagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtaggaccatacagagctccatgaagacctggcaggtacaagccacatgtgtctgtcagcagagattatagctttcagtgaggttctcttcagactcatatgtccaacgtagtattggccacaaggggagaaaaaaaacacagggtggctaaattggcacttgtttccttaaggcgagctatgtagtaggtaacagctactcacagacttagttggatggtctatacactggtctttccaattttagcaatatgttattaagtatatcctgttatgcaatgtttaatttttactgctttatcagaagttgacacgtaaatatttttcagtgactcattgaaggcaaacttgactgttgctttatttctcagttatagtcttcccttatagttaatgggtcagtcccactggttccagaaaatatggggtttcctcttgaactctaacagcaaaaaagaatgatttcttctgaaattgtggaacatgaggattcaagtttttattttgttactaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaacctatga

SEQ ID NO: 947 - DNA, 35221 bp, Homo sapiens
gaacaggtgggaacaagttttcttagaaactgttatgaaggaggagccctccacccccacccccacatcttttactatctgacatgttatcagatcagaggccttcagcctcagcaacatctggggattagagggaccccacacagctggggcctcagaccaagctgatccatgcctgtggggtggaggggaaatcctcctgggaaaaatatgtgcaaggccctacaggcccaggaaaggctgaccaaggcaaggtgagtcatggtgttctaagctgaatcttttgcccatctcacagaagcaggcaggaagcaccaccattgatcagctttatatggcacccactgtatacaacagacagacaaagacagacagacagagcacacaccacttctaagctcaacactgctcaccaactagaagcacctcggttaagcacatgtgagacactcttgcataggaaagatgtagtttttaaaggaatgaagaagtattttggcaaaacatctacttccctcccaggtctggggtaaagagggacctctaattctgaagcttctacatattgaaaaatttccccttctcaatggcagtatatacagtagcaaaccttccaagtctgttgtcacagccctctacagatatcctgaatctactttacaggtgggcaaacttagactaagagacagaaggtagcctggagcaaggggacactgggactggttcaaggggaagggaaacaggaggtgtctcagctcagccaaaggcagggcctctgtctacctggattggcaagggaaaggctcaggtggccagaactccctctttcttcccgcctggggaagcagtggttccacaggaaaggcaatcccactcttgctggctagggggcctcccgggatggcaaaggccagggccaacctgagctctgcctggggcctcttctgggatgcactctgagtttggggattgtggattgtgggttcactgcttccataacgttctcattacctgcatgtgagcctagacctcaaatccttaattatttttaaaagggcagggtgggggagtggcttaagagggaatgagacacagaacaatctttccacagcccccatctgcctaggctggggctgtcaagggtctccttcaccctgtctcctagggatatttaaaggcagcttttatgagactctatactgtctttttttgtagttgtttgtcttgttttttgtttgtttgtttctttgttttaatttatatagatatatatattcttaaaaaagcaatagtcctttggtccctaaactctaaggaatgatatgattttgaaagaagtaaatctgggcttcccttgcggagaagcccttggcacccccaacgccctctgctggttcccctggacagtcactcctcaccagccctatttgctctgccagcctgcgctctatgctgcaggcacagaacaacccacttgataaaaacaatccttagagtggccttagccccaggcaccagccttgggtccgatccacctccgtccgcagctgctccttcgggaagggctgctcaagcgtttctgtgcttttcctctcctttcttctcactcttctgtttctgttgttgtgtattaattgataaggagagataggggggaaaaggcaagaatcaccttggagggcaagaccagaagagcagcttgcccccatgagtgacgtctcaggtgagtggctggacctctcttcctgaggagtagggctgcagcaggacccaggcagcagccccgtccactgaagccagacttgagtcctgagcaaaagaccccaaccccacatcccctctagaaggttcctggggtagctcaaagtgaggcagggccatgtgggccttctgagacagaaaatctctaaaagttgcaggcagcatcctatggacccatgaccttgccaaaaatgtagaagaacttggcccatctttctccccatcacccaccaggccctgcagattctacctctgaagcatgtttgcttctcttcctccatctccatgttcactgccactatctcagcccttacttctagtcctttctctgcttaagctcctcaacagttcattctcatcttcaggataaagtccaaactcatggcctgaagacccttgaaaactggcccaaagctacttttctagtctcattttccagtctcctggaccctccccgcatacaggttctctactctcattggctgtctctggagtagaactgcttctccaggcagaaagactctgattgtctctcctagactgcggggcaggaatgttgtccaattgatctccttggattgaaggaaaagcaaagtctccatctgaggtttcctcctagctcctggctcttctctctatcccagactttctcagaggtgggtgcctccaaggtcccaaaaggaggaccatcaaagctgggagggcctcatcactcaggcctcatctacctggggtccatcagggactcacctttctgtggctggtcagtgaaagcaggtcagtaaggccggttggcatccttgggccgctttagctggaccttgagcctcttcatgccaatttgaaagccattcatcgcctgaatagcagtctgggcactagttggattgtcaaaactaacaaaccctggagggtgtgggcaaagagattagctggggactctgcctagcagggcctcctttctctctgaccagccccctcctcttccagccccgtcaggccagttccatcaaacacatacccctccactgtttgtgtggatacagagtcataggcagatggcctgagattcctaaaggtgtgattcttggaaggataggaagcaactctgagtgtgtgtgcagggtcagtgtgttgatttggatgtttccgtgtttttcctggcatgggttggctttctccctccacagctcccattctggtcctcagaaccatagttggagttggaggggatctttggtctcagaaccagactcctcctgccctggccagactccaaagctctgacctagctggccacattcctggtggacacatgatcatcccaggtaaacctgaaataaagctcgttctttttttttttttttgagatggagtcttgctctggggcccaggctggagtgtgcagtggtgccatcacaattcactgcaaactttccctctcggattcaagaaattctcctgcctcagcctcctgagtagctgggattacaggcacccatcaccacgcccagctaatttttgtatttttagtggagacgggatttcgccatgttggccaggctagtcccaaactcctgacctcaagtgattcacctgccctggcctcccaaagtgctaggattacaggcgtgagccaccatgcccggccaaggcttgttgttggcctaaacttaggcccatcactggtttgtgaccctgttttgtgccatacattcaatctcaggaaatcactgcattatggaagggcaatcgtagggtctgtaggaaatcctttatagtcagaggtgggagaggcctaggggtaggttctcagctcaccaaaacacttgctctggttggtggctcgatccacaaagactttagcagagacaacggctccaaagggcaggaatgtctgtatgagttccgcatcaccaaactcctgaggcaggtgatagatgaagaggttacagccttcggggcctggaggaacagtagcaagctggttcaggggaaggaccctgagtccagccccaccaggttctgctgtccagcccccagtccctcaccttctctctgctgctggggcagggctgaaggctgctggggaaaagctgtgctcactggggcataggccgacggataggctgctggagacagaggtgggagtggacagtgatccccaggagcccttccccaagcagggccccaactgcctggccgcttttgaccaattcagcccagtccaccataaccctcaccccaagagaggtcgttctgggggtaggaggggatgggaggatcaactccttggaacagagcctaaatcccccacaactctccctatttctttctagggcccttcaacctcccccaggccgcgtagcgccaagtgaaacctgcgtagtggtgcatcccagcgtaggcctgctgcagggggtcagccacgccggggctctgggctggggagagaggggcgcgaggcccacagtgaaggcaagcgggcgagcagagtgggtgagaagctcagggagtgtgggaggtggacggcggctgtgagagacagcagggaaggagggggatctcttcccagggaagccaggccctaaccccccaccccccgctccccactccatttcggggggatttgggcggagcggggggcccacctggataaggggagagcccgttattgtagagcgtgtcggagcccggctggccattggtctggggggtcagagggccgaatccattgaccccgatgggcgccggaagacctgggagggtgccagggccgctgccaggcggggagttggctgctgatggcggaaaaggtctgagagtcaggccgccaccccgccccgcccggcccctcccaggcgcgccccagtccctgggggccgtacctgccgcgggcaacagaggcgcagctaccaggctaaaggccgccacgtgttgcatctgggccgccactgccgccaccgggcctaggcctgggccctgtgccgccgccagcagggccgcctggtgctgcaggatctttgagaggaaagatgggcgagagtggagggccaaggggcaggcagctgcccgtgctctcagccccaggcctggcccacccacctgcgcgccctcgcacgcaggtgcccggtacctaccgccgtggtgtaggcgccgcaggcccctagcggcagtggcgcggggtggaaggcgcccaggtggccggccatctgctgcatccgccgcagcgcgcgctcccggtcggtgtccgccagcttgaccacgaggctggacgaggcgccctgggcagggcaggggaggccgtggtgaccggtcctgaccctggccccggcccggggccgagcgcctttcccatcaggtcctttcgcggggcaccgagcacactcggggaggagaagcccgtccccaccccactggcctcaccctcagcccagggaacccgccctcaccgccatggtccggctgccgtgcagaccccggatggccgcctgagcttccccttgactcccgaacttcacaaaggcacagcctggggcaggacagagggagcgggtggctcaggccacaggggccaaagagttatgtggcccagagtgaggaagggtcaccaggaaatcccggggtcagctcaggtcacctttactggtgccgtcaggactccgcaggaccgtgcactcctcgatgtggccaaagggctggaacaggcgtctgacgtcctcctcaccctgctgcttgcccagcatccccacaaacagctttcggtcctctggggacaaagccaggaatgacctggggaccccaagtcttcctagacccccgagagtagcctgaggaacttaggaaggcagctcaccagtctcactctgggaagcagagggagtgagaaggccctgggcttccagggttggttttcattgaggggcaggatctggggaagggatctggagaagggagctcagctcagctttccatcaggaaaacctgggtcctggggaaacccagagaggctcagggctgctcttgtggggagtaatgcagtcttgatatctctggctgggtagagccctatatgcattgttttacatgtttgacctttctgttcttagaggttgggaaacgctgttttggaccatttctgtactattaaggaagcgggtgctcagagaaagcctttctattcagactgggtccagagaagagaagtacatccttgctggtcagcctgatagtgctggctagaatcaatgccccttcctgctaatatcaaggagggttctggatttagaaacagcacagaaaacagtcctgtcatcctactgcctcatctttaggcactgagcactggcatgatgaatccttaccctctgcaccacatccaacctggatgcccctcccaaaggcctacagagagcaggaccttggtttcctgagcctccaacattagcatttttcctactacagttgctgaacccctgacccctttccttaactcccacctccaccaccctgtcccttcagcaagcttctagtgccctgtctgtatccttccctctgattcccctgtcctcttgccctgatgcctcccaaaatgttcatgctatgagagaacaagttctgcctatagacctggattgccaccagagaaccagtctgattcctccctgtgtccaccctttctatgggagtggcagaaatgcaggaaaggggctgcaagctgggcctgtgtccctcgaagaaagctggagagctggggctggaaactagggttttgccgcacatccagcaagttaggcctcaggaacactctgggagcgtggggtagaggggtccagcctgctgttaaagtctggggctcttctctgcaccaaggtaaatctctgaatttgggatggggcttgaccatgtaggggacaatacaagttgggagagaaggagtgggtaggaaactggtttcaggcttcatcttcaagaccttggagtgcaggaaaacccatcctaaatggttctactccttgaccagcttggctaggcagatgggggtccttggattctgagtgcagggaaaacaaggctagtggggggtcatagactgaagcctgggtgacagcgaaggaagaacagactgttcaaaactgaacgaagttagcaggggagaaatctccaacaagactatgtgtgtgtccatatgtcacccgggtggtgtggggtttggcctaggctgccttggggatcctgaagtgtctgtctgtctgacgatgctatgtctgtgtggagggcaggggctgcagttcataaggggcaggcaaaatgtgttttagcaaaattctgccgtctgtccagagaggtaccatccgatgatccttggagaggggatggataatggacttgtggctggaattctgatggaggaaagaaggtctcaccagtgaccttctgtggtgagagtacaacctggtgggtgtactttgcttctgggggtgtcagccacagaatagtgcccttggaacagatcactggtttcccaaccttttgaaaaatcagtggaatacattgttctaacataaatattaggatgaagctcaaaatgtaagagaaaaatagaactgctgtgactgaagccagaaaaggaggggtggagttcatcttgcttgatcctcccctaatactccctagaggggctccaaggaaagccctttgaaattactgacctagaagatagagaacagagttccagctgttgtttgaggggggatctgagatcatcctgttcaggagcctgagaagacaggaaaggtctttcatgagtctctcaaccaatctgatggctttgccttgacattggagaatgggctcatttggccagagaatcaaaccccgaaagaccatgccattgttctaagttattctgggctgcagaaggcctgggagaggctggagaagagtctagggcctccatagtcccaaggggggcttcacaatgccctaatttgtagtggagctgtgtcattgggcagggtctgaaaaatggtgatggcaccccaataagatatcataccacatggaccagaatccaggtagccttgtgtaggaagagagacatcacaggctgagatagagcccataagacagaaaagaggtttgtactgacagtggtgatctgatccttcatctgctctgcctcttgttgctttttctgctgatggtgaaattttccgatcctcttttccagtgagaatctcacaagttaagaattttcagcagggcgcagtggctcacgcctataatcccagtgctttgggaggccaaggtgggctgatcacttgaggtcgggggtttgagaccagcctggccaacatggtaaaaccccatctctactaaaaatataaaaatagccaggcgtggtggcacatgcctataatcccagctattcaggagactgaggtgggaaaatggcttggacctaggaggcggaggttacagtgagccgagattgtaccactgcactccagcctgggcgacagagtgagactccaactaaaaaaatttttttttccatttccctgtcagggcactgaccctatggatctggactactgggatgtacagagtttggaatggaaatgagtatctaccatggggtgggctctaggctcctgtttcccaggtatcaccttaaatcctggtatcctctttgccactttacagggaccttgattgtgtttgacaggaggataagctggatcacagtggtcatgagcctcaggtgacccagaaatggtgggataagtttcttaagagacccggccaaagagaagtacatgctggacccctaacagtagccccgcaaacccacagatctgaacattctgatggctgatcattgattgcctccaaagagagatgatgatgggatgtagcccagataattcagtttcctctagatcaaattctatcatttggataaaaagcggacgctacaagaggcaagtcagaaatgtctgaataaaagtatcccatgagtggtgggtagtatcctagaaagatgggaatatcaaacatggacgctcaaccttcctggagtggaaagtattagaaggcagcatcagcgcagagttgagacatagttggaatgccatatggttgaatggtataactgcattttcctgttggcaaccgatgtatacttcttaatcttctatcaaatgcttttttttttttttttgacactgagtcttgctctgtcacccaagctggagagcaatggcacgatctcggctcactgcaatctcctcctcccaggttcaagtgattctcctgcctcagcctcctgagtagctggattataggtgcacgccaccatgcccagctaatttttgtattttttagtagagacagggtttcaccgtgttggccatgctggtctcaaactcctgacctcaggtgatccgcccgcccaggcctcccacagtgcttgggatttcatgtgtgagccaccacacccagtctcaaatgctttttgagtccaaaacaagtggcttaggctcccagaggcccatctccatgaagctgccttgtgcagctggtcatataggtcagggattcgaatgcagcaaatgatggggttgacatcccagtaatcatagcagaatcaatccagactacttcttcagaaagggcaccaggatgctgttcaaggaaggagcgtctgcctcatgttgctccaaagaaattcctaagttgttcaagtttcttgttttctaggccactcacaccaaatcacctccatgttggtgaaatgtaatgattgtagggacagtgtaaggaaaggtccagccttcgggtaccaactaccagacacatcctaaaaatactggtccatttttcaatgtaaatgccaacccagaaagtcttgctggtggcagtaattgtattacagcaaagcaactctctcctgatactcttagtgacgactgcagcataagaagccacggggaaagtgacagaaggaagtagccaggacgagaagagtctcctggccagatgtgacaggcatcaggagggacttaaattccacacacaaaaaaactgttagaacaaataacccaattcagcaaagttgcaagaaataaaattgacacacaaaaaatcagttgtgtttctacacactagcaatgaacaatctgaaaatgaaatgaagtgaaagcaaaagccagcacggtggctcacgcctataatcccagcactttgggaggccaacgtgggtggatcacatgaggtcaggagttcaagaccaggctggccaacatagtgaaaccctgtctctactaaaaatgcaaaaattagccaggcatggtggcatgtgtctgtagtcccagctactcgcaaggctgaggcaggagaatctcttgaacctgggaggtggaggttgcagtgagctgagattgtgccgctgcactcctgcctgggagacagagtgagactgtgtctcaaaaaaaaaaaaaaaaagagatgaaagcaaacaattctatttgcaatagcatcgaaaagaataaaacacttggaggccgggcatggtggctcacgcctgtaaacccagcactttgggaggccgaggtgggtggatcacctgaggtcaggagtttgagaccagcttggccaacagggcaaaatcctgtctccactaaaaatacaaaaattagccgtgtgtaggtggcaagcacctgtaatcccagctacttggggggctgaggcaggagaatcgcttgaacctgggaggtggaggtttgcagtgagccgagattgagccactgcactccagcctgggtgacagagtaagactgtttcaaaatacataaataaataataagataaaataaaatacttgggaataaacttaacccaggaggtgaaagactcatacactgaaaactacaaaatgttgctaaaagaaattaagaggccaggcgtggtggctcacgcttgtaatcccagcactttgggaggccgaggcgggcagatcatgaggtcaggagtttgagaccagcctggccaacatagtgaaaccccatctctactaaaaatacaaagaaattagctgggcgtggtggtgggtgcctgtaatcccagctactcaggaggctgaggcagaattgcttgaacccaggatgcagaggttgcagtgagccgagatcacgccactgcactccagcctgggtgatagtgcaagactctgtctcaaaaaaaaaaaaaaaaaaattaagaagacacaaataaatgaaaagacaatctgtgttcatggattcgaagacttaatattgctaagatgtcaatactactccaagtgatctacagatttaatgtaatctctataaactcccaatggcattttttgcagaaatagaaaaatccatcctaaaattcatatggaatctcaagggactccaaatacccagcaatcttgaagaagaagaagaactccctgttttcaaaacatattacacagctatagtaatcggcactatggtactggcataaagataaatatatagaccaatggaatagaacagaaatcccagaaataaactctcttacatatggtcaaatgattttcaacaagggaggcaaggtcattcaataaggaaaggacagtcttttcaacaaatggggttgggaaaaatggatatctacaaaagaatgaagttagactcttacctttcaccatatacacaagattaactgaaaatggatgagtcctaaatgtaagagctaaaacaatagatgtcttagaaaactgaggggaaaaagatttcctgacaggatttggcaatgatttcttggatatgacaccaaaagcacaggcaacaaaagtaaaaataaataaattggactgactacatcaaaattaaaaactttaacaaggatctattggagggcaaaaataaaaaactagaaaacttctgtccatcaaaagacacaactcacagaatgaaaaagcaacctctggaatgggagaacacatttgcaaacaatatatcaagataagaggttaacatccagaatatataaagaactcgtacaactaaatggtaacaacaacaataccaacaacagaaaacaccaaaccttctatttaataatgggcaaaggatttgtatagatgtttctgcaaagaagaaatacaaatgggcaacaagcataagaaaagatgctcaaaatgactaattgttaaggaaatgcaaatcaaaactacaatgagatatcacccacctcacaccgattaggatgactgctatcaaagaaacagaaaatcacagcgttggcgaggatgtggagaaattggaactcttgcacactgttgataggaatgtaaaatagtgtcgctgctacagaaagcagtatggcagttcttcaaaaaattaaaaatagaattaccatatgatctagcaataccttttctgggaatatatccaaaaacattgaaagcagggtcttttcaaaaattaatctataattttatttcaattgaccaataataattttatatatttatggggtacaatgtgatgctttgatatatgtagacattgtgaaatgattaaatggagctaattaacatattcttcaccttgcctacttatcacttttttatggtgaagatgattgaactctattagcaattttgaagtgcatattgcattattattaactacagtctccatgctatgcaatagatcactaaaacttcatccttctgtttaactacaactttgtatcctttgactaacatctcccctttctccatactgtaacccccctgccgcccctaacttctgccaaccaccatcctactctctgcttctatgagctccacttttttaggttccacacgtaagtgagataatgcaatgtttgtctttctgtgcctgggaaaacaagatcttgaagaaatcttttgtacacccatattcataacaacattagttacaatagccaaaaggttgaaggtacccaaatatccaacagatgaacggataaacaaaatgtggtatatacaaacaaagaactattattctgtcttaaaaaggaaggaaattctgacacatcctacaacgtgaatgaaacttgaagataggctaagtgaaataagccagtcacaaaaggacaaatactgtatgattccacttacataaggtatctagagtagtcaaactcacagaaataaatagaatgatggttgccatgctgacggaaattgggaaatggagaatcatttaatggatacagagttactgtttctgcaagaagaaaaagttctgaggattggttatacaatgtgaatgtacttagctctagtaactgtacccctaaaagtgttatgacaatcagctttgggtgatctgctctgagccaagcctaaggaaagcacctctcattacctttgtgggtagaatgcatttcaggaagtgaagagttaatgtgaggaaagggtcaagtagtacaggtgaaatctatccaatcttagttggaaaatactttttagaattaaattcatctaaggaccaataacaggtatgactgtcaactgactgtgacagaacagttgttgctaaggtctatttctgatttaggccacggaatatgtcccagtactatgaaattctgaaaattctacctcaaaattcaattttaactcaaagattagttgttaaacactgaataaagtggaatcctagaaagaacttggaaaagatggctctgctagtgagatagtcatatatgcattatgtttatactcaaaatccaggctgacatctaatcaaacccttgcaaattcaggcagaaattacttacgcaattataggatagtgataggagggttaattggataacagataattggcttttgagttgaaccaaattgcaagactgaaaaacgagatgcctcaaaatatattttaaaatcctcagagaatgttttaagtttgaacgttaaaagaaaataactgaagtggaaagagtgcatggattgattacctaacctatttctgtaccttaggcatcttggatacatgaatatttgctgagtaaaggacacagccaagttgagaagtggaacaagcagagcaatcaccattgtgatttatgtattgattctatgctatgaaatttgaaagaggaaagaatatacaattcaataatttttaatattttgctttaggactaaaaactacttttcctataagatcggtacttatagtttaacttattggtgtttccaaagtagagaaaatataagtgaggaaaaatcaactacagtccctatgccgaacagcaaataaaacagacttatttagttaccattgtctgagggatttggggatccttatttctgacctcatataatttgtggttaacattttaaaaatacgtgaacctaggccaggcacagtggatcatgcctgtaatcccagtactttgggaggctgaggccggtaaatcacttgaggtcaggagttcaagaccagcctgggcaacatggtgaaaccccatttctactaaaaatgcaaaaattggcagggtgcggtagcaggcgcctctagttccagctactcgggagggtgaggcaggagaatctcttgaacccaggaagtggagttgtaccttgcagtgagccgagttgtaccttgcagtgagccgagatcatgccaccgcactccagcctgggcaacagagcgagactccatttcaaaaacaaaacaaaacaacacaacaacaacaaaaatacatgaaccttgaatttttacccatacaaacattttaatgttcatgttcaaatgcacacaaatgctgagggaaaaggttttttgttttttctttttttttttttttgaaatggaatctcgctctgttgttcaggctggagtgcagtggcatgatctcggctcactgcaacctccgcctcctgggttcaagtgattctcctgccttagcctcccaagtagctgggattacaggcacacaccaccaagcccggctaatttttttgtattttagtagagacagggtttcactgtgttgcccaggctggtcttgaactcctgagctcagccaatccacccgcctcggcctcccaaaatgctaggattacaggcgtgagccaccacgcccagtcctgaggaaaaggtttttgacactatgtgtatttaatgtatgttaggagatagtttcattttagaaagttagatgcattttcctttaatagtgtactgctcaatgtgtagctgccacaggatgtaaaatataggcctggagtgtggagtataggaacagcgtggaacttagctacagaatttatgcaaactcactggaatacattaaaaggctgctataatatatccacaaagacccagatgcacctctggtactctgagaaaagtgttgccaaggctgcgggagatggccatgacagaaaaggaccttgacatcttccatcaggcagatcctggtgtattgctaatattaattgtattgcaggcatcgaattaacaagtgttaccaataactattaaaagtaatacaacaggggccgggcacggtggttcttgcctgtaatcccaacgttttgggaaggcaacgtgggaggatcatttgaagccaagagtttgagaccagccagggcaacaaagtgagactctgtccctacaaaaaataaaaatacaaaaattagctgggcatagtggcatgcacctgtagtcctagctactcagggggctgaggcagggggatcacttgagcccaggagttcaaggctgcagtgagctatgatggtgccactgcattctagcctgggcaacagagtgaaacactgtctctaaaaaaaaaaaaaaaagtaaataaacagacaaatcagtaaataaataaaaatcataaaatatacaatatgtatgttggttatttcaaccacaaacctcatgtttattgattaaaagtaagactactagtacactgttacatcaaaagtcaagtgacagaagacaaagtagctatttttgtaaaaaagctaggttgggcgtggtggctcacacctgtaatcccagcactttgggaggccgaggcagacagatcatttgtggtcagcagttcaagaccagcctggccaacatggcgaaacctcgtctctactaaaaatacaaaaattagctgggcgtgctagtgggcacctgttatcacagctactcaggaggctgaggcaggagaattgcttgaacccaggaggcagaggttgcgttgagtggagatggcgccactgtactccagcctgggcgacagagtgaaactccatctcaaaaagaaaaaaaaaaaaactcatgtgtgcacaatgtaatcctgctttatggcagatggaaaaagaagcaattatgataggtttggtaggctctcacagtgctggtctatttttaaaaattgaattagttgccaacatttaatacagctaaaatgattttttttttttaagacagggtctcattcattcacctaggctggagtgcagtagcgccatcttagctcactgcagcctcgaactcctgggctcaagtgatcctcctgcctcagcctcccgagtagctgggtagctgggactaaagatgtatgccaccacacccagctaatttttgcatattttttgcagagacagggcttcaccatgttgcccaggctggtctcaaacttgtgagctcaagtcatcctcccgccttggcctcctaaagtgctgggattacaggcaccagcccacatgcccagctgtaaattattttattaaaacatgggagtctcatccatttaaggttacctacctgggctcctgtagtatttgagctgatgatccctacttgatgggaagaaaaatcatgcataatcccttccagaagaaactggaaggttttggaagaatatgttggccttgatatcccttagattgttttcattgacatcagtactcttatcggataaagaaaccattattaaccaatggtaaactaagggatttaatttcaggaataattttagaagacacaggcttactggcgtaaatatatctggtcaggtgtgtgtgaccattgactctgacagtttatagaatgtttgaggtcacagatataagacttaaatgggacacgctgttccacgttgttgccaaatgttacattttaaaagcaaaatccaataccattttaaaaagttgattttttttttttttttttttgagacagagtctcactctgtcacccaggctggagtgcagtggtgcgatcttggctcactgcaagctccgcctgctgggttcacgccgttctcccgtctcagcctcctgagtagatgggactacatgcgcccgccaccacacctggctaattattgtatttttagtagagatggggtttcaccgtgttaaccaagatggtcttgatctcctgacctcgtgatccgcccgcctcggcctcccaaagtgctgggattacaggcgtgagccactgctcccagccaaaaagttgactttctaaagcattaggttgtgttaaaattcagcagagggttgaactcactttagaagagatatatgatagcactgaagaaaatacattttgattagtaatgattatctaacacagatctgttagtattaaaatacttataaattgtaaaggcccaactgttctgcaagactggatacataggccttttctctcctgaatatatagtagggagcagggaggaattgagagatctggtcatccaaacctgcaagaaggattattcatggatgcatttggagtgtatgcttcttgagagccaccacttgtccagaaatatctgtgtaacacaactgctaaattatgagttctgctgccaggcaatactctttttcagctagatttgcttttcctgctcttttaaacaggtgtataggtggaaatgccatatgtacagaattttttaatgatgtgacacctgcaaagtttatacaaaaatgtggaaagaaaattctacaactcaagctgatgtcattgcttagagcccagaccaccagaacacatcaaccaggccaagcaaaagcactatcagcatggaggccccctttgtgcggctgcccaaacactgacaagatgtagtggactccatacagcaggagtgccctagcattgtggacttagttcctgagcaagactccaaattgcaccacgttcttctgagctctggggcctgcggacatgctcttcctctgcccaacatgcttgctccctctctcctcttttctctgactacttcctattcatccttgaggtctcagcttaaatattactcctctgggaacccactttgatcttccagactgggttaggtgccccttgtttgtgtccccacaattcccctggacttccccttgaaagcagtgatcacactgaattgtgttcccttgtttacttgtccatatcctctcatagcatccgtgcttcatgaggccaggtaccaggtctgctttgctcacatctgtattcctgctgtggagtaagttgctcagaagatgttggttgtgtggttgaacctgtctgcttcacagctcactcacatactcttagttggcttctcagctgtgggactggctcatggttgtgggcagggcttagtagttggccaacaatggccttgatgcataaaagagtttcccaagaggcagaaattcttgggttacatgaacatgaagttttgcatgcagcctggaacatctcaaaaacctgactggaaagaataaaaagggaaaggagaatgtgtgtgtggatggaggaggaaacttggaaatatctctccaagacaaggtgaaggtgataacattttgaccagaaatcaagaatcagagaccagaggtcagagaatctaaaaggataatggaagtatttcttggaggaacgaacttcacagtggaaccacaaagtcaccagaactctgtgtgtgggttctcagactgagcatgaagtctgagaggggtacagaattagtaggactcaatacatgtttatatcaattgggttccattctgttcctgaactcgggcagcttctttcagctagcaaagccatggctgatcttgggttagacaggaagagagtcttacccaagataaagagtcagcagacatcagggagggctataggctgatacactggaaggatctaagatgcaagggtgagaaaaacaccaagaactgacaccagaatccagccttgcctttacagcttggaagctggccagaacccagctggttagaagaaagcacaggctctctaaccgtcctatgtggttttgtttttgtttttgtttttgttttgatacagagtcatgctctgttgcccaggctggagtgcaatggcgtgatctcggctcactacaacctccgcctcccaggtttaagcgattctcctgcctcagcctccctgcctcagcctccgagtagctgggattacaggcatccactaccacacccggctaatttatctatttgtagtagagacgaggtttcaccatgttgcccaggctggtctcgaactcttggcctcaaatgatccacccacctcagcctcccaaagtgctgggattataggtatgagccaccgtgctcagcccacctcctgttcttaaggagctctgttttttctctaccaggaaacagtgtagctatcagagctttccatggtcctcagcatagaggacttactatggcccataaagtctgtcgtaccagccttatcttttaccatgagcagctaggcaattacaatgaaggaatggcctcaatccgaaacggactgtgttttctgatatcagaaggatatggagaaggagaataacccccacctgattcttaaaaacaacaacaacaacgaaaccctgaaagttccatgtggcaaaacaggaatgatctctctccaagggtaagtggcaagaaccccctttctctatcactggcatctgtttaggcccttcttgcctcttctgggcctgggctccccagaaccccagccctgctcagtctgagcagggaaggctgagctatttctggggctcagcaactctgagccccacctgtccccttgacccagggaggctctcatactaaatgggtaggacagactccaggtgtgggcccaccctcccttacacgggttgcagcctgaggttggtcagacagggaagttacctcctcggccctcactggcagctggcttcacttggatcggacgattcatctgaaagacatcggaccaacacacccattcagcgtgactgcctggtcctggagcccccagcttctcgaaccctggactcctcaggatctgagccctagcccctttgaactctgcactctaccacttccaaactgggattacagattttctccaagattccttccttaaacccaggaatttagaaggtgctgaaactggcagggatgggtgacaggaacttagtggcaagcacaaggtggaatgaagcggctaaagagacttttctgcctggggctctgggcaggggctatgtgaggcctgtccctttggcttctggacttacttaaaggctttgcatgagaggattgggaaggagggtagaattgatactgcagatttgtgttttatgtctaaaatggagaatatcacgctatgtgtcatttagatgagagtctgggaatcagactcagtgctatctgccctcaactctagtcatttaatggttgtatgactttaagtaagccaccttttctcagattcaatttttctttttctcctgtgtagctgaaattacaggcacgtgccaccaggcccggctgatttttgtatttttagtagagacagggtttctccatgttggctaagttattcttgaactcctgacctcaaatgattcacccgcctcagcctcccaaagtgctgggattacaggcgtgagccactgcgcccggccagattcaatttttcaaatgaggaaaacatttcccaagctgctgtatcactagagtctccacgctcacctgctccatcccctccctagggtccccttccctgaggatgctggagttttccaaggtgccgttctcagccctttttgtctggctcttcctacttttcttggatagtctcatccacactcagcctcagctcctctccacacagggatgacttagagctctgtgtctccagcctgcattctcctctgagcttcagagccatgttaccagctgcctgctggacatccccactagaaagtcccacgggcgccttcactcaacacacccaaacgagagctcatttgtttttttttttttttgccccaacctgatcctcccagtcacccaagctataagcctggaaagcagcttgacttctccttccatcccttccccgctcccaccaacttcatcttttaattcaggggttcctgaggaagtgtagataaaaatcacccaggaaccagatgaggctcttaagttggggtattgcataatttgaaaacgctcctaggtgatttcaatatatcgcccccacatccccatcccccaaccaccctgagtgaattcatgattgaatccccatctcaccttcctctcatgggtgttgtggggatcacatgaggtaatggggacgcaaaaggtctttgtaaactgccaagagctgggtgcgtgggaggtgaggaattattgttggggggcaggcagctgagtgccaggagggaaaaacagcggccttcccgttcatggaggaaggggtactgatgcccatctggcctgagaaggtgatgatctgaccccctcccctcaagaaatgctctgcttctgcaccaatcaggggccactccatcccttaccaatttgctcgttgccgagacaacaggcagcttcctgttaccatagccacaagtgctacccagtaaccatggtaacgccctggcagtcacagttgagcaatttcctttggatcaaatttgggggtgggaggggcagggagggcttactaaaaaaaaaaaaaaaaaaggaaaagagaacaggccaagtctgaaccagcgcaactcccctcccacccagggctctgacacacccacccgctggtggtggagcacctgcagtgtaccaggctgtgggtgggggcggagacaccaacaggactcaggttgcagtctagaggggatgacagatcaatccaagcagatcagggcgagcttgacaggtctggactggcctggaccagggaccaggaggacaggacccgtccctgggcatggccacctgtgattgtggaggaaagaccaagagacagagccatggagagcagagacacagggagagatgaagaaacactggcagacagaaatgatgtgagagaaagacagttctagaaaggggcaaggaaagagagttactggtggagaggggaaggaaatgaggagaggaagggtaaggaagcgggtgcaggagaggcagggaggagcctggtagggaagaaggccaaaagagtagaagcctggggtggggggcagtgagggtgagcaagaccatcattattttattagttcttaaatagatcctgagaatttctctctggagcctagagtgacgagcacacgtgacagcagcagtttccatggcagctgcctccctggctgggtttcctgggagatggtgctctgggggacgccaccttctctcctcccacccacttccccacccttcaacagagagtgggcatcgggtggtacatacatgttcccccctggacctgacctaggcctcccaccacccaggcatgctgccagcatttcctgaactctgtgatgagccccaggcagcctttcgtgggagacagtgatgatctgtatggggatcctctcttcataggctcgcagaggggaagataatgttaccatttcctgagagcccactctgtgccaggcccttcctgggacactttacatacattgtctctaaatccttccaaccactcttcaagggaatacaagtgtccccatatcatagatgagaaagctgaggctgagggaggtgaaatcacttgtctaagatcccatggtgggtaagtggttgagctgggatttacccccagatctgtctgaggctgaagcccatgatttttgcactggagtgctgctcaaatccattcttaaggcatgaacacaaatagtgaggcacagagggaccagggcctcgggggagtgcaaggtcaagagctgtggaagaggcagactccagctgaagaggttgactgaggaaagctgcatagaagaggcaatgtttgacctgagccttgcaggactggggtcattggccatgtagagataataggagaggtaggagtggtggctgagcacgctgaatggctagggtacggacagggagctgcaatggctagggtacggacagggagctgcaagcctgaaggagcaaagtttctagtgagcacttggcatgggagtagccatggtagagcaaattgcttcctagcagatagatgtggatttcaatcctggctctaccacttgcttctctaaggtctctgagcctcaatatccacactagtgaagagggaatcatgatcttaacttgcagcgttgtgatgaaaatgacaactgctagatcttagtagatacctcagatataaaaagttattgtttttttttgtttgtttgttttttgagtcagagttttgctcttgttgcccaggctggagtgcaatggcgtaatctcgcctcaccgaaacctctgcctcccaattcaagcaagtctcctgcctcagcctcccgagtagctgggattacaggcatgcgccaccatgcccggctaattttgtatttttagtaaagacggggtttctccatgttggtcaggttggtcttgaactcccgacctcaggtgatctgcctgcctcggcctcccaaagtgctgggattacaggtgtgagccaccgcacctggccggtttttgttgttgttattgttgttaaggatatgaaactgaaaggtaggcaagggccagattagggaaggctgtgaaaaccgcatcaaggaattttgacttttgactttgttgtatttcaaaggcaatgaggatccaggggagggaaggatttttaaatgtttttttttaaacatttttatttatttatttattttggagactgagtctcactctatcacccaggttggagtgcagtggcgcgatctcagctcactgcaatctccgcctcccaggttcaagcaattctcctgcctctgcctcctgagtagctgggattacagacacccaccaccatgcccagctaatttttgtatttttagtagagacggtttcaccatgttggccagactggtctcaaactcctgacctgtggtcttactctgctacccaggctggagtacagtggcgccatcatagctcactgcaaactccaaatcttgggctaagcgattattctacttcagcctctcaaatagctaggaatacaggtacatgccaccatgcccagctaatttttaaattttttgtagagactgggtctcactatgttgcccaggatggtctcaaacttctgggctcaagcgatccttggacttcatcctttcaaagtgctgggattacaggtgtgagccgctatgcccagacaggaaagggttttaagtagaggaatcatctagtcagttttgtcttatgaaggatcccataagctgtcactatgtggagaaaggattggaaaaggagtgattagaggcaagaagatcagtggcacaggtgagaggtgaatgtgacctggatagaaagaaatgaacagatttaacagatgtgtaggaagaattaactgggctatagttctattggatatgtggacccgggaagaggagggcatattggctgagcctcaggttcatcgcttgggagttggggaaggtgggagtttgggagtttgggggtacaaggaagtccccaggggaggaacccaagagagtaagaacagagttggggagagcagggctctgagccttcagtccccacagagcagtggtgatggaggacacctgggatttaggcatgttatgtgtggctggaggagaaagagagctgcccccatgagcttcctgggcaacctattatatatatcttgttcctgccatgggcagaggagggacatggcagtgggataatcaggacgtaatcaggagtcccccttgaggaaaagaggacattgcctcccaggccaaaaacttgtcctgggacttcaggtgagctcttgccctggctgagcacctgttcccttaagaatttcccaggtggagtccaggcccatgtctgcttcagagcccagccctggaggggaattcaagggatagaatgtcagagagaacaacctattccaggcaatggagtgggaaaggtcagaggccgcacagacacgcacagggccctggaccttctgccccagtgagcagaagggagagcaaaaccctacctaactctctgccctgatttgtctaaaattcctccctttgggctcagcattgcccttttcagattcttctgccctgatgccaactattcttttcactgagcactcacaccctcagcactccccattccatgggaagagtttatcagaaccttcttgaggaagggaacactggtaggtctgggaaaggtgtcaggaggtgcagggcagagtgggacagaaaaaaaccaaactttctaatttttagtactttgttttacctcacccccctcctctaattcaacccactgtcaagtcccattggttctagaatctatatggatatcctaaacagctctgaaatctaacctcttatctcctttcctggcctatctccagctctaggccagcatcaccattcatccacactcaagcaacactgcactaaagggtcatccagcctgcagtgttgcttcctttccaacccaaccttcttcacaccatagccagagtaatcttttttttttttttttgagacagcgtcgacctccagggctcaagcaaccctcccacctcagcctcccaagtagctgggactacaggggcacaccaccacacctggctaatttttaaaaaacttttgtagagacggggtctcactatgttgtccaggctggtctcaaacttctgggctcagcgatcctccagtctcagcctcccaaagtgctgggattacaggcatgagccactatgtctggcccagagtaatcttttgaacctagtctcttactcttctctgcttaaaatccacctctgttcccccattgcaagcctcctgttaaagcccaagattctaagactagctgtcaaaacttgtgagtctttcttccactgctgcccaacatgcacgattctctctactcatgtggagccttagctatctttgctagacaccttccctgccagtgttcacactgtccccaaattttcttgtcttttaggtttctagatcctcaaatatgataaaatatgatcatgattcagctcagataacatctctgcaaagcatctactccctccccatttctttttattcttttctttattcctttatttatttatttatttttattttgtatttttgtatttttagtagagacggggtttcaccatgttggccaggctggtctcaaactcctgacctcaagtgatccgcccgcctcagcctcccaaagcgctgggattacaagtgtgaaccaccgcacccggccttttcctttacggtttgactctgggactccctccccaattctggtctctcttttacttgcccagatgtatgcctgagtgagatgcaatgaggctcaccttttttctttttttttttttttgagacagagtctcgctctgtcacccaggctggagtgcagcgatgcgatcttggctcactgcaagctccgcctcccaggttcacgcctttctcctgcctcagcctcccgagtagctgggactacaggcgctcgccatcacgccctgctaattttttgtatttttagtagagacggggtttcactgtgttagccaggatggtctcaatctcctgacctcgtgatccgcccgcctcagcctcccaaagtgctgggattacaggcgtgagccactgcacccggccaatgagactcatttttaagaagcatcttgagggcaaagactcagactcattcatgaagtggttgctagcacatacagtgcctttctgtaaattataaaaaggcactccccaaccctgggatgaatgagaaaaaatgtgccctttcctctgggctgacaaagccttgaaataatgtgcatgacttagtcaatagagcatggctggatttttgcccccatctgccctctctacccaagctgttttgtgcagggcacaacttgcaaaagcaaatgtactcccctactcagtaacatctgccttcttcacagcgtttgaagggatggcttcccaaagaaagggaagtcaggaacagggagataaacaaatagggaggcaccttatgcatctcgtaagtggggctgaggctaggcctcaccctcttcaggtggattctggagcataaagtgaggctaaaagaaggaattctggcttcatcaggaagaggctgcaggaggtgggagccaggtgggacagaccaaccaaggtttgaaggagttctcgaatagggaggcaagctttcataggggacagaaattggcaggggacaaatggagaggagccaagcaaaagaaggtcttagtcaatcagaatccatgaaattcttggccaggagtggtggctcacgcctgtaatcctagcactttgagaggctgaagcgggcagatcacttgaagtcaggagttcaaaaccagcctgaccaacatggtgaaaccctgtctctactaaaaatacaaaaaaattagcttggcgcggtgatgggtgcctgtaatcccagctacttgggaggctgaggcaggagaatcacttgaaccctggaggtggaggttgcagtgagctgagatggcaccactgcactccagcctgggtgacagaatgaggctgtgtctcaaaaaaacacaaaaaacaaaaaacaaaccatgaaattccccctagggtttcagacttttctctctgggggctgacctagccttttctggtcccatggtgacagtcctgcctgatgccagcaggaattcagattaaagtcttgtccctgcttctccagcaggtggcagctgtgctcaggacccaatggcagcagagagctgggcactcctcctccatgctggtgggcctaaggccaggcgactaaagttgctgctgtccctggcaggcccagaggaaagattgatggcacaggcattgctggggctggccaacacagccattgattttcatttaggagaataattaaatattaattttcactttgttaagctggagagggtgaataaagccaatcctgacagtatcagaggaagccaggccatgttggagacctgcagatgaaacagtgagagggggaagatgtccccagtcaccattctctctagaacctaagacccctgtctgctacctggttgtctcaggtcacagtacagtggttaagtgaatgagttctagggccagattagctgggcccaaagtccagatcttcccattattaactatatgaccttgggcaagtcacttgattcttatgacttagttttctcacctgtaaaatgggaatgccaataacaataccttatttaggcctggtgcggtggctcatgcctgtaatcccagcattttgggaagccaaggtgggtggatcacttgaggccagaagttcaagactagcctggccaacatggtgaaacctcatctctactaaaattacaaaaattagttgggcagagccctgtgtcttgtggaggagagatttttttcctcccaaagtttatcttaatttttttgggggggacctcccatttcctttcagggtaaagcctggcattcaaagtttcatcttcaactgctgccctctgtagatcttccctccagcttccctccatgctcacgtgggcctcccccacagtgccagccgcatttcacacccacctgttccttctgtgtctgcacctttaccatgctgtttcccacatggaatgttacagcttgtctcattgactctcagttctagaagcagaagtcatttgctcccatgattagatgaatgatgagttctactcctactcctactaatgctgctgttactattactgttactatcactactaccaccagctaactcatatcgagtgcttattttctgccaagaacagcattgagtactttagttcacttaatgacttagctcatttaaccacgacaacaaccctatgagtttaactttacaggtgaggaaacttaggcttagcagtaaagacttgcccaaagtcacaaagctagtgagtggtgggcctggatccacacccaggtctctctgactcaggagcttgcatacagaggaccagtgatggtgacaaattggtgttacttggcacttagtccccaaaagtgaggctaaaggtgcttcagttactgtgcttggttctaggagctgtcaccccattaacagcttgattagctcttggcgaagcttgctccattgcttggtagctccaattcagagaagtgacttctttatactgagctgaaatcagtgcctatttcttattatattaactgatccgaatcttgccttctgggatcactcatagaaaaccaaacccctcttctagaatctgaaggtagttaccccaaccccaacagtagtacttattgagatcttactctgtgccaggcacttgctaagcctcaagtaatcctcactacagccaagcgagctaggtgttagtataacccactcctcatatctaaagagactgaagctcaggagtccaagtaacgtgcccagagacacagaactgataaatggcagagctgggattcaaatccaggtctgtgagactcaaaacccagtgtttttttttttttttttttttttgagactgagtctcactttgttgcccaagctggagtgcagtggcatgatcttggctcactgcaacctctgcctcccaggttcaagtgattctcttgcctcagccttccaagtagctgggactacaggcatctgccaccatgtctagctaatttttgtatttttagtagagacagggtttcaccatgttggccaggctggtctcgaactcctgacctcaggtgatctgcccgccttgtcctcccaaagtgctaggattacaggcgtgagccaccgcactcggcctcaaaaaccagtatttttaattattagcttatgatgcctccctattaaagtccctctaagccctatctcctccagttaaatcatcccaactcttccaaactattattccaaatatatcttgtgtctttacttcatcctcgtctctttcttgtagacaaacgactctcttaaatttgagaggcctagaactggacatagtcccaagtttggcctgtgaatggcatttaaacagtgctctgttctagacacaccgcttcttggacaagagaaaacaaggctgtatagtatgacttgctcttggtaaacccatgctagttactaacgatcacccctttattctgccatatggtcagtaggtcccaccttgccttttgttgactgattatccattagccaagaccagaccaggtaccattggtgcctacaagccaagctgcctgtagaatcaggtctcccctaactttagccaagtgtttgcagtgtggagggaagacaatcttagtgagtcaaggcaccaaaaataaccattacaggaaaaggactagagagaagttccagcaaggaccttaggactagagaaaatgggctaccagtccagcagaacctctaccccatgtatctgcatacatgctcacaccagtgacaagagacacccaaagccataattttaccaaggtgaataaattctagcttagccctcaacactgatgcctctcctaaaagatgggtggaacgcctggcccaaggatcttgagccccttttttgagccagaagattggatgtaacaaagaatttgttgctgttcagggtacaggaagccctctcctagaaagatgactctgcttctagttctcggtcccaacccagcccccacatgctgctttggcatgcacacagggcactgtccccagcctgaggtgattcccaccccccaacctggaggacttacccctggcagggtcttctgctcgtgcagtgcactctgggccttgagagcagagtcccgggcgcagtaggtgaggaaggcacagcctgaggaggaagaggctggctcagggggtttcctgaaacccccaactattcttcttcgaaataccccactaagttgacaaacttaaggccactctcctttaagcaaggactctgctttctgagaagccctctctgcctcccacctctggagggaggggcttcatgtgcctggggaccagtgtcccaggctctggctccctttcatttgctcctggcatcctgcccagagaacatatgtgcccacacccagtcacatgtgcatacaatcccacatctcccctccccactccagtcacaagtcctgttggggttaaacctccctaagcagctttatcatcatctttaacccagacttccccttcctttttggattcagactcatggagtctcccaggatcagcctcaattccttcccaactcagtttcggatgggaggaggcaaaagagtaaaagaaggattgggagccaaccccaggagcccccagctcttgtccatgtctccctcccctaagtttgaagctggggaatggattgatttgagacttagaagatgggattggtttaagggcttcccataggtgggagtttccagggaccccctaatcctgttcaaggatcttgatctgtcaaccctcctagggctttgaggtagggcctcttaaagagttattgtgcctcaaatctggctcctctaaaagggccagcatatatgggtcagcgaagaggtctaggttgagccaaagggtcaagtttagccctctgtttgttcagcctcaggacctgtagcctgctaggaagcactgaagcagcactctcctcctttccaacagccactgagcactcattcattcagaaaatatttattgaacacttacttattatggtggggcattttgatgaccttggagatagagtggcaacaagacacacattccctgccctcatggggattagacaaatcatgagggacccctaaacaagtccaaagggttgagtaatgtctcaaagaaggcactgagtcctcgagaacaagaacactgagtccttaacaatcaggtgatgaaaaggacagtgattatttcagacagagggaaaagcatatatgaagactgaatcaagaatttggtgtgttggggaaatggataggttagtgtggctggaggctggtgtatgggggcagagtggctagtgagatatgcaggaatcaagtcatatgtagccttgtgggcctcagttggattttgaactttttcctaagagcaatagagagccactttaaagggttttaagcagatctgtgagatgataagatctgttttcaaaaggagcattctgagtgtaggagggagaaggactgaaggaggagaaagtggatatggtgagccattaggaacttggggcagatttccacttagacctcagcagattagaaaggcaaatgggaacatttttttctggcctcttctacagggctgccccattaagatgggtttattgccggacattcattgagttaaagggaacttagagaactgagcaaaactcttatcacatcaacagggaaactgaagcccagagagtgggtcagtggcagggcaggatttggaatgtcttaactcccaagctggggttgttttcaaagcactgtggctgcctgcctcggtacccagacatcaaaaggaaaatgagtcactgtttctggggagaggatgaggaagatgttgacttggagaccctctacaatcatcttggaaggcaacacttgccttggagagttgtgatttagtttggaaataaatcaccaaacacctgattccacttacatccctgctctgtgttttgctaccaacccatatcacctgacgtccaaaccgggcaggttgcctgtctgaaaggctcaggggcccagttgctgcctaaagaagccccatgtggactagccgggatagagggtggaagaatgaagggaagaaaagacagagaagcatggtttgagagacagatgaatgaaaataacaggcagaattagagctaaatgaaaagagagaggatgagggaacagttcagagactgatagtgagaagagtgagatttaagggtattctatacacttcccttattgtacggatggcctacaaagattagctttgtatgtacatcctgaaatcaatgtctaaaaataagaaaatgagttactacagagggatggacagacaggcaggtagtgggagtgcattagaaggactctagatggtgaggtattgtcctttcatacacccattaacacaatcccagcccaaagggtggaagctgtactcctagccagatggtcctagctcttctattggcattttctcgaagtgcctacattagtgtgccaaggaaccctacgaggcctccaagttgaagaggtggcagtctgattccagctctcagtccttaggaatgtacctttagctgttacccaaggcccaccactcctctcttaggaagatcatggaggatagttggtgactctttcccagcaaaaacttgaaagcacagcatggtggtggtggtgggggaggagataagagtgttccttctcaaatcatctccccttctcctgcccatgtatgacatgtgactctggctctcttactccagccctgcctggacagacttttctgcatgtaaacaagcctcctccctctctctacaggaagaaaggggtgtggccgaacaggaccgtgtatctctctagaaagggcagggagaagatctccttctgtctcttcagcctgactcaccctgagaatgggcctggactgggaccagcctgtgaggggagggaaagaaagaggccataaagaggactggggaggagcaaagaagaggcacaggagtgaggggattagagaaggaaagaagtgtggatttagctgagagaaatccaagaagaaagggacacagggtggcaggagttcccagctgaggtcagggttctgaactgaaatcaaaagaggtagagtgcattgggattctggcgaagggcaggagagattggggctgttgttgaacatgagggggtgtctggaactgagagcctcctgggaattgaattggattttgtgttagacaggtctgggttctgaagaaggggagggtttgggtctgcggtgttttaggttggcagtctgagagtcaaaagaaggctcttgagggggatggccggactaggaggccagaggaggggtgcaagtccaagatatgcatgtgggtggttaggcctgagtgaggtgccaccagatggaggattcaggagtgtttgggctcagggtttgggaaattgagggtattcgagatctagaaggtggaataagttttcaaattccagaattttaggtctgatgggagaggtggtggaaaggtccaattgaaaggcagggactgctgggatgtgagaggtggaggccaggaatttggaggttagagtggagaacatgttaggggaccacagtgataatcagagggaggatgtcagagagaaaattctgtgatctgggaagggggctgggctgaggtggggctgatattggactggtgttggactggctctcggcagggctagggctggggctgggctggggtcgggccacactctaatcggattggggctgggctgggctgggctgaccccgcgcacctttgtggaggccggtgagccggtccttcagcaccgtcagctcgtagatgcggccgaactcctcgaacagcggcttgaggtcctgctcgtccaagccccgcgggatctgccccacgaagagcttgatggcgtcgtggtccttcatgggtacggcgggaccggggtttagcccgctcatgccgacgccgctgtccgcggtgctgaaacccaggcgcgggccggggccagcgggctgcgctgaccctcccggcgccgcggccatgtccccgccctgtcagccctcccgccggtcccactggtcccgcctgtcccgccgtcccctccctggaccggt

SEQ ID NO: 948 - DNA, 35459 bp, Homo sapiens
gaacaggtgggaacaagttttcttagaaactgttatgaaggaggagccctccacccccacccccacatcttttactatctgacatgttatcagatcagaggccttcagcctcagcaacatctggggattagagggaccccacacagctggggcctcagaccaagctgatccatgcctgtggggtggaggggaaatcctcctgggaaaaatatgtgcaaggccctacaggcccaggaaaggctgaccaaggcaaggtgagtcatggtgttctaagctgaatcttttgcccatctcacagaagcaggcaggaagcaccaccattgatcagctttatatggcacccactgtatacaacagacagacaaagacagacagacagagcacacaccacttctaagctcaacactgctcaccaactagaagcacctcggttaagcacatgtgagacactcttgcataggaaagatgtagtttttaaaggaatgaagaagtattttggcaaaacatctacttccctcccaggtctggggtaaagagggacctctaattctgaagcttctacatattgaaaaatttccccttctcaatggcagtatatacagtagcaaaccttccaagtctgttgtcacagccctctacagatatcctgaatctactttacaggtgggcaaacttagactaagagacagaaggtagcctggagcaaggggacactgggactggttcaaggggaagggaaacaggaggtgtctcagctcagccaaaggcagggcctctgtctacctggattggcaagggaaaggctcaggtggccagaactccctctttcttcccgcctggggaagcagtggttccacaggaaaggcaatcccactcttgctggctagggggcctcccgggatggcaaaggccagggccaacctgagctctgcctggggcctcttctgggatgcactctgagtttggggattgtggattgtgggttcactgcttccataacgttctcattacctgcatgtgagcctagacctcaaatccttaattatttttaaaagggcagggtgggggagtggcttaagagggaatgagacacagaacaatctttccacagcccccatctgcctaggctggggctgtcaagggtctccttcaccctgtctcctagggatatttaaaggcagcttttatgagactctatactgtctttttttgtagttgtttgtcttgttttttgtttgtttgtttctttgttttaatttatatagatatatatattcttaaaaaagcaatagtcctttggtccctaaactctaaggaatgatatgattttgaaagaagtaaatctgggcttcccttgcggagaagcccttggcacccccaacgccctctgctggttcccctggacagtcactcctcaccagccctatttgctctgccagcctgcgctctatgctgcaggcacagaacaacccacttgataaaaacaatccttagagtggccttagccccaggcaccagccttgggtccgatccacctccgtccgcagctgctccttcgggaagggctgctcaagcgtttctgtgcttttcctctcctttcttctcactcttctgtttctgttgttgtgtattaattgataaggagagataggggggaaaaggcaagaatcaccttggagggcaagaccagaagagcagcttgcccccatgagtgacgtctcaggtgagtggctggacctctcttcctgaggagtagggctgcagcaggacccaggcagcagccccgtccactgaagccagacttgagtcctgagcaaaagaccccaaccccacatcccctctagaaggttcctggggtagctcaaagtgaggcagggccatgtgggccttctgagacagaaaatctctaaaagttgcaggcagcatcctatggacccatgaccttgccaaaaatgtagaagaacttggcccatctttctccccatcacccaccaggccctgcagattctacctctgaagcatgtttgcttctcttcctccatctccatgttcactgccactatctcagcccttacttctagtcctttctctgcttaagctcctcaacagttcattctcatcttcaggataaagtccaaactcatggcctgaagacccttgaaaactggcccaaagctacttttctagtctcattttccagtctcctggaccctccccgcatacaggttctctactctcattggctgtctctggagtagaactgcttctccaggcagaaagactctgattgtctctcctagactgcggggcaggaatgttgtccaattgatctccttggattgaaggaaaagcaaagtctccatctgaggtttcctcctagctcctggctcttctctctatcccagactttctcagaggtgggtgcctccaaggtcccaaaaggaggaccatcaaagctgggagggcctcatcactcaggcctcatctacctggggtccatcagggactcacctttctgtggctggtcagtgaaagcaggtcagtaaggccggttggcatccttgggccgctttagctggaccttgagcctcttcatgccaatttgaaagccattcatcgcctgaatagcagtctgggcactagttggattgtcaaaactaacaaaccctggagggtgtgggcaaagagattagctggggactctgcctagcagggcctcctttctctctgaccagccccctcctcttccagccccgtcaggccagttccatcaaacacatacccctccactgtttgtgtggatacagagtcataggcagatggcctgagattcctaaaggtgtgattcttggaaggataggaagcaactctgagtgtgtgtgcagggtcagtgtgttgatttggatgtttccgtgtttttcctggcatgggttggctttctccctccacagctcccattctggtcctcagaaccatagttggagttggaggggatctttggtctcagaaccagactcctcctgccctggccagactccaaagctctgacctagctggccacattcctggtggacacatgatcatcccaggtaaacctgaaataaagctcgttctttttttttttttttgagatggagtcttgctctggggcccaggctggagtgtgcagtggtgccatcacaattcactgcaaactttccctctcggattcaagaaattctcctgcctcagcctcctgagtagctgggattacaggcacccatcaccacgcccagctaatttttgtatttttagtggagacgggatttcgccatgttggccaggctagtcccaaactcctgacctcaagtgattcacctgccctggcctcccaaagtgctaggattacaggcgtgagccaccatgcccggccaaggcttgttgttggcctaaacttaggcccatcactggtttgtgaccctgttttgtgccatacattcaatctcaggaaatcactgcattatggaagggcaatcgtagggtctgtaggaaatcctttatagtcagaggtgggagaggcctaggggtaggttctcagctcaccaaaacacttgctctggttggtggctcgatccacaaagactttagcagagacaacggctccaaagggcaggaatgtctgtatgagttccgcatcaccaaactcctgaggcaggtgatagatgaagaggttacagccttcggggcctggaggaacagtagcaagctggttcaggggaaggaccctgagtccagccccaccaggttctgctgtccagcccccagtccctcaccttctctctgctgctggggcagggctgaaggctgctggggaaaagctgtgctcactggggcataggccgacggataggctgctggagacagaggtgggagtggacagtgatccccaggagcccttccccaagcagggccccaactgcctggccgcttttgaccaattcagcccagtccaccataaccctcaccccaagagaggtcgttctgggggtaggaggggatgggaggatcaactccttggaacagagcctaaatcccccacaactctccctatttctttctagggcccttcaacctcccccaggccgcgtagcgccaagtgaaacctgcgtagtggtgcatcccagcgtaggcctgctgcagggggtcagccacgccggggctctgggctggggagagaggggcgcgaggcccacagtgaaggcaagcgggcgagcagagtgggtgagaagctcagggagtgtgggaggtggacggcggctgtgagagacagcagggaaggagggggatctcttcccagggaagccaggccctaaccccccaccccccgctccccactccatttcggggggatttgggcggagcggggggcccacctggataaggggagagcccgttattgtagagcgtgtcggagcccggctggccattggtctggggggtcagagggccgaatccattgaccccgatgggcgccggaagacctgggagggtgccagggccgctgccaggcggggagttggctgctgatggcggaaaaggtctgagagtcaggccgccaccccgccccgcccggcccctcccaggcgcgccccagtccctgggggccgtacctgccgcgggcaacagaggcgcagctaccaggctaaaggccgccacgtgttgcatctgggccgccactgccgccaccgggcctaggcctgggccctgtgccgccgccagcagggccgcctggtgctgcaggatctttgagaggaaagatgggcgagagtggagggccaaggggcaggcagctgcccgtgctctcagccccaggcctggcccacccacctgcgcgccctcgcacgcaggtgcccggtacctaccgccgtggtgtaggcgccgcaggcccctagcggcagtggcgcggggtggaaggcgcccaggtggccggccatctgctgcatccgccgcagcgcgcgctcccggtcggtgtccgccagcttgaccacgaggctggacgaggcgccctgggcagggcaggggaggccgtggtgaccggtcctgaccctggccccggcccggggccgagcgcctttcccatcaggtcctttcgcggggcaccgagcacactcggggaggagaagcccgtccccaccccactggcctcaccctcagcccagggaacccgccctcaccgccatggtccggctgccgtgcagaccccggatggccgcctgagcttccccttgactcccgaacttcacaaaggcacagcctggggcaggacagagggagcgggtggctcaggccacaggggccaaagagttatgtggcccagagtgaggaagggtcaccaggaaatcccggggtcagctcaggtcacctttactggtgccgtcaggactccgcaggaccgtgcactcctcgatgtggccaaagggctggaacaggcgtctgacgtcctcctcaccctgctgcttgcccagcatccccacaaacagctttcggtcctctggggacaaagccaggaatgacctggggaccccaagtcttcctagacccccgagagtagcctgaggaacttaggaaggcagctcaccagtctcactctgggaagcagagggagtgagaaggccctgggcttccagggttggttttcattgaggggcaggatctggggaagggatctggagaagggagctcagctcagctttccatcaggaaaacctgggtcctggggaaacccagagaggctcagggctgctcttgtggggagtaatgcagtcttgatatctctggctgggtagagccctatatgcattgttttacatgtttgacctttctgttcttagaggttgggaaacgctgttttggaccatttctgtactattaaggaagcgggtgctcagagaaagcctttctattcagactgggtccagagaagagaagtacatccttgctggtcagcctgatagtgctggctagaatcaatgccccttcctgctaatatcaaggagggttctggatttagaaacagcacagaaaacagtcctgtcatcctactgcctcatctttaggcactgagcactggcatgatgaatccttaccctctgcaccacatccaacctggatgcccctcccaaaggcctacagagagcaggaccttggtttcctgagcctccaacattagcatttttcctactacagttgctgaacccctgacccctttccttaactcccacctccaccaccctgtcccttcagcaagcttctagtgccctgtctgtatccttccctctgattcccctgtcctcttgccctgatgcctcccaaaatgttcatgctatgagagaacaagttctgcctatagacctggattgccaccagagaaccagtctgattcctccctgtgtccaccctttctatgggagtggcagaaatgcaggaaaggggctgcaagctgggcctgtgtccctcgaagaaagctggagagctggggctggaaactagggttttgccgcacatccagcaagttaggcctcaggaacactctgggagcgtggggtagaggggtccagcctgctgttaaagtctggggctcttctctgcaccaaggtaaatctctgaatttgggatggggcttgaccatgtaggggacaatacaagttgggagagaaggagtgggtaggaaactggtttcaggcttcatcttcaagaccttggagtgcaggaaaacccatcctaaatggttctactccttgaccagcttggctaggcagatgggggtccttggattctgagtgcagggaaaacaaggctagtggggggtcatagactgaagcctgggtgacagcgaaggaagaacagactgttcaaaactgaacgaagttagcaggggagaaatctccaacaagactatgtgtgtgtccatatgtcacccgggtggtgtggggtttggcctaggctgccttggggatcctgaagtgtctgtctgtctgacgatgctatgtctgtgtggagggcaggggctgcagttcataaggggcaggcaaaatgtgttttagcaaaattctgccgtctgtccagagaggtaccatccgatgatccttggagaggggatggataatggacttgtggctggaattctgatggaggaaagaaggtctcaccagtgaccttctgtggtgagagtacaacctggtgggtgtactttgcttctgggggtgtcagccacagaatagtgcccttggaacagatcactggtttcccaaccttttgaaaaatcagtggaatacattgttctaacataaatattaggatgaagctcaaaatgtaagagaaaaatagaactgctgtgactgaagccagaaaaggaggggtggagttcatcttgcttgatcctcccctaatactccctagaggggctccaaggaaagccctttgaaattactgacctagaagatagagaacagagttccagctgttgtttgaggggggatctgagatcatcctgttcaggagcctgagaagacaggaaaggtctttcatgagtctctcaaccaatctgatggctttgccttgacattggagaatgggctcatttggccagagaatcaaaccccgaaagaccatgccattgttctaagttattctgggctgcagaaggcctgggagaggctggagaagagtctagggcctccatagtcccaaggggggcttcacaatgccctaatttgtagtggagctgtgtcattgggcagggtctgaaaaatggtgatggcaccccaataagatatcataccacatggaccagaatccaggtagccttgtgtaggaagagagacatcacaggctgagatagagcccataagacagaaaagaggtttgtactgacagtggtgatctgatccttcatctgctctgcctcttgttgctttttctgctgatggtgaaattttccgatcctcttttccagtgagaatctcacaagttaagaattttcagcagggcgcagtggctcacgcctataatcccagtgctttgggaggccaaggtgggctgatcacttgaggtcgggggtttgagaccagcctggccaacatggtaaaaccccatctctactaaaaatataaaaatagccaggcgtggtggcacatgcctataatcccagctattcaggagactgaggtgggaaaatggcttggacctaggaggcggaggttacagtgagccgagattgtaccactgcactccagcctgggcgacagagtgagactccaactaaaaaaatttttttttccatttccctgtcagggcactgaccctatggatctggactactgggatgtacagagtttggaatggaaatgagtatctaccatggggtgggctctaggctcctgtttcccaggtatcaccttaaatcctggtatcctctttgccactttacagggaccttgattgtgtttgacaggaggataagctggatcacagtggtcatgagcctcaggtgacccagaaatggtgggataagtttcttaagagacccggccaaagagaagtacatgctggacccctaacagtagccccgcaaacccacagatctgaacattctgatggctgatcattgattgcctccaaagagagatgatgatgggatgtagcccagataattcagtttcctctagatcaaattctatcatttggataaaaagcggacgctacaagaggcaagtcagaaatgtctgaataaaagtatcccatgagtggtgggtagtatcctagaaagatgggaatatcaaacatggacgctcaaccttcctggagtggaaagtattagaaggcagcatcagcgcagagttgagacatagttggaatgccatatggttgaatggtataactgcattttcctgttggcaaccgatgtatacttcttaatcttctatcaaatgcttttttttttttttttgacactgagtcttgctctgtcacccaagctggagagcaatggcacgatctcggctcactgcaatctcctcctcccaggttcaagtgattctcctgcctcagcctcctgagtagctggattataggtgcacgccaccatgcccagctaatttttgtattttttagtagagacagggtttcaccgtgttggccatgctggtctcaaactcctgacctcaggtgatccgcccgcccaggcctcccacagtgcttgggatttcatgtgtgagccaccacacccagtctcaaatgctttttgagtccaaaacaagtggcttaggctcccagaggcccatctccatgaagctgccttgtgcagctggtcatataggtcagggattcgaatgcagcaaatgatggggttgacatcccagtaatcatagcagaatcaatccagactacttcttcagaaagggcaccaggatgctgttcaaggaaggagcgtctgcctcatgttgctccaaagaaattcctaagttgttcaagtttcttgttttctaggccactcacaccaaatcacctccatgttggtgaaatgtaatgattgtagggacagtgtaaggaaaggtccagccttcgggtaccaactaccagacacatcctaaaaatactggtccatttttcaatgtaaatgccaacccagaaagtcttgctggtggcagtaattgtattacagcaaagcaactctctcctgatactcttagtgacgactgcagcataagaagccacggggaaagtgacagaaggaagtagccaggacgagaagagtctcctggccagatgtgacaggcatcaggagggacttaaattccacacacaaaaaaactgttagaacaaataacccaattcagcaaagttgcaagaaataaaattgacacacaaaaaatcagttgtgtttctacacactagcaatgaacaatctgaaaatgaaatgaagtgaaagcaaaagccagcacggtggctcacgcctataatcccagcactttgggaggccaacgtgggtggatcacatgaggtcaggagttcaagaccaggctggccaacatagtgaaaccctgtctctactaaaaatgcaaaaattagccaggcatggtggcatgtgtctgtagtcccagctactcgcaaggctgaggcaggagaatctcttgaacctgggaggtggaggttgcagtgagctgagattgtgccgctgcactcctgcctgggagacagagtgagactgtgtctcaaaaaaaaaaaaaaaaagagatgaaagcaaacaattctatttgcaatagcatcgaaaagaataaaacacttggaggccgggcatggtggctcacgcctgtaaacccagcactttgggaggccgaggtgggtggatcacctgaggtcaggagtttgagaccagcttggccaacagggcaaaatcctgtctccactaaaaatacaaaaattagccgtgtgtaggtggcaagcacctgtaatcccagctacttggggggctgaggcaggagaatcgcttgaacctgggaggtggaggtttgcagtgagccgagattgagccactgcactccagcctgggtgacagagtaagactgtttcaaaatacataaataaataataagataaaataaaatacttgggaataaacttaacccaggaggtgaaagactcatacactgaaaactacaaaatgttgctaaaagaaattaagaggccaggcgtggtggctcacgcttgtaatcccagcactttgggaggccgaggcgggcagatcatgaggtcaggagtttgagaccagcctggccaacatagtgaaaccccatctctactaaaaatacaaagaaattagctgggcgtggtggtgggtgcctgtaatcccagctactcaggaggctgaggcagaattgcttgaacccaggatgcagaggttgcagtgagccgagatcacgccactgcactccagcctgggtgatagtgcaagactctgtctcaaaaaaaaaaaaaaaaaaattaagaagacacaaataaatgaaaagacaatctgtgttcatggattcgaagacttaatattgctaagatgtcaatactactccaagtgatctacagatttaatgtaatctctataaactcccaatggcattttttgcagaaatagaaaaatccatcctaaaattcatatggaatctcaagggactccaaatacccagcaatcttgaagaagaagaagaactccctgttttcaaaacatattacacagctatagtaatcggcactatggtactggcataaagataaatatatagaccaatggaatagaacagaaatcccagaaataaactctcttacatatggtcaaatgattttcaacaagggaggcaaggtcattcaataaggaaaggacagtcttttcaacaaatggggttgggaaaaatggatatctacaaaagaatgaagttagactcttacctttcaccatatacacaagattaactgaaaatggatgagtcctaaatgtaagagctaaaacaatagatgtcttagaaaactgaggggaaaaagatttcctgacaggatttggcaatgatttcttggatatgacaccaaaagcacaggcaacaaaagtaaaaataaataaattggactgactacatcaaaattaaaaactttaacaaggatctattggagggcaaaaataaaaaactagaaaacttctgtccatcaaaagacacaactcacagaatgaaaaagcaacctctggaatgggagaacacatttgcaaacaatatatcaagataagaggttaacatccagaatatataaagaactcgtacaactaaatggtaacaacaacaataccaacaacagaaaacaccaaaccttctatttaataatgggcaaaggatttgtatagatgtttctgcaaagaagaaatacaaatgggcaacaagcataagaaaagatgctcaaaatgactaattgttaaggaaatgcaaatcaaaactacaatgagatatcacccacctcacaccgattaggatgactgctatcaaagaaacagaaaatcacagcgttggcgaggatgtggagaaattggaactcttgcacactgttgataggaatgtaaaatagtgtcgctgctacagaaagcagtatggcagttcttcaaaaaattaaaaatagaattaccatatgatctagcaataccttttctgggaatatatccaaaaacattgaaagcagggtcttttcaaaaattaatctataattttatttcaattgaccaataataattttatatatttatggggtacaatgtgatgctttgatatatgtagacattgtgaaatgattaaatggagctaattaacatattcttcaccttgcctacttatcacttttttatggtgaagatgattgaactctattagcaattttgaagtgcatattgcattattattaactacagtctccatgctatgcaatagatcactaaaacttcatccttctgtttaactacaactttgtatcctttgactaacatctcccctttctccatactgtaacccccctgccgcccctaacttctgccaaccaccatcctactctctgcttctatgagctccacttttttaggttccacacgtaagtgagataatgcaatgtttgtctttctgtgcctgggaaaacaagatcttgaagaaatcttttgtacacccatattcataacaacattagttacaatagccaaaaggttgaaggtacccaaatatccaacagatgaacggataaacaaaatgtggtatatacaaacaaagaactattattctgtcttaaaaaggaaggaaattctgacacatcctacaacgtgaatgaaacttgaagataggctaagtgaaataagccagtcacaaaaggacaaatactgtatgattccacttacataaggtatctagagtagtcaaactcacagaaataaatagaatgatggttgccatgctgacggaaattgggaaatggagaatcatttaatggatacagagttactgtttctgcaagaagaaaaagttctgaggattggttatacaatgtgaatgtacttagctctagtaactgtacccctaaaagtgttatgacaatcagctttgggtgatctgctctgagccaagcctaaggaaagcacctctcattacctttgtgggtagaatgcatttcaggaagtgaagagttaatgtgaggaaagggtcaagtagtacaggtgaaatctatccaatcttagttggaaaatactttttagaattaaattcatctaaggaccaataacaggtatgactgtcaactgactgtgacagaacagttgttgctaaggtctatttctgatttaggccacggaatatgtcccagtactatgaaattctgaaaattctacctcaaaattcaattttaactcaaagattagttgttaaacactgaataaagtggaatcctagaaagaacttggaaaagatggctctgctagtgagatagtcatatatgcattatgtttatactcaaaatccaggctgacatctaatcaaacccttgcaaattcaggcagaaattacttacgcaattataggatagtgataggagggttaattggataacagataattggcttttgagttgaaccaaattgcaagactgaaaaacgagatgcctcaaaatatattttaaaatcctcagagaatgttttaagtttgaacgttaaaagaaaataactgaagtggaaagagtgcatggattgattacctaacctatttctgtaccttaggcatcttggatacatgaatatttgctgagtaaaggacacagccaagttgagaagtggaacaagcagagcaatcaccattgtgatttatgtattgattctatgctatgaaatttgaaagaggaaagaatatacaattcaataatttttaatattttgctttaggactaaaaactacttttcctataagatcggtacttatagtttaacttattggtgtttccaaagtagagaaaatataagtgaggaaaaatcaactacagtccctatgccgaacagcaaataaaacagacttatttagttaccattgtctgagggatttggggatccttatttctgacctcatataatttgtggttaacattttaaaaatacgtgaacctaggccaggcacagtggatcatgcctgtaatcccagtactttgggaggctgaggccggtaaatcacttgaggtcaggagttcaagaccagcctgggcaacatggtgaaaccccatttctactaaaaatgcaaaaattggcagggtgcggtagcaggcgcctctagttccagctactcgggagggtgaggcaggagaatctcttgaacccaggaagtggagttgtaccttgcagtgagccgagttgtaccttgcagtgagccgagatcatgccaccgcactccagcctgggcaacagagcgagactccatttcaaaaacaaaacaaaacaacacaacaacaacaaaaatacatgaaccttgaatttttacccatacaaacattttaatgttcatgttcaaatgcacacaaatgctgagggaaaaggttttttgttttttctttttttttttttttgaaatggaatctcgctctgttgttcaggctggagtgcagtggcatgatctcggctcactgcaacctccgcctcctgggttcaagtgattctcctgccttagcctcccaagtagctgggattacaggcacacaccaccaagcccggctaatttttttgtattttagtagagacagggtttcactgtgttgcccaggctggtcttgaactcctgagctcagccaatccacccgcctcggcctcccaaaatgctaggattacaggcgtgagccaccacgcccagtcctgaggaaaaggtttttgacactatgtgtatttaatgtatgttaggagatagtttcattttagaaagttagatgcattttcctttaatagtgtactgctcaatgtgtagctgccacaggatgtaaaatataggcctggagtgtggagtataggaacagcgtggaacttagctacagaatttatgcaaactcactggaatacattaaaaggctgctataatatatccacaaagacccagatgcacctctggtactctgagaaaagtgttgccaaggctgcgggagatggccatgacagaaaaggaccttgacatcttccatcaggcagatcctggtgtattgctaatattaattgtattgcaggcatcgaattaacaagtgttaccaataactattaaaagtaatacaacaggggccgggcacggtggttcttgcctgtaatcccaacgttttgggaaggcaacgtgggaggatcatttgaagccaagagtttgagaccagccagggcaacaaagtgagactctgtccctacaaaaaataaaaatacaaaaattagctgggcatagtggcatgcacctgtagtcctagctactcagggggctgaggcagggggatcacttgagcccaggagttcaaggctgcagtgagctatgatggtgccactgcattctagcctgggcaacagagtgaaacactgtctctaaaaaaaaaaaaaaaagtaaataaacagacaaatcagtaaataaataaaaatcataaaatatacaatatgtatgttggttatttcaaccacaaacctcatgtttattgattaaaagtaagactactagtacactgttacatcaaaagtcaagtgacagaagacaaagtagctatttttgtaaaaaagctaggttgggcgtggtggctcacacctgtaatcccagcactttgggaggccgaggcagacagatcatttgtggtcagcagttcaagaccagcctggccaacatggcgaaacctcgtctctactaaaaatacaaaaattagctgggcgtgctagtgggcacctgttatcacagctactcaggaggctgaggcaggagaattgcttgaacccaggaggcagaggttgcgttgagtggagatggcgccactgtactccagcctgggcgacagagtgaaactccatctcaaaaagaaaaaaaaaaaaactcatgtgtgcacaatgtaatcctgctttatggcagatggaaaaagaagcaattatgataggtttggtaggctctcacagtgctggtctatttttaaaaattgaattagttgccaacatttaatacagctaaaatgattttttttttttaagacagggtctcattcattcacctaggctggagtgcagtagcgccatcttagctcactgcagcctcgaactcctgggctcaagtgatcctcctgcctcagcctcccgagtagctgggtagctgggactaaagatgtatgccaccacacccagctaatttttgcatattttttgcagagacagggcttcaccatgttgcccaggctggtctcaaacttgtgagctcaagtcatcctcccgccttggcctcctaaagtgctgggattacaggcaccagcccacatgcccagctgtaaattattttattaaaacatgggagtctcatccatttaaggttacctacctgggctcctgtagtatttgagctgatgatccctacttgatgggaagaaaaatcatgcataatcccttccagaagaaactggaaggttttggaagaatatgttggccttgatatcccttagattgttttcattgacatcagtactcttatcggataaagaaaccattattaaccaatggtaaactaagggatttaatttcaggaataattttagaagacacaggcttactggcgtaaatatatctggtcaggtgtgtgtgaccattgactctgacagtttatagaatgtttgaggtcacagatataagacttaaatgggacacgctgttccacgttgttgccaaatgttacattttaaaagcaaaatccaataccattttaaaaagttgattttttttttttttttttttgagacagagtctcactctgtcacccaggctggagtgcagtggtgcgatcttggctcactgcaagctccgcctgctgggttcacgccgttctcccgtctcagcctcctgagtagatgggactacatgcgcccgccaccacacctggctaattattgtatttttagtagagatggggtttcaccgtgttaaccaagatggtcttgatctcctgacctcgtgatccgcccgcctcggcctcccaaagtgctgggattacaggcgtgagccactgctcccagccaaaaagttgactttctaaagcattaggttgtgttaaaattcagcagagggttgaactcactttagaagagatatatgatagcactgaagaaaatacattttgattagtaatgattatctaacacagatctgttagtattaaaatacttataaattgtaaaggcccaactgttctgcaagactggatacataggccttttctctcctgaatatatagtagggagcagggaggaattgagagatctggtcatccaaacctgcaagaaggattattcatggatgcatttggagtgtatgcttcttgagagccaccacttgtccagaaatatctgtgtaacacaactgctaaattatgagttctgctgccaggcaatactctttttcagctagatttgcttttcctgctcttttaaacaggtgtataggtggaaatgccatatgtacagaattttttaatgatgtgacacctgcaaagtttatacaaaaatgtggaaagaaaattctacaactcaagctgatgtcattgcttagagcccagaccaccagaacacatcaaccaggccaagcaaaagcactatcagcatggaggccccctttgtgcggctgcccaaacactgacaagatgtagtggactccatacagcaggagtgccctagcattgtggacttagttcctgagcaagactccaaattgcaccacgttcttctgagctctggggcctgcggacatgctcttcctctgcccaacatgcttgctccctctctcctcttttctctgactacttcctattcatccttgaggtctcagcttaaatattactcctctgggaacccactttgatcttccagactgggttaggtgccccttgtttgtgtccccacaattcccctggacttccccttgaaagcagtgatcacactgaattgtgttcccttgtttacttgtccatatcctctcatagcatccgtgcttcatgaggccaggtaccaggtctgctttgctcacatctgtattcctgctgtggagtaagttgctcagaagatgttggttgtgtggttgaacctgtctgcttcacagctcactcacatactcttagttggcttctcagctgtgggactggctcatggttgtgggcagggcttagtagttggccaacaatggccttgatgcataaaagagtttcccaagaggcagaaattcttgggttacatgaacatgaagttttgcatgcagcctggaacatctcaaaaacctgactggaaagaataaaaagggaaaggagaatgtgtgtgtggatggaggaggaaacttggaaatatctctccaagacaaggtgaaggtgataacattttgaccagaaatcaagaatcagagaccagaggtcagagaatctaaaaggataatggaagtatttcttggaggaacgaacttcacagtggaaccacaaagtcaccagaactctgtgtgtgggttctcagactgagcatgaagtctgagaggggtacagaattagtaggactcaatacatgtttatatcaattgggttccattctgttcctgaactcgggcagcttctttcagctagcaaagccatggctgatcttgggttagacaggaagagagtcttacccaagataaagagtcagcagacatcagggagggctataggctgatacactggaaggatctaagatgcaagggtgagaaaaacaccaagaactgacaccagaatccagccttgcctttacagcttggaagctggccagaacccagctggttagaagaaagcacaggctctctaaccgtcctatgtggttttgtttttgtttttgtttttgttttgatacagagtcatgctctgttgcccaggctggagtgcaatggcgtgatctcggctcactacaacctccgcctcccaggtttaagcgattctcctgcctcagcctccctgcctcagcctccgagtagctgggattacaggcatccactaccacacccggctaatttatctatttgtagtagagacgaggtttcaccatgttgcccaggctggtctcgaactcttggcctcaaatgatccacccacctcagcctcccaaagtgctgggattataggtatgagccaccgtgctcagcccacctcctgttcttaaggagctctgttttttctctaccaggaaacagtgtagctatcagagctttccatggtcctcagcatagaggacttactatggcccataaagtctgtcgtaccagccttatcttttaccatgagcagctaggcaattacaatgaaggaatggcctcaatccgaaacggactgtgttttctgatatcagaaggatatggagaaggagaataacccccacctgattcttaaaaacaacaacaacaacgaaaccctgaaagttccatgtggcaaaacaggaatgatctctctccaagggtaagtggcaagaaccccctttctctatcactggcatctgtttaggcccttcttgcctcttctgggcctgggctccccagaaccccagccctgctcagtctgagcagggaaggctgagctatttctggggctcagcaactctgagccccacctgtccccttgacccagggaggctctcatactaaatgggtaggacagactccaggtgtgggcccaccctcccttacacgggttgcagcctgaggttggtcagacagggaagttacctcctcggccctcactggcagctggcttcacttggatcggacgattcatctgaaagacatcggaccaacacacccattcagcgtgactgcctggtcctggagcccccagcttctcgaaccctggactcctcaggatctgagccctagcccctttgaactctgcactctaccacttccaaactgggattacagattttctccaagattccttccttaaacccaggaatttagaaggtgctgaaactggcagggatgggtgacaggaacttagtggcaagcacaaggtggaatgaagcggctaaagagacttttctgcctggggctctgggcaggggctatgtgaggcctgtccctttggcttctggacttacttaaaggctttgcatgagaggattgggaaggagggtagaattgatactgcagatttgtgttttatgtctaaaatggagaatatcacgctatgtgtcatttagatgagagtctgggaatcagactcagtgctatctgccctcaactctagtcatttaatggttgtatgactttaagtaagccaccttttctcagattcaatttttctttttctcctgtgtagctgaaattacaggcacgtgccaccaggcccggctgatttttgtatttttagtagagacagggtttctccatgttggctaagttattcttgaactcctgacctcaaatgattcacccgcctcagcctcccaaagtgctgggattacaggcgtgagccactgcgcccggccagattcaatttttcaaatgaggaaaacatttcccaagctgctgtatcactagagtctccacgctcacctgctccatcccctccctagggtccccttccctgaggatgctggagttttccaaggtgccgttctcagccctttttgtctggctcttcctacttttcttggatagtctcatccacactcagcctcagctcctctccacacagggatgacttagagctctgtgtctccagcctgcattctcctctgagcttcagagccatgttaccagctgcctgctggacatccccactagaaagtcccacgggcgccttcactcaacacacccaaacgagagctcatttgtttttttttttttttgccccaacctgatcctcccagtcacccaagctataagcctggaaagcagcttgacttctccttccatcccttccccgctcccaccaacttcatcttttaattcaggggttcctgaggaagtgtagataaaaatcacccaggaaccagatgaggctcttaagttggggtattgcataatttgaaaacgctcctaggtgatttcaatatatcgcccccacatccccatcccccaaccaccctgagtgaattcatgattgaatccccatctcaccttcctctcatgggtgttgtggggatcacatgaggtaatggggacgcaaaaggtctttgtaaactgccaagagctgggtgcgtgggaggtgaggaattattgttggggggcaggcagctgagtgccaggagggaaaaacagcggccttcccgttcatggaggaaggggtactgatgcccatctggcctgagaaggtgatgatctgaccccctcccctcaagaaatgctctgcttctgcaccaatcaggggccactccatcccttaccaatttgctcgttgccgagacaacaggcagcttcctgttaccatagccacaagtgctacccagtaaccatggtaacgccctggcagtcacagttgagcaatttcctttggatcaaatttgggggtgggaggggcagggagggcttactaaaaaaaaaaaaaaaaaaggaaaagagaacaggccaagtctgaaccagcgcaactcccctcccacccagggctctgacacacccacccgctggtggtggagcacctgcagtgtaccaggctgtgggtgggggcggagacaccaacaggactcaggttgcagtctagaggggatgacagatcaatccaagcagatcagggcgagcttgacaggtctggactggcctggaccagggaccaggaggacaggacccgtccctgggcatggccacctgtgattgtggaggaaagaccaagagacagagccatggagagcagagacacagggagagatgaagaaacactggcagacagaaatgatgtgagagaaagacagttctagaaaggggcaaggaaagagagttactggtggagaggggaaggaaatgaggagaggaagggtaaggaagcgggtgcaggagaggcagggaggagcctggtagggaagaaggccaaaagagtagaagcctggggtggggggcagtgagggtgagcaagaccatcattattttattagttcttaaatagatcctgagaatttctctctggagcctagagtgacgagcacacgtgacagcagcagtttccatggcagctgcctccctggctgggtttcctgggagatggtgctctgggggacgccaccttctctcctcccacccacttccccacccttcaacagagagtgggcatcgggtggtacatacatgttcccccctggacctgacctaggcctcccaccacccaggcatgctgccagcatttcctgaactctgtgatgagccccaggcagcctttcgtgggagacagtgatgatctgtatggggatcctctcttcataggctcgcagaggggaagataatgttaccatttcctgagagcccactctgtgccaggcccttcctgggacactttacatacattgtctctaaatccttccaaccactcttcaagggaatacaagtgtccccatatcatagatgagaaagctgaggctgagggaggtgaaatcacttgtctaagatcccatggtgggtaagtggttgagctgggatttacccccagatctgtctgaggctgaagcccatgatttttgcactggagtgctgctcaaatccattcttaaggcatgaacacaaatagtgaggcacagagggaccagggcctcgggggagtgcaaggtcaagagctgtggaagaggcagactccagctgaagaggttgactgaggaaagctgcatagaagaggcaatgtttgacctgagccttgcaggactggggtcattggccatgtagagataataggagaggtaggagtggtggctgagcacgctgaatggctagggtacggacagggagctgcaatggctagggtacggacagggagctgcaagcctgaaggagcaaagtttctagtgagcacttggcatgggagtagccatggtagagcaaattgcttcctagcagatagatgtggatttcaatcctggctctaccacttgcttctctaaggtctctgagcctcaatatccacactagtgaagagggaatcatgatcttaacttgcagcgttgtgatgaaaatgacaactgctagatcttagtagatacctcagatataaaaagttattgtttttttttgtttgtttgttttttgagtcagagttttgctcttgttgcccaggctggagtgcaatggcgtaatctcgcctcaccgaaacctctgcctcccaattcaagcaagtctcctgcctcagcctcccgagtagctgggattacaggcatgcgccaccatgcccggctaattttgtatttttagtaaagacggggtttctccatgttggtcaggttggtcttgaactcccgacctcaggtgatctgcctgcctcggcctcccaaagtgctgggattacaggtgtgagccaccgcacctggccggtttttgttgttgttattgttgttaaggatatgaaactgaaaggtaggcaagggccagattagggaaggctgtgaaaaccgcatcaaggaattttgacttttgactttgttgtatttcaaaggcaatgaggatccaggggagggaaggatttttaaatgtttttttttaaacatttttatttatttatttattttggagactgagtctcactctatcacccaggttggagtgcagtggcgcgatctcagctcactgcaatctccgcctcccaggttcaagcaattctcctgcctctgcctcctgagtagctgggattacagacacccaccaccatgcccagctaatttttgtatttttagtagagacggtttcaccatgttggccagactggtctcaaactcctgacctgtggtcttactctgctacccaggctggagtacagtggcgccatcatagctcactgcaaactccaaatcttgggctaagcgattattctacttcagcctctcaaatagctaggaatacaggtacatgccaccatgcccagctaatttttaaattttttgtagagactgggtctcactatgttgcccaggatggtctcaaacttctgggctcaagcgatccttggacttcatcctttcaaagtgctgggattacaggtgtgagccgctatgcccagacaggaaagggttttaagtagaggaatcatctagtcagttttgtcttatgaaggatcccataagctgtcactatgtggagaaaggattggaaaaggagtgattagaggcaagaagatcagtggcacaggtgagaggtgaatgtgacctggatagaaagaaatgaacagatttaacagatgtgtaggaagaattaactgggctatagttctattggatatgtggacccgggaagaggagggcatattggctgagcctcaggttcatcgcttgggagttggggaaggtgggagtttgggagtttgggggtacaaggaagtccccaggggaggaacccaagagagtaagaacagagttggggagagcagggctctgagccttcagtccccacagagcagtggtgatggaggacacctgggatttaggcatgttatgtgtggctggaggagaaagagagctgcccccatgagcttcctgggcaacctattatatatatcttgttcctgccatgggcagaggagggacatggcagtgggataatcaggacgtaatcaggagtcccccttgaggaaaagaggacattgcctcccaggccaaaaacttgtcctgggacttcaggtgagctcttgccctggctgagcacctgttcccttaagaatttcccaggtggagtccaggcccatgtctgcttcagagcccagccctggaggggaattcaagggatagaatgtcagagagaacaacctattccaggcaatggagtgggaaaggtcagaggccgcacagacacgcacagggccctggaccttctgccccagtgagcagaagggagagcaaaaccctacctaactctctgccctgatttgtctaaaattcctccctttgggctcagcattgcccttttcagattcttctgccctgatgccaactattcttttcactgagcactcacaccctcagcactccccattccatgggaagagtttatcagaaccttcttgaggaagggaacactggtaggtctgggaaaggtgtcaggaggtgcagggcagagtgggacagaaaaaaaccaaactttctaatttttagtactttgttttacctcacccccctcctctaattcaacccactgtcaagtcccattggttctagaatctatatggatatcctaaacagctctgaaatctaacctcttatctcctttcctggcctatctccagctctaggccagcatcaccattcatccacactcaagcaacactgcactaaagggtcatccagcctgcagtgttgcttcctttccaacccaaccttcttcacaccatagccagagtaatcttttttttttttttttgagacagcgtcgacctccagggctcaagcaaccctcccacctcagcctcccaagtagctgggactacaggggcacaccaccacacctggctaatttttaaaaaacttttgtagagacggggtctcactatgttgtccaggctggtctcaaacttctgggctcagcgatcctccagtctcagcctcccaaagtgctgggattacaggcatgagccactatgtctggcccagagtaatcttttgaacctagtctcttactcttctctgcttaaaatccacctctgttcccccattgcaagcctcctgttaaagcccaagattctaagactagctgtcaaaacttgtgagtctttcttccactgctgcccaacatgcacgattctctctactcatgtggagccttagctatctttgctagacaccttccctgccagtgttcacactgtccccaaattttcttgtcttttaggtttctagatcctcaaatatgataaaatatgatcatgattcagctcagataacatctctgcaaagcatctactccctccccatttctttttattcttttctttattcctttatttatttatttatttttattttgtatttttgtatttttagtagagacggggtttcaccatgttggccaggctggtctcaaactcctgacctcaagtgatccgcccgcctcagcctcccaaagcgctgggattacaagtgtgaaccaccgcacccggccttttcctttacggtttgactctgggactccctccccaattctggtctctcttttacttgcccagatgtatgcctgagtgagatgcaatgaggctcaccttttttctttttttttttttttgagacagagtctcgctctgtcacccaggctggagtgcagcgatgcgatcttggctcactgcaagctccgcctcccaggttcacgcctttctcctgcctcagcctcccgagtagctgggactacaggcgctcgccatcacgccctgctaattttttgtatttttagtagagacggggtttcactgtgttagccaggatggtctcaatctcctgacctcgtgatccgcccgcctcagcctcccaaagtgctgggattacaggcgtgagccactgcacccggccaatgagactcatttttaagaagcatcttgagggcaaagactcagactcattcatgaagtggttgctagcacatacagtgcctttctgtaaattataaaaaggcactccccaaccctgggatgaatgagaaaaaatgtgccctttcctctgggctgacaaagccttgaaataatgtgcatgacttagtcaatagagcatggctggatttttgcccccatctgccctctctacccaagctgttttgtgcagggcacaacttgcaaaagcaaatgtactcccctactcagtaacatctgccttcttcacagcgtttgaagggatggcttcccaaagaaagggaagtcaggaacagggagataaacaaatagggaggcaccttatgcatctcgtaagtggggctgaggctaggcctcaccctcttcaggtggattctggagcataaagtgaggctaaaagaaggaattctggcttcatcaggaagaggctgcaggaggtgggagccaggtgggacagaccaaccaaggtttgaaggagttctcgaatagggaggcaagctttcataggggacagaaattggcaggggacaaatggagaggagccaagcaaaagaaggtcttagtcaatcagaatccatgaaattcttggccaggagtggtggctcacgcctgtaatcctagcactttgagaggctgaagcgggcagatcacttgaagtcaggagttcaaaaccagcctgaccaacatggtgaaaccctgtctctactaaaaatacaaaaaaattagcttggcgcggtgatgggtgcctgtaatcccagctacttgggaggctgaggcaggagaatcacttgaaccctggaggtggaggttgcagtgagctgagatggcaccactgcactccagcctgggtgacagaatgaggctgtgtctcaaaaaaacacaaaaaacaaaaaacaaaccatgaaattccccctagggtttcagacttttctctctgggggctgacctagccttttctggtcccatggtgacagtcctgcctgatgccagcaggaattcagattaaagtcttgtccctgcttctccagcaggtggcagctgtgctcaggacccaatggcagcagagagctgggcactcctcctccatgctggtgggcctaaggccaggcgactaaagttgctgctgtccctggcaggcccagaggaaagattgatggcacaggcattgctggggctggccaacacagccattgattttcatttaggagaataattaaatattaattttcactttgttaagctggagagggtgaataaagccaatcctgacagtatcagaggaagccaggccatgttggagacctgcagatgaaacagtgagagggggaagatgtccccagtcaccattctctctagaacctaagacccctgtctgctacctggttgtctcaggtcacagtacagtggttaagtgaatgagttctagggccagattagctgggcccaaagtccagatcttcccattattaactatatgaccttgggcaagtcacttgattcttatgacttagttttctcacctgtaaaatgggaatgccaataacaataccttatttaggcctggtgcggtggctcatgcctgtaatcccagcattttgggaagccaaggtgggtggatcacttgaggccagaagttcaagactagcctggccaacatggtgaaacctcatctctactaaaattacaaaaattagttgggcagagccctgtgtcttgtggaggagagatttttttcctcccaaagtttatcttaatttttttgggggggacctcccatttcctttcagggtaaagcctggcattcaaagtttcatcttcaactgctgccctctgtagatcttccctccagcttccctccatgctcacgtgggcctcccccacagtgccagccgcatttcacacccacctgttccttctgtgtctgcacctttaccatgctgtttcccacatggaatgttacagcttgtctcattgactctcagttctagaagcagaagtcatttgctcccatgattagatgaatgatgagttctactcctactcctactaatgctgctgttactattactgttactatcactactaccaccagctaactcatatcgagtgcttattttctgccaagaacagcattgagtactttagttcacttaatgacttagctcatttaaccacgacaacaaccctatgagtttaactttacaggtgaggaaacttaggcttagcagtaaagacttgcccaaagtcacaaagctagtgagtggtgggcctggatccacacccaggtctctctgactcaggagcttgcatacagaggaccagtgatggtgacaaattggtgttacttggcacttagtccccaaaagtgaggctaaaggtgcttcagttactgtgcttggttctaggagctgtcaccccattaacagcttgattagctcttggcgaagcttgctccattgcttggtagctccaattcagagaagtgacttctttatactgagctgaaatcagtgcctatttcttattatattaactgatccgaatcttgccttctgggatcactcatagaaaaccaaacccctcttctagaatctgaaggtagttaccccaaccccaacagtagtacttattgagatcttactctgtgccaggcacttgctaagcctcaagtaatcctcactacagccaagcgagctaggtgttagtataacccactcctcatatctaaagagactgaagctcaggagtccaagtaacgtgcccagagacacagaactgataaatggcagagctgggattcaaatccaggtctgtgagactcaaaacccagtgtttttttttttttttttttttttgagactgagtctcactttgttgcccaagctggagtgcagtggcatgatcttggctcactgcaacctctgcctcccaggttcaagtgattctcttgcctcagccttccaagtagctgggactacaggcatctgccaccatgtctagctaatttttgtatttttagtagagacagggtttcaccatgttggccaggctggtctcgaactcctgacctcaggtgatctgcccgccttgtcctcccaaagtgctaggattacaggcgtgagccaccgcactcggcctcaaaaaccagtatttttaattattagcttatgatgcctccctattaaagtccctctaagccctatctcctccagttaaatcatcccaactcttccaaactattattccaaatatatcttgtgtctttacttcatcctcgtctctttcttgtagacaaacgactctcttaaatttgagaggcctagaactggacatagtcccaagtttggcctgtgaatggcatttaaacagtgctctgttctagacacaccgcttcttggacaagagaaaacaaggctgtatagtatgacttgctcttggtaaacccatgctagttactaacgatcacccctttattctgccatatggtcagtaggtcccaccttgccttttgttgactgattatccattagccaagaccagaccaggtaccattggtgcctacaagccaagctgcctgtagaatcaggtctcccctaactttagccaagtgtttgcagtgtggagggaagacaatcttagtgagtcaaggcaccaaaaataaccattacaggaaaaggactagagagaagttccagcaaggaccttaggactagagaaaatgggctaccagtccagcagaacctctaccccatgtatctgcatacatgctcacaccagtgacaagagacacccaaagccataattttaccaaggtgaataaattctagcttagccctcaacactgatgcctctcctaaaagatgggtggaacgcctggcccaaggatcttgagccccttttttgagccagaagattggatgtaacaaagaatttgttgctgttcagggtacaggaagccctctcctagaaagatgactctgcttctagttctcggtcccaacccagcccccacatgctgctttggcatgcacacagggcactgtccccagcctgaggtgattcccaccccccaacctggaggacttacccctggcagggtcttctgctcgtgcagtgcactctgggccttgagagcagagtcccgggcgcagtaggtgaggaaggcacagcctgaggaggaagaggctggctcagggggtttcctgaaacccccaactattcttcttcgaaataccccactaagttgacaaacttaaggccactctcctttaagcaaggactctgctttctgagaagccctctctgcctcccacctctggagggaggggcttcatgtgcctggggaccagtgtcccaggctctggctccctttcatttgctcctggcatcctgcccagagaacatatgtgcccacacccagtcacatgtgcatacaatcccacatctcccctccccactccagtcacaagtcctgttggggttaaacctccctaagcagctttatcatcatctttaacccagacttccccttcctttttggattcagactcatggagtctcccaggatcagcctcaattccttcccaactcagtttcggatgggaggaggcaaaagagtaaaagaaggattgggagccaaccccaggagcccccagctcttgtccatgtctccctcccctaagtttgaagctggggaatggattgatttgagacttagaagatgggattggtttaagggcttcccataggtgggagtttccagggaccccctaatcctgttcaaggatcttgatctgtcaaccctcctagggctttgaggtagggcctcttaaagagttattgtgcctcaaatctggctcctctaaaagggccagcatatatgggtcagcgaagaggtctaggttgagccaaagggtcaagtttagccctctgtttgttcagcctcaggacctgtagcctgctaggaagcactgaagcagcactctcctcctttccaacagccactgagcactcattcattcagaaaatatttattgaacacttacttattatggtggggcattttgatgaccttggagatagagtggcaacaagacacacattccctgccctcatggggattagacaaatcatgagggacccctaaacaagtccaaagggttgagtaatgtctcaaagaaggcactgagtcctcgagaacaagaacactgagtccttaacaatcaggtgatgaaaaggacagtgattatttcagacagagggaaaagcatatatgaagactgaatcaagaatttggtgtgttggggaaatggataggttagtgtggctggaggctggtgtatgggggcagagtggctagtgagatatgcaggaatcaagtcatatgtagccttgtgggcctcagttggattttgaactttttcctaagagcaatagagagccactttaaagggttttaagcagatctgtgagatgataagatctgttttcaaaaggagcattctgagtgtaggagggagaaggactgaaggaggagaaagtggatatggtgagccattaggaacttggggcagatttccacttagacctcagcagattagaaaggcaaatgggaacatttttttctggcctcttctacagggctgccccattaagatgggtttattgccggacattcattgagttaaagggaacttagagaactgagcaaaactcttatcacatcaacagggaaactgaagcccagagagtgggtcagtggcagggcaggatttggaatgtcttaactcccaagctggggttgttttcaaagcactgtggctgcctgcctcggtacccagacatcaaaaggaaaatgagtcactgtttctggggagaggatgaggaagatgttgacttggagaccctctacaatcatcttggaaggcaacacttgccttggagagttgtgatttagtttggaaataaatcaccaaacacctgattccacttacatccctgctctgtgttttgctaccaacccatatcacctgacgtccaaaccgggcaggttgcctgtctgaaaggctcaggggcccagttgctgcctaaagaagccccatgtggactagccgggatagagggtggaagaatgaagggaagaaaagacagagaagcatggtttgagagacagatgaatgaaaataacaggcagaattagagctaaatgaaaagagagaggatgagggaacagttcagagactgatagtgagaagagtgagatttaagggtattctatacacttcccttattgtacggatggcctacaaagattagctttgtatgtacatcctgaaatcaatgtctaaaaataagaaaatgagttactacagagggatggacagacaggcaggtagtgggagtgcattagaaggactctagatggtgaggtattgtcctttcatacacccattaacacaatcccagcccaaagggtggaagctgtactcctagccagatggtcctagctcttctattggcattttctcgaagtgcctacattagtgtgccaaggaaccctacgaggcctccaagttgaagaggtggcagtctgattccagctctcagtccttaggaatgtacctttagctgttacccaaggcccaccactcctctcttaggaagatcatggaggatagttggtgactctttcccagcaaaaacttgaaagcacagcatggtggtggtggtgggggaggagataagagtgttccttctcaaatcatctccccttctcctgcccatgtatgacatgtgactctggctctcttactccagccctgcctggacagacttttctgcatgtaaacaagcctcctccctctctctacaggaagaaaggggtgtggccgaacaggaccgtgtatctctctagaaagggcagggagaagatctccttctgtctcttcagcctgactcaccctgagaatgggcctggactgggaccagcctgtgaggggagggaaagaaagaggccataaagaggactggggaggagcaaagaagaggcacaggagtgaggggattagagaaggaaagaagtgtggatttagctgagagaaatccaagaagaaagggacacagggtggcaggagttcccagctgaggtcagggttctgaactgaaatcaaaagaggtagagtgcattgggattctggcgaagggcaggagagattggggctgttgttgaacatgagggggtgtctggaactgagagcctcctgggaattgaattggattttgtgttagacaggtctgggttctgaagaaggggagggtttgggtctgcggtgttttaggttggcagtctgagagtcaaaagaaggctcttgagggggatggccggactaggaggccagaggaggggtgcaagtccaagatatgcatgtgggtggttaggcctgagtgaggtgccaccagatggaggattcaggagtgtttgggctcagggtttgggaaattgagggtattcgagatctagaaggtggaataagttttcaaattccagaattttaggtctgatgggagaggtggtggaaaggtccaattgaaaggcagggactgctgggatgtgagaggtggaggccaggaatttggaggttagagtggagaacatgttaggggaccacagtgataatcagagggaggatgtcagagagaaaattctgtgatctgggaagggggctgggctgaggtggggctgatattggactggtgttggactggctctcggcagggctagggctggggctgggctggggtcgggccacactctaatcggattggggctgggctgggctgggctgaccccgcgcacctttgtggaggccggtgagccggtccttcagcaccgtcagctcgtagatgcggccgaactcctcgaacagcggcttgaggtcctgctcgtccaagccccgcgggatctgccccacgaagagcttgatggcgtcgtggtccttcatgggtacggcgggaccggggtttagcccgctcatgccgacgccgctgtccgcggtgctgaaacccaggcgcgggccggggccagcgggctgcgctgaccctcccggcgccgcggccatgtccccgccctgtcagccctcccgccggtcccactggtcccgcctgtcccgccgtcccctccctggaccggtggcgagggccagggggagggggcggagcccgggcggagagggcggggggctgcccagggggcggggtccgggtggaggggcgtagagggggtggggcgggcaggaaaggggcggggccggggcggggcgggcccgggccgaggtggcggctgaacgctggggtctggcttgaggtccccgtgcggctctctctgggctcccgcccgagctctcccagagccgagccccgagccccagc

SEQ ID NO: 949 - DNA, 21590 bp, Homo sapiens
gaacaggtgggaacaagttttcttagaaactgttatgaaggaggagccctccacccccacccccacatcttttactatctgacatgttatcagatcagaggccttcagcctcagcaacatctggggattagagggaccccacacagctggggcctcagaccaagctgatccatgcctgtggggtggaggggaaatcctcctgggaaaaatatgtgcaaggccctacaggcccaggaaaggctgaccaaggcaaggtgagtcatggtgttctaagctgaatcttttgcccatctcacagaagcaggcaggaagcaccaccattgatcagctttatatggcacccactgtatacaacagacagacaaagacagacagacagagcacacaccacttctaagctcaacactgctcaccaactagaagcacctcggttaagcacatgtgagacactcttgcataggaaagatgtagtttttaaaggaatgaagaagtattttggcaaaacatctacttccctcccaggtctggggtaaagagggacctctaattctgaagcttctacatattgaaaaatttccccttctcaatggcagtatatacagtagcaaaccttccaagtctgttgtcacagccctctacagatatcctgaatctactttacaggtgggcaaacttagactaagagacagaaggtagcctggagcaaggggacactgggactggttcaaggggaagggaaacaggaggtgtctcagctcagccaaaggcagggcctctgtctacctggattggcaagggaaaggctcaggtggccagaactccctctttcttcccgcctggggaagcagtggttccacaggaaaggcaatcccactcttgctggctagggggcctcccgggatggcaaaggccagggccaacctgagctctgcctggggcctcttctgggatgcactctgagtttggggattgtggattgtgggttcactgcttccataacgttctcattacctgcatgtgagcctagacctcaaatccttaattatttttaaaagggcagggtgggggagtggcttaagagggaatgagacacagaacaatctttccacagcccccatctgcctaggctggggctgtcaagggtctccttcaccctgtctcctagggatatttaaaggcagcttttatgagactctatactgtctttttttgtagttgtttgtcttgttttttgtttgtttgtttctttgttttaatttatatagatatatatattcttaaaaaagcaatagtcctttggtccctaaactctaaggaatgatatgattttgaaagaagtaaatctgggcttcccttgcggagaagcccttggcacccccaacgccctctgctggttcccctggacagtcactcctcaccagccctatttgctctgccagcctgcgctctatgctgcaggcacagaacaacccacttgataaaaacaatccttagagtggccttagccccaggcaccagccttgggtccgatccacctccgtccgcagctgctccttcgggaagggctgctcaagcgtttctgtgcttttcctctcctttcttctcactcttctgtttctgttgttgtgtattaattgataaggagagataggggggaaaaggcaagaatcaccttggagggcaagaccagaagagcagcttgcccccatgagtgacgtctcaggtgagtggctggacctctcttcctgaggagtagggctgcagcaggacccaggcagcagccccgtccactgaagccagacttgagtcctgagcaaaagaccccaaccccacatcccctctagaaggttcctggggtagctcaaagtgaggcagggccatgtgggccttctgagacagaaaatctctaaaagttgcaggcagcatcctatggacccatgaccttgccaaaaatgtagaagaacttggcccatctttctccccatcacccaccaggccctgcagattctacctctgaagcatgtttgcttctcttcctccatctccatgttcactgccactatctcagcccttacttctagtcctttctctgcttaagctcctcaacagttcattctcatcttcaggataaagtccaaactcatggcctgaagacccttgaaaactggcccaaagctacttttctagtctcattttccagtctcctggaccctccccgcatacaggttctctactctcattggctgtctctggagtagaactgcttctccaggcagaaagactctgattgtctctcctagactgcggggcaggaatgttgtccaattgatctccttggattgaaggaaaagcaaagtctccatctgaggtttcctcctagctcctggctcttctctctatcccagactttctcagaggtgggtgcctccaaggtcccaaaaggaggaccatcaaagctgggagggcctcatcactcaggcctcatctacctggggtccatcagggactcacctttctgtggctggtcagtgaaagcaggtcagtaaggccggttggcatccttgggccgctttagctggaccttgagcctcttcatgccaatttgaaagccattcatcgcctgaatagcagtctgggcactagttggattgtcaaaactaacaaaccctggagggtgtgggcaaagagattagctggggactctgcctagcagggcctcctttctctctgaccagccccctcctcttccagccccgtcaggccagttccatcaaacacatacccctccactgtttgtgtggatacagagtcataggcagatggcctgagattcctaaaggtgtgattcttggaaggataggaagcaactctgagtgtgtgtgcagggtcagtgtgttgatttggatgtttccgtgtttttcctggcatgggttggctttctccctccacagctcccattctggtcctcagaaccatagttggagttggaggggatctttggtctcagaaccagactcctcctgccctggccagactccaaagctctgacctagctggccacattcctggtggacacatgatcatcccaggtaaacctgaaataaagctcgttctttttttttttttttgagatggagtcttgctctggggcccaggctggagtgtgcagtggtgccatcacaattcactgcaaactttccctctcggattcaagaaattctcctgcctcagcctcctgagtagctgggattacaggcacccatcaccacgcccagctaatttttgtatttttagtggagacgggatttcgccatgttggccaggctagtcccaaactcctgacctcaagtgattcacctgccctggcctcccaaagtgctaggattacaggcgtgagccaccatgcccggccaaggcttgttgttggcctaaacttaggcccatcactggtttgtgaccctgttttgtgccatacattcaatctcaggaaatcactgcattatggaagggcaatcgtagggtctgtaggaaatcctttatagtcagaggtgggagaggcctaggggtaggttctcagctcaccaaaacacttgctctggttggtggctcgatccacaaagactttagcagagacaacggctccaaagggcaggaatgtctgtatgagttccgcatcaccaaactcctgaggcaggtgatagatgaagaggttacagccttcggggcctggaggaacagtagcaagctggttcaggggaaggaccctgagtccagccccaccaggttctgctgtccagcccccagtccctcaccttctctctgctgctggggcagggctgaaggctgctggggaaaagctgtgctcactggggcataggccgacggataggctgctggagacagaggtgggagtggacagtgatccccaggagcccttccccaagcagggccccaactgcctggccgcttttgaccaattcagcccagtccaccataaccctcaccccaagagaggtcgttctgggggtaggaggggatgggaggatcaactccttggaacagagcctaaatcccccacaactctccctatttctttctagggcccttcaacctcccccaggccgcgtagcgccaagtgaaacctgcgtagtggtgcatcccagcgtaggcctgctgcagggggtcagccacgccggggctctgggctggggagagaggggcgcgaggcccacagtgaaggcaagcgggcgagcagagtgggtgagaagctcagggagtgtgggaggtggacggcggctgtgagagacagcagggaaggagggggatctcttcccagggaagccaggccctaaccccccaccccccgctccccactccatttcggggggatttgggcggagcggggggcccacctggataaggggagagcccgttattgtagagcgtgtcggagcccggctggccattggtctggggggtcagagggccgaatccattgaccccgatgggcgccggaagacctgggagggtgccagggccgctgccaggcggggagttggctgctgatggcggaaaaggtctgagagtcaggccgccaccccgccccgcccggcccctcccaggcgcgccccagtccctgggggccgtacctgccgcgggcaacagaggcgcagctaccaggctaaaggccgccacgtgttgcatctgggccgccactgccgccaccgggcctaggcctgggccctgtgccgccgccagcagggccgcctggtgctgcaggatctttgagaggaaagatgggcgagagtggagggccaaggggcaggcagctgcccgtgctctcagccccaggcctggcccacccacctgcgcgccctcgcacgcaggtgcccggtacctaccgccgtggtgtaggcgccgcaggcccctagcggcagtggcgcggggtggaaggcgcccaggtggccggccatctgctgcatccgccgcagcgcgcgctcccggtcggtgtccgccagcttgaccacgaggctggacgaggcgccctgggcagggcaggggaggccgtggtgaccggtcctgaccctggccccggcccggggccgagcgcctttcccatcaggtcctttcgcggggcaccgagcacactcggggaggagaagcccgtccccaccccactggcctcaccctcagcccagggaacccgccctcaccgccatggtccggctgccgtgcagaccccggatggccgcctgagcttccccttgactcccgaacttcacaaaggcacagcctggggcaggacagagggagcgggtggctcaggccacaggggccaaagagttatgtggcccagagtgaggaagggtcaccaggaaatcccggggtcagctcaggtcacctttactggtgccgtcaggactccgcaggaccgtgcactcctcgatgtggccaaagggctggaacaggcgtctgacgtcctcctcaccctgctgcttgcccagcatccccacaaacagctttcggtcctctggggacaaagccaggaatgacctggggaccccaagtcttcctagacccccgagagtagcctgaggaacttaggaaggcagctcaccagtctcactctgggaagcagagggagtgagaaggccctgggcttccagggttggttttcattgaggggcaggatctggggaagggatctggagaagggagctcagctcagctttccatcaggaaaacctgggtcctggggaaacccagagaggctcagggctgctcttgtggggagtaatgcagtcttgatatctctggctgggtagagccctatatgcattgttttacatgtttgacctttctgttcttagaggttgggaaacgctgttttggaccatttctgtactattaaggaagcgggtgctcagagaaagcctttctattcagactgggtccagagaagagaagtacatccttgctggtcagcctgatagtgctggctagaatcaatgccccttcctgctaatatcaaggagggttctggatttagaaacagcacagaaaacagtcctgtcatcctactgcctcatctttaggcactgagcactggcatgatgaatccttaccctctgcaccacatccaacctggatgcccctcccaaaggcctacagagagcaggaccttggtttcctgagcctccaacattagcatttttcctactacagttgctgaacccctgacccctttccttaactcccacctccaccaccctgtcccttcagcaagcttctagtgccctgtctgtatccttccctctgattcccctgtcctcttgccctgatgcctcccaaaatgttcatgctatgagagaacaagttctgcctatagacctggattgccaccagagaaccagtctgattcctccctgtgtccaccctttctatgggagtggcagaaatgcaggaaaggggctgcaagctgggcctgtgtccctcgaagaaagctggagagctggggctggaaactagggttttgccgcacatccagcaagttaggcctcaggaacactctgggagcgtggggtagaggggtccagcctgctgttaaagtctggggctcttctctgcaccaaggtaaatctctgaatttgggatggggcttgaccatgtaggggacaatacaagttgggagagaaggagtgggtaggaaactggtttcaggcttcatcttcaagaccttggagtgcaggaaaacccatcctaaatggttctactccttgaccagcttggctaggcagatgggggtccttggattctgagtgcagggaaaacaaggctagtggggggtcatagactgaagcctgggtgacagcgaaggaagaacagactgttcaaaactgaacgaagttagcaggggagaaatctccaacaagactatgtgtgtgtccatatgtcacccgggtggtgtggggtttggcctaggctgccttggggatcctgaagtgtctgtctgtctgacgatgctatgtctgtgtggagggcaggggctgcagttcataaggggcaggcaaaatgtgttttagcaaaattctgccgtctgtccagagaggtaccatccgatgatccttggagaggggatggataatggacttgtggctggaattctgatggaggaaagaaggtctcaccagtgaccttctgtggtgagagtacaacctggtgggtgtactttgcttctgggggtgtcagccacagaatagtgcccttggaacagatcactggtttcccaaccttttgaaaaatcagtggaatacattgttctaacataaatattaggatgaagctcaaaatgtaagagaaaaatagaactgctgtgactgaagccagaaaaggaggggtggagttcatcttgcttgatcctcccctaatactccctagaggggctccaaggaaagccctttgaaattactgacctagaagatagagaacagagttccagctgttgtttgaggggggatctgagatcatcctgttcaggagcctgagaagacaggaaaggtctttcatgagtctctcaaccaatctgatggctttgccttgacattggagaatgggctcatttggccagagaatcaaaccccgaaagaccatgccattgttctaagttattctgggctgcagaaggcctgggagaggctggagaagagtctagggcctccatagtcccaaggggggcttcacaatgccctaatttgtagtggagctgtgtcattgggcagggtctgaaaaatggtgatggcaccccaataagatatcataccacatggaccagaatccaggtagccttgtgtaggaagagagacatcacaggctgagatagagcccataagacagaaaagaggtttgtactgacagtggtgatctgatccttcatctgctctgcctcttgttgctttttctgctgatggtgaaattttccgatcctcttttccagtgagaatctcacaagttaagaattttcagcagggcgcagtggctcacgcctataatcccagtgctttgggaggccaaggtgggctgatcacttgaggtcgggggtttgagaccagcctggccaacatggtaaaaccccatctctactaaaaatataaaaatagccaggcgtggtggcacatgcctataatcccagctattcaggagactgaggtgggaaaatggcttggacctaggaggcggaggttacagtgagccgagattgtaccactgcactccagcctgggcgacagagtgagactccaactaaaaaaatttttttttccatttccctgtcagggcactgaccctatggatctggactactgggatgtacagagtttggaatggaaatgagtatctaccatggggtgggctctaggctcctgtttcccaggtatcaccttaaatcctggtatcctctttgccactttacagggaccttgattgtgtttgacaggaggataagctggatcacagtggtcatgagcctcaggtgacccagaaatggtgggataagtttcttaagagacccggccaaagagaagtacatgctggacccctaacagtagccccgcaaacccacagatctgaacattctgatggctgatcattgattgcctccaaagagagatgatgatgggatgtagcccagataattcagtttcctctagatcaaattctatcatttggataaaaagcggacgctacaagaggcaagtcagaaatgtctgaataaaagtatcccatgagtggtgggtagtatcctagaaagatgggaatatcaaacatggacgctcaaccttcctggagtggaaagtattagaaggcagcatcagcgcagagttgagacatagttggaatgccatatggttgaatggtataactgcattttcctgttggcaaccgatgtatacttcttaatcttctatcaaatgcttttttttttttttttgacactgagtcttgctctgtcacccaagctggagagcaatggcacgatctcggctcactgcaatctcctcctcccaggttcaagtgattctcctgcctcagcctcctgagtagctggattataggtgcacgccaccatgcccagctaatttttgtattttttagtagagacagggtttcaccgtgttggccatgctggtctcaaactcctgacctcaggtgatccgcccgcccaggcctcccacagtgcttgggatttcatgtgtgagccaccacacccagtctcaaatgctttttgagtccaaaacaagtggcttaggctcccagaggcccatctccatgaagctgccttgtgcagctggtcatataggtcagggattcgaatgcagcaaatgatggggttgacatcccagtaatcatagcagaatcaatccagactacttcttcagaaagggcaccaggatgctgttcaaggaaggagcgtctgcctcatgttgctccaaagaaattcctaagttgttcaagtttcttgttttctaggccactcacaccaaatcacctccatgttggtgaaatgtaatgattgtagggacagtgtaaggaaaggtccagccttcgggtaccaactaccagacacatcctaaaaatactggtccatttttcaatgtaaatgccaacccagaaagtcttgctggtggcagtaattgtattacagcaaagcaactctctcctgatactcttagtgacgactgcagcataagaagccacggggaaagtgacagaaggaagtagccaggacgagaagagtctcctggccagatgtgacaggcatcaggagggacttaaattccacacacaaaaaaactgttagaacaaataacccaattcagcaaagttgcaagaaataaaattgacacacaaaaaatcagttgtgtttctacacactagcaatgaacaatctgaaaatgaaatgaagtgaaagcaaaagccagcacggtggctcacgcctataatcccagcactttgggaggccaacgtgggtggatcacatgaggtcaggagttcaagaccaggctggccaacatagtgaaaccctgtctctactaaaaatgcaaaaattagccaggcatggtggcatgtgtctgtagtcccagctactcgcaaggctgaggcaggagaatctcttgaacctgggaggtggaggttgcagtgagctgagattgtgccgctgcactcctgcctgggagacagagtgagactgtgtctcaaaaaaaaaaaaaaaaagagatgaaagcaaacaattctatttgcaatagcatcgaaaagaataaaacacttggaggccgggcatggtggctcacgcctgtaaacccagcactttgggaggccgaggtgggtggatcacctgaggtcaggagtttgagaccagcttggccaacagggcaaaatcctgtctccactaaaaatacaaaaattagccgtgtgtaggtggcaagcacctgtaatcccagctacttggggggctgaggcaggagaatcgcttgaacctgggaggtggaggtttgcagtgagccgagattgagccactgcactccagcctgggtgacagagtaagactgtttcaaaatacataaataaataataagataaaataaaatacttgggaataaacttaacccaggaggtgaaagactcatacactgaaaactacaaaatgttgctaaaagaaattaagaggccaggcgtggtggctcacgcttgtaatcccagcactttgggaggccgaggcgggcagatcatgaggtcaggagtttgagaccagcctggccaacatagtgaaaccccatctctactaaaaatacaaagaaattagctgggcgtggtggtgggtgcctgtaatcccagctactcaggaggctgaggcagaattgcttgaacccaggatgcagaggttgcagtgagccgagatcacgccactgcactccagcctgggtgatagtgcaagactctgtctcaaaaaaaaaaaaaaaaaaattaagaagacacaaataaatgaaaagacaatctgtgttcatggattcgaagacttaatattgctaagatgtcaatactactccaagtgatctacagatttaatgtaatctctataaactcccaatggcattttttgcagaaatagaaaaatccatcctaaaattcatatggaatctcaagggactccaaatacccagcaatcttgaagaagaagaagaactccctgttttcaaaacatattacacagctatagtaatcggcactatggtactggcataaagataaatatatagaccaatggaatagaacagaaatcccagaaataaactctcttacatatggtcaaatgattttcaacaagggaggcaaggtcattcaataaggaaaggacagtcttttcaacaaatggggttgggaaaaatggatatctacaaaagaatgaagttagactcttacctttcaccatatacacaagattaactgaaaatggatgagtcctaaatgtaagagctaaaacaatagatgtcttagaaaactgaggggaaaaagatttcctgacaggatttggcaatgatttcttggatatgacaccaaaagcacaggcaacaaaagtaaaaataaataaattggactgactacatcaaaattaaaaactttaacaaggatctattggagggcaaaaataaaaaactagaaaacttctgtccatcaaaagacacaactcacagaatgaaaaagcaacctctggaatgggagaacacatttgcaaacaatatatcaagataagaggttaacatccagaatatataaagaactcgtacaactaaatggtaacaacaacaataccaacaacagaaaacaccaaaccttctatttaataatgggcaaaggatttgtatagatgtttctgcaaagaagaaatacaaatgggcaacaagcataagaaaagatgctcaaaatgactaattgttaaggaaatgcaaatcaaaactacaatgagatatcacccacctcacaccgattaggatgactgctatcaaagaaacagaaaatcacagcgttggcgaggatgtggagaaattggaactcttgcacactgttgataggaatgtaaaatagtgtcgctgctacagaaagcagtatggcagttcttcaaaaaattaaaaatagaattaccatatgatctagcaataccttttctgggaatatatccaaaaacattgaaagcagggtcttttcaaaaattaatctataattttatttcaattgaccaataataattttatatatttatggggtacaatgtgatgctttgatatatgtagacattgtgaaatgattaaatggagctaattaacatattcttcaccttgcctacttatcacttttttatggtgaagatgattgaactctattagcaattttgaagtgcatattgcattattattaactacagtctccatgctatgcaatagatcactaaaacttcatccttctgtttaactacaactttgtatcctttgactaacatctcccctttctccatactgtaacccccctgccgcccctaacttctgccaaccaccatcctactctctgcttctatgagctccacttttttaggttccacacgtaagtgagataatgcaatgtttgtctttctgtgcctgggaaaacaagatcttgaagaaatcttttgtacacccatattcataacaacattagttacaatagccaaaaggttgaaggtacccaaatatccaacagatgaacggataaacaaaatgtggtatatacaaacaaagaactattattctgtcttaaaaaggaaggaaattctgacacatcctacaacgtgaatgaaacttgaagataggctaagtgaaataagccagtcacaaaaggacaaatactgtatgattccacttacataaggtatctagagtagtcaaactcacagaaataaatagaatgatggttgccatgctgacggaaattgggaaatggagaatcatttaatggatacagagttactgtttctgcaagaagaaaaagttctgaggattggttatacaatgtgaatgtacttagctctagtaactgtacccctaaaagtgttatgacaatcagctttgggtgatctgctctgagccaagcctaaggaaagcacctctcattacctttgtgggtagaatgcatttcaggaagtgaagagttaatgtgaggaaagggtcaagtagtacaggtgaaatctatccaatcttagttggaaaatactttttagaattaaattcatctaaggaccaataacaggtatgactgtcaactgactgtgacagaacagttgttgctaaggtctatttctgatttaggccacggaatatgtcccagtactatgaaattctgaaaattctacctcaaaattcaattttaactcaaagattagttgttaaacactgaataaagtggaatcctagaaagaacttggaaaagatggctctgctagtgagatagtcatatatgcattatgtttatactcaaaatccaggctgacatctaatcaaacccttgcaaattcaggcagaaattacttacgcaattataggatagtgataggagggttaattggataacagataattggcttttgagttgaaccaaattgcaagactgaaaaacgagatgcctcaaaatatattttaaaatcctcagagaatgttttaagtttgaacgttaaaagaaaataactgaagtggaaagagtgcatggattgattacctaacctatttctgtaccttaggcatcttggatacatgaatatttgctgagtaaaggacacagccaagttgagaagtggaacaagcagagcaatcaccattgtgatttatgtattgattctatgctatgaaatttgaaagaggaaagaatatacaattcaataatttttaatattttgctttaggactaaaaactacttttcctataagatcggtacttatagtttaacttattggtgtttccaaagtagagaaaatataagtgaggaaaaatcaactacagtccctatgccgaacagcaaataaaacagacttatttagttaccattgtctgagggatttggggatccttatttctgacctcatataatttgtggttaacattttaaaaatacgtgaacctaggccaggcacagtggatcatgcctgtaatcccagtactttgggaggctgaggccggtaaatcacttgaggtcaggagttcaagaccagcctgggcaacatggtgaaaccccatttctactaaaaatgcaaaaattggcagggtgcggtagcaggcgcctctagttccagctactcgggagggtgaggcaggagaatctcttgaacccaggaagtggagttgtaccttgcagtgagccgagttgtaccttgcagtgagccgagatcatgccaccgcactccagcctgggcaacagagcgagactccatttcaaaaacaaaacaaaacaacacaacaacaacaaaaatacatgaaccttgaatttttacccatacaaacattttaatgttcatgttcaaatgcacacaaatgctgagggaaaaggttttttgttttttctttttttttttttttgaaatggaatctcgctctgttgttcaggctggagtgcagtggcatgatctcggctcactgcaacctccgcctcctgggttcaagtgattctcctgccttagcctcccaagtagctgggattacaggcacacaccaccaagcccggctaatttttttgtattttagtagagacagggtttcactgtgttgcccaggctggtcttgaactcctgagctcagccaatccacccgcctcggcctcccaaaatgctaggattacaggcgtgagccaccacgcccagtcctgaggaaaaggtttttgacactatgtgtatttaatgtatgttaggagatagtttcattttagaaagttagatgcattttcctttaatagtgtactgctcaatgtgtagctgccacaggatgtaaaatataggcctggagtgtggagtataggaacagcgtggaacttagctacagaatttatgcaaactcactggaatacattaaaaggctgctataatatatccacaaagacccagatgcacctctggtactctgagaaaagtgttgccaaggctgcgggagatggccatgacagaaaaggaccttgacatcttccatcaggcagatcctggtgtattgctaatattaattgtattgcaggcatcgaattaacaagtgttaccaataactattaaaagtaatacaacaggggccgggcacggtggttcttgcctgtaatcccaacgttttgggaaggcaacgtgggaggatcatttgaagccaagagtttgagaccagccagggcaacaaagtgagactctgtccctacaaaaaataaaaatacaaaaattagctgggcatagtggcatgcacctgtagtcctagctactcagggggctgaggcagggggatcacttgagcccaggagttcaaggctgcagtgagctatgatggtgccactgcattctagcctgggcaacagagtgaaacactgtctctaaaaaaaaaaaaaaaagtaaataaacagacaaatcagtaaataaataaaaatcataaaatatacaatatgtatgttggttatttcaaccacaaacctcatgtttattgattaaaagtaagactactagtacactgttacatcaaaagtcaagtgacagaagacaaagtagctatttttgtaaaaaagctaggttgggcgtggtggctcacacctgtaatcccagcactttgggaggccgaggcagacagatcatttgtggtcagcagttcaagaccagcctggccaacatggcgaaacctcgtctctactaaaaatacaaaaattagctgggcgtgctagtgggcacctgttatcacagctactcaggaggctgaggcaggagaattgcttgaacccaggaggcagaggttgcgttgagtggagatggcgccactgtactccagcctgggcgacagagtgaaactccatctcaaaaagaaaaaaaaaaaaactcatgtgtgcacaatgtaatcctgctttatggcagatggaaaaagaagcaattatgataggtttggtaggctctcacagtgctggtctatttttaaaaattgaattagttgccaacatttaatacagctaaaatgattttttttttttaagacagggtctcattcattcacctaggctggagtgcagtagcgccatcttagctcactgcagcctcgaactcctgggctcaagtgatcctcctgcctcagcctcccgagtagctgggtagctgggactaaagatgtatgccaccacacccagctaatttttgcatattttttgcagagacagggcttcaccatgttgcccaggctggtctcaaacttgtgagctcaagtcatcctcccgccttggcctcctaaagtgctgggattacaggcaccagcccacatgcccagctgtaaattattttattaaaacatgggagtctcatccatttaaggttacctacctgggctcctgtagtatttgagctgatgatccctacttgatgggaagaaaaatcatgcataatcccttccagaagaaactggaaggttttggaagaatatgttggccttgatatcccttagattgttttcattgacatcagtactcttatcggataaagaaaccattattaaccaatggtaaactaagggatttaatttcaggaataattttagaagacacaggcttactggcgtaaatatatctggtcaggtgtgtgtgaccattgactctgacagtttatagaatgtttgaggtcacagatataagacttaaatgggacacgctgttccacgttgttgccaaatgttacattttaaaagcaaaatccaataccattttaaaaagttgattttttttttttttttttttgagacagagtctcactctgtcacccaggctggagtgcagtggtgcgatcttggctcactgcaagctccgcctgctgggttcacgccgttctcccgtctcagcctcctgagtagatgggactacatgcgcccgccaccacacctggctaattattgtatttttagtagagatggggtttcaccgtgttaaccaagatggtcttgatctcctgacctcgtgatccgcccgcctcggcctcccaaagtgctgggattacaggcgtgagccactgctcccagccaaaaagttgactttctaaagcattaggttgtgttaaaattcagcagagggttgaactcactttagaagagatatatgatagcactgaagaaaatacattttgattagtaatgattatctaacacagatctgttagtattaaaatacttataaattgtaaaggcccaactgttctgcaagactggatacataggccttttctctcctgaatatatagtagggagcagggaggaattgagagatctggtcatccaaacctgcaagaaggattattcatggatgcatttggagtgtatgcttcttgagagccaccacttgtccagaaatatctgtgtaacacaactgctaaattatgagttctgctgccaggcaatactctttttcagctagatttgcttttcctgctcttttaaacaggtgtataggtggaaatgccatatgtacagaattttttaatgatgtgacacctgcaaagtttatacaaaaatgtggaaagaaaattctacaactcaagctgatgtcattgcttagagcccagaccaccagaacacatcaaccaggccaagcaaaagcactatcagcatggaggccccctttgtgcggctgcccaaacactgacaagatgtagtggactccatacagcaggagtgccctagcattgtggacttagttcctgagcaagactccaaattgcaccacgttcttctgagctctggggcctgcggacatgctcttcctctgcccaacatgcttgctccctctctcctcttttctctgactacttcctattcatccttgaggtctcagcttaaatattactcctctgggaacccactttgatcttccagactgggttaggtgccccttgtttgtgtccccacaattcccctggacttccccttgaaagcagtgatcacactgaattgtgttcccttgtttacttgtccatatcctctcatagcatccgtgcttcatgaggccaggtaccaggtctgctttgctcacatctgtattcctgctgtggagtaagttgctcagaagatgttggttgtgtggttgaacctgtctgcttcacagctcactcacatactcttagttggcttctcagctgtgggactggctcatggttgtgggcagggcttagtagttggccaacaatggccttgatgcataaaagagtttcccaagaggcagaaattcttgggttacatgaacatgaagttttgcatgcagcctggaacatctcaaaaacctgactggaaagaataaaaagggaaaggagaatgtgtgtgtggatggaggaggaaacttggaaatatctctccaagacaaggtgaaggtgataacattttgaccagaaatcaagaatcagagaccagaggtcagagaatctaaaaggataatggaagtatttcttggaggaacgaacttcacagtggaaccacaaagtcaccagaactctgtgtgtgggttctcagactgagcatgaagtctgagaggggtacagaattagtaggactcaatacatgtttatatcaattgggttccattctgttcctgaactcgggcagcttctttcagctagcaaagccatggctgatcttgggttagacaggaagagagtcttacccaagataaagagtcagcagacatcagggagggctataggctgatacactggaaggatctaagatgcaagggtgagaaaaacaccaagaactgacaccagaatccagccttgcctttacagcttggaagctggccagaacccagctggttagaagaaagcacaggctctctaaccgtcctatgtggttttgtttttgtttttgtttttgttttgatacagagtcatgctctgttgcccaggctggagtgcaatggcgtgatctcggctcactacaacctccgcctcccaggtttaagcgattctcctgcctcagcctccctgcctcagcctccgagtagctgggattacaggcatccactaccacacccggctaatttatctatttgtagtagagacgaggtttcaccatgttgcccaggctggtctcgaactcttggcctcaaatgatccacccacctcagcctcccaaagtgctgggattataggtatgagccaccgtgctcagcccacctcctgttcttaaggagctctgttttttctctaccaggaaacagtgtagctatcagagctttccatggtcctcagcatagaggacttactatggcccataaagtctgtcgtaccagccttatcttttaccatgagcagctaggcaattacaatgaaggaatggcctcaatccgaaacggactgtgttttctgatatcagaaggatatggagaaggagaataacccccacctgattcttaaaaacaacaacaacaacgaaaccctgaaagttccatgtggcaaaacaggaatgatctctctccaagggtaagtggcaagaaccccctttctctatcactggcatctgtttaggcccttcttgcctcttctgggcctgggctccccagaaccccagccctgctcagtctgagcagggaaggctgagctatttctggggctcagcaactctgagccccacctgtccccttgacccagggaggctctcatactaaatgggtaggacagactccaggtgtgggcccaccctcccttacacgggttgcagcctgaggttggtcagacagggaagttacctcctcggccctcactggcagctggcttcacttggatcggacgattcatctgaaagacatcggaccaacacacccattcagcgtgactgcctggtcctggagcccccagcttctcgaaccctggactcctcaggatctgagccctagcccctttgaactctgcactctaccacttccaaactgggattacagattttctccaagattccttccttaaacccaggaatttagaaggtgctgaaactggcagggatgggtgacaggaacttagtggcaagcacaaggtggaatgaagcggctaaagagacttttctgcctggggctctgggcaggggctatgtgaggcctgtccctttggcttctggacttacttaaaggctttgcatgagaggattgggaaggagggtagaattgatactgcagatttgtgttttatgtctaaaatggagaatatcacgctatgtgtcatttagatgagagtctgggaatcagactcagtgctatctgccctcaactctagtcatttaatggttgtatgactttaagtaagccaccttttctcagattcaatttttctttttctcctgtgtagctgaaattacaggcacgtgccaccaggcccggctgatttttgtatttttagtagagacagggtttctccatgttggctaagttattcttgaactcctgacctcaaatgattcacccgcctcagcctcccaaagtgctgggattacaggcgtgagccactgcgcccggccagattcaatttttcaaatgaggaaaacatttcccaagctgctgtatcactagagtctccacgctcacctgctccatcccctccctagggtccccttccctgaggatgctggagttttccaaggtgccgttctcagccctttttgtctggctcttcctacttttcttggatagtctcatccacactcagcctcagctcctctccacacagggatgacttagagctctgtgtctccagcctgcattctcctctgagcttcagagccatgttaccagctgcctgctggacatccccactagaaagtcccacgggcgccttcactcaacacacccaaacgagagctcatttgtttttttttttttttgccccaacctgatcctcccagtcacccaagctataagcctggaaagcagcttgacttctccttccatcccttccccgctcccaccaacttcatcttttaattcaggggttcctgaggaagtgtagataaaaatcacccaggaaccagatgaggctcttaagttggggtattgcataatttgaaaacgctcctaggtgatttcaatatatcgcccccacatccccatcccccaaccaccctgagtgaattcatgattgaatccccatctcaccttcctctcatgggtgttgtggggatcacatgaggtaatggggacgcaaaaggtctttgtaaactgccaagagctgggtgcgtgggaggtgaggaattattgttggggggcaggcagctgagtgccaggagggaaaaacagcggccttcccgttcatggaggaaggggtactgat

SEQ ID NO: 950 - DNA, 52299 bp, Homo sapiens; identical to SEQ ID NO: 946
